United States Patent 11,001,841 (CCCTC-BINDING FACTOR (CTCF) RNA INTERACTOME) - sequence listing, part 2

SEQ ID NO: 2435 - DNA, 1834 bp, Homo sapiens
gctttttgtaacattgtgtccacattttgggtcatgggcaccaaagcgagaaggatgggaatggaagtggagatgtgtgcgtgtttgtgtatgagtttatactgctgtgacactcttagtagggatgagtagaagaatttcacgaacagcatctatggccctggggttacagcaaaatgttgaaaagccacatgaagccaagggctttttaatctcttccttaagtcagtgataatgatgcagggcaggttttactttaaatatctctcctccttggagtgtcacaaggtgcacatctttaaaggagggattttctgtgtctttgatcagattgccctctggagctgttatcaagatgcagatgtgccgggcttttaaactcttgaaaaacgaaaagaacaagatcccttgtatttccaccttctgaaaagtacagttgtgtgtgtgtgtgcaagttcctttgtgggaaggttttcttgtttttgtttttgtttaaaacactcaagacctgtaaatagggcttggctgattttccgactgattttaaggacctagaggggtactaagttttggtcagctgtccagagctctctgtctagttatctcatcagccgtccagcttttgatataccactgacttcatggggttggtaaaataaaataacgaagcgctttggtgttcttagacaaaaggcatgagagaaaggatacaagctcacttctgagttgttggaggggtataaacagatgatttcatcttaggagggaagcacagaaatttaatataactatacaaagagagaagaaattctactaagagaccattgttagaggacctgtgaagatgtttcagagtatgcttttgtcttccctagcgccgtgcatttaaatgggaaagatagtgtaaggctgctgctatcataaattagaacttcatttgcatcataactattttagaaaatataattgatacataattttgattgagagattgaacaagttcagagaaaaagatggatattttggtttgagttggttttaaagccgagttggcacagaatttttctaacaggaacattaaaaaaatgcctgtcattcaagagtgtgaatgaaaagtatgacagatgataacctttgtttttattagcaaattactgtatgtgttaacccaggaggagtggaaaaatacattgtttttattttcttttagattttgaatagtatagcttttctcatacttgtatgaataaggtacttcataaagacatgagatataattatagaaatatgcattaaggaatagcacaaaatgcagcttctcatgtaagaacacacaaaaaaggattttaaagctaagcaataatagtatgataaattttgttgtgagtaccttctgaaaatgattatgctgtataaactgatttgctgtttctgaacatgttatttcaaagtcacttttatggtcttgtgccttattgtgttgtacataatgatatctccatttagcttactttacccacaccttattttctcctaattgctgtggaaaatatctattatatgacacctgtcaattaataagtatgcactcagcatgttcattttttaggtaaagggttgggaaggggatatagaagtagtgtttaagataaagtctctccctgcaaggagcttacagaagagataataatcccaaacaagtaatgtatggtagaagacattgtgtaaatagggctaaattggtttataggtgttataggtgtttatcaaagaggccaccactgatggctacgaaatcaccattggtgactctctttattctctagttggtagt

SEQ ID NO: 2436 - DNA, 1051 bp, Homo sapiens
tttcatttgaaaatttactagatttttgaaatcatttgttacaattgttagaatgattaattttcaagaatggctcaggcaaagtggaaatctaacagaacttttgcataattgatgaatagatcgaactatgagcatcataattaaataaatgcaagcagttgtccactgcttccatttatgtgagatgctctcattagccatgacagtcattgaaattaagtagcaacataaactggacttataatcagtctttcagttctttatcacaaattgttaagccaacatttacaaaactcaagaaacattcatttgtattgtataacattaataatattttgctaatcactgaaaagtttgtaccattagaattcaatatatttccaaaaatttttatactatactttttaatatgcataatctatttataaagtaattcatatgtaatttattagcatttctatgggaatgcatacttacacattttgaagctaaaaataccttggactgtagtttagaggccattctatgccacagagtttagcgttgttctctaattcttctgcgtataaacttctgctttctagctaaattgaaaatattttgaggccatggaccactttcaacattatttctgtatatcctttattacctagcatagtgtttggcatattttttggtactcaacaatttaataaaccaaggtctattttatttatttattctcaaatacagtgagtttatgaactacctgaggagattgtttcaaatttgcatttcttaactcctgctccctcccaatctttgttcttgctcagtttttctagggtggggtctaggaatttctccaaacccttagggaattcttacacagataggttttggaaaacactgatttatgtgatgatgatgattacattgtaattaacctcatattatgatgaaaatgaaaagacaattatagttgatggctatattttagaaagtaggatggaaaaaatgataagtcaatccttttgtaggtgatgacaacagtagaaaatatcaggga

SEQ ID NO: 2437 - DNA, 1065 bp, Homo sapiens
cctggaaatagtggagtactttaagaatatgaggtgatgctatgtagatacagtatttgctggttaaattctggtcattttttggtgaacatctgaagtatatcggagagaggttcctctatgttcatgatcaaaagttaaagttatcataaaatttcaatgtacttcaaaaaattaatttaagttgatatgattattagcttatattaggaaataattactggattttgttagatttactaaatataactgaaatgaaggttgtagaataagctctgactactatagtattaaattaaatcaaatgtaatgatttagagaacaaacatcgggttgggcacggtggctcacacctgtaatcccagcacttcgggaggctgagactggcggatcacatgaggtcaggggtttgagaccaatccggccaacatggcgaaactccatctctactgaaaatacaaaaattagcaggcgtggtggtgggcacctgtagtcccagctacttgggaggctgaggcaggagaattgcttgaacctgggaggcagagactgtggtgagccggaggctgcggtgagccgagattgtgccactgcactccagcctgggtggacagtaagactcccatctcagaaaaaaaatataataataataattaataaataaagaacaaacacctattgtaatttctggcatgagtttgctgtaacgtttttgttcttgtgagagtgaaagaactaggaagtttggaaaagaatttaacacggtatttttagataatttaggtaagtgttttcttttattaccagcttgtaataaatcctggcaagtggtagtgaaagccctcccaaagtagcttcttggggtgtaggggagtatcttagggagaagtgcctctaaaaatacaggctcagccactccctgttcgcctcctctgtctcagccctcaggctgtgcttgtgtggggaataggggtaattgccctttgtataccacaattcagatgtagaggcagtgtaatttcttggttaagagcacaagctttgaagctcaagtccttgggttca

SEQ ID NO: 2438 - DNA, 1063 bp, Homo sapiens
cagtgtgatttcctatagaaggaaaggtgattaaggtccctgtgcactagatcagcgcttctagctgggggcagttttacctcccagggcacatgtgccaatgtttggagacatttttggttatcacaagtagaggttggagtactactggcatctgctgagtagaggctagggatgctgttacacttcttataatgtgtaggatagtcttctataacaaagaattatgtggccccaaatgtctgtagtactgagtttgagagaccctgaactaaattatgacataagggtagaggtttgaaatagcccccaggtaggatagtaaatgaagcagcaagctggttcagatgtttctttactaacagttataaataaaaaagcatttgcagttcatcagtcacacaccaggtactggagtgtgttgatttgattcagcaaggaaaccacatctagaatagtgctgtaattggcataaccaacttataaaactttgataacttaactgtcattttacaagattcatctgtcttctgcataggccaaataggtgagctgagtggagatgtagtgggaattgccatccctgaaaattttaaactttttatggtggcactaaacctacagttcccccaggaagcaatattgcttttggtttactattttggtaagcccaagcagttctaatggcttccacttgtcctttcccagtgtaatagtccttaattcgcaggccaagggatgaatgtgtaggctgtagcagatgctgagtacatgtcttccaactgtattccagaactggggaagtaaccacagaatgggtttggggacccactgattccattgtgaactggacccagtccaaaacgtcattgatcatctgatttccataaactcctgctttgattggtggatcacagtggaatttggggtctctaggaattactactttggagatagtttggagatgtggcagggggttgagggcatggaaatctattacataatcatcctatctgtattagatatatttaattgtaatgaaaataatcacatatgacttaat

SEQ ID NO: 2439 - DNA, 1004 bp, Homo sapiens
aggtgagtgagaaggggcatagtagtaaatgagggcagaaaggtaatagggggtccgactttgttagtcttaccttattggtcatataagggctttgattttactgtgaataaaatggggatctgttgcaggatatttaacaaagagtgtgatgatatgatatgaaaaagaaaatgttccctatactcccgtttcccagtcccctagctcccttttctagaggtaactactttctcttctgtgtcttgtgtaaccttctggagatagtctgtgcttattgaagcatgtgcatggaggcacatgtacacatatacacatttacaaagaacataccatacatacataaccagctctgcctattgatggactttgtgcttgcttctgttttttgctgttacaaacagtgctacaataaatattgtatgtgttcatctttacactcatttgtgactatgtctgtaaaactaattactagaagtaaaatttctagcccaaggattgtgggaatttacttgatagttgtctcccaactcctcctatacatagaatttgtgtcaattttcactgtgaccaatgatatataagtatgcctagttctataccatcaccatcaaatgctatcaaactctaatcgttgtaatctgatagatgaaaaatagattttattgtagctttaatttatatttcacttatgatttacttcatatgtttaaaagtcacatatatgtccttttctgtgaaatatctgtatacatcctgtgcacattcatatttgcccattttaaaaattgacttgtggaagtttagtattttaaaattaaccattttcctgccatatgttacaaatattttttctcaatttattttctgcctctttactttgatataaggagagttttttaaaaaatcaactactgtcttttaaatttgcgatgtcacatttattaaacttttttttagtgacttctattttatgttatacctagagagccatttcccatgct

SEQ ID NO: 2440 - DNA, 1064 bp, Homo sapiens
gacaaccagtataacttttcataacactgatatttctgcccagtaagaacatgaaaactttgctgggttcttctttttctgtgaatgtgagataatgtattatgggtctcttcttggagaaagtctcttcttttagcaccagtctttttgctaaccatgatgcctttgtgtaagtgagaaaaagacatcctacctggaccaattaactatgcaaagatgctgttttttactgggctggaaccacagtaggacatatctttgcctacccctgtgctgggaacccacttaaaatgcacaaactgggtaattgtacacagtgtccctgtccatggcccacatagcttttctacttttcctggatttagttgtgggttactctggcaaattgagtgatttttaagtggcatctagaactactcaggcctgttgtgctagctggaatacacagcaatgcgactcctactctgtctttcccaaggttgtataaacaaagttgtacttattgaaacatgtgaacatgaaactgaatgttgctttctttatctgaataactaaaacgtgtacttgatgatgataagtaatttctgtcataaaatctactaatcttgttgataaagtattgcttttccaaataggcatataaaaatgatacaattttgttttctttaacccgtgaaaataaagatgaagactcactaaatgtagccagtacactgtgtgtgtgattgttttttgagtgatttacatgtatgttgatagatttgctttcttttagaagttctgaaggaaaagcagatcaagtcttcattaattctcatgtgtttagaacattcagcatttgacctttcccatttaggcagtagcatctcccagtcagtcatacttaaaaagtaatggaatgtgaaacaatccatttttccctagcattgaaaaagacagtaaaatttgcttccatgtcttaggtatactcataaaaggcaggtaattatcgcacatttatatgaaataaggattcattgtaatctcacttctagaagtgtttgggtaaatttgttctggtttga

SEQ ID NO: 2441 - DNA, 1885 bp, Homo sapiens
tggttttggacaaagtactgaaaacagagtataacataaaatcataggaagaattggtgggaagtatacttttcacactgaaatatgaggattttgagggaaaggtgtttaaacaagtgttttaaaggtgataccaataatattaatatctggctaaaatatcaacagtttaaatgttgaggatgtgatcatcagatttgctgagaaaaacaaactgtgcagtttagtgaccaaaaatctgacttttctaaaccttgttagccctctttaattactggggaaagggctcaatgacatataattgggcatttttaacatacagatgtgcatccaaatatgaaaaatatcttccagagcaagcatatccaaagagtatgtcaaaaatctatttgctaatatccctcaaattaaaacttccagtctttcacgttttgagtttagtaagctcaacaacctagaatttcacagccatacataatcttcggggagaaatatctctttaaggttagattcagtaatcactctgaatgtcttgagaattacctgaaacattacctaatgcttattcattttcccagtcaatctatgattgtgacttgggaattttcttgctgattttatttcttgtatctcttttgaaaatgtctgcttttatctttctctatcatgaccagtttagacaaagtcactgttatcttcttgtagccttccaactgcatccactttacatacgtatacacacacacacacacacacacacacacgcgcgcgtgcgcagagagagagagtttaaaatgtaatacatagagtttaaaagttgtcaaggatgcaaaatacgtctgtgaatatgctatccctttgtttaagctttcagatggcgttttattgtttgtagtccaaaaatcaaattcattaacatggtataaaggtcctcacttccttttccacctcatggaccatgaactcgccgtagcttctcttcactctcctcttccccgactcctacagctttagtgattttcatctgctcctattcatactctattccagttaccaggcctttgcaactttctcccaccttctgggtaaggcttatctcccctcttcccttaattagtccttactcattcctcccatttcagcctagagtcacttcttcagggaaacctttcctattcccctaacagtgttaaatccacttaccctccataaaatcaagcactcataaccaaggattatttataaataaccactttatttttatttgttttggttttggtagtcgtttgttgatttgtttgttgacactttttgtttctgatgtttttgttttaatgcctgtattctacctctaactccaaaaacctctgtcctaattgcttggtttttaatagctgcaaagcatccatttctatgttctcaagaagctacttaagatatactgaaatcaatgtggaagaattttctcttgagggaaatgaaggaggcttagagtctttaagtcacctatgaagtttagactaactatctggctgttttaaaagtcacagtcttattttcttatttagttattttaagcatcgtattttcatgtttttctaagcttggcagtttgttgatataataaactagtctatttttaatttttggatggggacttcaaaatgtctttcccattttaaaaaagttgctttctcatgatatttatttattgcactaaaatgttttgttctaatcttgtttttaaagaaataaaacatcacagctataattgaagacccatgtgtcatttcttggttccagtcttgtctttcctacctagaaataaccactattctgaatttgatctttcttattcccacttaaatttttaaaaacttttttt

SEQ ID NO: 2442 - DNA, 1073 bp, Homo sapiens
cacttcatattaataggccagtaaactgtcaaatatacagacagaagttttataaagattgcagtgaagacaaagaagggttcctatccctcctgaaacccaaatcagagcaaaatccttgaaaggtgaagaaggctatgttgtaaggcacaagaactgtatgccagccttctactagcccagtttactgtgactctgaagacagcctgaaagaactctctcaggaggaacaagctgaaccactgcctttgtcaagctcccaatgaccacaatgtgctccttctgcctcaagatcaagcaagcgatggcgaagtcctgtgacattgatgagaccaagggcaacttcgtcagactggtgagcaggtctgatggagagaaaaccatgtgcatttggcccctgactatgacactttgggtgtaactagaatgacgattgtctaagccatgtccagttggctagttctaaaaatgacagactttttcatcatcacaaaaagagtgctagcagaggaatggaagagataggaaggaacaaagagcagttgagaagagaaaaggaaaatgcacataattgagggaaatattgattgacactaatggagtttggctaaccctgacctaagctctagccaggaaagacccaattgaaaagtaaatatctccaaagaattgaagattgtttactactttagttatctggaacaaagccaagaaccaagaaggaaacaaagacctctgaacaactagaatagctgtgatatagaagacatatctcaggccttcactcctggcttattttcctaatttaacacacaagtctagcaaactctggccttaatttccagcctacagcaaacctgaaacagtaaatttgaaggggaatagtaaattcagagctcttttactaaatttacatttgctagcaacattgtgtgacatcacagtttgaaaatgagaaagaaaaagaactgaaaattaacatcagaaactcaaatagtagcatggcactgctgttcttaaaattacctctattttttatacttgtacctggagtgtatgacacatgcaataat

SEQ ID NO: 2443 - DNA, 1025 bp, Homo sapiens
gaataggaatctggtattccattatccttactcaatataccatgtaaaacatcctaatgttccttcttacagcaaccattcttcgacaactgcctatcatttttagtcaacacacacccaaacccacgcacatcttcttgttatcgcttatgtttttttctctctccttgtccaaagctgctgaaggagaggaaactaaggattaaacaatatactcaagacatctttgagatataggaacccaatggctgtgtattgttgttttattggaattaaaaattccagttaaagttctgattagaactttggccctgcctacacgtctttttcttgcttcttcagatggaagtggagtgaccttctgtttaggtgttgtttttgttatggatgccccagttttcacaaaatgattttaatcctgtccctcagctcatgtctgttctttgtagaacggaataactgcattccaggtaccagtcagggattgaatttatgaactaattgcagtcaaaaacccaacttaagaaataattaaataaaaaaacaccccaatacttttggaggaattcctgaagaatttgctgccagtctatttctttagattagttgttctgaaacatggagctgccaggaaacatcagtatgtttctgttagttttgagatatgtcccagccgattctaagagaaaactaccaaatttgccagtaatttcataaaaagtaactggagtaaattcaagattattcatatgacagtgttgtcttcagtatactgtaatttgatgtactttgtcaagacaagagaaagaagaggagttagaacccagaaaccagcatggcttattcatgttgtagcttaatgggccacacttcctagtacacaggaaatgcctgtgccaattagagagtacaagtaaaagccctctttcatagtgcagtaaggagctgttaattgaaaaaagcaggttaaagtgaggaattattaaaagttatataaacatttaacacttctattgtacacacaa

SEQ ID NO: 2444 - DNA, 1028 bp, Homo sapiens
tcagtagcacgctaatagctaatagctttttaaaacctgttagccctgtttgggaggtgaagagttcaaaactctgaggaacgcttctgagtgaaggctgactcccattgtccaaggctgcaatagcaaaatcatcagttacagtgacttggagctcaaaggggccattaggactgtggagcacaaaggtagagcagacgaggctcagagtaggcacttgagagtcatgagataaggctagagaggtaaataggatcttgatttttttctagagtctggtagccagtgttcaagattaggggtttagttctaatagcattgagaaaccaccagtggatgttaagtagtagataacggattggaggatgggaggatagaaaagatgtgtggataacaggttggaggatgggaaggtagaaaagagagtcagaatggttgtaccaagaccagtgagattcagtgtgacagtagtgtcaatatggatgggtagacgttgatggatttgagataaactgtggaggtgagtaaaaatgtcttaatgatgcatcgatgtagaaatttcaagagatggtgttgttaaggatgatcctaaagtttcagttattagggtgcttgacagacatatggagctggggaaaaccagtatcaaatttgatgtgagaaatcaagtattgggtttgaatttctgtgagacagccaagtgaaaatattgagtaggtatatatggattggatataaatgttgggatgataaagttaaatttagtagtcagcaacaaatcgatgatatttgaagccatgataaatcattaggagaaacatgtagagtgagaagataaagggggctaagggctgaaccctgaggacctccatgtttaaaggttgagtagaaggggagaggtttagtggaagactgagaggggtcatttaggcaggaggatggtcaggaagatgtactgtcagagccagagcaagagatgatctcaagtgtactgaagaccctgtgtactgagaggttaacccgtatgc

SEQ ID NO: 2445 - DNA, 1118 bp, Homo sapiens
ttttggttctcctattttcttgaacaaattgctttatttggaagctaacatatactcaaagacatagagaaaataataccaaattatgcttttgaaaaatgtgccctgtattgtttaaaaagtaaaatgaaaaggaggaaaattttaacatttgtgtttcaagtcgcttcttgtcattttgtttttatataaattagtaaatgtgtttttattgttctttaatgttattctacaaatctacctaaaaaccttactgaatctttcattaaaatgtctgatcagtcagaagagatgactttaaagagtcaaacccctaaggaaggtggtttctgggtaaaaatcatatgaaggagcatttagtttcattttcagtgtttttcttctgtagcttttcataaggaatggttaaataattgtaagttttactgtgtatagtgtattcacaccacagacacacacagatcatttgagttcatctacttaaaattcttttagaaaccaagtcacagcgaagttaatgtcacagtctaagttaacatagcttgtttgtacagagttgggactgagaaaatatcttgtttcaatgcattgccagaatcctgtagcattttgtaagcagattaatttcttcaaataaatattttaattggctctctgcttgcttgtttttttttaacagaaatatatctacctgttttctttaacagttatttcgagaagtacgaataatgaagatactgaatcatcctaatataggtatgaaatatatatatattatatatatatatatatataattagcgatgaagtgttttccttaatttgagggtatttgaaaagacacaatgtttaaggatagtttatttaagcagaagaaaagtgataacctgagtgataaccccaggaagtgatactttgggtaaaaatagattacaaagaagctaactggaggctacagattgctgttttctgctaccttgctatcttctgctctccactaaaataattgatatcattcagaattaatgcatacaattttttttaatttcctaattaaatgtttctaaatttaaaaaaaaatgtctttctggccgggcgtggtggcttatgcctgtaatc

SEQ ID NO: 2446 - DNA, 1026 bp, Homo sapiens
atttttcagtaagttctgatttctccccctttgcaaataaacgtattgattagatatattattatatgaaatcatttgattgtgacaagtaaaattctttttaaaatctgttttttaaaacacttttttttgcacatttaaaaatcttatctgtatatagttgttaaagtatttatttgtggtgaatatttgaactacataaatttgataatttggtaatttttctaaccagaaactttcataatatcacagaaatacagaaattcttttgtttctgtaccaaagattatttagcattttttgatgtctcactgtaatgtaacatagtctctttttaaacttcagtttaaattctgtttttctgattttaagagttccttttattaccttattctaatttgaaaaagtaatgaccttttaatcctagaaacttaactttttcaactcaagaagttggttctaaatcactttgtggtaagtagttttctgtcataggagtaataatctttgagagactttttgaacttaaaattgtgattaataatgtttagcaagtagtcaaattttctactagtttagtgttaccttagattttcttaaagcatattcaatctgtgctaacagttatagagttatatctctaattttttttcagtaaaattgtttgaagttattgaaacagagaagactctctatttagtcatggaatacgcgagtgggggtaagaatgagggtgattgaaaagttctctttgctgagacatacagaaatgttaacacctaagagttcattatgacatttatgtcttcagtgttaatgaatctattgttttatctaaatgcctttaaattacatcttaaggaaaattcagtgtttacttttaagacctttcgatcttacattataaatggaatttttggcttatttacattttacttagggacattttttgaaacgttaaatttgtattttcatcttataaatgtattgattctcttatctaaattttactatatcatatcatga

SEQ ID NO: 2447 - DNA, 1035 bp, Homo sapiens
tgatttttaatattttatttatatcctaggattgatattgcatatatatgtaatatatctgtatacctaggtacaaaaatgcaatttattgagtgcttactatatgccagtcgctgtgctaagcacatgcattatttcatttaatccttacaacaaccatgtgagtagacagtaggtagaaactgagtcttaatgaagttaagaaatcttcctaataatgtctttcagtagtacttagggctaaaacaaaattcataccaaaattggtctgattctaaagtctgagtttttttgtttttaccactttgctatactttacaagaacactttaagccattttgtgagtttttaatatacatgtatatctatctggtacaaattataaggacacaaaaataaatttaatccttatactaagataatattttatttttaaaattgtaactcaagtttaatttagttttaagctattactaactagagaaaaaggagaaaaacttacagacatgtaaagtaatggatccagtagaaaatttatacagcttctagttctttttaaattatttcaccaaacatttatctatccacttcgtgttctgccatgaagatgaagatgcaaattaagtacagatattatgatgattttcaagtaatttacagttcagctggggtattagagatacacacacaaatgatttaattctgtataatttgtggctgactactagaatgtatgaaatgagtagagtgagaataaacacagagtataggaaaggaaagaaataaatcaatgtggatggaagtagtgagatggaattttatccagactacatgacagggagaatttaaaagagcaatccaacaaaacacacttcatcattttgtttgaaacgtaggccccaaatacaaagccaaatgtaatttttgattgaccaggctgtggcttccctttactagaatgtataataaagagttgactgtatttttacataatacttgaaagcagaaagcaagttttcttggttgtgtttttat

SEQ ID NO: 2448 - DNA, 1031 bp, Homo sapiens
tatcaattttgttgatcttttcaaaaaaccagctcctggattcattgatttttttgaagggtttttttatgtctcaatctccttcaatcctgctctgatcttagttatttcttgccttctgctagcttttgaaagtgtttcctcttgcttctctagttcttttaattgtgaggttagggtgtcgattttagatctttcatgctttctcttgtgggcatttagtgctacacattccctctacacactgctttaaatgtgtcccagagattctggtatgttgtgtctttgttctcattggtttcaaagaacatctttatttctgccttcattttgttattcacccaatagtcattcaggagcaggttgttcagttcccatgtagttgtgcggttttgagtgagtttcttaatcctgagttctaatttgattgcactgtggtctgagagacagtttgttgtgatttctgttcttttacatttgctgaggagtgctttacttccaagtatgtggacggttttggaataagtgcaaagtgatgctgagaagaatgtatattctgttgatttggggtggagagttctgtagatgtctgttaggtctgcttgatgcagagctgagttcaagtcctggatatccttgttaacctgtctcattgatctgtctaatattgacagtggggtgttaaagtctcccattattattgtgtgggagtcttaagtctctttgtaggtctgtaaggacttgctttatgaatctgggtgctcctgtattggatgaatatatatttaggatagttagctcttcttgttgaattgatccctttaccattatgtaatggccttctttgtctcttttgatctttgtcagtttaaagtttgttttatcagagactaggattgcaacccctgcttttttttgttttccatttgcttggtagatcttcctccatccctttattttgagcctatgtgtgtctctgcacatgagatgggtctcctgaatacagcacactgatgggtcttgactcttta

SEQ ID NO: 2449 - DNA, 1099 bp, Homo sapiens
aaatgaatgagtacttataaactcggaacagcttctagtgaattattatgtgcttaaaaacttgaaacagtttctagtggattattatgtgctctgcattagctgtttattatcatcggtattgctctgtgatttatcattagtattatctatatatgaatttagatttcctattgggatgccagtgattccaacaaaagtttgctggcagcaaacaacttgtatgttacagagagagggatagtgtgtcaacctgcagtttaccatgctgagttctaaataaatataatttcctgatcagaaacagtaaaccagattttttttttgcaaatgtggagaaaaccaaacaaatctatatgtatgtttatatgcatacatatgtgtatatacatgtgtgtatatttaaaattttagattttattgtaagtttgaatctcagtgatgccccttaacttttttaacctcagtttttccatctataaagtgtaggttaatacatcataggtttgttgtgatgattaaataaagtgacatatagaaagagcttatttagcacagtgcctagtctataataacccattcagtaattggtagctgttatttcgtattttgactaaactaaggatttgtacaagataatacaagattatgagtagtcactaaagcgtattctatccagttcaccccttttcctgcttgccaacttaaagttctaggcccaatactacactgttttttcagtttggattacttcttgtatagctttaagtcatttagaaaatcaagagtgcagtgtttgtgcaaacttttttttttttttttttgctttaaaatccctgtggtttttcttcttatagtttgaaggtggtgaatcgttatccagtggaaacttgtgtcagaggtcccggcccagtagtgacttaaacaacagcactcttcagtcccctgctcacctgaaggtccagagaagtatctcagcaaatcagaagcagcggcgtttcagtgatcatggtaggggaaaaagtcacataagtgaagcaacacacgggttcttcccaaatttgtgtttttaaagcattgtacattcacgtctctatgt

SEQ ID NO: 2450 - DNA, 1035 bp, Homo sapiens
tttccaatgttattagtgtttctaggatttcaaagagtggatgtggaaaagagaagaagcagcttcagtcttacttgccttgtcatggagctatttataggcttggttcatacatcagtttgcccagtatcacatagctgaattaaaaactttaaagcctcaaatgtaacataaatttctaaccatatcagtcagtgactttgtaccattggggcaattactatgcagcatgaaacttgctagagaaagaactaaaagttcaccaacagagtcagcatggaagttagatcatagtgttagccggccatctgcagggtactagtcagattatcagtagtttctgcttttggaatttgtctatttaaggccatttcaaaaagccagtactttctcatggttaagccagaattaattttaaagtgaagaaaaataggtttatagtttagtgcttgattactaattgtgcattaagcattgtgcaaaatatttctcttaactgcaacaaaaatttagactctaggggaaacagagtactttggaaaggaagtcgtgagatagaatgccaaagcaagaaagtgccttagagctggtctgttgggaggttctgataaagattgccatatagtctttgaacacatatgtggagacctactacacgcaaggcccttttgtaggagctattgctacggcagtgagtgagactgatgggtctcctgccttcctgtgagcaacttactatcttgaaacattccacacatttaaagcgtttcccttgcttggctctggttttctcctacctcacagactagctatcacttctcaggctcctttgctggcttttttcagattcccttgcctttcccccaacctctaaatattagaatgccccagagctcagtctttggacacatttttttctctggttttccttacactcttggtgatctcagtcaggctcatgacattagattccgtcctgtatgaacaactcctaactgtatctctagcgcacatctttctgctgaactgcagact

SEQ ID NO: 2451 - DNA, 1057 bp, Homo sapiens
ggggatgcctgcaataagtaaaattcagtgagatttagtcatttaacaaatatgttaattattactatgtacccagcacagttctagatgcccgagatatatcagtgaatgaaatagacaaaattccttgccctcctggagtttacagtctaatggtagattcagacaacaccctaacaaatgggttaaataatatgttagaatgtgtaagtgctatcaagaaaaataaagcaggctaagggggcttggccatgctaggataggagttagggtacaatatgagcaaagatttgaaaaaagcaaaggagttagcgtcgcagccatctggggagaagcattcatgacagagggaacagtctgtgcaacagccttgtggcaagaacataacccgtgtgttcaaggagcagcatggaggccattgtgttctgataggagtgaggaaggagaaaaattctaggaaatgggattgggggtagtaggagttggaatggaagtcatggggaacgttgtagactgttttaaggatgtctttagtgaaatgagaagtcactggaggacattgagatgtgtggtataatctaacatctttacctaattgcagtacaacattctttctcaaccttaccaggtaaacgaattatctttccctctgaagttacgacattcctcctatccaaaaaggcagaaaaaagaaattttttatatttcaaaaatgtatatttacaaatagaatattagtggttcctattttgtgtgtgtgcttgaacagagaaatatggaactgaagaaggtattaagttcttcactttcagttgcagacttgtttccctcaaaccacttatatttaagaaaaatgctattttagattgacaatattaaaagtcaaaacagatggcatcttggggtgtgtttctgtaacagcaagataacataaatctttgcgtccatctgagggtggtctgcaaattaggtagtgttattaggcactgaactatgaccacttagattttatgtgtgttttgatctctttgctgagtgaaatatttgctttcattct

SEQ ID NO: 2452 - DNA, 1050 bp, Homo sapiens
ccctgtgctgggatattggatgtcctcctgaggtctcctcagcctttccctgatggctctggtcatattttggaatgtctccctgggaggagccgcccctgcttctggaaggggctgtgctttttatcctcctcacatttggaaagcctctggctttcagacaatttttacttatcagtgcctgcattttcctcacccgctagtctgcagattctatcttctttctaaaatagtgatattgggctaggcacagtggctcatgcctataatcccagtactttgggaggctgaggcggcaggtcacttgaggccatgagttcaagaccagcccagccaacatagcgaaaccccatctctactaaaagtacaaaaattagctgggcgtggtggtacacacctgtaatcccagctacccgggaggctaaggcaagagaatcacttgaaccaaggaggtggaggttgcagtgagctagactgtaccactgcactccagcctggctgacagagtgagactctgtctcaaacgaaatgaaacaaaacaactaaacgaaacaaaacaaaatgaaactaaactgtgatattgaaatttattttccctaggagtggaagatttttttctttttggcaacacagtcttttgtgtggtacagccccaacctatatgctaggctgtaggtaaaagcctaaccaactgggcctggccagcttcccctcactcttcagctcatcccatagaaatacaaagtaagaaaaccaagtccagtacagtgggctctctaggaaataagtgggattcttatctaacatgtgacttctgtgtgtctttgttctctatgtcagaatgtgtgcatgaagaggaaaggctgtttgggaggtttcctgatgtaggacccccgcatgccgcggcaagttaaacagagcagaggctggcctggttccgcttggaggcagcaacattgcaagacctttgtctcagactcaaactcacttggccaacctcatcttgttctacaacaaaaggacctgaaagctattttacttctcccaggg

SEQ ID NO: 2453 - DNA, 1030 bp, Homo sapiens
ttgctgatgagacattttgtgtcaaaatgtagaagagagtggactttgcagaaaattctgcaagaattggagaagatggcatggcagagggagcgataccatccagtgcagggatgggagacagggctggtggagggatgccttccatcggggggaaggggctccggttaatcagtattccattgccctgttgggggcttttctgcttttcaaagtgccacccataagctttcccgggtgggtggagactgtgagtaatatgtgtgcacttatgtacaagtgctgttctgaggggatgagggaagagctccatccaggagcatgtacttagggaactgctgaacagtgggatggaatcagttttaggggaaaggcagaaggccaggagaggatcatgagatgtctgtagagccaagaattaatcagaggtgaaacagtggcttcgagaagggggtttagagggaaggaaaaggcccaagaaatgtgaaaggaacagcactgagatttgacagtagataggagaggaggtgagaggttgggagtctctaccctcagaccaggattgtgagttgcagggtacacaggggttcatctaactgggagcacctcaggtgtccacattgaaatccttcacatgcatcgcctcaggagtcctcacactggtatgagccttcccacggggaggggcaagcccttcccatggtagatgagggtaggggaatcaatttccagatcctgtgaattatatctacaatcagcaagttctccggtctcaccataaacatttcttctttgtacagaggaaaggcttttgtctgtccaccccacatcttactaggggcattgcccttggagggaaaaacatacagggacccaaacaatgaaaaatgctggtgttgataaagagggtgatgttaatgacagggtaaaatggttgtacaagtcagtggttccaactctttgtcttacattaaaatgaaggggcctccagtgaaattgttgctgataaatcattaaaaatactttttga

SEQ ID NO: 2454 - DNA, 1044 bp, Homo sapiens
acaaatgcctaatattggtctttatgtggccattgagtcctgttgactttccactcatgtgctttttactctagcattatggaatctgggctgtacttgagtatggaaattctcttatagacttagttttagtactctattacacctttactaagccacataaaagtaatctgtttgtgtgtaactgccagatataccacctggaattccaagtaagataaggaagaggatgacatttaaaagagaatggaattttgagagtaggaatgcaaggaagacagcatgaacatatttttttcagtgcaaataattttttcgtaacaaagaaacgaacaactttggtatgatcttaagcaaaaatactcactgaaatagtatgtggatgaattcacctacttacaattttatggtttctttgtaaataataaatgtgaatctcaatcctgctttatctttggtatttatgagtcttcttcctgggtttttctctttatattagaatttgagtcactgcaatttatttttccttaccctttctgattgcctccagagatacaatctgactccacaaacactggcttctgtcattggcagggggcgagggcgttgtgagctgcaggcacacaggtggcctgtctgtggcaggatggccagtgtccgcaaggggccttcctagtggtcagtgaggagtggctgttccctcctcctccattttcctttgctgggttctgggactgaaattcaccaccattccccgcaccctgtgaggtaaaagtggtaagtgagctgtaggcctgggtaaattctggaagtgatgaaattgaaaaatcagaacttcaaagtcagccattaaaatagggaagccattttttcctcttaaattttcaaagaggaattcaggagggagataaacagaaacgcacatttggtgccccggaactgcctttccgaggaggatcaagtcgtgcctcctgctgagctgtgtcctttacagacaaggtgtgacctggggttggaagagaagagaatagagcagaaaaacag

SEQ ID NO: 2455 - DNA, 1056 bp, Homo sapiens
tattgtccaggagaaaggggggcactgagggaggggtacatacacagggctatgaaggtatgagagaatggccatcttgcagtgctggggctcaggagaggaggggagctgagagcacaggtacttggtgtcaggttttggggagtctgggaagaatttttggccagggagtgactgaatccgatttgcatgatacacatttgcctctgccaggagcctggagaaggattagcgcaggcggggccagggtgcagctgggagagcaggctagcatggaggaaggccgaggacctgcatggaagtttctggaaagcagacccactcctcatctcggaagctaccttctcagcaactgtggcttttcgctgcctcccttcatcatcggcactccccacacacatttcttacacctcacttctccctgaagccacagtagagacaaccaccctacctgccacagtcagtgaccgtttctcagtcaccaccaccccgctctgaggacacatggacactacttactgaaacgtttctcctttagctgtactgcccttgcttctctgctgtttgtcctcatcccttacttccaaaagttctggccttgacccttttctctcccctccttggtgatcacactgtctcctgcagcatcgccctctgtcacctgacataggtccctcaaatgtccacccaggactccctctggagtgctgcaccacagttccaactctttgttggttgacagagaaactcagacttatgtgctcccaccccagcccctacaccctcaccccacctccctaaactcattctttctttcttttttgaaacagagtcttgctctgtcacctaggccagagtgcgctggcatgatctcagctcactgcaacctccgcctcccggattcaagcgattctcctgcctcagcctcttgagtagctgggattacaggcagacgccaccatgcctggctagtttttgtatttttagtatagacagggttttgccatgttggccaggctggtctcgaactcctaacctcaggtgatccacccgcct

SEQ ID NO: 2456 - DNA, 1032 bp, Homo sapiens
tttgtgacaggaaaatcacagaagaagttcattttagtgttaaaaaatttttttttaaatttactggactaaaacctgctttcatattgtctttctctcattcgctccgttaatggttaccttactccttgtctctactcccccaatcttaaaacctgaatcacggtactctttttcatacaggacacattttcaaatatacggtgaagaaggatgggccattacacatgtgcatagttttcacttctcttatcaggtgaaacattcccaactgtttatttttccttacttaaatgaaaaggaatctaggtcttccaccttcttttaaaaaatattttattttttatggatacataatggatatacatatggatgtacatgtggtaatgtaataccttaatataatttgtaaagaccaaatcattgtaattagggtatccatcacctcaaatatttgtcttttctttatgctaataacattcagattattctcttctagctatttgaaatatataatggggtactgtaaactgtagtcgtactactcacctatcaaacactaggtcttatttcctatgtcaaactgcatatttatactcattaatcaacctctcttcatctgctcctactcactacctttcccagcatctgctaatcaccaatttactctctatcttcatgaaattcactgtttttgctcccacatatgaatgagaacatgtgatatttgtctttctgtgcttgacttacttcacttcacttcacataatgaccttccatccatgttgctgcaaatgacagaatttcatctttttatggctgaatagcattccactgtttatatataccacatttttttatccattcattcactgatgggcacttatgttgattccatattttggttattgtgaataatgctgcaatagacataagagtgcaaacatctcttcaatatactgatttcatttcttttagatatatacccagtagtggaattgctgtatcatatggtagttctatttttagttt

SEQ ID NO: 2457 - DNA, 1263 bp, Homo sapiens
ctgggaatcagggcaggcagtttgatgttaatctgcaagtccctgacagagcagttttagggaccattcatccagatccagaaattgaagaaagcaagcaagaaactagtatgattttggatagcgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgagaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaaggtgagatgcctatggccttgtagaacagggctggagaagcaggtgggtgggtcgctgaggtgcctcctatcttgtgaagctctgttcagtttccaatgtgcctaaaggagagggacaacacagggaggtccacatgttccttcctgccatctttcttttaggctggagcatggagaagaatttcttgccgtttcccttagaatagttgagactggttagcattttcaaaaggaaactttgtaaaaagctaaagagaaagatataaaccagaaagtaatatacaaaatacaaatgtcatgtaaaattatgaaagggttttattgaacacaattt

SEQ ID NO: 2458 - DNA, 1050 bp, Homo sapiens
taagaaatgggggaggagaacttttttgcatttaattaaaacatatattttggataagaaggcaatattcagatgaattttcagggtaaaatatgaggctacaaggaaattcacctttgctgtggatcacattggactgtcccctaagcctcttaggagaggagatggcttcactttgtttgactcttagaggtactttgaaagtattcgaaagacatctcagcaagctgccttggcgtggaatgtccctgtctgtactagttctgtgagaaaggcatgctagggtatgcaagagttcatgttacttctctgcagaatagatgtttcacatttctgctcttgagtggaattctcatttgcacatttatttgtgtgggtgtaggctgatttgccaaggaaagatgttactgaagtccctaccataaatgtatttatttatgaaatactcctctgtagattttattatgtagattagtcatcctttaaatggaataaaagaaactgaaactcttatttccctgcccagttgtgctccatgggatgcccatgcatggaggtcaatgttgaggtgccctggtgtggtcagtgggattagcctaacaggtagtgtcatcaagctgtgctagcccagtgtattcttctcaccctagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccaggtaaagcctgctaatttttttctacaaagtggagaaatcataaagaaggccttctaggagattcattgtcaaaggcaggagctagagacttgttaaattcaaaggaaaaaaggatcccagagctaattgagagaaaagcaggcgtcaagacagatggagatcaaaaataggaaagacaccagagactataactaacctacaaaccaatgtttggctgtcactatcttgtgtaaattat

SEQ ID NO: 2459 - DNA, 1060 bp, Homo sapiens
gtggagaatataggaaatagtttatgcaaagtatcaagtagttcatatagataattgtttcatagggttttggagtaatggggtgctgactttattgggaaaactataccagaggtcagactcgtagatcaataattgatgaatagttagtggaatcttagggttggaagagaccttagaagctactagtccaacttctcagtagtcacagcaattccctgtactctaaccctgccattttgggacctgtgcgtcaccggttcctagtgtaagccgcctaccttgcaaggctatacattcctttgttgcctatttcattcttatactgactccaaattttcctccagatgatttcctctatagaatctagttttctttttacatagtaatcctttaaatatttgaagttatactttaatttattttagcattttatcctggaaaatttcaaatatacaaaagcagagaatccgtgggaccatcacccaataattcccaaaagtgactgtaccattttatacttccatcagcagttaatgaaacttccatttgaccacaccttccctaacacttggtattatcagtcttaaattttagccattgtagtgggtatgcctttctggttttaattgtaattcctgatgattaatgatattgagcactttttcactgcttattggccatagttttttgtgtgtcagttcactctgactagctggaatttaaatgtcttgcagccctgtgacaactctgggaattgtttagcttacagttgttcttttttcctttagttattctttgcccatcctcaaggaatcttaccctacacaggagctgtttagaattcaggctgaggctgaaggagagacctccttgcatatttctggaactctacttgttcctagtgtccatcttttttttttttttttttttttttgagatagagtcttgctctgttgcccaggctagagtgctgcggtgccatcttggctcattgcaacctccacctcccgggttcaagcgattctcctgccttagcctcccaagtagctgggattac

SEQ ID NO: 2460 - DNA, 1042 bp, Homo sapiens
gcattatcaaatgatgcccaaagggttttgtttttttctgactctttctaataatcattatgctgtcatggatttaaaaatatttggtgtgtttctatccaatcaagaataattttttttttttttttttttggttaagatagggtctcaccctgtttcccaggctggagtgcagtggtgtgatcatggctcactgcagcctcgacctctctgggctcaggtgatcctcctacctcagcctcctgagtagctgggactacaggtgtgtgctaccattttttatattttttgtagagacggggttttgccatgtttcccagtctggtctcaaaatcctgggctcaagtaatttgcctgcctcagcctccctaagtgttgggattacagacatgagccaccatgcctggccagttattcttattgatgatcaatttacaattataattggagatttcagtatcccttctcaataactgatagaataggaagtcaataaggatctagaagttatgaacatcatcattaaccaacttgacattattgatgtttatggaacattccacccaagaagagcagaatacatattatatactttttagtgcacatgaagcgtttaccaaaataaactatattatcagccataaaacaagtctaatgaatataaaatgattcaagtagtacaaagtctgttctcttcacaatataattaagttagaaatgaataatggaaatatctggaaaatccccaaatatttggaaactaggtgacacacttctttctgaacatcttatgagtttaaaaggaaaaggagaaattagtattttgagatgaatgaaaatgaaaacaggccaggcgcagtggcatcccagcactttggaaggctgaggcaggaggatcacttgagcccagaacttcaagaccagcctaaacatggtgaaatcctgtttctacaaaacacacacacacacacacacacagctgggcatggtggcacgtgtctgtagtcccagctactcaggaggctgaagtgggaaggttgct

SEQ ID NO: 2461 - DNA, 1075 bp, Homo sapiens
ccattttcttatggagaactgtccttgttgtgagtaaattaatgcatactttaactcataaattcaagtatggttttataatcacagtccttttgtttctttttcagtttctaatatgaacagaaattaatgcttttaattcaagctaaccttgtaaaataatttagtataatttttgtgttggtaaattcttaagtgaataagacaacatgtataatctcagtgggaaaacttcagtttatatgtctcatatcaaagtctaaattttaagaattaggtgggtctgtatttcaactcacaaaggatgaaaagaaagaattagataggtcatatgtacactgttagtagaactaggaattcttagagccatcctgaaaaatagtttcatgatgtgtatgataagccttaaaaatggttatatccttttatattgtattaatgtcatgtctagtaatcgatcctaaagaaataaccagtcagccggcacagtggctcacacctgtaatcccagcactttgagagtccgaggcaggcggatcacttgaggccaggagttcgagaccagcttagccaacatgatgaaaccccatctcttctaaaaatacgaaaattagccaggtgttgtggcacatgcctgtaatcccagctactcgggatgctgaggcagagaatcgcttgaacctgggaggcggaggctgcagtgagctgagatgtgccactgcactccagcctgggtgacagagtgagactccatctcaaaaaaaaaaaaaaagaaagaaagaaataaccaatcatgcattaaatatcttacatggccgggcgtggtggctcacacctgtaataccagcactttgggaggcggaggcgggtggatcacataaggccaggagtttgagaccagcctgaccaacaagacaaaaccccatctctactaaaaatacaaaacttagccgggggtggtggcaggagcctgtaatcccagctacttgggaggctgaggcaggagaatcgcttgaactggggaagcagatcatgccactgcactccagcctaggcgacaaagtgagactctgtc

SEQ ID NO: 2462 - DNA, 1023 bp, Homo sapiens
attaacttgagtagcctcgagtgggtagtagattggctttttagacccaagagttagatattttataaccctcctttgagtagttactgcttcactagccaagggaaggttacatgatcaggagtgtggacttgggagatagtaggatgagcccttctgttccttctggaagtgaattatttgaattggctacaattttctgaaggatgcaataaacaagatcaatttccttgatagctctgatgttctcactacagctctgagggttggggccactgtctcctcccacttaaccaaggtcttagcccatagtgataggccaaggagaggcatggttccttatttacctgtctcattcatgtggtcctaatgtctccagtgcaaaagccctaacctgtgggaatcatgtgttttaactttgcagttgcagcaggaaatcgaagactggagtaaattacatgctgagctcagtgagcaaatcaaatcatttgagaagtctcagaaagatttggaagtagctcttactcacaaggatgataatattaatgtaagtgcgttcatgaatacaagcttaattcttgtgaattatcaaatctgttgaattaaatggaaagactcttaatgcccttttacttcttttctaggctttgactaactgcattacacagttgaatctgttagagtgtgaatctgaatctgagggtcaaaataaaggtggaaatgattcagatgaattagcaaatggagaagtgggaggtaagatcagcctcaaggaggatggaccccttttgccttcctgtctttaagtgcaccagtgctacttttcagctggctgcatttcctcttaagctttcgaggtgtaaatacattggatttgaatgtgtgtctgtttgcattgggcagaggtggattgctagggtgaggtgtagcagtaagcatgcagtgaacactgactttgttttcacattgagactagaagggtgcacgggagctgcactggtcatgtcttacacctctaagtat

SEQ ID NO: 2463 - DNA, 1035 bp, Homo sapiens
cttaaggtccagctgctgcactgcctctgatgaaaagcatggcccttaatgaggttgactcacacagggttgactgcttttagtaatactttctgtccttttcctctggtgagttagaccttttctccaatagtgaccaagatgacttgggcctcagagtgactcaaaaggggatgaatcactgcagtcctgttagtagggccctgtccattctgctgaatctgatcccataaatcttggcacattttccagcctataggcatgtagttatgactgtgaacctcttgtttaggttattgttttaaaaatacttttaatactaaatcataatttgttggattatataaatagactcagttttgctttgagtgaggcatcacattacactgtagatgaacttttctgttaaagtgataggctataactcacaatggcaaatattgtagaaaacacactgattgcccttaacctttgttgttattattagttttgtttttaattttgagagcctaaggaatagaagaactattggataaatgatttgcatgggggggtgggggaagttgaccactaccagtgacatactaggggtcttgatggtgggagctgtctgctatagttggaaagagtattttagcactgaggtttagaattgccagctcctggtgataatacagcagaaagacttttagttgttattatagtttttgaataccacacagatgatgcactcctttgttacctggagagggctgggaggggaatccctcccacctcttgtgtgaatgacctggtggagcctcccacctcttgtgtgaatgacctggtggagcctcttgaagcaaaatagtaccagtttgattttcactgtgttagtgtataattatggttctccggagaaacagaccaatatcacatatatatgtgtatttttaaaagagatttattttaagaaattggctcatgcagttgtgggagttggcaagtacaaaatttgtaggtcagaccagcaggctggaaatttaggcaggagtt

SEQ ID NO: 2464 - DNA, 1031 bp, Homo sapiens
atttacaagaggaaactgaggcacagagaagttaggtactcactcaaggttatcctgctagtaagtgtcagagctggacttcttgaactcatgtctgggttccaaagtttatgtgtttaaccactacgctagacagactcctatttttaaaaagtaccagctctaaaaattatttccatctccagaagactgcccttactagtggggcttttgttatttatagtaaattttattaaaatagaaattttcaaatggtaatattcactgtacttgtcttttatcatcaagctatttaatgagtatactgttttatttttaaaagtgatatttattataagcatatttgatgtctgtgtgctaataattatatggataaaatattgatattggtaaaatttggcattatttcaaaatgtgatggaatatgtatgtgtgactgttggagtgctttactttctgttggtattggtaaagtattctttctggctgaagcatctctgaaatatcagaggaaaaatgggaggtgggatccagagggattggaattttagacatctttcaattatttttgtcatttgtgataagtacctaatgaattttgaacctagtaatgcccttatgtgctaactattttggtacctgaggaactggagtgtttctgttccttaccttgtttagtggtctaggaaagaggtctgaagattcaaactctagtctagtttaagtttgtgtttgatagtttacaaatcaaggtgcttaaattcacactttatttactgctatatgcagctcttttttaaagccttttgtgatattttttggtattttgattgtttaaagccctcaggtagcctaattaaaaatgggatgtccaaattcacggaggcatctgttaaataaaacctgtcattttaaaaaaaaaaaaaaggaattgtctgttttattctatagccacagcagaagggttaaatatggacagaacactatttgtccttttaggtattactgttttagaaggagattatagctat

SEQ ID NO: 2465 - DNA, 1081 bp, Homo sapiens
ccccccagcaacttcaacaattgcttacatttagttgtagaccacgaaagaggtatttttaatataaaaggatgggtattgctgggcaacaattaaaacttcaaactcaacatttagggtttagccaactgactttactaaaatggaatgctttaactttttgactctatatttcaggaaaattgctcattgtagtttattaaggtaaaatgactttttgtgatgtagtgctaaaaaggtcaaatctccacttaaaatattaggttggtgcaaacgcagttgcagtttttgccattgctagcttttggtagtgctaaagagttttgcaaaaatgatttttcttttaaagaatatttaaattaatttactttgcttttggtaaatgccaaagaaaggcacagtgaagtattgtaagtgcattcaaaatcgattcttcatccgttcatttgtcatcctaaagtgaaaaaaagaagtggaagacaattattagatggatagtaaatataatctaatgatttatatgttgttctgacatttaaccatagatactgttgcttaaaaggactcttgaaagaaaatctcagcatattttttattcaaagttgttttgacttaggtactttttccatgtaagagacaaaaatcccacaaatattaaatctatttcaacaagtgtttttgaaacattatgtagatttgcaatgcagtttcattagcacaataaatatttcttaatgctgtgctttttgagtttctggatttttgaacaatatgtttaggtcattttgaattattatttacttaatattatttattatgactgtgaactgatttgtttatgtgtatgtatttgtgtgttttggctctatctgtatctcaacaagaccatttaatgtcagctctatcacaagataatttacttttttcccctctatgatatataacttttgggatagaaatttgttttggggtgtaatttttggaaatgtactagccacttgacatgctttaatattcaaaataattcacagtgaatctggatttttagtgactagtcaatgtccttggtagacatttttgt

SEQ ID NO: 2466 - DNA, 1022 bp, Homo sapiens
acaagattttggggaataggaggatggcttctttagagacctaacagttatttgtgtggcctggaaaagtgggatagctcattctgaatcattttcaaacttgtccagagagctctggggctcctcagaggaacctcagtactactagtgggaatagggttgccaagaagggcaggggtcttatccccacatcctttaactaaggaacttctactagacacaaaggaaaacaaagaactttgaatataataaattagcttttgcttctttgtcatagaatcttcctgagttactgtttgtgtaccaactcttgagggttccatcatgtatgatgaggagccacatcaagacctttcacctgtgctctcttattcttttcttctgccattccctctgcccctctcacacaaacctttttgtagaaaggaaagcagggacaaataacacttgagttccaggcgttgggaactagttaagatctgttagaaaagaaagatttaaacaatttttgaaagccctgaaaattatcttcctaaatcttttacctaaatggaaatttgtattatcttcattaggaagaatatatatggaagtaatcaacaaactgaactagttagaaagcagtgtattttagccaataatgagccttaacctttgcagggttagcacatggaaatcgttattatatactagcagatacagctatgccaccatacttcttaagtcaaggaccaattcttcattataccagcgtgttctgattttcacagttaatcttatttggttgctaaatgccttacgtacctaatgaaatgaaatttgggaattgactagcttaattttgcagtgtgaagtggttcccttctctttattttaaaacattttttctcccaaaattttgaagatattttgactaattcaaatttcatataattttaagagtactataatttataagctatagaggtgtgtgatttgaatgcttcctatctaatgcgactggaatttttctccaattataa

SEQ ID NO: 2467 - DNA, 1047 bp, Homo sapiens
tctcccttgaaattcttatcccttcacctggcccagggatttttttttttaactttttattttgaaataattttaaactttcagaaaactttcatagagttcctgggttcccagcttttcttcatgttaatatcttatataaccatagcacaattattgaaacaaggaaactaatattattataatacttctattaatttcaattttgccagttttttcacttatatcctttctctggcccagatccaatcctggatcccacactgtactaaattgttgtgtctccgtagtctcttccaatctgttaatgtgtgatagttctccagtctgtctttatctttcatgaccctggcaattttaaagagcatttttaaggtttctttttaaaaatgttcctcaatttgggtatagcttatgttttctcatatttagatggaggctatgcatttttggctatgcatcctacagaagggatgctgtataagtcttaatgcatcatatcaggggtatatggtgtccgtatgccttattggtgatgttaactttgatcacttggttaaggtgtctgcccagtttttactctgtaaagttactatttttcccttcatgattaatgagtatcttttgctcactgattttagcatccactgatggttcttgcctacaattattactatggtatgtgtctaatgatgactttttattatttatttatttggtgagacggagtctcgctgtgtgcccacgctggagtgcagtggcgcgatcttggctcactgcaacctccgcctcctgggttcacgccattctcctgcctcagccccccgagtagctaggactacaggcgcccgccactacgcccggctaattttgtttttgtgtgtttagtagagacggggtttcaccatgttagccatctcctgacctcgtgatccgcccgcctcggcctcccaaagtgctgggattacaggggtgagccaccgcacctggcctgtctaatgatggcttttaaatttctacatttcttctacattcagtaattggaaa

SEQ ID NO: 2468 - DNA, 1034 bp, Homo sapiens
tgatgtcagaactgttttgagagaccatttatgttgtgtttcctttgaagaagagtgattcaaggcaatctttacttacatagggccaatgagttgacctaggaagcctagaaacaaaaatcctttgccaaaaaagagttgaaagtagctgtaagtgatttgaaacatcatatttacataagagttttgagagagatcatttggaattaatctagtttacctagaggcagaggattagttgctcaaaatgattccttatgggaattcctagtttgatgtcatgcatctctcagaattttttgggcactggcatgtttaactgcagtcatttctggggagggtttgtttatagataaatgcacaactttacataaacacaaagtttgtgattgagacattttttaaaaccagctaaaaaggatttcgaatgggggaaaaataatcacagaagctgaaggttcagtttcagagataccaagttatcaggtttctttcttgatgtcagattaatgggaaattggaaactgaaagctggtgtgtattaccctcttacactttaaaatgttgcttgttaaggcaggcacatttttaaaatacttgtttgaatacctgaagtacaagcccttattttcctgcctgtatgtcatccttctgattggctgttctgattgtagccagaatatctgggcatttttcaggcagttgagataaagaaactcgtattttcttcttcattactcttaaattcatagttcaaaatatttatgttagttttaaacataatagtttcctgaattaggtaatttataaatgtcacattgtttttgtttttttttttttttttttttttgagacggagtctcgctctgttgcccaggccggactgcggactgcagtggcgcaatctcggctcactgcaagctccgcttcctgggttcacgccattctcctgcctcagcctcccgagtagctgggactacaggcgcccgccaccgcgcccggctaattttttgtatttttagtagagacggggt

SEQ ID NO: 2469 - DNA, 1019 bp, Homo sapiens
gtgtatgtcatacatttatcaccttgttactgcttatggctgttttccttttcccacatttcctttacagtctgttacttcctttctttttacttctttttacttctgttacttcctttcctcattctctcctcctctatttctgtttgccttggtttcctcatttgttgaaatcgttttcttaaaggggtttcttaaaggttatagtgagttgactcatggattaatcaaagtgtttctttttaactttattttattgtcaggccttattagccagcagaataataaagccaatcatagtatattcttaagtttgagtaaacttttgttgaacttatttggttatttgaggtttcactaaagaatgtgagttagaaaaatggcagagtgatagggatgtgctttcatgtctgagtattgacctgtgatgtaatgggtgcaagaatgaaacatagttgccatatgcagtgatgtgatcttgggatatgagacaatttgtactctcaacctgcatgactagatatttatagcagaaatgctaaaatgaaaacaaaaacaagaactttgttcttgaaaaaacttctaattagactttaaagttttggaatatagtaaaaaaaatagtgactggaacttagtaaattagaaaggtttgttttgatgtgagaagtatggcctgtaccccaccttcttggtacttggtagttgcttgtattctctttaaagatttacctatacaatagttagaagtgaaatataatattaagaccaaattattttataggatattaacaaattaagcaaataaattaagttttatttttatagatgagaccattcacttttatatatcaaaatgctagcttgcatgtatcaatatagagacattactcttagactcaaatgatctagaatatgaacttccaagttagagtttatttgcaaaagaagttgaatcataaaatatctaaattacttgaattatatttctcttataatcattcttctatttgcttagc

SEQ ID NO: 2470 - DNA, 1023 bp, Homo sapiens
gtccccccttcattcagtcctgtggtaaccgtagtaactgtggcaaactgcggcaagtggcacccaaacaggggcgaacagggacagatagagactagcagagacttgcagggacagggagggacagacagggacagatagggtcctatagggacttgaatgaggaaggtatgctggaacagagaaagtgagactgaccagacgaacaagaaacccctttacaagtctgccagcagcaatataaggtcagtgccctaaagaggtaaagagaatgggaagtttttgaatcagggtaacatggggaagaatttggctatttcttttctcttttctgtttggaatttggttcatattgtccttttgtcattatttcaaaattcgagagaattttttgcaccacccacagcacctatcaagggtggtgaacagaagagggaggatgaaaattgccttgtacggtcttcttttatggctacaggaaggctaactttaactttggcttttgagattgcaaacgtggactgtaaatgtgcactggcacctgtgagatgtacaaaaaacttgggaggttttctcagagcttgtcaagatatgggaactgagcttcattgctctacaatgttggttcaagcaatggcctatttggtagttgatccaaggggactaaagtgggaaaatgtcataagtgtagaaaaattggacatttcaaaaaagaatgctgtcagacctctgggcagaagggatcttataacacggttcccctctcaacagaaaaaatgccaggactttgccctcattgcaataagtgaaataaatcattgtgctaatcaatgccattcaaaatgtcatcaaaacggcacctccctgttgggaaatgagaagggggcctggacccgggcacctcaaacattgaggacattccccatccaggccacaattctgtttcaggggtgggtctccagaggcatattgattccctctccccaggaacacctggaagcgcagtattggatttcccagtca

SEQ ID NO: 2471 - DNA, 1066 bp, Homo sapiens
ggatttatcttatctatttgcagtgatatccaaattcataaaaactgaattcagagccagcagggacctatgagatcatctcatctagtgtttggattttgtagataaggagactgtaacctcttgattcagtgatgagttcaaggttacatagccagtgagtggtagagctgagactaacttcaagtcttcagtgattccctgcactgggctatgacttgggcagcataatgctctggtctgaagttttcagtgggtatggaactatttgtactctggaaacatcaaaatccaatatagaatattatcttcagaactttggtatgattagtttttctgaacttgtacttccaaattactaaactattaatttgaccatactgaaagaaaaatcttgctgaagcagtatctacaatgtaccacagtttacttgttcataactgtttgacacttaatgctaagaaaaaagataaatagacaagacttttaaatgttaataaatgtaacagaatccggaattgcatttttgactaggtgcagctgggaaagagtttatcagcagctgttttatcacttttctaaaagtaccaagtgttgtgcctctcctgcaggctctagtctctttttccctcccccatgcccttgtcttcctaataatgaagaaagatacctaaatagtatgatctacaacaaaaaggatactgttttcagaaaatattagaacatcgtaaggtcactagtacttttcttttcactctgaataatatattgagaaacatattgaagtaattggggataatatttatttataaaataattatgtgtcccatgtgacaataccaaaaatgtactttaacttgtctatttttacatggaccccaaatgtttaaatgaagtgattagacatacaaatctgtaattttgataaaaatataaataagaatttataagtttctgagttagagaatacaggtctttggtttttgtgacactatatttaatttaagggatttctttataggatcaacaactctagaacctttgtttgcatttcttgaaaggaaaa

SEQ ID NO: 2472 - DNA, 1053 bp, Homo sapiens
tctcttttcattgtaacaagagcaataaaaaaaagtaaagatagtttaaacttagagtaccaggtccaactgttttctaatatgcagcaatattctgcatttcaagcaatattttcagactgttgaatattttgagtggcagttgcttgctcttatagattgatcagcattaattatataaagtataaatcagtggctctcagctctgactgcatgttaaaatcacccaggatgctttaaaaaatgctaatgtccacacttcactacaatatgaattaaatcagaacctcaacctctggggccaggacccttttatcataatttttttagtattaccaaagtgattctaatgtgcagccagagatgagactgctgtgatagacttgtaattttattaatattcatatttaatgcataccttaagacttgtagcagagtctaattaaatgttttggctagttttggggttagataactacttatataggagaactttgtagaatttttttaaagtgaccattgtttgacatccctgattatagaaagtttctctagttttattttgtatatttttggttatacaatttcacataattctccaaacttagggttcaaaagaaattagtgcagcttaatggaatttaaactcatctgaaagaggagcgcaaagctatgagaagccttccctacctctttctttccagcattgatgcttatgggcacagtacttataacacgagtgtggagagaagtggtaaatattacatggaaagataatttttgtggatgaacctggaaaagagatctctgaaaagtgctttgataattgcaatattgtgagagtgctcttgaaatatgtatttaggaagataagtgtttatgctaaatgaaggatatcactgatatcatttacctgagattgaaagagataaacttcattttatacccacatttctgttcccacatagaccaaaggtacattggatgtaaaacaaaatgagaaaaatgaaattgatgtttctacaaccctgaaatttctatcactcacctcta

SEQ ID NO: 2473 - DNA, 1054 bp, Homo sapiens
agaaaagcaattcttcgtcattgtgaattaagtctttaaaatttagattatattatagaatatgcttaaccagaacatcagtatcccataaaggtttcaaaatgggaaaagatgaacattttgaagtcatatatttccttttctctcacctgcaaatatataggctttgcatgaacatgtaaccagctatatatggcttctacattaatgatgtccttgactatatcaggtcatataagcaattaagaatgtttagttttttttttatcaacattgcaatttagattgcataatatttaaattctttctaattctcatcacattattatctccttttagtaatttgtgatttttataacaaagttacctttctaagaattttaataaattttatcgtgactataaattttccaaaatattttgtaattatgaacactcttccctgagtataaagaattttttaaaattatgacatggaacttgatttgtgaactgaacttgtgtgactagtgaagtaagtggactttaatggcataaaattgcaattaaaatctataacaatagtattaatgattttattgaacccttactatatgccaggcattgtgctatattttacatgcattctctgatttaatcctgaaaacaacccaaggaattcagtgctattactgtcattttcattttatagatgaagaaactaagctttgcaaaattactgttggctgggcacggtggctcacacctgtaatcccagcactttgggaggccaaggcaggtggatcacctgaggtcaggagtttgagaccagcctgaccaacatggagaaaccccgtctctactgaaaatacaaaatgagccaggcatggtgatacatgactgtaatcccagctactcaggaggctgaggcaggagaattacttgaacctgggagaggtaggttgcagtgaaccgagactgtgccattgcactccagcctgggcaacaagagcaaaactctgtctcaaaaaaaaaaaaaaaagaaagaaaagaaaagaaaaaagaaaaattattg

SEQ ID NO: 2474 - DNA, 1020 bp, Homo sapiens
aaaaacattccatgctcatggataggaagaatcaatattgtgaaaatggccatactacccaaagtgatttatagattcagtgctattcccatcaaactaccagtgacattcttcacagaattagaaaagactactttaaatttcatatggaatgaaagaacaccctgtatagccaagacagtcctaagcaaaaagaacaaagctggaggcatcacactacctgacttcaaactttaccacaaggctacagtaaccaaaacagcatggtactggtaccaaaacagacatatagaccactgtaacagaacagagaccccagatataacaccacacatgtacaaccatctgatcttcaactaatctgacaaaaacaagcaatgggaaaaggatctcctattcaataaatggtgctgagaaaactggctggccatatgcagaaaactgaaagtagaccccttccttactccttatacaaaaattaactcaaggtagattaagacttaaatgtaaaacccaaaaccataaaaaccctagaaggaaacctaggcagtaccattcaggacataggcatggacaaagacttcatgatgaaaatgtcaaaagcaattgcaacaaaagccaaaattgacaaatgggatctaattaaactaaagagcatctgcacagcaaaagaaactatcaccagagtgaacaggcaacctacagaatgggagaaaatttttgcaatctactcatctgacaaaggactaatatccagaatctacaaggaacttaaacaaatttataaggaaaaaacaaccccatcaaaattgggcaaaggatataaacagacacttctcaaaagaagacatttatgcggccaagaaacatgagaaaagactcaacatcactgattattagagaaatgcaaatcaaaaccaaaatgagatactgtctcacgccagtcaaaatggagattattaaaaagtcatgaaacaatagatgctggcgaggctgtggagaagtaggaacactttacac

SEQ ID NO: 2475 - DNA, 1050 bp, Homo sapiens
ggactgtcgttagtaaggaggaagtcaagaggctgagagggaaggggagggccatgggtcattccaaggacaggtgactcaaggcatgacatgacataaccaggagacctagaatttttttaaaaacgagatttttgaatgaaggtaaaggtaatgttctggaaaaggaagtaaagcagtaaaggactaaccctgcttgagcactgtggcttggtgggctttgggggtgagagtggctttgtgctgtcagagaagcagggcgcccagggaaaaacatgagtcagaagcagcagaagtgaaggcagaggtgcactttagccccatgccatgcttgccaccctaacagcctttcaggcaagtcagcgtgcccttggtttcctagcaggcgcgccctcccaggtggagtcctggggctgaacacatcccctggacccacatggagtttccaggatctgagttcatgacactaattgctggtttatccttttctcctccggggaaattcttacggctgggaagattccctctgatattttagaagaacataataattaagcattttaaggggaggaggcttgtagaagttcaaattagatgctatatggggaaattatagctgctgccgccaagaagcagcagcaagaaaggctgtcagcaagaagttgcgtgcaacggcgacaggaatgggcccactttggaccagcagggctaggcgtgcttccccttcctgcacctctgcccattccacctcaggtccaggcgctgcccagggcccaacagaccagggagcagctggattctcatctcccaaaaccacacaagaagtcctggccttctcagatggtgggcatgaaggggtgggaccccccactccatggaccaccttcctcctgtgtctaccccaccagcaaatcatgggcaaggagggccatggggctgctggtgaaatggcacagttccctgattcccctcgcaggacatggggctgctggtgaaatgggacagttccctgattcccctcgcaggacatgcgacaggggtgttgcctgc

SEQ ID NO: 2476 - DNA, 1078 bp, Homo sapiens
aatttggtgggtagggggctagtgaattgggagtattgattggttggctccgcaatgaaatgacagagcgtcaaagctgttctcttctgctgagtcagttcctgggtgggggccacagaactggttagcaggtccaggtggggccatccagttgttagaaatgcacctgaaaactcatctcaaaaggccaatcttagattcacaatagtgatgttacctccaaaagtaactggggaagttgcaaatcttatcacctctggaataatggctggtaatatttagaattccagcccttctcttcctgacttggtggctggtggcctgtcatttgttttataagaatagtttagccttttaggaagggctattatttaaactataaactaaattccttcccaaagctggttctgactatgtccaggaatgaacaaggaccgtttagaggttggaagcaagatggtgtcagttaggtctggtatctttcactgtcataattttctcagttgtgatttttgcaaaggcagtttcagccaaggcagccctgcagaatgaatggacaggagacattcgcctgaattacccgggcattgacaagttctctaggttcactcttggatttgcaaatcacttgctgtgtgaatttggggcagtctcttcctcccagtgtgcctcagtttccttctttattggttcattctataaacatgatttcagttgaaacatgctaaaagaattgaaaaaaaaaaatcaaacagactgtatgtgcacaaccctaacacccaggggctgccttcttgtacttaactagcagtccctcgggggtactgttagctgaaatgctagtgaaatgaccgctctccacagataaggaatagctgattgttcctcccagccagcgctggattccctggaaccattcacattctcttttcctccttcctttggaatatacagacatatgcctagcatgctgcctggtatggagccagctctcagccaacacgtctgagtgaagctgcattgggcacacacccgcgtggggcagtgtgaggctggcactgcaggccaccccaggcag

SEQ ID NO: 2477 - DNA, 1028 bp, Homo sapiens
cttggacattagctcttcatggtttgcggggtggggaggatgtgttttctgggacttcccaaggtacacagtagtgaaggacttcacaagctgggctgatgtgccagcttcaggactccactcacccccaagcgttctgagatgcccatggggctcaggagccctgacttgcacaagccagcaactgcctttctgcttccattcagccagctttactgggcatctgttataggaagagcagtgggctgagacttcagcaaaaaagacaaaagcaaaacacaatcccttctctatacaaggttcttccctttctgtgtccaaccagtccctccattctcggtccttaactcatcaccaagccgccattttcttctattcccccattactccaaggcgggcctcagttctcacctggagtctggctcaggatgcctacaggtggccccagaattgtaatggcttgacatgcaatttttcagctttacaatggcatgaaagcaatacacatttagtagaaactgtacttgaagtacccatacaaccattctgtttttcactttcagtacagtattcaataaattacattgagttgttcagcattttattttaaaacaggctttgcctccttagataattttgcccaactgtaggctactgtaagtgttctgagcacaattaaggtaggctaggctaagctatggtgttaggcagtgtcaacaaaatagtcaaattctgtgaaatatttaaagagtttattctgagccaaatatgagtgaccaaagcctgtgacaaagcccaaggaggtcctgagaacctgtgcccaaggtggttggtttacagcttggttttatacattttaggaggacataagttacaggcagacatcaatccagaaaggcgggacaacttgaagtggatggggaaggcacaggggctggagggggctccgagtcacaggtggattcagagatttttctgattggcagttaattgaaagcattaagttactatctaaagacctggaatca

SEQ ID NO: 2478 - DNA, 1039 bp, Homo sapiens
ttgttttccagctgcccaagctggaacactatagacccagaggagagggaaaggctgaccagacggcatgaagatggagaattctggtaagattagtggaggcttcagggaaagctctgtctgccccaatgttctttactagaaaactgctaattagaaagagtgtcggccaaagtgagtttaccatgtcgaggacacaagcgtgtgggatcctggttttgttattttaagttcactataagagcctgaataaagaaattcttaagccccttcaacggtccatcttgacaatggggtttataagctgagcagcttcagaaaaaggctaagaggaattcctttggtaatgttcagatcccaggaaacaagggaaagatggggcctttctcccccaggttccggagactcatcccagccccttaagaaactggtcccttagtgagcagcaatggacccacatgtctgtgtgtctgcgccactctataaccacctgcacctggacacaacatgctctttatcaaatggggcccatatattgtcacatttgatgggcacggctcccatttttgcaggtgagagttctgagcttcagagaagtttaagtaacctgctcaaagtcacccagctagaaagttgcagcgccaggactggaatctgggccttctgattctgaacctggtgcccatccactcagttctaatgagctgctctgcctggctttgggtggctcctggtctggtgttggtggaaagtcaaggcttaccagtgtgtcttcttatcacctgtgatgattgtctctgcttttgccaggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgagtaagggctgttgcatataagggctgttgcaatgcggggccaccaaaggccaaagctccccttacccc

SEQ ID NO: 2479 - DNA, 1032 bp, Homo sapiens
gtgcaggtcatcctctctccacagctaccgtcacccgtctccagcctaacaaagcctgcagtccacactccaaccctggtgtctcccacctcctagcctctcccaacatcgcctgccgtctctgaccatcttctgccatcctctgccatctcccaccatctcccactgtctcccacagcctcccaccgcctcttgccaactcccaccatctcccgccattttctgacatctcccgctgtctcccaccatcttctgccatactctgccatctcccaccatcccccaccacctcttaccatctcccaccacctcccaccatctccctttatctccatccctctcagaagcctccaagcctgagaccagggccaccccccacccccatgcattcctgctcagggctgggctcctctgcccctttctggctgcagacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggtgcagagcgcaggggctcctgccctcccttccccatgtgttcatctcagcccctgcatggaaagctgaccccagaggcagaactggggatgggatcccagaccgggagcttggccaaggaaaaacaaaactaccagcctggccaggctcaggagtagcccccgtagggaggcccctgcagtggctctgggttgtggggccttctaagcccttcacgggccccccacagccagcctgcagggagttccactctcaaatggcctccacatcccttctcacatcctccaggcctggcattctggtcagcctacccatcttcaaagaacagaatatactgggccacatcaggcaatactgtgagggcaggactgagtccatgggtgcagctgctcagagctcggcaaagtcattggcctggatggtggagagct

SEQ ID NO: 2480 - DNA, 1134 bp, Homo sapiens
gatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcacaccatgccatgttttccttcctggagggcagccccacaggacggtttatgagcacacaattatagcttgtttctactttaacaaggtatgctgcctctgtaaattcatgtattcaaaggaaaagacaccttgcctataattaaaatgtggaactataaaattttttaaaatccaattcagaaactttgataatctgaccataacataagggaagctctaatttctactgcttgctgatctgctgttaggcagcacagagacgtatgtgcctctcaggaagttccctgctcgaccttggccagctcctcctggggtaggtacaagcaagggagct

SEQ ID NO: 2481 - DNA, 1029 bp, Homo sapiens
taatttgttttccatggatcccatgaggatacttgtaaaagcagatgatagggtccagttggatcctgtgaatggcactagtttgcagttatgttttctggatctcttccatatgtcgctgacttctttgtatttgaccatgtatggacatacagaatttcataggccagagaagaaaagaagctttataaacattccttatgtgtgtaaaatacaaatcttcatttgtcttagcaagtcaataagtaattaagttgttgaactgattttttttttaaacagggaaatatcttaaaatttaagctgttaggttaaaatgtgtgtttggtatacagcatattactgaaggtagaatgggcttcatttggtaataaaggaaccagaaatatttttaagtaaaattgggagatgattcatgtagattaactatatttttgtatcactttctagaatacagtactatgttgtttaaaagagtaagtaggtaaaggagtggtataattactttggatatttctgcgtcagccacagttaccatgaataaatgatctgtctttataaaggagatggaagtgaattcaagatattgagatgttagatttgactgggttgtcctttgactagaagatcaccagataaagaaaatgtaaacttcctaaaccagataagatgatattgttaaaaaatttttttggcccagcactttgggaggctgaaatgggaagattgcttgaacccaggagtttgaagctgcagtaagctatgatctaccatgcactccagcctgggcaacagagtgagaccctgactaaaaaaaaaaattttttttcctttggttctcatgatttcacactgatgaatctgattgttttctctgagtcattttgcctctctcatgttattagggtaacctgataatagacatgttatctgagttatgtggtatgtaacagtgatcttctaaatgatgtgcatccatcactgatactgaggatgatcagaaactattacaactcttatttattgatc

SEQ ID NO: 2482 - DNA, 1031 bp, Homo sapiens
ataagttttattcttgataataaaattcttttaacagaaaactcttgattgctatagacctctgctgtgtattcagtagtcactagccacatgtggctatttaagttaattcaaattaaataaaattaaatatcagttccttatttgcactagtcagattttaaggagtaagtagccacatgggcaagtggctaccatattggacagtgtggatacacaacaattccatcatctcagaaagtgttattggatagtgtggctacagacttttcttgctcagcaatcttagtctccgcatgttagtctcttcatgcattaggtagcatctataaaacatgccaaaaggaaataggctatctctaaaagtgtcccaaactttttgtcttgtaaattagcttatcagcatacttggagcctcttgccttaaaaaggacttgatataaatgtgtatcaggagaaagcctatcttatgaaggaattattccctttttatttgaatccatgtttgctttatcttcggctcctgaaaactgatactttgcatttaacagcagcatatgcccaggatgaatgataatacatctcctgatacagagcttgaggttacagaatatcttaaattgttccaggaactgttgttatcatttaagtccaataatcagtaagatttcaccctaccagaatacacttttttttattaactgtctggacctttgctgattacattgtccggaatgtggagtatcgcatttgagaagaggattggatcctagccataacataaatataagggtaattacatccatgctgagaaagatttaggaatgatagtaagttcatttgagtgagtggtttgggccaaacttgatagagaatagtccaggaagacatttactataaacagtagattaaatgttcttgcctggttaattacatttgaactctgttaatgactgaatcactcaaactgcttaattgtattattagatgcacatttaagttatgtattacatgtctttagtggtgatcag

SEQ ID NO: 2483 - DNA, 1044 bp, Homo sapiens
gactctctccaactacagtaattctcatgaaatcacattcctgccatccccttggggaaaattttatttcttaaaattgcatgggaaatgagagcttttttaaaagaaaaaaagttttatattcaaatgatatgtagtggctttgtgccatttcttattcatcacaaggggtaagatgtttaaaattgctatatcttatatataaaaatgtacctttgaataatttctcagtttaactatttttagaaatggagcaaagttttgcccattggtacatgatattgtggattaagtgaaagaatatgaggctgggtgcggtggctcacgcctgtaatcccagcactttgagaggctgaggcaggtggatcacctgaggtcgagagttcgagaccagcctgaccaacatggagcaaccccgtgtctactaaaaatacaaaattagctggccgtggtggcgcatgcctgtaatcccagcgactagggaggctgagtcaggacagttgcttgaacctgggagatggagtttgcggtgaaccgagatcacaccattgcactccagcctgggcaatgagagtgaaactccatctcaaaaaaaaaaaaaaagaatatgacacagaattttatgtatagagttccaggtaccctgctcactacagactgaaattctgtgcagtctaataaatgaatcagagcctttccatcttgtctgggtagtccctaggttccctttttagagggttttgtttttagagtgattataaattcatccaacagtgcactttcagtgcctcctacctccctctaccaagtatgaactgcatgcatggctgatatatgattttggctattatcgcttcatgtgcattgttcactattttgtaactgttattaaagtaaaatactgacttggaacatgaattttaaaatggtgttttatccttctagtattgattcccacttttagaaaaattggtgtcattcagtgagttttatatagaaggattttttcccttagaaatacatacatacatacatacaaaaaaa

SEQ ID NO: 2484 - DNA, 1112 bp, Homo sapiens
atctggactgaagattttttttaaaattagccctcatcacatgtagtcagctgtagaaatccttagcatggctgaaatttttcatattaagaaaagactagaacttggccaggtgtggtggctcacacctgtaatcccagcactttgggaggctgaggtgggtgaatcacctgaggtctggagtttgagaccagctgaccaacatggtgaaacaccatctctactaaaaatacaaaaaattagccaggcgtggttgcacatgcctgtaatcctagctacttgggaagctgaggtaggagaattgcttgaacccaggaggtggaggttgcagcgagctgagatcgtgccattgcactgcagtctgggcaaaaaaagcaaaactccgaagaaagagagaaagagagagggagagagaaaggaggagacaatgagagacagagagagagaaggagagagaaagaacaaaagaatgaatgaacgaacaaactagaaatcgagcaggaaccttggaggacctattgcttaaggtgtgggcgaaagaaagtaagttagggcaagagactaaggtatgccagagacccaggacaaaacacagtgcagagtgatgtcacagagccaaatgggagtgcaagctatggcaagccctcccaagtatgtgtgggttaaatgtgattaaattcaaaatctctcaacccaaaaattttctccacaaaggaagtagagaaacaaaacagttcattattgaataagcattaaaccagaatgtgatgtgtgaatataatggaatggaatggattcgaaagaaatggaatggaatggaatggagtggaatggaatggacccgaatggaatggaacagaatggaatggaatggaacgcactcgaatggaatgaaatggaatggaatggaatggaatggaacggacatgaatggaatggaatggaatggaatggaatggaatggaatggaatggaatggacacgaatggaacagaatggaacggaatagactcgaatgggatggaatggaattgaatggactctaatggaatggacatgaatggaatggaatggactcaattagaatgcagttgaattgaaaggatccaaaa

SEQ ID NO: 2485 - DNA, 1049 bp, Homo sapiens
gatggactctaatggaatggaatggaatggaactgaatggaatggaatggacttgaatggaatagaatggaatggaatggaatggactcgaaagaaatggaatggaatggattcaaatggaatggaatggacacaaatggaaccaaatggaatggaatggactcgaatggaatacaatggaatttaatggaatggactctaatggaatggaatggactagaatggaatagaacggaatagactcgaaaggtatggaatgcaatggaatggactcgaatggaatagaacagaatagactagaatggtatggaatgcaatggaatggacaagaattgaattgaatggactggaatggaatggaatggaatgcaatggaatgcacttgaacggattggaatggaatggaatggaacggaacggaacggaacggaacggacccggaatggaacggaacggacccggaatggaacggaacggaatggaatggaatggaatggaatgaagtggactctaatggaatggaatggaatggaatagactcgaatgaaatgggatggactcgaatggaatggaacggaatggaatcgactcgagtggaatggaatggaatggaatggaatagaatggaattgactcaatttaaatggaatgaagtggaatgaactcgaatggcatgcaatggaatggaatagaatcgaatggaatggaatggacccaaatggaatggaacggaatggaatggaatggaacggaatggcatggaacggaatggaatggattggaatgaactccaacggaatggaatggactcgaatgcaatggaacggaatggaatggaatggaatggagtggactggaatggaatagaatggaatggataggactggaatgaaatggaatggaatggactcaaatggaatggaatggaatggaatggactcaaatggaatggactcaagtggaatggaatggaatggacacgaattgaatggaatggaatggactgtaatggaaaggaatggaatggaacggaatggactcgaatggaa

SEQ ID NO: 2486 - DNA, 2074 bp, Homo sapiens
ggaatggacacctatggaatgcagttgaattgaatggacccgaaagcaatggaatggaatggaatggaatggaatgtactcgaatggaatggaatggaatggactcgaatggaatggaatgaactcgaatggaatggaatggaatggactcgaatggaatggaatggaatgcacccaaatggaattaaatgtaatggaatggactcgaatgaaatggaaagaatggactcgaatggaatggaatcgaatggaatgacatggaatggattcgaatgaaatgacatggaatggattcgaatggaatgacatggaatggactcgattggaatgggttgggatggaatgatctagaatggaatggaatggactcaaatggaatagaatggaatagaatggactcgaatataatggaatgaaattggctcgaatggaatggaatggacttgaatggaatggaatggaatggaatggaatggaatagaatggaatggactcgaatggaatggaatggaatggaatggactcgaatggaatggaaaggaaaggaatggactcaaatggaatagaagttaatatggaattacaaaccacagtgatataacacacatgcatgaagatttctaacatgccatcctaaattaagtcactgtatcagtcagagtccaagtataggaaacagtcactacccatgcaaacctgaacagaccttcatacaagggagctgaggcatccacagcctgcagctctgtcttctagtcttgcaggcattcatttagttagtggaagcatatctcctcccagagcccaggctgcaagagtctgaaatggagcttttagctttccagcctctgtatcaaaagggcacaccagaaagaggctagaatgaatggttgggcactaacaaatattttcacaacctaagcccatactcgcagttgtttgctgaacagacaatcaataaatcaaacagcccttccatgtagaaattaagaaggaaacacaacaccaaaactcattattaaatagcattttgtatttgaaaactcattattaaatagcaaataaattgcactaaaatacaaaattgtagaatttgtattctgggaagccacagtaacaaatccctgtgacagaacccacgaagtagaggtctcctgtgggaatgatgaccgaggccctcgctgctgctccacctgcccctacagggatgccctgcttttccagttgcccttactctgatgtgcatcatggcaggaaaaagtgggctgctgctttcctttaatgctttttgtcccactttattttttacttttgcctagtatatcttttcattcttttatttccaacttttgtaaatctctgttttaggtgggcttcttatgtacaacttggagttgggtttcactttttgattcaatctgaaatcttttaccagccttcaggttatgtgtataaagttatgtgtttacatgtatagatacaacgtttggtcttacttttatgacatgtttttgtagctttttgaaaaagtttgcgttctctctgtagttcttctgaaatttagaaatgtttgcactattttgtactaggggttacttttggaattttaactctatgtaattccctctccttcggaatcctcatacaacacatcttagcctgttagtttcctgttccacattgtgataaaactgtcattcatcttgctccttcttccttccatccctctcctctacaacttgattttagtgaataacatcttagtgcctccctgtgattataggtgagacagtcaacaaacctctaaccaccgaccttttttttctcctctgccctccactcacactctgctccatcaccctcagccacacagctgacgctgtagagattcactgacatccagtctgatggacactgtttctccagccgaaactgctcatgagaacagtgagtattccctgagttctcacatgatcaatagtgtttgtttgcagactggatacaaaagatgttttgactggacataaaattcatgggccattctttcttcctggaggatcccataagtaaggat

SEQ ID NO: 2487 - DNA, 1042 bp, Homo sapiens
gagttttctctgggcactctgacttcctccgacatctcagagctgtgcctgttaggttcattgacatgtcttagtggtcccagtctgagtgagtgtgggtgtgagggtgccctgcagtgagatggcatcctggccagggtggataacgacctggtgccctgagctgctaggatgggctccagccacctgcaaccctgaactagaataagcagattgaaaaatgaatgaataggacgggtgtggtggctcacgcctgtaatcccaacactttgggaggccgaggcgggcagatcacgaggtcaggtgatcgagaccatcctagctaacacggtaaaaccccatttctactaaaaatacaaaaaataaataaataaattagccaggcgtgatggcgggcacctgtagtcccagctacttgggaggctgaggcaggagaatagcatgaacccgggaggcggagcttgcagtgggctgagatcacgccactgcactccagcctggacgacagagcaagactccatctcaaaaaaaaaaaaaagaaaaatgaatgaatagccaggcatggtggctcacaccgtaatcccagcactttgggaggctgaggcgggtggatcacttgaggtaaggagtttgagaccagcctggccagtagagatagtgaaaccccatcctctactaaaaatacaaaatttagccaggcatggtggcatgcacctgtaatcccagctactcgggaggttgaagcacaagaaccacttggacccagagagagatggaggttgcagtgagctgaggttgcgccactgtactccagcctgggaaacagaatgaaactatgtctcaaaaaaaaaaaaaaggaatgaatgaatgggccaggtgtggtggttcatgcttgtaatcccagcactttgggaggccaagataggaggatcacttgagaccaggaattcaagaccagcctgagcaacatagggagacctcgtctctacagaaaaaaaaaattgccaggcatggtggcacacacctatggtcacagctacac

SEQ ID NO: 2488 - DNA, 1026 bp, Homo sapiens
tcttaaatgtgtgtatagttcacatttatttcagtgtttgatattagaagtgttttaggggccgggcgcggtggctcacacctataatcctagcactttgggaggctgagtcgagtggatcgcttgaggtcaggcgttcaagaccagcctggccaacatggtgaaaccccatctctactaaaaaatagataaataaatactaaaattagccgggcgtgatggcgggcatctgtagttccagctactcggaggctgaggcaggagaatcgcttgaaccagggaggcagaggtttcagtgagctgagatcgcgccactgcactccagcctgggcaacagagcaagactacatctcaaaaaaaaaaaaaaaaaaaaaggaagtgttttaggtctttatttagaggtttggtggttttcatgaccagaactatgccttaggaacttaacacttgtttatattaattagcctatgataaaattggtttcattacatgtcatttcacttaaagtcgggattttcaagaacctatcaacattaaaatgaggacttctgtataatatagtaaatactaggcgatgggaattttccaactccattataatcttacaggatgaccctcatatatggtttgtcattgaccataacatcatgatgcagcacataaccgtattcaaacaaacatgccatataaagaatattgaggccaggcctggtagctcatgcctgtaatcccagcactttggaaggctgatgcgggcagatcacctgaggtcatgagttcgagaccagcctggccaacatggtgaaactccacctctactaaaagtacaaaaattatccgggcatgggccaggcgcagtgactcacacctgtaatcccagcacttggaaggccaaggcaggtggatcaccagaggtcgggagtttgagaccagcctgaccaacatggagaaacccatcgctactaaaaatacaaaattgtccaggtgtggtggtgcaagcgtgtaatcccagctactcaggaggct

SEQ ID NO: 2489 - DNA, 1068 bp, Homo sapiens
actgtaccattttagacataagcgtggtacttctactgtgtgttagaaatgtgatggtgtactttttaatttttgtagagactgtttctagctatgttgctcttgaactcctgcctcccttggcctctcaaagtgctgagattacaggcataagccaccagccacagcctgtactgtacttttataaaactaaaatttttttttttttttttttttgggagactgagtcttgctgtgtcgcccaggctggagtgcagtggcacgatctgggtttgctgcaacctctgcctcccaggttcaagcgattcttctgcctcagcctcccgagtagctgggactataggcacgtgccaccatgcatggctaatttttgtatttttagtagagacagggtttcaccatattggccaggctggtctcgaactcctgacctcgtaatccgccctccttggcctcccaaagtgctgggattacaggcgtgagccaccgtgcctggccaaaaatattttttataacctgtagtcagctctgtattcgtgggttccacattcatggattcaaccaaccgtggatagaaaatatttagtgagactctgtcaaaaaatatatatgtatatttagagaagaaaaacaattgccggatgcggtggctcacgcctataatcccagcactttggcaggccgaggcaggcggatcacaaggtcaagagttcaagaccagcctgaccaatatggtgaacccgcatctctactaaaaatacaaaaattagctgggcgtggtggcaagcgcctgtagtcccagctactcgggaggctgaggcaggagaatcacttgaaccccggaggcagaggttgcagtgagccgagatcatgccactgcactccagcctgggcaacagagcgagactgtgtcaaaaaaaaaaaaaagagaagaaaaacaatttttaaaaccacagctgtttttaaaatatgaattttaaaatagtacaatgtaactactatttacaaagctttgacatggtattaggtagtgtaggtaatctagaggtgatctaggttatatgcaaa

SEQ ID NO: 2490 - DNA, 1040 bp, Homo sapiens
ctaaggcctgtggtctttccactagacctcaaaactcataccattacattctcgttaatgtaatttgcaaaaaaaaaaaaaaaaaaagattaaatctactcagaaaatgaactgttttgaaaatttgttaaataccttgctttcttaatatatacctctaaagccatggcagccacttaaaactctgaatggtagaagcagtatggttctcacacacatactttccttcaccttatcctctgcttaaagcttttggacaaagaaaagaaactattttgaattttattgaaaacatagattatcccatttgactaaaataatctctatacagtaagatttttaaatgttcttttttaatggaagactggggcaaatggaaagagtgaacttgcttttacactacatttagaagactacagtaaagataatatttcacaaattgtagatgtattttcacattacttttaatggcaaaaccacagttactttggaaccgatctaataatttactgtcagttagcaatccctgtaggatattttgataatgaaagttattctgaagaataagtatcatggaaaaagactaattgtataatatatgttaagaaacggccaggcacggtggctcacgcctgcaatcccagctctttgggaggccgaggcaggcggatcatgaggtcaggagatcaagaccatcctgcctaacacggtgaaaccctgtctctactaaaaatacaaaaaaaagagaaaaaaattcgccaggtgtggtggcgggtgcctgtagtcccagctactcgggaggctgaggcaggagaatgtcgtgaacctgggaggcagagcttgcagtgagccaagatcgcaccaccgcactccagcctgggcgacagagcaagactccgtctcaaaaaaagaaaaaaaaaaagaaaagaaacaccctagaataaatgcttggtacatgatagtactgcataactactgtataaatgttgaattgctatcctatcacctatccatccacatcatccctgtgctcaactcca

SEQ ID NO: 2491 - DNA, 1039 bp, Homo sapiens
gttcacgccgcttgtcccattgatcctcacgacaagcctgggacgtaagaacggcggattcgtaggcatttttcatccatctcggttttgtggatgaaaagactgaaaatggaagacttgccaaataaggaaaatatgtggcgtggcctgctggtcccctgacagctaattgagaggccttaactctccagaggattcgggccttctgtgttacatagagaatgctcatctctcccaggctactcctaatatgctagggattgtgtggaatgctttacaaacattacccaatttcatcctcttggtaattctacttggttggtattatcgctgttttaaaaaatgaaataagaacgcgtgactaaatgctagggggattctaatgcgcattcggttgcctcttccagagcacgtgtttgttttttgtttgtttgttttttgagactgcacgtgtttgttttttgtttgtttgtttgtttgttttttgagactgagtctcactctgttgctcatgctggagtgcagtggcgcgatctccactcgctgcaacctctgcctcctgggttcaagcgattcttctgtctcagcctcccgagtagctgggattacaggttcccaccactacgcctggctaatgtttgtatcttttttagttagagacggggtttcaccatgttggccaggcttatctcgaactcctgacctcaggtgatccgcccgccttggcctcccgaagttttgggattacaggcgtgaaccaccgtgcccggccagagcacgagctttttaacctctgttgaggaaacggggaccggtcacggtagctcaggcctgtaatcctagcacttcgggaggctgaggcgggaggatcgcttcagcccagaagtttgagaccatcctgagtaacatagtgagagccccccgtttacacacacacacacacacacacacacacacacacactttttttaaattgaggaaacggtgagttgaacatgagcaattattccttatatatagtatttccttagtttttctt

SEQ ID NO: 2492 - DNA, 1033 bp, Homo sapiens
gtgctgattgatacttacctcacactgagccttttttccccccacagacttatcactgaaccatttcactgggaaagtaaaaggaccacatatttcttggccgggcatggtggctcacgcctgtaatcccagcactttaggaggctaaggtgggcggatcatgaggtcaggagatcgagaccatcctggctaacacggtgaaaccccatctctactaaaaatacaaaaaattagccgggcgtggcggcagccacctgtagtcccaactactcaggaggccgaggcaggagaatggcgtgaacccgggaggcagagcttgcagtgagctgagatggtgccactgcactccagcctgggcgacagagtgagcctccgtctcaaaaaaaaaaaaaaaaaaaaaagaaggactacatatttctcaatgaaaatacagtgtacaatgttttccatgcaggtgtaaatactaactcatgttctgtttcagggtgggagatggaataacctgtagaaagaatctttagatttgtttaaattatacacaaatgataagagatctttctgaaagtattgactttttggcgggggagggaaggggcctgatagaacaaccaacaattgtacactttaagtttacatttagagttcacattaaaagttcatttacaaggcatctgtttgaaattcgtgaggatgagctgggctgggtggctcatggctgtaatcccagcccttgggtggctgaggtggacaggtcacctgaggtcaggagttcaagaccagtctggccaacatggtgaaaccccgtctctactaaaaatacaaaaattagctgggtgtggtggtgggcgcctgtaatcccagctactgggaaggctgaggcaggagaattgcttgaacccaggaggcagagggtgcagtgagctgagatctcaccattgcactccagcctgggcaacagagcgagactccgtctcaaaaaaaaaaaagaataaatcacaagaaatggttccttcactgttatactttaacatga

SEQ ID NO: 2493 - DNA, 2278 bp, Homo sapiens
ttttcttagttcctgtttttttgttttttctttacagcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtaagtaaaggatttgatacatattctaattttgttttttcatttgtttgttttttgagacggtgtctcactcagtcgcccaggctggcgggcagtggcacgatctcggctcactgtaacctccacctcccgggttcaaacgattctcatgcctcagtctcccaagtagttgggattacaggcgcatgctaccacgcccagctaatttttgtatttttagtagagatggggttttgccatgttggccaggctagtattttgtcagtccaagcagttcattaaaaaaaaaaaaaacaaaaagagcaagaatataaatactgcatcttccagcctacttttacaaagggttcactcttgggtccttaagcttagtggttacacttaggatttatttttaattttattttttaactttatgtttttttagagacagggtcttgccctgtcacctagtctagagtgcagtggtacgatagctcactgcagcctcaactcctgggtcaagcgatcctcccacctcagcctcctgagtaggcaggattataggcacgtgccaccatgcctggctaattttttattttttgtagaggcagggtcttgctgtgttgctcaggctggtctcaaactcctggattcaagtgatcctcctgcctcagcctcccaagtagctaggactacagccacatgctatgacaggctgattttttaaataatttcttttaatcctccaaatggtttgttaaaatttttaacatttttaacatttttatagagctggagtttcctggatgggtgcagtggctcacacctgtaatcccagcactttgggaggcctaggtgagtggatcatctgaggtcaggagttcgagaccagcctggccaacatagtgaaagcctgtctctactaaaaatacaaaaaacttagctgggcatggtggcgggtacctatagtcccagctactcgggaggctgaggcgggagaatcgtttgaactcgggcagtggaggttgcagtgagccgagattgtgccactgcactccagcctgggtgacagagcgaaactccgtctcaaaaaaaaaaaaagagagagatgggtttccctgtgttgcccaggctggtctcaaattcctgggctcaagtgattctcttgccttccagaatgatgctgggattatacatacgaaccactgtgcccatccagatagttttttaacttgagatgaaaagacatttttaacttgagatggcagaattgcacatttgataagtgcttttttttttttttttttttttttgagatggagtctctctctcacccaggctggagtgcagtggcacaatctcggctcactgcaacctccgcctcccgagttcaagcaattctcctatctcagcctcctgagttgctgggactacaggcgcacgccaccatgtctggctaatttttttgtatttttagtagagatggggtttcaccatattggttaggctggtctcg

SEQ ID NO: 2494 - DNA, 1050 bp, Homo sapiens
gcacccagccaagtgcttaatttctatctaattagcatgccacaatttattagtatttgtaagttcctggatggcagggatcagatgttgcctttatattctatggcgtcatccatgcagtacattctttaataatatcaagttaatctaattgtatgtatttgttgttaattttacaaataagccagatatttagtcccttggaatgtgatgggagagagacctagagggtcgagtgtattcaactgctgctgaaatgtagactgctttttgtttagaattcccacagctgctgctgctgctgcttttttttttttttaagagagaggagggaggcaggtctcatggtttcccttctcagtgtttgtgtcaaccattcatcagtcatctttgaaagaacctagtaacactcatttttcatcttgctgtattttttcccttctaggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatc

SEQ ID NO: 2495 - DNA, 1054 bp, Homo sapiens
ttgcgacagtcgggtgccgggataagtgcgggccatttgcctcctcctgttccccacgcaacacccccggcacccgcccctttgttctggcgggtgttagtacttgcagggacctttcacatccaggagttgactcattcgccaaaggagcgaagttgcttccttcactgtgccgttttgtagtgagtgttggaaaggagttgttttaacaactgtctacaaagtgattattttggttgtccccggtggttgcagatctgtaaattcaataactacatctgctgtagttcccaatcgtttctcagcttttaaatttttctatcgatccatgttaaaacttaagttgcagtattcaaactgttttccagagcaataaatggtggttgaatttagcactgcagtagccatgtcggctacaactcttcccatctcttgacaaagcatctaggcttagttgttgcccaatgttgtattgcaccatccaggtttaagtaattaaatataagaaaaaacgtatgaggaactccgcatttcagcttcctttcttggaaatcacatgtacctgtttctgatcggattaaaccatttgtttgctagagcatgcgggctttaggatagtcgtacagagtatatgttcagtgcagcttcatttttcattgtggactggcatcctgttgtagtggaaagggacaaaatttggaatcagatttcctggtcagctagctctttgcttgcacattatttccctaagcctcagttttctgatctttaaaataggaaatgtttatttcctagatatgcacaatgagaatggtgctgagcaccctagcacagtgcctgccccatagctaatgttcagtaaatattgctctgccttcgtgtccccaccctccccaattgagcagcagtttttactttgatgatatctaacgacaagatttctgagttttagtaggtttggggagctgattgaaagggcagcatcacttgcctaagttttgatgacctctatgcccctcttgtgatataaggaactagagcaagcttgtccaac

SEQ ID NO: 2496 - DNA, 1029 bp, Homo sapiens
tatgggaaagttttagaatctttatccttggtgttttgaaattttacagtgctgtatcgctgtgtacttttttttttttttttttttgagacggagtcttgctctgtggcccagactagattgcagtggcgtgatctcagctcactgcaagctctacctccccggttcacgccattctcccgcttcagcctcccgagtagctgggactacaggcgcctgccaccatgcctggctaattttgtttttgtatttttaatagagacagggtttcaccatgttagccaggatggtcttgatctcctgacctcgtaatctgcccaaagtgctgggattacaggcatgagccactgtgcctggccctctgtgtactttttaaaaggcctttcttgtttgttttggacatctgataggctctttcaatatgggaaattttcttgtattctttctttgatgtttcttccccatcttttttccctccttctcttcctacaacatccactaactagacaattgatctgctggattgatctgccaatttttcctttttcttagttttatctctttgattttttttctgctgtttttattatttcccttgctttttcttctgaattttctttttttcttttttctttctttttgagatggagttttgcacttgttgtctaggctggagtgcagtggtgctatcttggctcactgacacctccaactcctgggtttaaacaattcttgtgcctcagcctcctgagtagctgggattacaggggtgtgccaccatgctggctaatttttgtatttttaatagagatgaagtctcgccacgttggccaggctggtctccgactcctgacatcaggtgatctgctctcctcggcctcccaaagtgctgggattacaggcatgagccactgcacccagccttcttttgaattttctaacaaatgtagcatttatgctaaaatgatgatttttaagaggtttttattctcttggttcatgtttgactcctagttctctgcgaatact

SEQ ID NO: 2497 - DNA, 1254 bp, Homo sapiens
ggcccggttgctagtagaacatgaaagtggtaatgcttgggccctgctttcatctcaagagttgctcatagtccagtggtagagacaacatgtaagccacagcagcaggaagaagagctgtggaaggaggctgtgcaactgccctgggctgagaggccagcttccccaacgaggtgccctagagccaatcacaaaacctgagtaagaagttactgctttgatggagtggtgggatggggagaagaggttccaggcatagaacagtatgtatctggctagagaatttaaaggtttttttttctggacataggtgttttttgttttgttttgtttttttttaactgagctaggttgtttttgttttgttttgtttttatttttttaactatagcctaacataggttttaagttgtacttcccccaactccccacccccagtcactcttttttagtgaaaaagtttggacatgaaagatcctaatatattctttcctttgggtatgaatgattgtcttttactcaaatgattgttcctttgtgaaccttagggacgcaagtctggacaaaccaggctctgtaggaacattcctgagaaaacattagtgacattcatttcttctttccacagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaat

SEQ ID NO: 2498 - DNA, 1073 bp, Homo sapiens
aagcgattctcctgcctcagcctcccaagtagctgggattacggctagctactcctggctaatttttgtatttttagtagagatggggtttcaccatgttggccaggctggtctcaaactcctgacctcaaacgatctgcctgccttggtctcccaaagtgctgggattataggtgtgagccactgcgcctggccatgtagatgacttttgaccaaaatgtttcaccttctcattcagatattcttagtaaccaaaacagtgactcatgcagttgagagagcctttgggctgtcagtttacagtacatcaggcttgctgaggctaagcaaatcagaaaggtgccatgtttataacagaggtcaaagctccttacttctgaaacattagctgtggttaaaaacaaaaactcttccttcttgtattgcttgtctatcaaagccaggaaagtgggggatcactgtagttaaattttttttttttttaattagagacagagtcttgccctgtcgcccaagctggagtgcactggcgcaatcgtggtacactgcagccttgaactcctggactcaagcagtcctcctgcctcagcttcccaagtagttgggagtaggtgcacaccaccatgcccagcgaattttttgtagagacagaggtcttgctatgttgcctaggctggtatcaaaattactggcctcaagcgattctcctgcctcggcctcccagatgttgggattactggtgtgagccaccacgcccagctcaaaaacaatttttttaggggcacttctacaaatcatgaaagggggataaaagcactgactttaaaaagccatgtttaagatgctataaatgttctccccttttcattgattggagagttgtagaggaccttagagatcattttgtctaactccctcatcccaaagataaactgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatc

SEQ ID NO: 2499 - DNA, 1076 bp, Homo sapiens
aatcctctggggtagctttatataaatttgccaactttctgggacagagtaataggatttacccgtgttagttggtaattttctattttaccaggtacaataatcaacttacggtcatacttgctgattcaaacagcagagaaaaaaaataaacttacagtcattcttcttttatccattacctaccaccttctttgccctccactgccctccattttgaagcaaatcccagaccttgttacatctgtcatattttagtatgtttctctgtaagataagggttcttaaaacacatgcgactagaggagcagtgtcacacaaactggcaattccttagaattaagtatctaggccaggcacagtggctcatgcctgtaatcccagcactttggaaagacaaggtgggaggatcacttgaggccaggaggtcgagacacccctaggcaaaatagtgagaccccatctcttaaaaaaaaattagccgatataggcacctatatagtcctagctacttgggaggctgacgtggagggatggcttgagcccaggagttcaaggttacagagagctatgatcacatctctgtactctagcctgggtaacagagcaagaccctgtctcttgaaaaaagattaaaatttgttgtggaggtttccctctacaaaacttgagtctgttttacaattagagcaatcaggccgggtgcggtggctcatgcctgtaatcccagcactttaggaggccaaggcaggcagatcacttgagggcaggggttcaagaccaccctggccaacatggtgaaacttcatctctactaaaaatacaaaaatggggcacggtggctcacgcctgtaatcccagcactttgggaggccgaggcgggtggatcacagggttaggaattccagaccagcctgaccaacatggtgaaaccccgtctctactaaaaatacaaaaattagccaggcgttatggcgggtgcctgtaatcccagctacttgggaggctgaggcaggagaattgtttgaacctgggaggcagaggttgcagtgagccgagatcgcaccactgcactc

SEQ ID NO: 2500 - DNA, 1045 bp, Homo sapiens
ttaagttttagatttttttggaaaagagaagtcattaaatgatgtaataaaataccagtttttcttttgcttaagtggaagagaattagattgtattttatttattattatttttgagatggagtcttgcactgtcgctcaggctggagtgcaatggcgcgagcttggctcactgcaacctccgccttccaggtccaagcgattctcttgcctcagcctcttgagtagctgagactacaggcgccggccaccacgcccagctcatttttgtatttttaatggagacggggttttgccatgttggtcaggctggtcttgaactcctgacctcaggtgatctgtctgcctcagcctcccaaagtgttgggattacaggcgtgagccactgtgcccggccagattgtattttaaaaaaaaatctgtactcttagatttgttaagactgagaaaatttctatacctggtcctgggaattggcatggaactctaaatgtagatgaataaactgactaaattagctaaatctgctgttaaggtatagctgtatttaaagaaaacaagtagaaaaacttcttccttctctttcctgttaatcagaggaagctgcaaaccatgattttctaagccgtgagctatggaagcaatacctctcacagctacactcaccattagtcggctgccaaatacttatttttcacatttgaactttatttttgaacaaaatagggcatgcaattcctttgaaatgcaaatactcctaaaatttttctaagtttatccatgaatgcacagtggcccttaaaaagacgatcccaggccaggcgcggtggctcacgtctgtaatcccagcactttgggaggccgaggcaggtggatcacgaggtcaggaattcgagactagcctggccaatatggtgaaaccccatctctactaaaaatacaacaattagctgggcgtggtggcgggcgcctgtagtcccagctacttgggaagctgaggcagaagaatcacttgaacccgggaggcagaggttgcactgagccg

SEQ ID NO: 2501 - DNA, 1057 bp, Homo sapiens
gagtgcagtggcgcgatcttggctcactgcaagctccgcctcctgggttcacgccattctcctgcttcagcctcccgagtagctgggactacaggcaaccaccaccacacccggctaattttttgtattattattattatttttagtagagacggggtttcaccgtgttagccaagatggtctcgatctcctgacctcgtgatctgcccacctcagcctcccaaaatgctgggattacaggtgtgagccaccatgctggccttttttttttttttaaatacagacacagtctcattatgttgcccaggctggtctcaaactcttgagctcgagcaatcctcccgtcttggcctcccaaagtgttaggattacaggtgtgagctaccactcctgaccccaagacaatatcttaactgtaaaaattaaactctaccatattttaaaaagctgagatagtataaatgtttataataaaacataaaaccaacatttctcacaagtctttgtaactagtagagactgtagttgttctgtccagatataagtgtggtatatcaacttggcacttagcaacattgatatttaatttgttaaatttttgttaggaagaggtgttttcagatctcaggtgtctttgggaaggaatatttttatatttatatctccagcttcattcctagcttttctttggaacactaaaattgtccagctggacttgttgggcctgggtgggattgggagaattcaggagagcacagttcttgggccagaacagttggtcagctgattgactctaggcaagtcatttaactttcgcagcccctcaggcatgtcatgtttaagtggggataatgacattggcatacctgcttgctagagttaatgtgtgggtcatgagataacgaatataacaaatatttggaaaagtactatgttgaaatattttaaaataaaatttaaatccctcttcatttagaaaggatttgaggcagctaaatgcagaggtgtaagatggttttttggttaggattgtttctgagctgtgactctgtagtca

SEQ ID NO: 2502 - DNA, 1033 bp, Homo sapiens
gactaatggtgtgtgtatataaatacataagtaagtgtatgtatagtcctacatatatgtatgtctatatacattttttgctatttggatgttttcttttgtgaagtgccttttcaaatcttttgcttgttcctcctcttttaagattgtgttgccttttggccgggtgtggtggctcacacctataatctcagcactttgggaggccaaggtgggtgggtcacctgaggtcaggagttcgaaatcagcctggccaacatggtgaaaccctgtctctactaaaaatacgaaaattagccgggcgtggtggcgcatgcctgtaatcccagctacttgggagtctgaggcaggagagttgcttgaacctgggaggtggaggttgcaatgagctgagatcatgccactgcattccagcttgggtgacagagtgggactctgcttaaaaaaaaaaaaaaaaaaaaaagaaagattgtgttgcctttctattattgatgtgtggaattctgtgtatattctggatgtgagtcctttgttggatgtatgtactgcaaatttattttccctctgtgtggtttgcttttgctctcttaatgttgtcttgatgaacagaagttcttaatgaaatccagttcatcagttctctttatggtttgtgctttttgtgttttactttagaagtcatttctcgtcctcaagggcataaatatattcttctgtgttatatcctctggaagtttcaacgttttgcctttcatgtttatgtctacaaccattctgtagtttagttttctgactggtgtgaggtaggggccacagttcattgtttttccatgtgaatgtccagttgacccacaccacagggtaaagaaaatcctttcccccctatcttgcagtggtgttgttataaattagagcactgtatatgtgtgggtatgtttctaaactctctgctcaattgctgtattcacatatctttatgtcttaactggcaaaagtttgtgctgataccatactgacttacttgctgctgtaa

SEQ ID NO: 2503 - DNA, 1027 bp, Homo sapiens
atctttacttccatggagcttatattcttataagcttacacaaacttatattctagtcttgtattgtgtctcctagggaagaccagcaaaaagaaataaataaacaggaaatgcatcaaaaagaaagaaacaggaaatgtatcaggtggtgtgacggtatgatggtatgacgtgctaggcagagaattaaagaaggaccacatgacatagtgcgtgggaagaccctgtctactgaatggccagggagggcctctctcaggggtacccttgaggctgagatctgaatgaactactctcgtgaagatcagggtaaagagcattccaggcagagggaacagataatacaaaggacttagggtaagaacgaactgacttttagaataaacaccctggttagctaaagccaaggcattaaaaggacacaatgaagaaaatgcctctaagggagatagaaccgaagggagatcatagctggttgtggagccaaaggtaaattattctttaagatgtactagatacttattggcagctgctaatagcaaaataaaaaaggtcctgttgttcacaactgaggcacaaaagtacttaggaatgtagggagcagacaccccctccacatttcacttggagccatgcggtctgtgtcaagatggcctgtgtgaagagccaccagttatagttcatgtgggtttccattattctttgggccttcactttgcccaaggcacacagttaatataaccacaagaatgtgaacacttttatttgttctgaaatatgcttttaacctttacagtgggaaaggcccttaatttatctattccttattattttccagcctcatattttctatttcctttctgtgctccctgaaaaacaagatgccatgtctaaaatcctgtgtgcctttgtgcagggcaaagccatgtcctcgtgcacagtcatggggtatggccgagggttatgtaacaagagctgttcctagtgcagttggctcctgcaggagaccatgatgtggcaactacaa

SEQ ID NO: 2504 - DNA, 1059 bp, Homo sapiens
ttccttgacctttgggagtttgattattaaatgccttgatgtagtcttctttgggttaaatatgcttggttttctacaacctttttgtacttgaatattgttatctttctctaggttttggaagttctctgttattatcatcttgaataaactttctacccccatctctttttctaccttctctttaaggccaataactcttagatttgcccttttgaggttattttctagatcttgtaggcatgcttcattcttttttattttgtctcctccgtgtattttcaaatagcttcttctcaagcttacggattcttttttctgcttgatcagttctgctattaagagattctgatgcattcttcagtagatcattgcattttttaactccataatttctgcttatttttaattatttcaatttttgttaaatttatgggataggattctgaatacattttctgtattatcttgaatttctttgagttttctctaaacagatattttgaattccgtctgaaaggtcacatatctctgtctctctgggattggttcctggtaccttatttagttcgtttgctgaggtcctggatagtcttgatgtttgtggatgttcatcagtgtattactctgttttcatgctgctgataaagacatacctaagactgggcaatttacaaaagaaagagttttattggacttaaagttccacatggctggggagggttcacaatcatggcagaaggcaaggagcagcagcaagtcacatcttatgtggatggtggcaggcaaaaaagagcttgtgcagaaaaactcccccttataataaccatcagatctggtgagacttactgtcacaagaacggcatgggaaagacctgcccgcatgattcaattacctcccactggatccctcctacaacatgtgggaattcaagctgagattttggtggggacacagccaaactgttatcattccctccctggcccctcccaaatctgatgttttcacattcccaaaccaatcatgccttcccagcagtcccccaaagtctttttttt

SEQ ID NO: 2505 - DNA, 1077 bp, Homo sapiens
acataactattttaatattattaagttgcttaaagagtcactgaggtacatggttctgggtgggggtctggagagtgcagcagccatggccagccacattgtgctcaacaatggcaccaagatgcccatcctggggctaggcacctggaattcccctccaggccaggtaactgaggctgtgaaggtggccattaatgttgggtactgccacatcgactgtgcccacgtgtaccagaatgagaatgacgtgggggtggccattcgggagaagctcagggagcaggtggtgaagtgtgaggagctcttcatcaccagcaagctgtggtgagcgtaccatgagaagggcctggtgaaaggagcctgccagaagatgctcattgacctgaagctggactacctggacctctaccttattcgctggccaaccagcttcaagcctgggaaggaatttttcccattggatgagccaggtaatggtaatgtggttcccagtaacagtaacattctggacacatgggcgggcatggaagagctggtggatgaagggctggtgaaagctattggcatctccaacttcaaccatctccaggttgagaggatcttaaacaaacctgacttaaagtataagtaggtggttaatcagattgagtgccacccgtacctcactcaggagaagttaatccagtactgccagtccaaaggcatcatggtgactgcctacagctccttcagctcccccgacaggccctgggccaagcctgaggacccttccctcctggaagatcccaggatcaaggcgatcacagccaaacacaataaaactacagcccaggttctgatctggttccccatgcagaggaacttggtggtgatccccaagtctgtgacaccagaatgcattgctgagaactttaaggtcttcaactttgaactgaacagccaggatatgaccaccttattcagttacaacagaactggagggtctgtgccttggtgagctgtgcctcccacaaggattaccccttccatgaagagttttgaagctgtggatgcctgcttgtccccaagtgacctata

SEQ ID NO: 2506 - DNA, 1071 bp, Homo sapiens
gcaaaggaaatggataagaagggttgaatttgaaacactttgtaatacaagaataagcaagacatgaattgatattagaccagtcgctgctccaatgtatgtgatgttctggaccataccccacttcctgtcgtattttccacattagcatagctaagttctgcaactcactcaccactgcattagcctcacttatagccctttctttggaaataatttcactgacagcatagttctttgagaacttagcggacaacttttaaaaaggatatttttgcacatcattattgctgacactattattattcatgttttaaaagctattttattataaatctcagcttgagttttgttcaattctgctctttaaaagaaagttacaatacacagaacaaaggcattagaaaaaagaaattttcaagtttctattgcatagagaagtatacagtccccataaacattccaggtctaatttgtccttgaacatccttagaataacggtagacttaaagacaatattatgcctggcagtatttaggacagcaaggcacttcttgattttggacaaacaggatttaagttttgtttgggggctagaaaaataaataaccagttctatcacaaaccctttatgccggagtagacaatatttcactaaaagacagagaaaaagtgctgatgtaaatccttcctttttgggaagctgattctttttgtcatggaagaaagactggtaaaaatattcacatttgcagtcatcaggatggcaaaacttgaatttgatgcagaaatgcatttatcatttgatatattttttctggctgcatgattcagcattttgatttgcattgaccattttggaaaaatgaagcatttcttggttgtgaaataatttgtaatttgtttctttggaatattccagtttgtggcctagttgactatgtagtgttttccccagacttagtgtaagataagaaaatgagaatctcagcaatgcctaatgggttggcccagcattaagtctatgaggataggaccaagggacatctttaggaatgggaacgacacagc

SEQ ID NO: 2507 - DNA, 1030 bp, Homo sapiens
ctctgctacaaatagtgaggtcatttgcatgagtaaccaactcagatctgcagggttggaagtggttgctgtttgggatcattcatagccagagtgtctgcatcttaacagggttagctgagggttgcctgcatttcttaatgacacttggaatctgcttaactcccacaaactggtcactgaaaactctaaatgcacagctagatcctgaactggtttctgaatacaaatccagggcataatgatcagactcgcaaatatttttaatttggcatagaaagagaagcaaacagggacattcttgcatatgctaaaataaagcccaaacaaaaaactaaaaaatatatctaaagattaggctgatagactgtaatggggccaccaccatttctgtgtgcacagtgtcctgggcattaaaagacttgagaatcttggttaagatgatccctgctctagggcatggggattgaagactaatcttgaggtctcatgggatcgacataaactgcctgtaggataacgtccaaaccgctcaatttggggttggaagcctattacaacatagcattgacctacctctccagccggtctcccacaactccccatctcacagccccaaccccacaggtagactttattgcaccgtagatatgtctatttattctttctacaagcagagccttcttgcctcttggatctaagttttccatgtgctgtcactgacgagcctgggtctcatcatcagcaactctgctcactccaacctaccacaggctcctacaacctggcaaacttgtgtgggttgtttgttcttctccaggtacaaacctgtgttcttacacacttctgtgtgcctgtgcctggactttctaagtgaagcaggggtggatggagaacagggctcttggtgtccaatatatgtgttcacgggacttaggaggacatggtggacacgtgttgagcgcatgactgatggtggctctcagactgaccatgaaagcagaaaaaagtcacctctttggtagcctca

SEQ ID NO: 2508 - DNA, 1032 bp, Homo sapiens
attcaaattttaaacttaaattttattcaaattttgtagctcccacatataagtgagaacatgatatttatctttttgtgcctggcttatttcacttaagataataacttccagttccatctatgttactgcaaatgatgtgatttcattcttttttatggctgaataatatttcattttgtatatatgtaccacattttttatccattcatccatcgatgggcacttaggttaattctgtatctttgcttttgtgaatactgctgcaataaatgtgtgagtgcaggtattccttttatatattgatttcttttactttggttagatactcagtagtgaattgctgaattgaatggtaattgtatttttagttttttgagaaatctccctactgctttccatagtggctgtgctagtttacatacccactaacagtgtataagagttcccttttctccacatccttaccaacatctgttattttttgactttgactttttattaatagccattctgactggggtaggatggtatctcattctggtttttgatttgcatttttctggtggtggtgagcatttttttcaaatacctattggctggttacatgtcttcttttaagaaatgtctatgcttgtcctttgcatactttttaatgggattgtttgtgcttttcctgttgagttgtttcagttccttgtatattatggatcttggttccctgtcaaatgaatagtttgcaatttttttctcctattgaacaggctgttttttcactctgttgattatttgttttgctgtgcagaaactttctagtttaagtccgatttgtctatttttatttttattgcctgtgcttttgaggtcttagtcacaaattatttgcctagcctaatgtccaggagagttttccctagttttggatcttatgtttaagtctttaatccattttgagatgatttttgtatatggtgagagatagtggtccagtttcattcttctgcatgtggctgtccagttttccaggcatca

SEQ ID NO: 2509 - DNA, 1040 bp, Homo sapiens
gatagatgcagaaattctcaacaaaattctagcaaaatgaattcaacaacacattaaaaaaattattctccatgatcaattgagattcttcccagggatgtaaagatggttcaacatacacaaatcagtgaatgtgatacatcacattaactgaaccaggaacaaaaatcatatgattatttgattagttatcaaaaagcattttataaaattaaacatccttttatgataaacatcctcatcaaaatgagtatagaaggaacataccacaaaataataaaggccatatatgacagacctacagccgacatcagggaaaaattgaaggcttttccactaagaagtagaacaagacaaatatacccactttgccacttttatttgacatacttctggaagtcttggccagagcaactaagcaagagaaagaaaggtcatcccaattggaaaggaagaaatcagattaaccttgtttgcaaatgtcatgatcttatatctagaaaaatataagggcgctaccaaaaaaactgatagaactgataaatgaattcagtaaagttgcaagttacaaaatcaacatacgaaaatcagtagcatttatatacaccaaaagcaaacaatctgaaaaagaaatcaagaaaggaatctcatttacagtagctacataaatataaaatacctagaaatcaatctaatcaaagaaatgaaagttctatacaagaaaactatgaaaatttgatgaaagtaattgaagaggacacaatgaaatatatattccatgctcatggatcagaagaattaatattattaaaatgacaatactacccaaagcaatttacatattcagtgcagtccctagctaaataccaatgacatcctgcacagaaatagaaaaaacacttctaaaatttgtatggaaccacaaaagattctgaatagccaaagccctcctgagcaaaaagaacaaagctagagacatcacactaccagactttaaaatgtactcccaaactatagtaaccaaaacagtatgatactgg

SEQ ID NO: 2510 - DNA, 1045 bp, Homo sapiens
aacaactgagaaatcctaggaaagcaaaaggtatcatttgtaacagtatcaaaaaataggtacattagatacatagaaatactttttttttttgaaacagagtctcactctgtcgcccagactggaatgcagtggcacgatcttggctcactgcaacctccgcctcccaggttcaagcgattctccaacctcagccccccgagtagctggggttacaggtgcccactaccacacctggctaattttttttgtatttttagtagagatggggtttcaccattttggccaggctggtcttgaacacctgacctcgtgatccacccgcctcggcctcccaaataaatacgattttttaaaatgatgtaattatgacctttatgagaaaattataaagtttaattgagaattcaacaaaatttatatagaagagcaaagggccaagaatatgtaaaacactccttaaaaagaaaatctgataatcttgacctacaactataaaaaacttattataaagctatcataactaagaagtgtgctgtagaaacaaggatacacaaataaagaataaagaacccaagaacagacaattatattcattttaagtgaacatagacttggcgttataggttagtgaggattgagtgggcatgttcaataatggtgctgtgacaattgtatatccttattgggtgggggcaggggaagaaatggagtctgtctcttacactataccaaaaagtcaaggatttaaagacttatgtattaattaaaagacttgtaaaaggtaaaactttatgttaggaaaacatataagctcattttgttattaccttggactaaggaaagatttcttaagaagccataaacaatacaaaccataaaggaaaaggtagataaattatattaaaattagtaacttctgtttataaagacatcaagaaagtgaaaagataattccaaatcagagatacaaagtgacattttgattgctgctcaaaatgtgtaaataactactacacattgttaagaaaatggcaaaaaattc

SEQ ID NO: 2511 - DNA, 1140 bp, Homo sapiens
aggtttgtgtaagtgcactcttagatgtttgtgtgacagaattgcctaatgatgcatttttcagaatgtatccctgtcattaagcaatacatgactgtatttcttcctattttacctattaaatccataccacaaacaatatttaggtacacctttagttgtcttcatcctctgcctgaagatgggtatatttgatttctggaaggggcctgagcttccagaattctggccttcattgggccagaatgttttaatctgtggagtgcctagaccttacagatagctgtgtttgcaggctggacaaagcttcccctccaacagagtgaaaagtagaagtactctgagccttttgctatttttcttaggaaagaggaaagaaatataaggctagatagggatacaagtgttgggtaaagcaaggatttggccacgttaaggaattttgtcattatactttgaagataagagccgtggaaaggttctaagcaaggagttaatatgaggatttctgttttgtaaagatcactctggctgtatattgaagaacagattggaagagaacaagaatcgatatagggggaccatttatgaggctgtagatattctgaaggtagaattatcagttacggtgatgggttggtgagagagaaggaggtgtcaaagatgatacctacactttgggcttgcttaaaataatgaatagtggtcccattcactaagacaagaagtcctaaaaaaaggtcaggagtttagaggaaggatcatgagttcaattttggacatgttgaatttggggtacctttgacacatgccagtgatgtctaggaggcagttgaatatatgtgtcaggagctcagagaagttagggctgaggtgttgtatttgggaataatcatgtgtgtggatgtttaagccatagtcatggatgagattgaccagtgagaatgtataaagtgagactaaaacagggccaaggaacagtagcaattacgagccaggaaaaggacagctgcaaaggacatgggattggtcagagttaagctgaataggatgacaagaaagacagagtgtgaggtgtcacaggactcacccaaaggaaacaactgtatccaaaaggaggagtggtctaaagtatcaaat

SEQ ID NO: 2512 - DNA, 1273 bp, Homo sapiens
caagttaactggacagacaataggatttttggtttgtgttcaggatccatttgtggttaattaaaatgaattttgggggttaccaatccacgtagggcctctttcaaatagcactaggatgtgcagatgtaggcacaaagaacacatagagttggttttatccaggggcagcgttttgccatacaggtgaggccaacagaaagtgggagtttcggatattggcaagagtgctgtggaaagacataatctaagctggataaagagaaaggtgaaataaaatagagggatgatggattgtaagaaaggaatggggcaatggactggagttcctgatgagcttaaaaaatggtcatgttgggagaattaaacaagctgagaggatggagggcaagtgatgacaagcactattatgtaattgtgaatgtggttgattgatgtagacttagtgatgggaggacatctagaaaatgggggaggagagcacagctttagacagggtcttaattcatgaacactgaagtcatccatgtgatggcagatttagtatggagaaagttggctctcccgtgagccagagttccagattgagtgaccaggcaattggtacttatcaatgaagagtggaagaatatagtggaatcaaaaagcatgagcttctaaggaataggattttttttatttattaaagaaagagggcaagttgttatgatttggaagtggtgaatggagagtaaggagtgttaaaacaagctcactttccaatcttgaggtaaatggagtgtgggaatataaacagcctctaaccagagggttgcatgtcagtagtgccatagggaataactaggtttcaactaaggtagagaggtcagagaaattcttggaatagagcttaaagatagaagaaagttttcacaactacctcaccaatctttccactaatgcccacatttttttcattgtgatctcctgaacagtcctcttgttttcttatctttctctcatccccagccaccctcctcctcattaccccacaattgaaagccttaccatcattcaacatttgatctttggaacaggagaggtctgtggtctcctgattatacaagtgggaaattatctctcttctgaattaggactattggttgaaataaaacttactgtttatttcatttgtatccctttgttttgtttgtaattatcgtgtcttttgccttactaaattgtagcacaatgccttgcactacagaaatatttgttcaatgaatgagaacaa

SEQ ID NO: 2513 - DNA, 1280 bp, Homo sapiens
aaatagaccttttgttacttttctgtatttatctctaaatattttctctgctcagttatcaaattacagttaataaacagggtcctcttctgtatttatttcatgtgaggattcacactttaaagatttagtataatattcaaaaaccacagttacttttgtatcaacctaataataaagttacctaacatttaccttagtaagcacttactgtgtgctttaaatgtattaactaatttaattcttgtaacaacctatgaggttcttactgtgacaattctcatttcaaaggtgaggaaagcaaggcagataggtaacttacaaagtaaatcatgtgactatgagtgttaaagcttgtatatgagcttggaacccaggcagtgggattcagcctgtgctcttaactaccatgctatactgccttatataatcattaactgtattgctgggtatgtggaattactatggtattatttacagctcacactagttattcagttaataatggttttattttcagattaccttagagaaagtataattcaacaacatatggtttctccagagccagcttcccttaaggagaaagggaagtcaaggagaaaaaaggatcaaactcatgcttgtccaaatgttaggaaagccaggcctgtgtcctatgatagaacaggtatgtggtatcactgaaccaattgcttagaaatcactatactttttcagattattctgtggtttgtgtgcttatattggacactgactttagaaaaaacagtcttactgaattttatgtgtttggttgcttaaggattattacaatgcttttaaaattctttttgaaaatctaaaatattatgttgaaaaattgacagagactgtttaatgactgttcttaactaagaacaatatctgaaggctatgattttagaactataatataaactgtatggttttttacatacaactgtagtaaaacttgatgatttcattttatttaacaattttatgcctttgcctgatagagtttaaatccccaaataaatagtttatttaaatagattttcttccactaacatcttctagtttgtgttttctctataactgaaattcttcttagtattaatattttaattttataaaagaaaggaaacttttctattttcactgaaacaccatggtacagaggtggatttatcataaagctattgaagcctaagcttcagggcctctcactcacacaggcttcatcccttcatcctttctttaaataaatatcctcaaaa

SEQ ID NO: 2514 - DNA, 1320 bp, Homo sapiens
taaatacaccctacagttgactctggaacaacgcaagggttaggggctctgaccccctacacagttgaaaatttgagtataacttttgactctacccaaactttgctattaatactaatagtctattgttgacaagaagctttatcagtaacataaacaatcaattaacatgttttgtctggtagatatatactgtattcttacaataaagtaagttagaggaaagaaaaaggaaaatcataagggagagaaaataaatttactactcattaaatggaagtagatcataataaaattccttcatcctcatcattttcacattgagtaggctgaggaggtggaggaaaagtagaggttggtttttgttgcaggaagtcagggaccccgaacggagggaccggccgaagccatggcagaagaacgtggattgtgaagatttcatgaacatttattagttccccaaattaatacttttataatttcttacacctgtctttactgcagtctccgaacataaattgtgaagatttcatggatacttatcacaataaatacccttgtgatttcctatgcctgtctttactttaatctcttaatcccgtcatcttcgtaagctgaggaggatgtatgtcacctcaggaccctgtgttgattgcgttaactgcacagattgtgtgtagagcatgtgtgtttgaacaatatgaaatctgggcaccttgaaagaagaacaggataacagcaatgttcagggaacaagagagataaccttaaattctgaccactgatgagctggaacagagccatatttctctttcaaaagcaaatgggagaaatatctctgaattctttttctcagcaaggaacatccctgagaaagagaatgcgtccctgagggtaggcctctgaaatggccgcttcggggggcggctgtattttatggtcaaagctgtagggatgaaataagccccagtcccgtaacgctcccaggcttattaggacgaggaaattcccgcctaataaattttggtgagaccggttgtctgctctcaaaccctgtcttctgataagatgttatcagtgacaatgcgtgcccgaaacttcattggcaattttaatttcgccccggtcctgtggtcctgtgatgttgccctgcctccatttgccttgtgatatcttattaccttgtgaagcatgtgatctctgtgacccacaccctattcgtacactccctccccttttgaaaatcactaataaaaacttgctggttttaccgctcgggggcatgatggaacctgccgacatgtgatgtctgccccggac

SEQ ID NO: 2515 - DNA, 1541 bp, Homo sapiens
gagataatagaaaacatgcaaataggtaaaatattgagtggagactaaatgtagttgaaggaaaataaaacagagtaagggagctggggcagcttgttgattcaagttcatgattaaaaatttatctagttttaaggtacattatgttacattacattatatcacatcacattaggattctcaagactctgattcttcacaaagtagttccagattgttgttcttttagtgtgtatctagttctataattttcttgtttcttctctaatgtctgcattttcttgtgatatgtttttgtccattggggactaggaaaacagaaaaataatattttaaattgtttatttaatatgtaaatagcttaaataactaaggacctgagaaactttttttttgtaagagaagaaggattttgtgacagagaaattaattattgaataaatgttatcatgtccctattttgtttcactggtgtaagaactggagatagaactgtgaaaaaatatacaggtttctgttcctatagaacttagattctaatggagggagatagataataataggtaaataaataatttcagatagtgatgaggcctagaaatataataaaacagagaactagagacgtctgtgtgcattgcttctttagataggttggtcagagatgtggcagtgaagcagagacctaaatgatgaaaaagagacagccatgtggggcttccagaaggagaatatagcaagtttcaaagttgtgaagcaggaacaagtttagtatggatttgatggtagaagtggtgttcctggaatgaagttggtaggaaatgaagctggttctgttattttctgggacctgtcacatgtagtgtagatgactgagtaacagttctgagaagtttctcgtcaaagataggtgatagttgcatccctgtaatttaggaactagaattggggctagataggtttttgattctggattatcaatttaagatattatccaaagtactattttctgtatctttttatttgaaactctgtcagtgtcagactttccactgttgtccttgccttctgataaatcctcagggtctgctctgctgtaaataattatcatttattaaactttttaagttcaactgcagatgggacaagaatcatctttttacatgacatttggcatcaatgtctatagtcaaaatgattcattttctttattcaagttaaaaatacaaattaaattttatatttacttaatttgtacttaattttatatttactgaagttgtacaattaatatagacttacttaatttttaaattttatgatttatttatttattattttttttgagacagagtcctgctctgtcacccaggctggggtgcagtggtgcgatctcggctcactgcaagctctgcctcctgggttcaggccattctcctgcctcagcctcccaagtagctgggactacagatgcctaccaccgcacctggctaatttttttttttttgagatggagtcttgctctgtcacccaggccggag

SEQ ID NO: 2516 - DNA, 1853 bp, Homo sapiens
tgcataagtaatctcacattggcaaacaagtatcacatctcagtgtttatttaaaggtggttgttttcctctagatgcaaaggctaccaagggagtgattgtgatattgcattagactagtcccacacgtgcataatataggtggccatattcatttagagttgagagagctttgcagaaacagttggcctgtctttttcaaaatgcatgacaattattgatgatgagtaataaccagggaaactttccaattctttctcatgtaggttctttgagttttaaaaattacaagtgcattttttacataagtattatataatatcaaaatgacatacattgccttaattttttacttaccactatacagactttttatcaatgtaccttttcattatcactgaaaattgaatcttgattttattgaaatatgaagtctcttttcgaagtaagccaataaacatataaaggaaaacggtattttaaaaataatttttaatatttattggaatgttgcagctaagtgaatcctgtatctatgagaattataaggactttcatttacatttaccttttgctctatattctgttgatagtttgggagaaaatttatatggcttagcatttcctttaggtaactcaggatgaatgaaatatgttctagagaatattctggtattactaagcttttactaaatttattccatataaatacgtggtttatggatatggaatataagaagcatttttcctttcagaatgaataaagcatttgttacctggaaattgaatgttaaaagaattaagacagagaagagcaggtaagttttgatacgcaatatataaaaatttcaaaaggaagctgtatgttttacatgtactatggaagcagatataatttcattttcattcagtgattagaaagtcacattccattgctttacgattaaacttaacccatttttatttttaaaagactattaaacactgtgttttgcagtgtaccattctatggtcatagaactatggaaaaccttgatgagttcccttggtcactttatctaacttcttgcttccaggaagaagaataattaagtcatttaaagtagacaacagtaatcttattttgttaggatctccatcagccaaatgttttttaaaattgtttttattaaactttttattttgagataatcgtggattgagatgcagttataagaaataatagagatatcccatgtaccttttacccagtttccctcccaaatgttgcaaaactacagtctatgatgacagccagggcattgacaatgatatataatcaagatatagaacactgctatcaccacagtttcccttgtgttggccttttatagctatatccaccttcctcttattcctactctctccttgacctttggcaaccactaatctgtttgccatttctgtaattttatcttttcaagaatgttcttttcaaagggaatgcttccagtttttgcccattcagtatgatattggctgtgggtttgtcatagatagctcttattattttgagatacgtcctatcaatacctaatttattgagagtttttagcatgaagcgttgttgaattttgtcaaaggccttttctgcatctattgagataatcatgtggtttttgtctttggttctgtttatatgctggattacatttattgatttgtgtatattgaaccagccttgcatcccagggatgaagcccgcttgatcatggtggataagctttttgatgtgctgctggattcggtttgccagtattttattgaggatttttgcatcaatgttcatcaaggatattggtctgaaattctct

SEQ ID NO: 2517 - DNA, 1160 bp, Homo sapiens
cagccaaaaaacacatgaaaaaatgctcaccatcactggccatcagagaaatgcaaatcaaaaccacaatgagataccatctcataccagttagaatggcaatcattaaaaagtcaggaaacaacaggtgctagagaggatgtggagaaataggaacacttttacactgttggtgggactgtaaactagttcaaccattgtggaagtcagtgtggcgattcctcagggatctggaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaaggatgagttcatgtcctttgtaaggacatggatgaagctggaaatcatcattctcagtagactatcgcaagaacagaaaccaaacaccgcatgttctcactcataggtgggaattgaacaatgagaacacatggacacaggaaggggaacatcacactctggggactgttgtggggtggggggagggtgaagggatagctttaggagatatacctaatgctaaatgacaagttaatgggtgcagcacaccggcatggcacacgtatacatatgtaactaacgtgcacattgtgcacatgtaccctaaaacttaaagtataataataataataaaaaagaatgttcttatgataaataacaataaatcaagaggagggaaggaaacttttggaggtgacagtttatggcatagattgttcacagatgtatacttatctccacatgcaccaagttgtatacattaaataggtacagctttttgcgtgtcaatcatacttcaattaaatggttttcaaaaaaagaatgctgtatctgcgcagcaaaggaaataatccacagggtgaagagacagcctgcagaatgggagaaaatatttgccaactgttcattctataagggattaatatgcagaatataaaggggactcaaacaacagtaaaaaataaataatctgatttaaaaatgggcaaaggattggaatagacatttc

SEQ ID NO: 2518 - DNA, 1032 bp, Homo sapiens
gtgttaaccaggtagtacactatggccttgggtgagactcaaacatgctggcttcaggtgagacccagcacattcacagctgtggtggctatagtgagactccttctgcttaagaaaagcagagggaaaagtaaaggggattttgtcttgcaccttaggtactatcttggccacagtgggatggaataccaagtagactcttggtgtccccgattccaagccttggttcttggatggcatttctggacctgcactgggacagaggagagcacactgccctgaagggtgagtcccaaacctggcaacgttcaccacaagctgactgaaaagcccttggtgaacatcagtggtagcctggaaggtactccctatgggcctgtggtggtggtggccacggggatttcctctgcctgtggagagaggaaggaagaatgggaaggactttgtcttgtggtttgagagccagctcagttgcggtagtatagagtgtcacatcaatttctaaggttttggactccaatccgtggctcccagacagcatctctggacctatccagggcctgggggatctcactgccattaagggaaggatgcaagcctggcaggctttgccacctgctgattgtggagccctaggttcttgagtgaacataggcagtagccaggtagtggttacaaggctttggtgagactcaggcctgttggcttcaggtttaaccagaaggacacaagcctggctggctttgccaactactgattgaagagtcttaggtccttgagtgaacatacatccgacccagtgcaatcacagtggtggtggccacagtggggcttgtgtcaccccacccccagctccatgtggggggctatgggagggatagcattaggagaaatacctcatgtagatgacaggttgatgggtgcagcaaaccaccatggcacgtgtatacctatgtaacaaacctgcacgttctgcacatgtatcccagaacttaaagtataattaaaaaataaaataaatagctgtattgg

SEQ ID NO: 2519 - DNA, 2448 bp, Homo sapiens
acatcccatgctcatggatgagtagaatcaatattgtgaaaatgaccatactgccaaaagcaatctacaaattcaacccaatccccaccaaaataccatcataattcttcacagagttaggaaaaacaattctaaaattcatatggaaccaaaaaagagtctgcatagccaaagcaagactaagcaaaaagaacaaatctggaggcatcacactgcctgatttcaaactatatcacaaggccatagtctccaaaacagcatggtactggtataaaaataggcacatagaccaatgaaacagaagagagaacccagaaataaacctgaatacttacagtcaactgatctttgacaaagcaaacaaaaacataaagtgggaaaggactccctttttaacaaatggtgctgggataattggctagccacatgtaggagaatgaaactggatcctcatctctcaccttatacaaaaatcaactgaagatggattaaggacttaaacctaatacctgaaactataaaaattccagaagataacattggaaaaacctttctagacactggcttaggcaaggatttcatgaccaaaaacgcaaaaacaattgcaataaaaacaaagataaataggggggacttaattaaactaaagagctcttgcactgcaaaaggaatagtcagcagagtaaacagacaatccacagagtgggagaaaatctttacaatctatacatctgagaaaggactaatatccagaatctacaatgaactcaaacaaatcagtaagaaaaaacaatcccatcaaaagtgggctgacaaaggactaatatccagaatctacaatgaattccaacaaatcagtaagagaaaaaacaatcccataaaaaagtgggctaaggacataaatagaaaattctcaaaataagatatacaaatggctaacaaacacatgaaaaaatgctcaacatcactaatgatcagggaaatgcaaatcaaaaccacaatgcgataccttactcctgtaagaatgcccacaatcaaaaaatcaaaaaataatagatgttggcatggatgcagcaatcagggaacacttcgacactgctggtgggaatgtaaactagtacggctgctatggaaaacagcgtggagattccttaaagaactaaaagtagaactaccaatttgatccagcaatcccactactgggtatctacctagaggaaaagaagttattattcgaaaaagatacttgcacatgcatgtttatagcagcacaattcacaatagcaaaatcgtggaaccaacccaaatgcccatcaaacaataggcatgtaaagaaaccctggtatatatatgatggaatactactcagccataaaaaggaatgaattaacagcatttgcaatgacctggatgagattagagactattattctaagtgaagtaactcaggaatggaaaactaaacatggtatgttctcactgatatatgggagctaagctatgaggacacaaaagcataagaatgatacaatggactttggggacttgtgggggaagagctgggtgggggtgaggggtaaaagacaacaaatatggtgcagtgtatactgctcaggcaatgggtgcaccaggttctcacagatctccactaaagaatttactcgtaaccagataccacctgtaccccaataacttatcaaaacatagaattaagaaaaatagctgtattgaggaagctcaaagaaattcaagataacacagagaaggaattaagcaaccagataaatttaacaacaaattgaaataatcaaaaagaagcagaaattctggagatgaaaaatgcagttgatctactgaagaatgcatgagtctcttaatagcagaattaatcaagcagaagaaagaattggtgagcttgaagacaggctatttgaaaatacacagagaagattaaaaaagaataaaaaaaaatgaagcatgcctacaagatctagaaaatagcctcaaaagggtgaatctaagagttattggccttaaaaaagaagttaaaaaagagctggggtagaaagtttattcaaaggaataataacagagaacttcccaaacctagggaaagatatcaatattcaagtacaagaaggttatagaacaccaaggagatataacccaaagcacacctgaaaataccagtaacaagtaagaagatcaaagctgtaataaaaaaaagtctctcagcaaagaaaaccttaggacctgatggcttcttctgaattttgcaaacatttaaggaagaactatagcaatcctactcaaactattctgacaaatagagtatttgggaatatttccagactcattgtatgaggacagtattaccctgataccaaaaccagacaaaggcttattaaaaaaaaaaaaaaaaaaaagaaaactacaggccaatatccc

SEQ ID NO: 2520 - DNA, 1049 bp, Homo sapiens
attaaaaagtttattcatcatgaccaaatggaatctatcccggggatgcaaggatagttcaacatatcaacatttgtatttgcaacatttgcatattgattgatatgcaaagcaatcaatgtgaaacattatatcaacagaatgaaggacaaaaaccatatgatcatttcaatggatgctgaaaaaggatttgataaaatccaacatcctttcatgacaaaaattcctaaaaactggctataaaatggaacatacctcaacataataaaagccatgtatgacagattcacagctagcattgttgtactgaatgtggaaaagttggaagtctttcctctaagatatggaatacaacaaagatgcccattttcaccactgctattcaaactagtactggaagtcctagctggagtactcagacaagagaaagaaataaaggccatccaaattggaaagtaaaatatcaaatgatccttgtttgcagatgatatgatcttgtatttggaaaaacctaaggactccactaaaaatctatttgaattaataaacaaattcagtaatgttacaggatacaaaatgaacatacaaaaatcagtagtatttctatatgccaacagcaaataatctgaaaaagaaatccagaaagtagtcccatttacaatagctacaagtatatgtggagagagaggagagagagaaagagacagagacagagacagagacagagacagagacagacctgagacctgtagttggtaaactagagtcccaggagatgtgatggtatagtatagttccccttctagtctgagtccaaaggcctaaaaaccaagagagagagtgatttaagttccagtccaagttcaaatccaacaacaggagaaagccagtgtctcagcttgaggatgggaagagagagacagaattatctcttactctgcatttttgttttattcaggccacaatggattggatgaggcctgtctcagttcattttgtattgctatagcaaatactacggactggatcatttatggagaaaaagaagc

SEQ ID NO: 2521 - DNA, 1047 bp, Homo sapiens
aatgggattagaggtgtgatccactgtgcccagcctgaactcttcttttttatcaggagcctactccagcagtaataatgcattcccagaataatggcattaatccattcatgagggcagagccctaatgacctaatcactcttaatagtcctaccttttaatatcttcacaatggtaattaaattacaacatgaattttagagggaacattcaaaccatattaaggcccaacccctctggagagggcaatctgttttactcagtttacctactcaaatattaatctcatccagaaatacctcacagaaacacccaaaataatgtttaaataaaaatctgggcacctgctggcccactcaagttgacacacaaaattaatcaccagaaatgttttgttagatttatgtctatttcattttattatgagtaattataaatgggattgagtatttaatttacatgttcatgcattcattgctagtatatagaaacacaattgattttcatatattgatcttatatgctataaccttgttgaactcacttaatagttctaggagttttttaatatattttttgggatattctacatagaatattggttatctgtaaatagggacaatttatttcttcctttctgatctatatggctttatttcctcttcttgccttatataatggatggaatttccagcattatgtcgaataagtggtgaagaatagacattgttgactttttccctatcttaaaggaaaggattgagtctttcactattaaaatgttagctgtagacttttgtcaatgctctttgtcaagttgaggcagtttctctctattcctatttttctgagagtttttatcctaaaagtgtgctgaattttgtcacatgcttttttctgtataaatttatttgatcacgtgatttttttcttcttttgcctgttaataatggtaaagtacattgatagatttttgaatacaaaaccagctttgcatccctggaataaatccctattggtcatgatgcataattctttttacatat

SEQ ID NO: 2522 - DNA, 1051 bp, Homo sapiens
cacattttctttatccagtctatcattgatggacatttgggttgattccatgtctttgctgttgtgaataatgctgcaatgaacatacgcgaaaaaggtcaacatcactgatctttagagaaatgcaaatcaaaactacagtgagatggtttgacatggttgcagtttaattcttctgcatatggatgtccagtttccccaacactatttattgaagagactatcctttatccattgtgtattcttgacaactttgtcaaaaatcagtttgtacacgcataggttcatttatgggttcccctttctgttttattggtatatatgtctgatttttttttctggccaatatcgtgctgttttaattgctatagatttaagattagtttaaaattaggtagtttgatgcctcctgctttgttctttttgcccataattgccttgactattcaaggttttgtggtttcatacgaattttaagattttaaaaaatttccataaaaataacattagtattttgatggcaattgcattgaatctgtaaacattttaacaacattagttcttccaatccatgaacataggatattttatcatgtatttgtgtcttcttccatttcttttattaacattttatagttttcagtgtataggtctttcacctcattgattaaatttattcctaagtattttattattttttgtgtggctatttaaatgcagttgttcccttgagtgtttttagatggtttattattagagtatagaagcactactgatttttatgtgtgattttgtgttctgcaactttaccatatttgtttattctaacattttcttcgtggaatctttaggtttttccttaagaacatgttgtcaggaaacagcaacaactttagttttttctttcttattaggatgtcttttatttcttttccttaactgctcagacaaggacttctactactatgttgaatagaagtggtgagagtggacatccttgttttgggtctcagaaagtacttcaattttttactatgcttaccaacaagca

SEQ ID NO: 2523 - DNA, 1390 bp, Homo sapiens
agttcataaaatttttggtagtgttctgctgtgaagcaaccaggtcctgcactttttttgatgggagatttagttactgattcagttgtctttcttatttttggtctgttcagattttctgtttcttcatgattaagtctgggtaggtgatatgtgtctaggatttatttatttattctaggtaatccaatttgttggtgcataattgttcataacagcctcttaggatcctttgtatttctgtggtatcagttgtaatgttttctctctcatttttgattttgagttttctctccttttttcttagtctagctaaagatttgtcaattttatctttaaaaaaaacctaactcttagttttgttgatcttttaaattattttttctagactctattttatttgttgctgctctggtctttattatttctttccttctgctaattttggcttagtttgttttctgtgtagtttctgaaggcgtaacattaagttgtttatttgagatctttatacttttttgatgtaagcatttattgctataaacttccttctttgaactccttttactgcatcccataagttttggtctgttgcatttctatttttgtttgtctcaagatatttttaaatttcatttttaatttcttcattggctttttcgttgtgcaagaacatgttgttttgtgtctatgtatttgtgaattaccaaaaattcctccttttattgatttctattttcataccacagtagttagaaaaaataattgatactgtttcagtcctcctaaaattgctgagacttgttttgtggcctaacatgtgatctctcctggagggtgttttgtgtgcacttgagaacaatgtatattctgttgctgttagatgcaatattctgtatttacctattaagtccatttggtctaaagtgttaagttcaattttttttatgaattttctgtctgaatgatctgtccattgttgaaaattggttattgatatcccctactattattgtattgtaacctatctctccctttaaattctttaatatttgcttgatatatttaaggtctcaaatgttgggtgtgtatatagttatgacatatcatcttgatgagttgacccctttatcattatttaatgtcatttttcatctatttttatagtttttgacttaaagtctattttatctgatataactataaccacccctgttctttttctttccatttgtgtggaatgtcttttccatcccttcactttcaatctatgtgtgtccttaaaagtgcagtaaatgagtgtcttgcaggcagcctatagttcagtctttgttttttaaatctatttagtcactttttattgaagaatttaatccatttatattcaagg

SEQ ID NO: 2524 - DNA, 1073 bp, Homo sapiens
tagcatttatttgtctgggaaagtttttatttctgcctcatttctgaatgacagctttgctggggaaaatatttttggcttgcaggggttgtttttttttcccccttagcatttttaatatatcatcccattcttccctggcctacagagtttctgctgacaaatctgctgattgttatactgggatttttttttgtatatgatctgtttcttatctcttgctgctctcagaaatttttctttgtctttgattttggtagtttaattattatgtgtgttgttgaactctgggttaaatttaattggagatctctgcacttcctggatattggtatttttccctagattagggaagtttttagccgttatttctttaaatgtgctttctgacctgtcttctcatttttctactttgtaacttctattttgagactcttggatctcttgacagtgttctataattcatgtaggctttttttattcttttttattcttttccctttgcttttctgactggataatttcacatgttctgtctttgaccttattcattctttcttcagtttgactgagcctgctgttgaaactctctattgcattatttagttcagtcattgtatctttatttttaggatttgtattttgcttcttttattatttcttagtcagacttctaattttgtttgtatatagttttctaagttaattttttatacatatctttttgtagtttactgagcttctttaagaggatattgctgaattatttgtctgctatttaataggtttccacttctttagggccaagtgatggggctttgttagtttctttgggaggtgtcatgatttcctgagtctttgtaatcccatgttcttgtgttgatatctgtgcctgtaaggagacagacacctctttcagcttttataggttttttttttcttttttgagacagagtcttgctctgtggcccaggcatgattgtggttcactacagtctcaacctcctgggctcaagcaatcctcctcaccttcctgagtagctgagaccacaggtgcatgccaccacatccac

SEQ ID NO: 2525 - DNA, 1391 bp, Homo sapiens
tgcagggccttggggtgggctttgagcctgaactgagtgctgtttaacctgctgggtgtagaagaactagctcctgtgctttgttatattgcgctgtggtgggtatttctctctctgtggggtgtgggggcagggtctgaggctggactggaggctgagccatctagggatataagccaggtagaatgtcccaccacttctgggagtgaccagctaggatttgtgagggagctatgctgttagctggtacctcagattgtgtactactgctggcaggtacacagagctgccaccaagatctgtaggctggttgccatgggctctgtctccttgctttatctctacctgaccctaggtggtctagccatgctgttaccctctgtgttccttatgaagtgagactggagtggacttcttgggaagcatatcagaatgccagggaaactggatgtctgttttctattctattttcccactgtagaaactgtgggccctgggaaattttttctttgttgaactgagccatcttggggaaaggaggagcagtgggatcaaagtgagataatttctcttatccttcaaaggcaggtttttttttgtttgtttgtttgtttgtttgtttgtttgttttggttctgtgttctgtggtccatgcagctttctcaggcctttccaagttttgggaacacaagggtattcttgtctgtgaatagttgctagttgaactttctttgggaggtaataaaggcctgagaccctgtattttgcccttttactgatatcagtctgtgttaattcttctttaaacatttggtagaaatgtccagtgaaataatctgggcctggagattgcttctttggaagtttttaaattatgaattcaattttctttttttttcagattatcgattttttaaattattattattatactttaagttttagggtactatgcagccatgaaaaatgatgagttcatgtcctttgtagggacatggatgaaattggaaatcatcattctcagtaaactatcgcaaggacaaaaaaccaaacaccacatgttctcactcataggtgggaattgaacaatgagaacacatggacagaggaatgaattcaattttcttgataggtatagggctactgagattatctgtttcacattgggtgagttgttgtagtttgtgttttttgaggaattggtacgtttcatctaagttgtcagatttatgtatagaattattcataatattcccttatgatacctttgatgtctacagaatcaatcttgatatcccctatttcattcctgttcctgatactttgtgtcttttcactttttttcagtcttatttgaagttaggtttattgatgtttttaaagaatcagct

SEQ ID NO: 2526 - DNA, 1130 bp, Homo sapiens
tctgtcttttaattgccatatttagactatttaaatttaatctgattatttatatgggctttaagttgtaagccattttttttattctgttcgttctctctgctgtttgtttctatgttttatttttcctgccttgaacatttttaagaattccattttgatttatctatagtatttttcaatatgtctctttgtgtagcttttttagtggttgctatagtataagattatatatatattacagtctactgatgttataattttatcagtttgaatgatatgtagaaactttcatgtttctttaccttcctgtttgtaatatattgtcttaaatagtttttatgcatacatttgaaactttatcaaacattgttataatttttgcttctgtcatcaaatagaatttagaaaattcatgagaggaatattctgtttgattatatttttgtttatcatgttctttcttcctttttaatgttgcagtgttccttcttttattgtttggttgtttgatttctgtttaaagaactttctgtagccatatttttagtgtgggtctgttagtatacaggttctacttttcatttgtcttagaacgtcttaatttcctcttcattcatgaacatttttgctagatataggattctgggttgacagttcctttctttcagcacttgaaaaacattgtgtgactttcttctaaccatggtcatttgaattgtttttctcctatggataaagtgtttttcctcttgctgatttcaaggttttttctttgtgtttagttttcagaagtttgactttgacatgtttttggtgtggattattttgtctttattctgttttgagttcccttagcttcttgaatctctaggtttgtgtttcttttgacaaatttggaatgtttcagccattatttcttcaagtatttttttttttagccctgtcttctttaacctctccttctgggacttcagacacaaatgctagatcaattttataatcccacaggtgaatgaaggtttgttctttttttttttttttcttttttctgaggtgggatctcactctgttgcccaggctggatggagtgcagtggcatgatctcagctcactgcagcctctacctc

SEQ ID NO: 2527 - DNA, 1061 bp, Homo sapiens
tatttagatttagtgaatttaatacattgaggacatataattcattttacataatacttcctcatatttcaaaattattagaactcagtggcataacagaatgtcattacttgtttccccctcctattttgttcttattcaacacacctagtccccaaaaccttgcctacaacattatcatccaaacacaacccctaatgcttactaatcattatcgtttaaaatggggtagatgtaaaacatttcaactataaggatattaactaaaccacactacttacctctaaattaattttattcattttgaatgagagatatatctgtagaaattttttaactttcaggtcatttttgtaccaccatctttttttggctgatgacttgtttcaaacctgtttggtttatataagaggactttgtgaagatgcaattaatctcaaaaattataatgaccatgaaaataatctatctgccatatgccttgtaaaggtgagtagaagtatactactataagctaatattggtatatagaaactaggaagaaaaatagcattttgaattaaaaaatacagatttctaaattcataaataaaccatctctttcgattactaccgttctaaaatatctgcaaagaatgtgagttccttgcaataaattttaatagttaacatttcttgtaatttcttccttatgcctaacctaagtctataagaccctttattttcaaatgtatttccgaatgtgtaatatgatttaaaataatcagttatctcttatacataattgatattcttcctctagtatagcatgtcaagatagtatcataagcttcaactcagaagttttggttaaatttatgaattctcctatttcaagattctagaaaaagtgagcctgttaatggaataacttaatttatataagatagctcttttgagtggttaagtacctagaactaattaagtctacaattgaacaagattctagcagattttacttcactcactcaatgtatggggaaaaaagtaaaattgatagagttatctagactaagaaagag

SEQ ID NO: 2528 - DNA, 1029 bp, Homo sapiens
attgttaaggggcttagacaagttaaatatttgaaaattagctcgaaaatcagttgtgttgactgcatgtaacaagatcaatacttgtaaatcaacatcgtatgtttagaattgattatgtgtaatgacagatacatagtaggtgctcaccaatagtctttgagtgaataaaagaataaactaatgaaggaggaggaattatcacatagatgtatattttttatacttatatagagaatgtttatgtttcaaaaggattaaattcaccttaagtaggagacatttcacagaggaatctctttgatttggtttttatgtagaaggaaataggatatggttttcttgtagaaggaaataaaataatctgtaatatcagattattttgtaaatggctgagtgacaaaatttattaatttttaatgatgggtgggaaggcataaaagactttaaaatacctttgaagtctgtgccttaaatgccaccaaatgatagagaacattactagtgatagagaagaaatgttaggactctttcctagagacctcaggccatgtcagctttaatatagaacatcaggaggaagagaacaaacttttccagacagtatgtaagtatttattatctattatatgcgaaatgctgtgcaaaagagatgaatacaaagtgaaaaacaaagctttgctattttcaatctgcttacagttcatgggaagaaataattctttatatataaaaatgaaaactaattctagagatagtttctttgttatgctaatcattctacctaacccattagcaaagtataaggtaaggaatgtttactggcaaataatacttgtaaaacagtcatgttacagaaatccagaggaggcagagattagccttatttggaattaaagttaggtcatgcctcatattttgagctaggctgtgctggatttgaatagccatagaagaggagataaggcttttaaataaagaatataaatgtgagtaaggcattcaatatatatttgatttgaaagttag

SEQ ID NO: 2529 - DNA, 1028 bp, Homo sapiens
gtaaagaacatatgttctttgttcaaatcttcactttcaagtggatggaatattatgtttttgtattaccagagattaattcttagcttagttgatggagatttctcccagctagattctgaatgaattttgaataaaattcacctatttgaacaaaacttagttctagagagattgccacttatccaagttgacagaatcatctagagttgagactttggatcatgtttcatattcgggtgaagtttgttttattgagcagtatttgggtgcttaataaaaatgtaaatatttgtgtcccactccttttgcaagagagggcagtgagtggtgctggtaatctacattttaaatcggttcctcagttaactgttaggcaggataaattttgagaactacttttaaagaacaactattcaaagtttttgaacatggtattttaggaaaattattgtgatattggtttttgggaaaaattggtagtggagagatacttgagtgatagagatcaattattatagtactggataaatgcaggtataagcaataaagactttaattaggatgtcatcagtaagaccagaaaggcagggaaattttgaaaaatttggacctggtagtcagatatgggaccaggagaatggaaacttaaagagtaaatccaaaattttaagcaagagcagtacttttcaatcttttttgttgtgggaagatacatttattaatttttataatataactatatgataaaagataaacatatctgtatatttattaatgaaaatgtattttgttaagagaattaacacagtagtggaaaaacaatactgaaagaaggaagaatgatgtaatatacacgcatgtatggaacattatgattttgtattaccagagattaattcatagcatagtagatagagatttcttccttatagattctgaatgaattctgaataaaattaaccttatttgaattatttaattttaccctctttatgctgtgttgtgggaagttggggaccccaaac

SEQ ID NO: 2530 - DNA, 1048 bp, Homo sapiens
ccattgtcccttggtgtccatgttcaattgagttcagatttaactttttaagtttaatttaacttttcctcctcagaattccctcagtttttgcttatctgtaaaagattctatttattcttcatttcagaagaatttctctgctgggaataatattcttggctgatagtttatttctttcaatattttgtatatatcattccaatgtctcctggcctgtaaagtttctgctgagaaatctgcttatctaatggaaattcccttatatgtgacttgacattcttgatacttttaaaattctttctttctctttgactttgtcaatttgactataatgtgccccagagaggacatgtttgagtttaatctctttgggtttgtttagcttattagacctggatgttcatttctcttccaagacatgggaaatttttagctattatttcattaaacatatttttcttgtttttctcttctctttctgcaacaaccataatctgaatatttgtcacttaatggtgttccataaatcctgtgagttttcttcactgttttttttctttttcttttctttttttttgtctgcctgtgttatttcaaatgcccggtcttcaggttcagaaattttcttctgcttggtctagtctgttgctgaaggtctcagttgcatttttaaatttccttcattaaatttttcagttctaggatttctatttggttcttttctatgatatatatctttatttaatttttcattcagtttatgaattgttttcctggtctcattgaattgtctatctgtattctcatatatttcactgaatttccctaagattaatattttgaattatttttctggcatcttatacatttctttatgactggggcctgttactacagtattattgttttcatttggaggtgacatagtttcttgtttttcaagatgacattcagtatgttggaggatgatccctttatgtaggaacacacagatatttattagtatatacttccttgtttgatttccaaaacttaagttatctgc

SEQ ID NO: 2531 - DNA, 1763 bp, Homo sapiens
aacatccttaaaggaaagaaattccaaccaaaaatgtcatatcccaccaaactaagcttcataagcaaaggagaaatgaaatccttgtcagagaagcaaatggtaaggaaatttgttgccactagacctaccttacaagaggtcctaaagggagtgctaaacatggaaatgaaagaacattccctgccaccacaaaaacacgcttgagtacataaacacacttaagtacataggccattgacattttaacacaactgtaaaattaggtctacataacaacaagctaataacacagtgacaagatcaaatcctcacatgttaatattgaccttgaatgtaaatgggctaaatgccccactttaaaggccaactgtgacaaactggataaagaagcaagacccaactgtctgctgtctctaagagacccatctcacaagtaacaacacccatagactcaaagtaaagggttagagaaagacctgtctggcaaatggaaaacaaaaaaaaaagagcagaggttgctattcttatatcagctaaaacagaccttaaacaaacaatgatcaaaaaggacaaagaaggccattacataacaatatagagttcagtactaaaagacttaaatattctaaatatatgcacacccaatattggagcatctagattcattaaacaagtactgagagtcctacaaagagttttagacaaccacgcaataatagtggtggacttcaacaccccaatgacagcattagacacattgttgaggcagaaaactacaaaactattcaggacttaaacttgatacttgaccagttggatctaacagacacctacagaacactatgcctaacaacagagtatacattcttctcgtcagcacatggcacatactctaagattgaccacatatttgtccataaagtaagtctcaactaaatcacaaaaatcaaaaccataacaaccacactgttggaccacagctcaagcacaaccagcttctgagtgacttttggttaaagaataaaattaaggcagaaatttaaaaaaattatttgaaactaataacagacacaacataccagaatcttcaggacacaactaaagaaggatgaagaggaaagtttatagtgctgtacacctacctcaagaagttagaaagatctcaaattaagactctaattattgcacctagaggaaccagaaaaacaagagaaaacaaatcccaaagccagcagaaaaaaagaaattacaaaaattagagcagaactgaacaaaactgaggcatgaaaatccatacaaaagatcagcaaaaccaaaagttgattcttcagaagattaaacaagtttgatagcctggtgcctagatttataaggaaaaaaataaagaagacccaaatacacccaatcagaaatgacaaaggtggcatcataactgaccccagagaaatacaaaaaaaaatctcagccaggcaaggtggctcatgcttgtaatcccaacactttgggaggccaaggaaggcagatcacctgaggtcaggagtttgagaccagcctggccaacatggtgaaacctcatctctattagaaatacaaaaattagccaggtgtggtggcatgtgtctgtagtttcagctactcaggaggctgaggcaggagaatcacttgaatctgggaggcggaggttgcagtgagccaagattgcaccactggaatccagcctgggtgacagagcaaggctctgtctcaaaaaaaaaaaaaaa

SEQ ID NO: 2532 - DNA, 1469 bp, Homo sapiens
cattcccactgataactggaacaagagaaggatgccaactcttaccactcctgttaaacacagtactggaaattctagccagatcaattatgcaagagagagaagcataaggcatccagataggaagaggtcaaactatctgtttgtagatgatatgattctctatctaggaaaccttatagtttctgtccaaaagctcctacatctgataaaataacttaggaaagtttcagcatataaaatcaatgtacaaaaatcagtagcatttctgtacaccaaaaacatccaaactgagagccaaatcaatgccattcacaatagccacaataagaataaaatatctaggaatacagttaaccaaggtggtgatagatatgtacaatgagaattacaaagcactgctgaaagaaattagagatgacacaaacaaatggaaaaacattccatgctgatgaataggaaaaatcaatattgttaaaatggccatactgcccaaagcagtttacagacttgatgctattcctgtcaaattaccaacatcatttttcacaattcaaaaaaaaaactattctaaaatttgtgttgaaccaaagaacctgaattgccaaagcaatccaaagcaaaaagagcaaagctggaggcatcacattacccgacttcaaactatacaagactacagtaaccaaacagcatggtaagggtacaaaaacagatacatagaccaatggaacaaagtagagaactcagaaataaagccacacagtctacaatgacaacaatggagaaagaactcccttttcaataaatgcttctgggataactggctagccatattcagaagattgaaactggatcccttcctgtcactatatacaaaaattaactcaagatggattaaagacttaaatgtaagacctaaaacagtacaaaccctagaagaaaacctaggaaataccattctggacatcaaccttgacaaagaatttatgacctagtccccaaatgcaattgcagcaaaaacaaaattgataagtgggacctaatgaaactaaagggcttctgcatggcaagcaaaattatcaacagagtaaacagacaacttacagaatgagagaaaatattcacaatctgtgcatctgacaaagttctaacatccagagtctataaggctctttaacaccccaacaaacaaaaaaccaaataactccactaaaaaatgggcaaaggatatgaacaaatacttctcaaaagaagacatacatgtagccaacaaatatattaaaaatatgaccaccaatcattagagaaatccaaatcaaaaccaaaatgagttaacatcttacaccaatcagaatggctgttattaaaaagtcaaaaaacaatagatgctggtgaggatgtggcaaaaaggaaacaccctgctggtagcaatgtaaattagttcagccactttggaaagcagtgtggag

SEQ ID NO: 2533 - DNA, 1026 bp, Homo sapiens
ttgggcaatttcttataaagataaacataaacttaccctataatgtagcaagcctcctcctagccatttaccgcaaaaagcagaaaacatttttctatggagaaaaaccatatgtaaatatttataatggctttattcataattgttcaaatctggaaataatttaaatatctataagtggatagccatgaaatgcagtacttctcagcaataaaaatgagtgaaatattatacttacttatgcaacacgaataaatctcaaatgttaagtgaaggaagccagactcaaaacactatatattatatgattccatttatatgacattttggcaaaccaaaactggaagggcagaaatcaagtcagtgattgccatgggctaggtgggggtgagaggaaccttctataaaggggcctgatacaatgttttagatgacagaaatgtactacatttagtcattgtgattgtagtggttgttaactgtgtgtgattgtcaaaattcattagaactgcatacctgagaagcatgaattttactggatataaattatacctcaataaacctgacattaaaaataaagtattatttatttagcacatgtaacttgtcagatactttgttagatcctggacatacaatgctgagcaaaatagacagtttttgctctaatgtagtttacagtctagaggaagggagagatattaatctactgaccacacaaatatatttaacattacaataaatgctacaaagaagaagtttggggtattgtgagactgaatctggtctgggagaagtttcgttgataggagttaatgaggaaatcaagaagaaagggtggtcaagtcatccctaaaaagtgtatcatataccctacagaacaagaagcatatttgaaaaagtgagaagaagacagtgtgacaacagtaaagtgataagaaaatagcataagacataatgtgattggtcaaacctataaataataaatgtcttttctaccatcctaaaagtttctgaaaaattttg

SEQ ID NO: 2534 - DNA, 1042 bp, Homo sapiens
gcagaaatcacaagggaaattagaataaaatacagttttataaatgaatgaaaatgaaaacacaacataacaaaacttactataggcagcaaaggcagtgcttagagggaatttatacatgtaaaaactacatgatatctgtgttctacaaatattttatcccagtccataaattgtcttaattttcttaagtggcttttgataaacaagagtttttaatttttatgaagttcaatttatctgttttttcttttaaaggtttgggcttttggtttccgatctaaagcattgtttcctaatgcaacagcatgatgaatttttccaatattttcttttagaagttttatacttctggatattatatctgttatcctttttgagttaatttttgcaaatggtgtcaggtgtggtttgaggtatatattgttatatgttggtatttaatcactccagtagtttgttgaaaagactaatcttcctccagacaattaccctaacatctggtagaaaattgattaattaaatatattcatgagtctatttctgaatgcttttttctagtccagtgatctgtgaatctgtccttccaccaatatctcacagtctgcataactataattttataataagtcttgaaatcaggtagtatgtattcttcagctttgttcttctttttcaaaattgttttaactattttaattcatttactttttcatatatatcttataattaactagcagatttattcaaaaggcctactgagattttgattgagattgcattgaatatatagatcaatctggggagaattgacatcttaacaatattcagtcttttaaagccctgaacatggtagactttttcctttgtttagatcttctttgatttatctcttcagtgttttgtagaactcagtgtgcaaatattgcacatttttgttttaaactacctatttcatattttgatggtattaaaaatggtaccatattttaaatacagtttctaattattcattgctggtaaaagaaatgcggttgatttt

SEQ ID NO: 2535 - DNA, 1972 bp, Homo sapiens
tttaaagtatgttttctagatttgtagttcttaaacccaggtgcacaatagagtcacctgttgagcttgtagatgattaagagtcctgggccctgcctctgactttttaactcaatatctctggggataggacctaagaatttgtattttaaataggcactcagtgactaggactaatgatatactgactctggcatcaatttacagtctttggggggaactccttcattacaatgtcatttgtttcacatgcaatttacttattttaacatgcaagtgtcaggtatttggtaatacagtgttactcggttatactggagttatgatttctcatttaaaattttggtctgtattctaaattaaatgttctgtaagttatatgttgtcactggcaccctcacattatccgttaaattagattttgaatagtgttgaagtggggaaggatttgagaaaaacatatgcaccaatatttgaagtaaatctatgcttgagaattcctgctgagagtgattcttcagaaaattctaaagagaactttcatgagtctgaccagtgccctgaagagtgtgtgatgtttgaagatgaaatgtcagaaaataaagacaattgtgtcaaaaaacactcaagtgaagaattgctcccaaaagccaagaaatcaaaagaaattagttacaatcttgaagatattatttcaggtaagacaattgagactataaagaatgaggggttgccaggtgtggtggctcatgcctgcaatcctggcactctgggaggctgaggtgggaggatcacttgatgccagaagtttgagaccagcctgggcaacacagtgagaccttgtctcttgtctcttggggaaaaaaaaaaaaaaaaaaaaagaatggagggaaatatcttaacaactggaaaataacaaatgagagatcattttaatagtctgttgtgtcttctaatttatagattatgattttataaatcttaaggtaaatactgctaaaagtaaggataaacttacagatcattgttgtgcatgtcagtaatgacaccattattcattttcatctcaaaacccaaacagtttctcactgaagcagagccgagggccccgttcatcaagaggaacaacatctaggatgtttgtcctcagatctctttaatcagaaccttggaatggggtgtactgcttcagtattgtgtttcaagtgacttcttgagtttattcttaggatatgtgtaaagcactggcatatattaatttgtcatttacctgatataaatatcaatcaattttgtattttctctttctttcaatggattctaatagacacagaaattgagactgagtttgagaataaatacatgtattatgagtaagtattagacattttaaaaattacgagtaattgtattttatatggtagttattatattcctctgaaatatgcttttattgttttctctgttagatttccagaatttcctacaaatctctttatagatcccaacagattggagttttcagtaaaaattcaaaatatgttgactaatatggaaaaatgtataagtaagtgtttttaaagcttagtgaaatgcattgtcttctttggcaatatttttttaaatttaagcatctgatgcctttacccagggatgtggcagatgttacagaatattagtatatcataaatgcacagtccttgggatcaaacactgaatttggaattatttgaggatgtgtgaattttacacatggccttagagtgcataaaagatgagaattaggaaaatattcaaggtttggattttttcagttacattctatagaatgttatgacacttaatacaaatgagcaagatcttttatgtcatagtataacaaagatattgtttctaccttaaagagactttaattattttgcagctgtatgtacacaatctgaaattgcaggcaattactagcctgaccaaa

SEQ ID NO: 2536 - DNA, 1030 bp, Homo sapiens
tatgaagatgaaatgtgcataagaacatgggtttgttttaaaaccaagaattatcacaaagttgttataattttttacccagtccattttgaatcagtttggtaagggtttcttgctgagtaaaatccagagatattagtatcttgcaacattatacacttacagacattctaaacaactgtgctctcttgttgggatgacccctcccatactcattttattcagtgcccatagatttgttctactgccttctagcttttaataatgtaaataagaagtctgatgctactctgattctccttcctttgtatacttgtgatttctgtctagtaatttatcatttggagttacgaacttttctataataaagccatatatataattctatgttgatctttcttaaaatccagtgaggctcttcagtctgaagaactaagttcttaccaatctttccatatgttcctttttttccctttggattttttgtttttcatcttagatttcctgggtctaaacatctgattatttctatttcttttttctttattatgaaatgtttctactgttttttttttaagtttctataatgagataatttgagacttctataagttggaagcgtagtacagagtttctgtatactctttatatgctttaatctagttatgaaaatgaagaaattaatattagtataatagtattaatgaaatgatagattttatttggattttcccagttgtttccctaatgttcattttctgtgccaggatctaatcccggatcacacattgcatatattaatagttgttatgtctgctaagtcttttccagtgtgtaccagttgctcagtctttccttgtcttttatgaccttgagatactggtaatttactctacagattgtccatcagttttggattgtctgatgttgtctcatgatgagtttgaggatatacatcttgagggagaataccatactgggtgtgtgcccttttcagtacatcagcctagtagtacatgacattgatata

SEQ ID NO: 2537 - DNA, 1054 bp, Homo sapiens
atttcatttttatatttaaatatttgttcactctgagatttatctggcgtatgttgtgaagtaggacttcacttttaatttttctcagatgactaatgatctgtctgtcctagcatcatgaattgaataatccattccttatccccactgatttgaaatgccacatttatcattttttattttccagaatgttttccattgtatttctgggctatgcagatgatatgtctgtaacttatgtaccagtattatactgtgttagttattaggtagctttgtactatttttagcatctgttagccgtctcctttttctctcttttttccttggaaatttcctgggttcattgatatttattttggtctttagactataatacagtattactgttatttattttgttgctcaagttgttctggcttaattttggaagagtaattctccccagttggctcctgtgcccttcaatatacctccatccttgtcttgtgactacttccttagtttccgtcacctcaagatacttcaggctcatcttgtattttctctgccccagccctgaaattaactgtttctccaaggaaccctggattagagaaggaaatttaggaactaagatctatgcactagatgtgctcattgctacaggagtgtcactacttcctggcctaccagagaaaatatctagaaaatatatgtatgtatgctagctcatgcatacacacacaactatatttattcctagatctttttgtttgtccattttaaactgaattcatactgatacctcagaccccaatccaatacctcagggttcattctagccttttcttttccttatatctaacttttttctctggctatgagaaatctggctgacataatcaacaacatagttacttgtttgttatacagtcatgcactgcataaagatggttcaatcaatgacagaccacatggtagtcccataagattataataccatacttttgctgtatcttttctatgtttcaatatataatccttaccactattttacaattgcctacaatat

SEQ ID NO: 2538 - DNA, 1046 bp, Homo sapiens
agtgtctgttcatatccttcgcccactttttgatggggttgttttttgcttgtaaatttgtttgagttcattgtagattcttgatattagccctttgtcagatgagtagattgcaaaaattttctcccattctgtaggttgcctgttcactctgatggtagtttcttttgctgtgcaaaagctctttagtttaattagatcccatttgtcaattttggcttctgttgccatcgcttttggtgttttagatatgaagtccttgcccatgcctatgtcctgaatggtattgcctaggttttcttctagggttcttatggttttaggtctaacatttaagtctttaatccatcttgaattaatttttgtataaggtgtaaggaagggatccagtttcagctttctacatatggctagccagttttcccagcaccatttattaaatagggaatactttccccatttcttgtttttgtcaggtttgtcaaagatcagatggttgtagatatgtggaattatttctgagggctctgttctgttccgttggtctatatctctgttttggtaccagtaccatgctgtttcggttactgtagccttgtagtatagtttgaagtcaggtagcgtgatgtgtccagctttgttcttttgacttaggattgacttgtcaatgcgggcccttttttggttccataggaactttaaagtagtttttttccaattctgtgaagaaagtctttggtagcttgatggggatggcattgaatctataaattaccttgggcagtatgcccatttgcacgatattgattcttcctacccatgagcatggaatgttcttccatttgtttgtatcctcttttatttcattgagcagtggtttgtagttctccttgaagaggtccttcacatcccttgtaagttggattcctaggtattttattctccttgcagcaattgtgaatggaagttcgctcatgatttggctctctgtctgttattggtgtataagaatgcttttgatttttgcacattgattttgtatcctg

SEQ ID NO: 2539 - DNA, 1032 bp, Homo sapiens
tccaggtgccgtgtgtcacccctttctttgactaggaaaaggaattccctgaccccttgcgcttcctgggtgaggccgtgcctcactctgctttggctcatgctcggtgcgcagcacccactgtcctgcacccactgctgacactgcccagtgagatgaacccagtacctcagttggaaatgcagaaatcacccatcttctgcgtcgctcatgctgggagctgtagactggagctgttcctatacggccatcttggatcctagattattgttttttaaagatggggtcttgttatgttgcccaggctgatctctaactcctggcctcaagtgatcctttcagcctcctgaatagctaggattataggcacaagccaccacacctggctgtatattctattttgaaagtccttatatagcacttaaattacatactcccagaaagttcatcttcatccatttagctatatagacaggaatgagaatgtaatgtttagaacattgattatgatgtgagactgcctatgttcaaaatctgtgatctagccatgatggagaaacaaagactggacttaacctccttccataaacaactaaataaaataaaggaaagaaatactggctgggtacattggctcatgcctctgtaatgccagcaatttgggaggccgaggcggatggaatgcttgagctgaagagtttgagactagcctgggcaatgtggtgaaaacccatctctacaaaaaatgcaaaaaaattagtcaggcatggtggtgcacacctgtggtcccagctactcaggagactgaggtgtgaggatggcttgatcccaggaagttgaggctgcagtgagtggattgtgccactgcactccagcatggtcaacagaataagactgtatctcaaaaagagagagagagagagaaagaaagagaaataaataaataaataccttcagacactgattagtgtctgattaacaggtagtacaggattatgattcttgaaatcagggaaacaagtgagagagagg

SEQ ID NO: 2540 - DNA, 1161 bp, Homo sapiens
tggggtcctgtgactcagtaggcagaatgttcatagagtgaaagttcacaaagatgaattggaaccactaattgtaagcagaacaatcttttgaaatcaccaagttctcactgctcagagtggagggtctcaacaattatacaaggcattcagtgtggaccccaaatgagtaaaccttagcaatagagctaactatccctaaaggaaagtccattttataactacccttccaaagattaaagatagacctcaaagagatcaaattgttctgcatttaattacctgaaaaaatgaaagacaacactctttaaatgaaaacagcaaaaatcagatacgtaacatgtaacactgacaatgcttggttgtcaaccagaaattactaaatatgcccagaagcagtaaaatgtgacctacaactaagagaaaaaaaataaatggaaacagaaatgacgagatggggctaacagaaaaagacactaaaacagattatatatttatgtagaagtatttaaatgaaaacatgaacataacagacaaatgaaagatatttaaaaaaagcaaaatagcaaaacttaaagagatgaaaaatacaatatagtcatccttttgtatttgtggaggatttgtttcagggctccaaggataccaaaatccatagatactcaagtcccttatgtaaatcatgtatttgcatataacctacctatgcacatcctcctgtatactttaaatcacctctagattacttataataccaaatacaatgtaaatgctgtgtaactaatttttatatggtaggtttttacttgtattattttttattgttataatttttttgttgttttttaaaaacactttccatttgtggttggttgaatctatggatgcgaaagccacagacatggagggctgactgtatcttaaatgaaaacttcacttgatgagattaattgattagacactgcagaaaaaaatctgaacttgaaataatagaaatagaatcaattgcaaaggaagcacagggatgaaagaagactaagaaatcaaacaaaaacagagactcagttgcctgtgggataataccaagtgatctatcatatgtgtaattatagttctatgggaaatgagaaggtggagagacaaaagttatctgaaaaatga

SEQ ID NO: 2541 - DNA, 1650 bp, Homo sapiens
tccatattgacacaaatgacagaatgaatttcttttttaaagctgaatagtattttattgtgtacatatactacattttatttgtccattcatctgttgatagacacatagtgtccacaattgtccataagtgaatagtgctaaaaggaacatggaagtgcagacatctctgacatacttatttcagatcttttgggtaaatacccagaagtgagattgttggatcatgtggtaattctatttttagttttttgaggaacctccatacagttttccaaaagggcagtatgaaattatattccaaacaacagtgttcaactgtccttctttctccaaatccttgccacatgtactttcatcattttgataataactattctgacaggtgtgaggtgatgactcactgtgattttaacttgaatttccctagtgattagtgatattgagcatttttttcatatatctgttggccatttgtatgtctccttttgagacatatctactttttattggattgtttgttttctttctgtaaaggtatttgagttgcttataaattatccccttatcagatgtatagcttgcaaaatattttctccaaattcataggttgtcccttcagtctgtgaattgtttcctttggtttgcagaagatttttagtttgatgtaatcctattcatctcattttgcttttgttgcttgtgttttcagggtcatatccaagaaatcattttttaggccaacatcatggagctttgcccctgtcttcttctagaagttttacagttttcagtcttcatttttaaatttttaatttatttttattatgtatttttatttcgatagttttgggggtacaagtggttattggttacatggataagttctttagtggtgatttctgaaattttggtgcacctgtcaactgagctgtatacactgtacccaatatgtagtcttttatctcacacccccctcccacccttcccacctgagtcccaaagtttattatattgttcttacgcctttgcatccttatagcttagctcccacttataagtgagaacatatgatatttggttttccattcctgggttacttcacttagaataatggcctccagttccatccaagtttctgcaaaagacattattttgctgctttttatggttgagtattattccatggtgtgtgtataccacatttaatttacccactcattggttgatgggcacttagattgtttccatatttctgcaattgtaaaatgtgctgctataaacgtgtgtacatgtgtctttttttacttttaagttcaggggaacatgtgcagaatgtgcaggtttgttacataggtaaacatgtgtcaaaggagtttgttatatggattatttcatcagccaggtattaatccattagttatttttcctctctccctcatcccactctccaccctccagtaggccccagtgtgtgttgttcccctctatgtgtccatgtgctctcatcatttagctcctgcttataagtgagaacatgtggtatttggttttctattcctgcattaatttgctaaggacaatggcctccagcttcatccatgtccctgcacagaacatgatctcattctttttatggctgcataatat

SEQ ID NO: 2542 - DNA, 1069 bp, Homo sapiens
atagatgctggatattagatctctgttagatgactagtttgcaaaaattttctcccattctctgggctgtttactctgttgatagtctcttttgctgtgcagaagctctttagtttaattagattccatttgtcaatttttgcttttattgcaattgcttttggcatcttcatcatgaaatctttgcccatgcctatgtcctgaatggtattgcctaggtcatcttccagggcttttatagtttggggttttacatttaagtctttaattcatcttgagaaaatttttgtatatggtataaggaaggggttcaatttcaatcttcagcatatggctagccagttatcccagcatcatttattgaatagggattcctttccccattgcttgtctttgtcaggtttgttgaagatctgatagttgtaggtgtgtggtcctatttctgggctttctgttctgttcccttggtctatgtgccttttcttgtaccagtaccttgctgttttggttagtgtagccctgtagtgtagtatgaagatgggtagtgtgatgcctccagctttgttctctttgattggattgtcttggctatttgggttctttttctggtttcacttgaatctttaaatagttttctctagttctgtgaagaatgtcaatggtagtttaatggaaatagcattgaatctaaaattgttttgggcagtatagccattttcacaatactgattcttcctatccatgagcatggaatgtttctccatttgtttgtatcctctctgatttccctgagcagtggtttgtagttctccttgtagagatcttttacctccctagttaactgtattcctaggtattttattccttttgtggcaattgtgaatggtagttcatttatgatttggctatcagcttgattgttgttggtgtataggaatgctagttatttttgcacgttgattttctattctgagactttgctgaaattatcagcttaagaagcttttgggaggccgaggcgggcggatcacgaggtcaggagatcgagaccatcccggctaaaacggtg

SEQ ID NO: 2543 - DNA, 1023 bp, Homo sapiens
gtttgtatttctgtggggtcagtgataatatctcacttgttatttctgattgcatttatttgaatactctcccttttctactttattcgtctagctagcagtgtctcttttattaatttttttcaaaaaacccagctcctggattcattggtcttttgaatggtttttcatgtctctttctccttcagttcactctgattttggttatttcttgtctcctgctaactttgggatttgtttactcttagttctctaggtcttttagttgtgatgttaggttgttaacttgagatctttctagctttttgatgtgggcatttagtgctataaattttcctcttaatactgccttagctatgtctcagagattctggtacattgtatatttgtcctcattaatttcaaaaaacttcttgatttctgccttaatttcattatttacccaaaagtcattcaggagcagcttattccatttcagtgtcattgtatggatttgagtgaatttcttggttttgattgtggatttcattttgctgtgttgtgaaagacagtttgttatgatttcaggtcttttgcatttgctgaggagtgttttactcctgattatgtgatctattttagagtaagtgccatgcggtgatgaaaagaagtatattctattgtttttgtgtggagagttctgtgggtatgtctcaggtccatttgatccagtgctgggctcgggttgtgaatatctttgttaactttctgtctattagacatattgtcagtggggtgttaaagtttcccactattattgtggcaaggtctctagaaactttctttataaatctaggtgctccagtcttgggtgcacatatatttaggatagttaggttttcttgttgaattgaaccctttaacattatgtaatgtccttctttgtcttttttatctttgttggtttaaagtctgttttgtcagaagctaggattgcaacccctgctattttctgttttccatttgcttcgtagattttctttc

SEQ ID NO: 2544 - DNA, 1681 bp, Homo sapiens
tgggattacaggcatgagccaccgcactcagctgttttaggaagttttttttttttttttttttttttttgagacggagtctcgctctgtcgcccaggctggagtgcagtagtgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcctgcctcggcctcccaaagtgctgggattacaggcgtgagccaccgcgcccggcctgtcttaggaagtttttaaacctctgtccgctggagaacactggtgggattggctggagaacctggtttggagagtccacccagtgaggaggaacagatacgggacctacttaatgaagcagtctggtcatgcttttgtagagaagctgtgctgtgctgtgcttctgcctctgcccccgattggcttgggctctccaaagccagtaggctggaatggctaaggggcccaaacagcaaagatggtggcccacccttccctttgggagctctctcccagggagttttctaatctctatcacatggagaacaccagcggggtggctggaggccccagtttggaggtcttgccaaatgaggaggaacagataagggacctgcttaagcagtctggccaccctttggtagggtagctgtgctgtgctggggaaccccttccacctccagtcagtttggaatctccaaagccgcaggctatagtggctaagttgcccaaacagcaaacatagtggcctgcccctccttccaagagcttcatctcaggtgcaacactgctacctgtggctggctggaattccaagccactggatgttatcctgtgaggcatcgtgaaagtagcacccccagactatcactgcttggtgccctggattcagcttctttcctaggggtatatatgggggtctaacctcccactttgccagcattgcagttacttttgctggaaagcctggagctggactatctaaagctcctgggtttctgtgcatacctgagtgactactctgccaagactccatgtagctctgtgtgtcagactgaaggccctggtgaagtgggttcacaaggggttctcctgccccaagggttgcaaagatccatgggagaagtgtggtttcctgtggtcacacattcactcaccacttccctgggtgggggaggttcacttggctctgtgtcactcctgggtggaccattgtccttccttgcttttctctgttctccgtgggtcgagttgtttcctttattagtcccaatgcaagtacctggatgtttcaattgaaggtactgtatttactcacccttttcatacctctctgtgagagcaatgcattctagctgcttctagtcagccatcttggccactccctccaaattcttaaaaattatttaaatctctttgttaaatttctaaatttagtcatttattattttctatatgttgttgagttgttcctgtgtaatcttatgaagtttgctaagcttccttaaaataattatttttaacctgggtgtggtggtgtttacctgtagtcccagctactcaggaaat

SEQ ID NO: 2545 - DNA, 1033 bp, Homo sapiens
tattctcttggtttatatgagattggaattatttggttgtttgtgatataaatgtgtatttcaaaattttttgggcatttaattagtatttgtattggagtctaaatagttatgtttactcagtctactgacacgatcattcttggtgcactttccatatgccaggtacattgtaagtctattactgaattattttatttgatctccaaagtacagatgaggacaataagtttatcagaataaagctatttgcttaggttcacacagttagtaaatactgaggctgggatcgaaaataagtttctctgattttaaggcctcttaatataaactctgtggcaaagagacacacacatgccccataataaaatttctgatggattaacaatggtaatctctgggtaatggaataatagttgaccatctgataaacttttccatcttataaacttttttgtattgtgatttttgcatgaacatttattttaatatcaaattagacacacacatatgtgaaattaattcaaggctgtaaagattaaaaattgaactgactttcataccaaaattacataaaattatgcaggcatactccttaagaacccttgaaacatgaaaaaatatgaaaaaattttagttccagcacagaaatgcaattacttcaagcattttatggagtaatttatatacacttttgacaagtatggttataaatataatagatataagtatggtggaaaataatgggacgtggaatcaatttgggtttgaatcacagttgtataacttgctacatttctgatcttggtacaataaaccctctgagactcagtttcctcctgtgcaattagaaaaaatacctaattagcaaatatactatctgaataaagtatgatcatgtacgtaaagaacctatcacatacatgcccaaaaagttgtagcatttattatgcaccgttcacatttcagtcataatttgccatttgtattacatttcttgaaaattgttattcataacttacttattttatgt

SEQ ID NO: 2546 - DNA, 1086 bp, Homo sapiens
acagacagaattttggtgatttgtgaacctgaaagggaagtaaaattacatttctattttcactaatttctaactggaacttagcattttctcaactatgaatgaatgtaggcaacaaacagcagcatggctggtgacttttaccataggcttcaagagactgccaaatgggctcatggcataaaagggactaaaaccccctgaaatctttctgggccaatctttatctttgtctgggccaaatggtaatgatagttccagtttcactcacttatcaggtaaaagcctagattatatactaaaatgctttcactgccagtaaaacagtacgttctagacatactgatttctcttagaaagtcctactcttattttttagataagaactcctcttctgttatgtgctggtactcaagtgtcaacagcaatggaaatgatccagactctctcaggggaagctgcaagtttaactaacaaagctaaagcatattcacattatcaggattgtttcagtgattctcaatctcatatgcattctgttaatgtggaagaaattacacagattgtgctttcagagatctctgacattgaaggtgacttgactttgaggaaaaaactatgggaagcacaagaggagtggaagcgagcctcttgggaatggaggaatagttctcttcaaagtattgatgtagaatcagtacagagaaatgtttcaaaactgatgcacataatctcggtactagaaaaaggtaaaaatgtgtttctcaaattttcccacctaggtctatataccaaatggcctttggacatcaagagcattgtccttggcttgtttctttacccattctcaggttgaccattatggctagagctacaatacaggagtataggtaggaatttcactcaggcaaaaaagagattaagtccttgtcaaaaaagttttgttaagaaattaacaatttttatgtcctttaaaagttggttccctgcatagaaccccagctacctcaccctgagtatggcccttcttagggcactggtcagagatgttttgatgataaaggaccatctgcataatcattcatt

SEQ ID NO: 2547 - DNA, 1018 bp, Homo sapiens
aaacctaactggaattagatcttcaatatttttgatgtgcctttcaaaacttgcatttaaaatttccattttggacatatcaggaattatttgctatactggatactaaagaatactttgttcattttagatgtttcagtatgaaaatgaaataaatgatatgtcaacctcagcaactaatgaagctgctcttgaaaaaatgctatttaagattattgatttttggaacactactcctttgcctttaattcttcaccacacagagatttactctatcttcataattccatctatagatgacatatcagctcagttagaagagtctcaagtcatacttgcaacaattaaaggatctccccacattgggcccattaaggtaagtattatggcaaaggaaaaatgttttctttttctgtagttttatttattatttcaatcttttgcggtctacagtttgcctttgaattgtataaatcattcatatacttatataaaaattacaatgaatatttactagtttgaataccaaaaataactttttgtagaagccttaattgttcatgagaaaatgtcaaagtttaattttggcagaaaagataaatttagatcatagaaaaatatgaccttataaccatggcttatcaccagtgtacagtgttccctgatagtccctcactgagcaaccccacgtgtggtaatacacctaataataataataattattattattattttttgagacagagtcttactccgtcacccaggctggagtgcagtggtgctgtctcggctcactgcaagctccgcctcctgggttcacgccattctcctgcctcagcctcccgagtagctgggactacaggtgcccgccacgacgcccggctaattgtttgtatttttttagtagagacgggatttcactgtgttagccaggatggtctcgatctcctgacctcatgatctgcccacctcagcctcccaaagtactgggattacaggcatgagccaccgtgcccga

SEQ ID NO: 2548 - DNA, 1059 bp, Homo sapiens
cctgtaatcccagctacttggaaggctgaggcaggagaatcgcttgaagccgggaggcagaggttgcagtgagccaagatcgtgtctttgcactccagcctgggcaacaagagcaaaactccgtcaaaaaaaaaaaaaaaaaaaaaaagagagcgagagaaagaaaagaaaagaaaaaagaaaacagatttagaaaggagatatttaaaaaatttttaaaaactagaaatcaatagccctcttaaatatagatgcaaacattctaaaaaaatatttccaaatcaagtccgtcaatatacagagaatgttgtattattaccaagagagattaatttgagaaatgcaaggttggtttaacattcaaaaatcaatctacaatttgccatattaaacataaacaggaaaaacagaagatattctcagtacattttaaaaaattttttacagaattcaacattcattcctgattaaaatatgtctcaacaaattaagaatagaagataacatcctgaataaagaacatctatgaaaaacattttgtccttaatagtgaaagactgaacgcttttcccctaagatcaagaataaggatgttctcccttaccaattctattctacattttactggagtttccagccagtgtactgaagtaagaaagagaaataaaaaatgtccagattgaaaaagaagaagtaaaatatcatttgtattccgatgacatgattacctatgtaaaaaaatcaaacaaaatttacaaactaaataaaacttattttagcaagtttgcaggatacatgattagtatacaaagtcaaattcattatatatactggcattgagaaatagcataaaaataagatatataaacctgagaaaaatgtataagatctgcacacaaaaaacttcaaaaccctgcagagagaaagaagacttaaaaaatggaagatacattgtgttcatccattgaaagacctaataaagatgtcaaatatcaccaaatggatctctagattcaacacaatcctaatcagaatcctagcagactacttgtagaaatt

SEQ ID NO: 2549 - DNA, 1035 bp, Homo sapiens
tagagaatgagataatagtggaagtggtcttgggaaatcttgacatgtatttccctagagtgtagggacattagaaactagcgcttgcctcttctctggagaattctaaagcagcctttaataacagggcaaggaagaagtgcaggaatacatggttatcttagaccagtgattttcaaccagcggtaatttttttacctctgggagtcatttcacaaagtctggaaacatttttacttgtcacaactgaggggatactactggcatctagtgggtataggccaggatattgttaaacattctacaatgcaccagaacttctccctacccccagcccccacaccaaccagaattatgtagtccaaaatgtcaacagtgcagaaactgagaaatcctgacagacatagtaggggtttccaagctagagccatcttgaaagatctccacccaaaaatggcagaacaagggaatcccagaagtatactacttagagcaggagcttaaggaatggttgtaagaggtcagctggcaagagccaatgaatggtgcaatatagaggttcctgttggggtactctgaaatctccagcaatatactttatggatacctgccatgacagagggcatgcaagaggcaaaagaggattcaaagtaacactagctgagtgaagaaaaaaagtccctctaaattcctcccctcttcaacttcagagccaagaggagtttgaatcaggttgaggctagggtgggagaggggtgggaaatataggtgaacagaaaaaaaagaaataatgcaactgtataattatagaaactatttctctcattcaattccaacaacaacagaaacaaaactaaaattaatatattaatggcttatcacatcacatgtgggttttgcttcccttttccaaagggagaaaataatgataatcttctgtaaaggaaaatttatacaccaaggctgacatggcccttacattttcttatcctctaagatgagataaccgttaatagaacttcagtgtttttatac

SEQ ID NO: 2550 - DNA, 1153 bp, Homo sapiens
atgacaaactagaataaaatggtatatgtgtgtctaagggtggggttttcttgtttattttgattttggtttcatttgttttagtttagctttattaaacttttttttagcaatttaagtatcactttcattaagcatggaatgttattttaactgatactactatatataccataactaatattgtggcttttgtttgtaagtataggtcaaaatgaggatgtaattcatatcataattaagcatatattctgaattgcatttcttttgattctggacaggattaccttgaagttaaaagattaattttcccaagattttactttcttagcaatgccgagcttcttgatattctagctgatagcagaaatcctgagtctgtacaggtaataacatctttctctgctcagcaatattatattagcgatattcagatcacaattcaataatattactgacatttgtttctggttcacagcctcatcttgtgaaatgctttgaaaatataaaacaattattgatatggaaacaagacattggccctcctgctgtaaaaatgctaatatctgctgaaggggaaggtctcgtgctgccaaagtatgataaatgttacaaactgtttagattctgtacaacgtcattatttaaaatctctgctttgaaatttttgatatattataaaagtgcgctaagcaaactgtttcttcaaagattatatccttacgtaaatatacttttgcctttccatattccctacaatacataatctcacctttgctctaattaaaagttgagaaagcagtcttcaaactcctgggtgcattctaatttgcacttacattttgttctgtcattaaattctgccttaagtttcctactctctttttagtgctttttccctttttggttttagtatatgaatatagataagaagaaaattggctatttggagttgttgatgctactcccactactgcttctgctgatctctggtttcactgtggtttgctcccaggcaataatgacaaactaggtccttccattacactggttcaatttgccagccccagcaagggctctctaacctttggcaagtggtcctgatgtaagttgatttttaaaaaaatgctgtgcccaacccttcttatctacc

SEQ ID NO: 2551 - DNA, 1070 bp, Homo sapiens
tgtgctaaaaaagtaagtacaattttcaaatcctaaaattatatattttatatatatacttgcacatatatatatacacacacattttttaaaactcacttatctactaatctaagtgagaaatatccagaaaagaatatggagtcaaatctcttatgaaatgggttttaatggaacatgatgacacatgatgactaaatggaaaataatcacttttacagtgtaactgtcagtttgagagtgtttacatgcacaaccttcagatggcttttgtgtacgttgagattcagctgtatcagaaaactgttcaggatctgaactctgctcagtagggctcccgtttgagcacacctcactactttgcattttggttctacttttacttcctaggattgtttacttggcttactctttctaacgttctccttttcatatttaagtctatcattgcatctgtttagaatgaagaaaaaaacctcagagcgtgaactttcaaaactaacttgactagaactgttatattgtatttctaattattcattgttggtaatagaaaggctattgacttttaggtttttatatctatagttgttaatattattctgaaggccaatacaaggtttctagagcagagaagattatgatttacttacataaataaccattctggctctccttttcttcaattcttgtaaccacccagtgggttcaccttgcctgctgcctagacagagccaatttatcaagacaggggaaatgcagtggagaaagagtaattcacacaagccagctgtataggagaccagttttattattactcaactcagtctcctggagaattcagggatcagagtttttaaggataatttggcaggtaggggctccagaagtggggagtactgattggtcaggttggagatggaatcatagcgggggtcaaagtgagcttttcttgctgtcttctgttcctggatgggatcccagaactgattgagccagattaccagactgggtggtgtcagctgatccatcaagtgcagggccagcaaaatatctcaagcactgatctt

SEQ ID NO: 2552 - DNA, 1059 bp, Homo sapiens
tatctcttcctttgcaattctttttaaaatgccattttttcatgttattttagatgcaaattttatttaacatcgaaaagtacaactgacagcatcctttttttgttcttaattttattggaaaagcttctagtgtttgaccataatgcataggtttctggaatatacgccttatccaactaaagatatttcatcctattcatagtttgcagagttttaaagagatttaatttatttttaatttttaattgagaaataataattgtatctattatggcatacattgtgatgttttgatacatgtacacaatgtaaaatgattgattcaagctaattaaaatactcatcacctcacatgcttattttttatggtgaaaacatttcaagtttacttttagctattgcgaaacatacattattattaactatagtgacctgctgtgcagtagatcgctaaaatttattcctagtctaactgaaactttgtatccttagactaacttctcccctttcctcatccctccccactttcaccctctggttaacaccattctactctctacttctgtgaatagagaatgttttttagattctccatataaatgagatcatacaatattcatctttcttggcctggcttatttcacttagcatacataatgtcctccagggttattcatgttgtcataagtgatagaatttacctcttttttgggaggccgaggtgggtggatcccctgagatcaggagtttgagaccagcctggccaacatggtgaaaccctgtctctactaaaaatacaaaatttagccaggcatggtgatgcacacctgtagtcccagctacttgggaggctgaggcaggagaatcccttgaacccgggaggcggaggttgcagtgagctgagattgtgccactgcactccagcctgggtgacagagcgagactccatctcaaattaaataaataaataaataaatagaaataaataataaataaataattaaataatttttttctaaagagaatgtacaagtacattcatcaaatgtaacagat

SEQ ID NO: 2553 - DNA, 1029 bp, Homo sapiens
aggcagacatctcactctgttgcccaagctggagtgcagtggcatgatctcggcttactgcaacctctgcctcccgggttcaagcaattctcatgctggtattacaggtggtgccaccacacctggctaatttttgtatttttagtagaggtggggttttaccatgttggccaggctggtctcaaaatcttgacctcagtgtgatctgcccgcctcagcctcctgaagtgctggaattacaggcatgagccaccacacccagtgagataaaaagcaaagtgggtatactggccacatacctgaagagccctcttgtcttattactctgaattaatgtgcttttattgaaaagctctgtaataacagtatttattagtattactaatgtttagcaataaaagcaaaaattttttctctttaggtaattttaatactcatatgatttatggacatataaaattgtatcataatctaatatttctaatgcaagctaatggatactaacttgtggctttcctctcatggattttgttcaaactgttaaagctagtattacaggactcataaatctgtggatatagttgggggtgggggggtcacagtaacatttcactgactcttctacacctcatcctctgcaaagttttccccatttatgtccagagagttccccaggttttgtcccaattgttttcctgttttcaccaccctctttggtatcagctgtccaagaaatcactgtaggatttctcccattgtctctaccactgatgctgattgtaagacactgatgttcatgccaagcattctatctcatagtggtcccaaagtttttaaactggggctagggacacttgggagacaggctgtgttccatgctgaagcaggatatctgtgctgtgccccattctgtgttctactatatcttccaggcagagctcttttattccctaagtgtctcccaggttccttttactatgtaagtcaactcattcagctaggtatcttccagcctcaggtcccagaaac

SEQ ID NO: 2554 - DNA, 1045 bp, Homo sapiens
cccatctctactaaaaataaaataattagccagctgtgatggcacgcacctgtagtcccacatactcaggaggctgaggcacaagaatcgcttgaacctgggaggcagaggttgcagtgagtccagattgtaccactgcacaccagcctgggcaacagagcaagactctgtctcaaagaaaataaaaacaaaaacaaaacatatgattgtctcagtagatgcagaaaaagcattttataaaatccaacatccctttttgataaaaagtctcaacaaactaggcatcaaaggaacatatcttaaaaaaaagagagagagagagaaagaaagaaagaaagaaaaataaagaaagaaagaagccatactgaataggtggaagctaaaagcattccccttaagaattggaataagacaaggatgcccactcacaccactcttatgcattatagtacgggaagtcctagccagaacaaccaggtaaaagaaagaaataaaagacatccaaataggaaaagaggaagttaaattatgcctctttgctgatggtatgactctgtacctgttattaaaataaaaaataaaaaataaattttaaaaaacatagccaagaggctcctaaatctggtaaacaacttcagcaaagtttcaggacacaaaatcaatgtaaaaaaaaaaaatcagtagcatttctatacaccaataacattcatgctgagagccaaataaagaacacaaactcatttattatagccacaaaaaataaaatagtcaatggatatagagatatattggttaataaacttaaaatcattaatgaatgaataaatctgtaaattttgttttaggtttgtgttggtgtgatgttagtgggcccaacaggtggaggaaagacaacagtcagaagaattttggaaaaagcattaacgctattaccaattgcagacttcttatcagttgcagaaagaaaatctgcttcaaaggtaaatgttctgttaaataaaatgtttctctatttgttcatatcttattttacactttaatattt

SEQ ID NO: 2555 - DNA, 1034 bp, Homo sapiens
ttcttcttttaattggcaaacttaatctattttattttgattactgatgatggacttttgcctttttgcgattttattctatgtcttgtatcttttttgtttctcaattcctccaaaattgccttttgtgtttgatttttttctagtgtaacatttggattccttcttcatttccttttcattttttactcatttttaaaatagttacctgggagattgcagttaacaactgttagggtctgaattgtgtcccccccacccaaaattcatgtgttaaatctccaacccacagtacctcagcttgtatctccccttattcatggggaatacattccatgaccccaagtggatgcctggggccacagatagtactgaaccctatatatactatgttttttcccatacatacatatctatgatgaagtttaatttataaatttgacacagtaaaagatgaacaatgacaactaatgaaatagaacaattataaaaaatatgatgtaataaaaattatgtgaatgtgatctctatctctcaaaatatcttattatatatactgtattcacccttcttcttgtgtatgtcgatctgataactgagttgttactgagtgactgattagcaggtagatttatgtcccaggtgggacagagccagatggtgcaagatttcatgtaactactcaaaatagcatgaaacttaaaacttacaaattgtttatttctagaattttccatttaatatttttggactgcagttgaccacaggtaaatgcaactgcagaacatgaaactatagaaaagggaggattacagtatatttggagatacagcctttaaagaggtgattaagttaaaataaagctattacagcaggccctaatccaatttgacttgtgtacttataagaaaaggaaatttacaaacacaaagtgacattagaggtgtgtgtatgcacagagaaaagaccacatgaagacacagtgagaaggcagttatcagcaagtcaaggattgaggtcttgaagaaatcaaa

SEQ ID NO: 2556 - DNA, 1054 bp, Homo sapiens
acttaatgctattcctatcaactaccagtgacatttttcacagaattagaaaaaactattataaaattcttaggaaacaaaaaagagcctgaatgaagctgaaggcatcatgttacccaatttcaaactatactacaaggctacagtaaccaaaacaacatgatacttatacaaatgcagacacatagacaagtagagcagaatagcccagaaataatactgcacacttacaaccatctgatctttgacaaagttgacaaaaagttgccaaagtttgaaaaaataagcagtggcaaaaggacttcctgttcaatacatgatgttgggatacctggctagatgtatgcagaagattgaaactggaccccttcctttcacgatatacaaaaatcaactcaagatagattaatgatttacatgtaaaacttgaaactatagaagaaacctaggaaaatcattctgtatatgtgcctgggcaaagatttcatgatgaagacaccaaaagcaattgcaatgaaacaaaaattgataattgggacctaattaaagagctgctgcacagaaaaaaaggctatcaacagaataagcagataacctatagaattggagaaaatatttgcaaactgtgtatccgataaaaatctaatatctggaatccataagaaacttaaacaaattggcaagaaaaaaacatccccactaaaaagtgggcaaaggatatgaacagacacttctccaaagaagatatacattgagccaataaccatatgaaaaaatactcatcatcactaattattagaaaaatgcaaatgaaaatcacaatgagataccatctcacaccagtcagaatggctattacaaaaagttaaaaaataacagatgctagcaagggtatggagaaaaggggacacactgcttgtgggaatgtaaattagttcagccactgtggaaagcacagtgatttggtgatttctcaaagaacttagaactaccattcaatccagccatcccattattgggcatatatgcccaaattaacataaatcattctacc

SEQ ID NO: 2557 - DNA, 1028 bp, Homo sapiens
tgaaaggttaacattcatataacagaacctccagaaagatatagtaaaaataaatagaggggaagaaatgtttcaggaaataattgcctaggagttcagagaattagagaaaatatgagacctaagattgaataggatcctggagtatttaaacatgacaaaaagtaaaaacccacacctagaaatgttagatagataaattttcctacacctcttggatgttctgttcttttttgtttgttttctttattctctttgtgtttctgtttggttgatttctattgacttgtcctccaatttactgattccttgctctgctacatgcagtctgctgtaagcccattgaaagaattctcatatttgatattgtggtttttatttccagcatttccattgaccttcttatagttttcatctctcttctggaattccctctctgtccatgaatgatttcttccttcaacattagatcttttacattttaatcatagttttttaaaaaaattcctgactgataatttcaacatctggccatctctgggtctgttcttttgactgctttatctcttggcaacatgacttttcttaatctttcttatttttatgtctcataatttttaattgaataccagatattgtgtataaaagaaattagagactgaggtatacagtagttatacctggaaatgggcatactttttcttctgccacattgttcaggtagtggcacagtgggttgagtcaatattgacctagatttggctgttagtgttactatagttaccttcagtgcaccacagactttaaattttccatgctcctgtacctttcctggcaatagattgctgttgtttgttacttggttcaaggttcatggtgggaacaggggagatttacaggttctcatgttatagcctcattttaaggcagggtctgtgcacctgagcctcaggcatggtgtttctcagcaaagaaacaatttattgtgaatagctacattcaatatcaatttatgaataatacctaag

SEQ ID NO: 2558 - DNA, 1037 bp, Homo sapiens
tttcccatggtcttcgcaacctgcagaccaggagattcccttgggtgcctacaccacaagggccttgggtttcaagcacgaaactgggtggctattacggcagacaccgagctagctgcaggagtttttcttcgtaccccagtggggtacttactggcctgtaatgccagtaagacagaatcattcactgccctggaaaggaggctgaaaccagaaagccacgtggtctagttcagcagatcccaaccccagggagcccagcaagctaagatccaatggcttgaaattcttgctgccagcacagcagtatgaagtttacctgggactctcgagcttggtatggggaagggcatccaccattacagaggcttgaataggcagttttcccctcactgtgtaaacaaaggaactgggaagttcaaactaggcagagcccaacacagcaccgcaaagccactgtatccagactgcctctctagattcctcctctctgggcagggcatttctgaaagaaaggcagcagcccaagtcaggggcttatagataaaactcccatctgcctgggacagagcacctgggggaagggttggctgctgcttcagcagacttaaacattccttctgctgtctcagaagagagcagtggctcttccagcacagtgctcgagctctgctaaaggacagactgcctcaagtgggtccctgacccccgagcctcctgactgggataaacctcccagcaggggccaacaaacacctcatacaggagagccccagctggcatctggtgggtgcccctgtgggatgaagcttacagaggaaggagcaggcagcaatctttgctgttctgcaacctccgctgctgatacccaggcaaacaggatctggagtggacctctagcaaactccaacagacctgcagcaaagagtcctgactattagaaggaaaactaacaaacagaaaggaagagcatcaacatcaacagaaagtaagtccacacagaagcctcatctgaaggtcaccagcatcaaagacca

SEQ ID NO: 2559 - DNA, 1022 bp, Homo sapiens
acccaataccctcattatagtgaaagaagctgaagaaaattacattcctgtttggttttaggtgctacgaaaacctataatgccagtaaggcagaagataaagccataaaactatcaattcagttactctgagctcatctgctgtgtttctggatctgtattatccatatcgccatgtagcaagaagttctgtaggatcataatattatagtcttatatttcttttttttaaaaaaatccaaattattttataaagccttagatttccttagtacttgtgctttttgaatcggttctaacaaatggaatccatcctattactttgaaacagtaaacatttgcaattagctgttgttgactaaaagaactttgagtaggtaaagtgattgttgatgcaggtaccaaaaagagacaaaatattaagcataaatatatttagaagaactttgttaaataaagatgaatgctaacaacattataccaaaaatacaaatcctactgatttgtctgatgtacttgtttgaggttacagtcatacattgctgaacaactgggatgtgttctgagaaatgtgctgttgggggatttttttcatggtgtgaatgtcaaagagtgaacttacacaaatctagatagtgtagcctactacacacctaggctatatggcataacctattgctctaaggctacaaatatgtacagcatgttactctactgaatactgtaggcaattgtaacaaactagtatttgtgcatctaaacatatctaaccatagaaaaggtacagtaaaaattcagtataaaagatttaaaatatggtacacctgaatagggcacttaccatgaatggaacttgcaggactggaagttgttctgagttagtggagagtgactgtgaaggcctcagacattactgtacattactgtagactttataaatactgtacacttaggctacactaaatttatttgtaaatttttctttcttcaggctgtgtgcagtagcccatgcctgtaatccc

SEQ ID NO: 2560 - DNA, 1038 bp, Homo sapiens
tgggatcagtggtgatatccccttcatcattttttattgtatctatttgattcatctattgtcttctttattagtctggctagtggtctatctattttgttaatcttttcaaaaaaacagctcttggatggttgatcttatgaagggtttttcatgtctctatctccttcagttctgctctgatcttagttatttcttgtcttctgctagcttttgaatttgtttgctcttgcttctctagttcttttaattgtgatgttagggtgtcgattttagatctttcccgctttctgatgtgggcacttagtgctataaatttccctcttaacactgctttagctctgtcccagagattctggtacatgtgcctttgttctcattggtttcaaaaaatttatttatttctgccttatttgattatttacccagtagtcattccagagcaggttgctcagtttccatgtagttttgtggttttgagtgagtttcttaatcctgagttctaatttgattgcaatgtggtctgagagactgttatgatttcctttcttttgcatttgctgagagagtgttttacttccacttatgtgatcaattttagaataagtgctatgtggtgctgagaagaatgtatattctgtagatttggggtggagagttctgtagatgtctattaggttcatttggtccagagctgagttcaagtcctgaatatccttgttaattttctgtcttgttgatctgtctaatattcacagtggggtgttacagtttcccaccattattgtgtgggagtctgagtctcttctgcaaagtctcaggacacaaaatcaatgtgcaaaatcacaagcattcctatacaccaatataggcaatatattgacaataatagacaataatataataggacaaacagccaaatcatgagtgaactcacatttacatttgctacaaagaaaataaaatacctaggaatacaacttacaaggtacgtgaaggacctcttcaaggagaactacaaactgctgctcaaggaaa

SEQ ID NO: 2561 - DNA, 1031 bp, Homo sapiens
agctaaaagtgcctctagtgtcctctgtggtaatgaaagtgatgatgaaagtgacttgcagaatgactttaatttagtggaaatgattgcttctccaatacatgcgacatttaggaactcctggacataatcaatggagttttctcaggaataggaagacttttaagagtaatgaactaataacttttatgattgactatattgtgacatgattacattttcctgaaacaaatcttaacatattttatttctgcatagccatgtacttttcttttcttttttttctttcttttttttttttgagacggagtctctgtcgcccaggctggagtgcagtggcgcaatctcggctcactgcaagctccgcctcctgggttcaggccattcttctgcctcagcctcccgagtagctgggactgcaggcgtctgccaccacacccggctaattttttgtatttttagtagagatggggtttcaccgcgttagccaggatggtctcgatctcctgaactcctgatctgccagccttggcctcccaaagtgctgggattacaggcgtgagccaccgtgcccagccagccatgtacttttcatatatacaattaatgaaaataaaataatcctaatgacaaaaaaaaaaaaaagatgaggtgaatagtactttctaggtcatttgaaactttttttaaaatgttaacttaggaacttcattactaactaatcttcaaagatctggcggaaacttcttgaagataacagaatgtggagaatgcattaattataccgctaccagagacacaacatgcctttcttttctcatgagccttcttttaaagaattcctgccctgtacttctcacaggtattacaaatatttaatagaaggagaatttcagagttagaaaaagatttacagatatttggtctaactatcttattttgtaagtgggaaaaaaatatacactgaaaagttttggttactatattaatttattttcttaccagcagtttatgaacacccatttttccac

SEQ ID NO: 2562 - DNA, 1016 bp, Homo sapiens
tcataacaccctatgatataggtcctgttattatcctgattttacagatgaagaaaccgagcagagtaagattaagatctcacctaaggtcaccctgctagttaagtggtggagtcattattcaaacctaggatatctaatgacatatattttcgaattatcataccataccacccctcaatcttcatttagccatttgcgaaacaaacatcttctaaatgcctatcaggaattcccagtgccagacagcaagtgggataagtgctgaggactacctaggactagtatggaccctgcctccaagcacattacaacctaagaagtgcaatgcatttctgtcagtgctataacgtcagtgctgtgacagacctatgcacacaatatagtggtggaacaaaggaggaaggagtaatttattctacctgattttaggggagagggagatggtcagacttcaaataagaggtagcccatgaccttggtgtgaaagataagcaagaatttgccaagtaaaccaggaaaggacatgtggaaacttgcagaactgtagtggtaaactaagggaagattctttttctcagactgttgctggaactacaagatatttctagcaacaggagttcttaacctgggatccacagaccctcaaagcgttcttaaataaaaccatattctaatatatttgggggtttttggtaacccttatattttgatatatgcattttaaaatattattttgagaaagagtccacaggctttctaaacctttataaaccaagaggagtttatagcacaaaaaaagttaagaacacattagtcctagatccactgtgccaggagcttctccaacacagatatatgctgtgagttttgataacaagtagaattgtgctattaatggatagtgttaaattcttatcttacaatagattcagtggacccaagaaaacctgatgaatcactcaactgtatttttggacttcttggatataaacaagactcatagaaaaaagatt

SEQ ID NO: 2563 - DNA, 1032 bp, Homo sapiens
ttggcctcttgtcatacctaattagctcatcattgttttttaccttataacatggttgaagaaaaatttatatcaagaataaaagaagtgtcagcctgccttttgcttgttattcacttgtgcttccattattagcattgctttcaatccagtgtttctttcagacatctttttaagctacctgcccatgttttaggagctgacatttcaaactaggtaacagaagaggcaaatccctcacttggatacgagtaagctgcaaggcttcctcgtgtcctcagtgttaagcaaataggggaggccccattcctgagccttctcagatggggagcttcccctcttccattaaggtgccacctatctcactgagtgacccagaacttctgcaatgccaaccacctgaaggtgccactgttgatcaatatattaaatatgagtaaggggccgagcggggtggcttatgcctgtaatcccagcactttgggaggccgaggcgggtagattacgaggtgaggaaaccatgaccatcctggccaacatggtgaaaccccgtctctactaaaaatacaaaaattagctgaatgtggtggtgcaggcctgtaatcccagctacttaggaggctgaggcaggacaatcacttgaacctaggaggcggagattgcagtgagccaagatggcgccactgcactccagcctggtgagagagcaagactcggaggggggagggatagcattaggagatatacctaatgctaaatggcgagttaatgggtgcagcacaccagcatggcacatgtatacatatgtaactaacctgcacattgtgcacatgtaccctaaaacttaaagtataataataataaataaataaataaaaataaaaaaagaaaaataaataaataaataaataagagtacggcttaatttcagtatttaatattttaagccaattaaaaattgatacagagaaattcatggcgtttgtttttgctttttgttttgcatggttttgttttgttttgttttgtttt

SEQ ID NO: 2564 - DNA, 1037 bp, Homo sapiens
ataacgtaaagcaatatggaaggaatgttatcagtcatttattaagtgtaaatggatgcattctctcaataaaaggcaagactattaaattgggttacaaaacaaaacccagaaatgtgcaatttatacgaaaaagtgaaattaatgaagaaattttgaaattatcaagaaaataaaaaagaagaaagcagaaatggcaatattaatattagtcagaatgtaatgactgagagtgctatattcttcagacaacagcatattgtagcatatatatatatatatatacacacatgtatatatacactggtatacatgtacatatatatgtatatatgtatatgcaattattgtgggaaatttcaaaaaacctccatcaggattggacagctctaataaacaaatataagatgaatagaataatgtagtcaacaaatttgattaacagatagatcgagagactaacatccctctaataaaaagtacatattttttcaggtatccaaggaactgttacacaactcagtcatgagcatggccacaaagaaaaacctttaatgattttatgggccacgttatctgaacacaatttaatataataaaaatttgacccctaaaaatctaaacaacttggatattaagaaacataactctagataaccttttatcaaataggatattaaaagggaaatcagccaggctcggtggctcacagctgtaatctcagcactttgggagggtaaggtgggcggatcacctgaggtcaggagttcaagaccagcctggccaacatgatgaaacctgcacggtggctcacgcccataatcccagcactttgggaggccgaggcagttggatcacctaaggtcgggagttagagaccagcctgaccaacgaggagtaaccccatctctactgaaaacaaaaattagcctggcgtggtggcacatgcctataatcccagctactcaggaggcaggagagttgcttgaacccgggaggtggaggttgcagtgagctgagatcacagcacttcactc

SEQ ID NO: 2565 - DNA, 1100 bp, Homo sapiens
aattatgtttctgttctggcttgtagataagtagcagtttttattttattttattttatttatttattttttttgaaatggagtctcgctctgtccccaggctggagtgcaatggtgcgatctcggctcactgcaagctccacctccctggttcacaccattctcttgcctcagcctcccgattagctgggactgcaggcactcatcaccacgcccggctaattttttgtattttttagtagagacggggtttcaccgtgttagccaggatggtctcaatctcctgactttatgatccacccgccttggcctcccaaagtgctgagattacaggcgtgagccaccgcgcctggccgatacttagcagtttttaaaacagctagctaaacaagagttactgatactggttagggaaaaactgcgatacactgtgcttgaatccatcactgaaaaaaaataatgttcgtggaagtgttcttgggagatgtcttataggaatatgctaatatctaaatgccttggcaatctgtagaatattgaacataaagtattgtgtaacatggaacttcagtataggagttattctggtttttggaaaagttgttggtggagacttcaaggcagaattctgcttttatgtaataatgcgttatgttctaccttcgtgataaagacctgattttgctgaatattttagtctgaatctgcttgctaagatttgtggaaaaatggaaagtgtgagttgcactgacctgcagcactgtttgctaatgaatggatttggactttttaactagccatttctgctaaatgttttcctccctttcctgtcattcctctgtggctaggtgtgttggtgtatattcttattggcaagaaatgccaccttataagtctcacagacattccctgaatgtggatgtgttttgagaatgttcagtacatctcttcaaactggctgcaaataaaatatccaactttttaagtcttaaataaatggtagcaaaggaatgaactaaaatagctgattttttttttaacttcatttcggtttagtttatagtaaaaatgcctttagatgtttgggggtatttattcta

SEQ ID NO: 2566 - DNA, 1024 bp, Homo sapiens
agactacaggtgtgcaccaccacactcagctaatttttaaatttttttgtcaagacagggtctcattatattgcccaggttgatctggaactcctggactcaagccatctttctgccttagcctcccaaaccactgggattatgggtgtgaaccactaagtacttcttaaatcttgacattccacacagaaaaattttaattgtgattgtcacagagtggttaggtatacttgctgaagaaaaacccctatgtcctgtcttaaaaataggggaataggccgggcgcggtggctcgtgctggtaatcccagcattttgggaggctgaggtgggcggatcatgaggtcaggagttcgagaccagcctgaccaacacagtgaaaccccgtctctactaaaaatacaaatattagcatggtggtgggtgcctgtaatctcagctacttgggaggctgaggcaggagaatcgcttgaacctgggactgggaggcagaggttgcaatgagccaagattgtgccactgcactctagcctgggtgacagaactagactcggtctcaaaaaaaataaaataagggaataaatgcagaacgaattttaatacaaaaggccttatctccaattgatggctctttttgccctgttaatgattgaatataattaaggatccatgttaacttcgacttttttataatcccatgtatccatcatttttctaatcccataattgatttagaatactgtcttctatggacctaaaatctttttctgtcagaaatttcagtgagaaggtatgtacattctctcataggacatgtgctaaaattttgatgatgaagattaatatggcctttttacaagattgccgcacaaatttgtacaatgcgtggataaaaatttttttaagtgagttgtttaaaaggctcacttaaaaaaatcagttgggcatgatgaggttgaacttcaagttatttaagttgttgacttttattataggatcattagttcctgttgtttaaaactcat

SEQ ID NO: 2567 - DNA, 1735 bp, Homo sapiens
aattagctaggtgtggttgtgtgtgcctgtagtcccagctactcaggaagctgaggatcgcttgagcccaggacgcaggttgcagtgagctgagattgcaccactacacccccaacctgggccacagagtgagacactgtctcaaaaatacataccttcagcaaatcaagattttttttttttttttttttgagacggaatctcactctgtcgcccaggctggagtgcagtggcatgatcttggctcactgcagccctcactcctgggttcaagcgattctcctgcctcagcctcctaagtagctgggattacaggcacacgccaccacgcccagctaatttttgtatttttagtagagacggggtttcaccatattggccaggctggtttcgaactgctgacctggtggtccgcctgcctcggcctcccagagtgctgggattacaggcgtaagccaccacgcctggccaagaaaatcaagatttacctggtttatgtgttgaccagctatacacagagaattctagatttttttctaaaaattattatcaaacccccaatttcaccagtagaaaaagagatcttaagatttctgtgtttttttttccagcataactcagttacttatggctgggagaaaatatgtagggagataatctaatacctaattcgaaggaagaaaatatctaattctaagtcttgagttcttctcatcagaccatagcaggatttaacatttaacatttttcagaagcttctaatagacttcattcagttttttgtccacagcagtggcatttaaattactgtactttaagacatggaattgctggaggcttggaaacttgagtgcaatttccctagtacgacctccaaggagaatagagcaaaacagtggtaggaaaaactctcaaaattttacccaattgtatgttttctacattgtcagtatctagttttatatagttaatatgtacttctaaaatttctgacagtgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagct

SEQ ID NO: 2568 - DNA, 1047 bp, Homo sapiens
cttctccaactcccatggcctccccagtggggccagtgctgaaagaggctggctctgtgctcgctcctcagccctgaggcctgttcctccgccatctctcctctctccctgtccttgacaccagcccagcctcaccccggcccctctctctgccttcagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggtgagtgtgctcaggggtcctcgcccactgccggctccactggggcagggagacacccgcggggtaacctcaccaccccaccccaatgctgcccacagaaggaagcctcttgtaaggacctcccagctctttagatctttaaactgcattttcccatagaatcaagaggatggaccctcagcagattcccaggccaatttagcaactctgtttagccgactcagtattcatagtggctttcacccctgatctcccacccctgagtctatatcctacactgagaagcagagggatggagggggtgaggtaggaggaatcctgggagtgggcagctctggggctgcaggggagaggggagagggtgccctggggccttggggaagaggttcccaggcagtgagggagggcccagcaaccatgtctgccaccagggtcctgttaaaggacaatactttttcaaaaaggtaaatttataaaggaaccagtaaaattttaaaaagaaacaattcaaagacaaataagaacactgaaattaatttgctaacagacacaaaacttgtcaacatccacagagtaatatcaattaaatctccatgggacaaaattcatttgcctctatgaacaagagtcattcgcattaccctcagttctttacaattcacagaactgtaaaatagct

SEQ ID NO: 2569 - DNA, 1032 bp, Homo sapiens
agaggcgtaggcccttcagtttgaaggaagctgagcaggcagtgtgccaggccctgggagacagtgggaaggtatcgtccctgtttatcagatgaggatgccgaggcagagttaaggaagcgaggcatgtgagcacccaggagttaaggcaggcctgtgctcgaacgtggcttcctgcacacagccccgccctctgcggccagtgccacacatcacacctgaagctccagctctctggtccccaggcctgagtctctcccttgctccccgctccccgccaggctctgctctgaatgactctcctgtgggtctggctgcctatattctagagaagttttccacctggaccaatacggaattccgatacctggaggatggaggcctggaaaggtgaggccctggtttgcccctgcagtcatgaccctggtcccagcagccaacctcctcaccctcttcatccccttgtctggttgctctgcatggggcactcagcaaattctattgttggctttcttacaaatcctcaccctgtgaccaacgtagctgcattttttgggtgaggtggcctggtgggttgttcccagcctcacagtgcatggtcaagactaggatgcaggctcacctgcttgtgctccttttgctgaacaggcccctctggggattagggagcccacagggcagcaggcaccacattattgtcaagagcacctgggcttttcctcctgattccctggagagcctggcatcagggtcacgtgactgcgtgttccaggagggtggtcgcagaaagacaggaggctgttaatctctcagagccttagaggctgtatcctctacatgcctgactcccagctctgtggcctgactcaggcttcaccaaggtcagctctgacccaccctttccagggcccatccctttattccttcagtgacacacaggaccagacagtgctggggatgggaaagacagtaaaatgagactgaatcctgccttgggggtagggactctgtcttggccatgctgtagcccca

SEQ ID NO: 2570 - DNA, 1028 bp, Homo sapiens
caggcttttcttggggaagataccccttttctgaggaatgagtttgcctccgtcccctgcccatgctgggagcccacgctcaccccctcacccctccaagctcactccccaacccccaactccgtgtggtaagcaacatggctttgatgataaacgactttactctaaaagcggctggaactcagtgacatgagcgtgcgctgaccccacatggggccccctgtgcaagcagagctggccggcccctccttgctggcagaggcacgggaggcctgctggggatgaggccactggccagggctatgctgcaccagaccaatggcaccgcccccacccctcccagcgcaggggcagcttggagcagaggcagcactggccaccactgcgggggcaagtcagcgtcaagagagtccctgagtgagaaggcccagataagcccaggccccccaggccagcggacaggcacaggcagggcctacagaggtgccaaggccccaggccagttgtgctaggagcctggacctgctcttccacacccccatcccgcccctactgcacaggcttgtgccttggtgccccctggaggcagcagggaggaggcttctcaggcagaagtcttaagttgcatcccattccccagaatccccaggagggagaagagggatgggctgcccctccttcctgccagagccacagctcaagggcagtgggatggccctgcacccagcccaggtaccccttcctctgtgccgaccatgctgtcctttggctccgaggaggccctgagcactgcccacccccacaccttggagggagcagacggagggggtgagtactgcacagagcctgcctggaggtgcagactcatgcactcagccctgaagaggtgagagaggctggatcttaactgtggtccaatgggcatattatgagtggtccttgtccctgcctgctatggggtaaccctgacccagctagcgtccctgacaacatgatacaaaaacacagaactctagcgggatacagag

SEQ ID NO: 2571 - DNA, 1033 bp, Homo sapiens
cacagagaaggggagatttggactggaccttttggttactcattttgtgtgtgtgtgtgtgtgtgtgtgtgtgtgtgaatgcaatgtatgcatttcaggaggggatggtggcaatgggtaaaggtactgaggtaggaatatgtatgactcacttagagtacaaatatcctgatattgctggagtcaggggaataaaggaagaaaagattgaaaagttgggtaagtcagaaccaaacaatgaggaggcttaattatcaaattctcaagattttgactctcagtatattccagaataaattaagataagaaactggcccataaggacaggtaaagctcatgcttgacgtgaaatagtaaaggaatggaattggctgcagaaagaatgaagaaggatagcttagaagagatggtttacctagagaagtaattctcacggcgtggtccctggactggagcatcagcatcaactaggaacttgttggaaatgcaaattgctgggcccctgcaagacttattatcagaaactctggggctggactcagcgatctgagttttaaacagcacactcaagtttgagaactagtgaactagataaataatccttttagcagataaacagtgtagcagaattctctctatccaatttatgttctacatatgaaaaaacaaaactgttaaaccaattatttgaatcatttttaaaactttttttgttggccgggggtggtgattcacgcctgtaatcccaccactttgagaggctgaggtggttggatcacttgagccaaggagttcaagaccagcttaggtaacacagcaaaaccacacctctacccaaaatacaaaaattagccagtctcataacctggtctcaaaataaataaacacatagattaaattttaaaataaaataaacaaaccctttttatataaacattttaaacctacacaaaagtagacagaacaataaaccttcatatacccatcatcagatttaacaattatcaagatgttgccacgttatcactttctc

SEQ ID NO: 2572 - DNA, 1090 bp, Homo sapiens
ttcccttttttggagaggcggaaacttgatgcatttgaaatgcaaaaaaaacttttgcattttggagggcggcacgtggcaggggataggggtattttcgagcgatttggtgttttgtctctttggaacggaatcggatacgttttgcgattgtttccattttgttctggtcggggagccgagttggttcctgctcgaggcgctgggagcgaggcgggcaggttgggggaccctgtgccgagggacccgaaggaggcaaaaccaaaagtttatgtggtgcttggggtggaccggtcggcggatgtcgtgcgttaattaaagcctgggtgcggggcactttttatttcactgcgaagcctgtgaggactggacgcgaggacggggctttgtagaatgctcgctggtggtagctgttgttcctctcttgttttttcgagacgcctttttgtcaacataactgtaaagatgcaaaaccaagaatattttcagatatttacagcaatccatcaacagtcagacgaagggggggcagccaaagtgggggggagtaagaccttttttttgctgtaatttgactcgaccttccagtggtttgtgccttttttcttttgacttgtttgtggatggaatgtttacagacatttctaattactgctttaattaaataaattggatcaaaggccgttcgaggtatttttgttttgccgtttgtcgctcagaattggcattttgagaggtgattgatactgctaacaattttctagtactctagtttgtttcaagaagagattttgggtagacgtaatcttcaccctttcaaattatataacaatacgaacattattttttatactgatcataatttccagatttggggagggggtgatcgtggcaggaaaagttgtatgtttggtagttgcatatggtgatttttgatttttcaatgctggtaggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaa

SEQ ID NO: 2573 - DNA, 1050 bp, Homo sapiens
agcgcagctatcggtgctttgcaggtaaaatggtgggtgggaagactcagagtttgtattcctgttgtgtaccaagaacagttccaaattgttgcatgtgcttatatcatttaatcacaagcctgtcaggtagttgatattgttacttcactgttgagacttcagaaaggttaaattgctcaaggtcatacacgtagaaaatggcaaaaccataatttgaacctatttgactccaaggcttagtgcacattccattataccatttaaaattttgaaacattgcactaaaaacaatatttaaagaaaatcctctggtttggtttatggatgctgcaggacattaagaagaacttgagactagaggtctatatttgtagtaacaatttcaaacaacagtgcctagaataaaagaaatgtctcttcaggtcctgaagaaacatataggtagagagagcttaatacctaggatgggaataggcagtattaaaaaattatgcattaagacgtaaaaggagcagtgagtggaggataggattggattggcaagattgggggaacggtgcttaaaggtgatactggacgtgtaaaggggccaggatttgccttgtggtttcctaaaggggattagggattgccacttacatgtggagcatattgaatttaatcttaatctctagcatgtcaggacttagagaaatactgttctagagatatttatgtatttgagatatttgtggtttaagttaagaccaaaacttgaaattcctacaagatacttgataaaggtatgtagacgtcattaacatcagtcacttaagtaacctattttatattgtgtggttggattctttagttgcaagtatcccagaatacagtaaagctaccacctccatcagaagcatgcagttgggggtcgttaaaaatgctgattgttaggcaccattgcagacctgaatcattctgggggtggggagggggcatccagaatctaagtacattccattggaggattttcaaggctgctgttgctgtgctgggcttttgctttat

SEQ ID NO: 2574 - DNA, 1062 bp, Homo sapiens
gtagcttgtaccacattttacaaaagcattctagctttctgtaatcccgaggtgccaggttaagcaaaattaaactgttttctttcctgatataatagctgatatgcgttgtgagcccctaaggaggctacaatatgccattttttccaggatttctacccacttctagaatatcttaagaacgaatctcggaatattaaggacttttgcttttaatacctgtggaataggtaagatgcgagggactacttgcatagaatagaaacattttttaaaactagcaaatattgaaaatctacttgaggacaaggcatttggagtattaaatgagatttctgttatcaagtaacttaagggcaccaaaaaatggctgataatgcaaggtcattgtgagtgccaaggaactaggagttcagggttgcctgcactggcaacaggagcaagagacaagtatgcgattttctccttcatggaatagtcttgagctgggccttaaagggtagataagtaagacttagttgttaataacaaatgctggagaaacacacgtgaaaatagttcaatttgaatgaaggaaacttgtagaagagtagtgatagggctaaaaaggatgaagctagaaatgtgaaagtaccttttttttttttttttgagacgagtcacactctgtcacctaggctggagtgcagtggtgcaatctcggcttactgcagcctccgcctcccgggttcaagcaattctcctgtctcagcctcccaagtagctgggactacaggcacatgccaccacgcccagctactttttgtatttttagtagagacaaggtttctccgtgttggtcagtctagtctcaagctcctgacctcgggtgatctgcctgcctcggcctcccaaagtgctgggattacaggcgtgagccaccacggcacctggtctggaattttttttattagaataaaaatgcaactataagactgttttctcccttaatatatcttcagcagagaaataacttttccttatagaaaaggagagagagccaactaacctatcatttcatgc

SEQ ID NO: 2575 - DNA, 1062 bp, Homo sapiens; identical to SEQ ID NO: 2574

SEQ ID NO: 2576 - DNA, 1092 bp, Homo sapiens
acacctgtaatcccagcactttgggaggctgaggtgggcagatcacctgaagttaggagttcaagaccagcctggccaacatggtgaaaccccatctctactaaaaatacaaaattagctggacgtgatggtgcatgcctgtaatcccagctactcgggaggctgaggcaggagaattgcctgagctcgggaggtggaggttgcagtgagccgaggttataccactgcactccagccagggctacagagcaagactcaaacctcaaaaaacaaaaacaaaaagagtaagcagatgttttggcttagactaaaagattcttcagcttttcagacagctataagtatactaagaatttgagttatgagttaattctaagtggaaacgcccctttttcctcttcacaagttaagtgtcaatgagtgattcatacactgtcatttttaagtggtagtaggaataagataacttgaaaggatcttacagtcaaatgggaaaaaccagagaaatcgatactagtactagagggcaacaaatgctgttacaaattggggtacgtagaggaaggtacttggtagaggacaggggcatgtttccggggcatagatcaaagtatataaataaggaactgccaggccagttgcggtggctcactcctgtaatcccagcactttgggaggccgaggcaggaggatcacgaggtcaggagatcgagaccatcctagctaacacaatgaagccccatctctactgaaaattagtcaggcgtggtggtgggcgcctgtagcccgagctactcgggaggctgaggcaggagaatgacatgaacctgggaggtggagcttgcagtgagctgagatcttgccactgcactccagcctgggcaacaaagagagactccgtctcaaaataaataaataaggaactgccgggcgcggtggctcacgcctataatcccagcactttgggaggccaaggtgggtggatcacgaggtcaggagttcgagaccagcctgaccaacatggtgaaaccccttctctactaaaaatacaaaaaagtagccaggcatggtggcgcatacctgtagtcccag

SEQ ID NO: 2577 - DNA, 1092 bp, Homo sapiens; identical to SEQ ID NO: 2576

SEQ ID NO: 2578 - DNA, 1050 bp, Homo sapiens
catataaaagtatagcagaggggtccccaacccgtggatcagtactggtccatggtctgttaggaaccgggcggcacagcaggagttgagcggcgggccagcccccaaagaaagcttcatcagtacttacagccactccccaacactggttttgctgcctgagctccgcctcctgtcagatcagcagaagcattagattttcctagaatcggaaacctattgtgaactgcatatgccagggatctaggttgtgcactcctaatgagaatctaatgcctcatctgtcactgtctcccatcacccccagatgggatgtctagttgcaggaaaacaagctcagggctcccactgattctacattatggtgaattgtataattacttcattatatattacaatataataataatagaaataaagtgcacaacaaatgtaatgcacttgaatcatcctgaaaccatccctcccccttaccccagtctgtggaaaaactgtcttccacgaaaccagaacctgctgtcaaaaaggttggagacctctggtacagcacatataattatgtacagtacataatacttgataatgacaacaaatgacgatgttactggcttatatgtttactatgctatattttttattgttattttagagtatagaccttctacttataaaaagaaaaacacattaactgtaaaacagccttgggcaggtccttcgggaggaatccagaaggcattgttatcataggagatgccagctccctgcatgttattgccctggaagaccttccagtgggacaagatgtggaggtggaagatggtgatgttgatggtcctgaccctgtgaaggcctaggctactgtgtgtgtttgtgttttaacaaaagagtttaaaaactaaaaaaagccgggcatggtggctcacacctatagtcccagcactttgggaggctgaggcgggcagaccacctgaggtcaggagttcgagaccagcctgaccaacatgatgaaaccccgtctctactaaaaatacaaaaattagccgggcaagg

SEQ ID NO: 2579 - DNA, 1050 bp, Homo sapiens; identical to SEQ ID NO: 2578

SEQ ID NO: 2580 - DNA, 1048 bp, Homo sapiens
gggtaagacacggctgccgcgacccttgcgacccccaccccgccgcgggagggcgtggggggagagaagggcgcggccggagacctcctggcggggccgcgcgctccaagtgctgcgaccacgcgccaccgcccgctcctggcgtccccgggcaggtggcagaagcgcgtggagtgtgcaccccagaggggagaggctgcgctggggtctccgacccgcaggcggggccccaaagagccggaaactttgcggccaatgttggagcccgcagcggcggccggaatggctctgccggcttcggagtagggctcccgtcccggcgccccgatttctgctccttctctccgtcgtgtgcatccgtccgcgagcccacttccccgagaggaatggggtcggatcagaatgagctctagggcctcggcggcgaggatcaaactcccgggcgtcgaagtcagctgagccggggaaagaggacgagccgggctagatatacctgcagccccctttggttcgcggagtgcggaccgcgtggggacgagaactctagccagagtctcctccgcctcattcaggggtacctgcacttccgccagcaccccgcagggcgccagggggatgggggatgattttattagtttggatgcatgtggccagagatgaacccatagctccctcggatcccttctgttcctgagaagtagagagtgcgccgatgtaattctgtgcaggactccggcagccggcaggggttctggtggcatctatgtcccacgttttaaagcagaggccccttacagagatggtgcaggagggtgaatggaggcagggaatgagaagttttcctgaccctccctcccttaactccacccccaggtctctgcctgcacgcccctcccctcctccagcttggcactggctgctcctgcgtgctgggaggtgcccccctctcccgtgcccgcccgaagaaccaggcgccccagtgccctctccgggagaaagcgtgcccctgtcggcgagcctgttgccaacgtatggttccaagttccca

SEQ ID NO: 2581 - DNA, 1044 bp, Homo sapiens
acacctgtctcccctccgtagctgctcaccgtccccccaaggggggtttgcctcttgcctactttggcctttctctgttatcgatgttaataatgacatatatctcgcttatgagttggtcataataaaaagctatcttgtacagaatattagaatttaagatcttaagaatttcaatgacactgaaatagtttattattacctttttacagaagaggaaacaagttcagggagttaagcagctagtccagttatgtggcttcagtgctttaagcaccaggatttgaacatagctggctacactgtctttatctcttgagtttttgcgcaggaggttcctgtattcaactcctacccgtgtctctccactactgctgggaaagttttgtggagtccccatgagcaacttcctgacaaacaaacaaaatttttttaaagaaaccaaagcagtgtgtgtaggtcacatgcagtgtgtctaatgaaaacatctctggcgggttttcagctgttgctttgactttcggacactgtttagttggggactgataagacagcaaatatttctgcaagtattcccacctgttctattcccagctgccacagctgcggaaaggcgggggtgaggctgagaggccccgagaggaacattttccactgggctccaatcctggagatgggatgaccatcatgttaatgtctggagaaaagaatgatttcaggctgggtgctgtggctcatgtctgtaatcccagcactttgggaggccgaggtgggtggatcacctgaggtcggaagtttgagaccagcctgaccaacatggagaaaccccatctttactaaaaatacaaaattagccgggcgtggtggcacatgcctgtaatcccagctactcaggaggctgaggcaggagaatcgcttgaacccaggaggcggaggttgcagtgagccgagatcgggccatggcactccagcctgggcaacaagagcaaaactccatctcaaaaaaaaaaaaatggtttcacatcagtcctcaggaaagatcag

SEQ ID NO: 2582 - DNA, 1037 bp, Homo sapiens
ggcagaaagttcaaagtaatttcttcctctgcaaattcccagtatcttagtcacacgcaaagagagtgtccctgtgcactgactcctctagctagtgatttgtcagccaaaaatgtttatttatctcctggcctgtttcctcccatatcagtatggccacatgaacagaattgagtgacctcctgagtccctgtattaggaaggggaaagatcttttgattcattaaccattaagttgattcattaaccattaagtcttgggcctgcagaccatagcaaccttccttccttcatttatggtgcttcatccagctccaaatcttctctactttgtcctcacaaacttttcatatgccctagtagctcatagactgctccttatatctggaaagcaacattcaaacttctcatttctggttccaaaaatccgtgcattacatggataggctgccgtgggggacattctgcggccctcacgatgtggtttcccacagagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctgtgagttggggggctggggggagcagggtggggtgagggctgagttgccagggggtggggggcgcagcagcctgtgttggtcactgtacctgcagctccacaccagcagcggtaaagagcagggatgaagaaccgcccaggttcatggcctggctcactgcctcctggattgtgacctacttgggcatgcttttaacatccctatgcctcagcttccttgttcgtataatgggttgataacgcagttactgggagaattaagtgagttaatatgagtgaagggcttagaagagtgtctactgcacgtgagtgctcaggcaagctggat

SEQ ID NO: 2583 - DNA, 1045 bp, Homo sapiens
tgcctcagcctcctgagtagataggattataggcatgtgccaccacgctgggctaatttttgtatttttagtagagatggggtttcaccatgttggccaggctgatctcgaactcctgaccttgtgatcggcccgcctcagcctcccaaagtactgggattacaggcatgagccactacacccagcctcattttccattattactgctatgctgattgagcaagtgcactgttaagcactggacacgctgtaagtgatttgttcatcaagacagtcctttgggtaccatgcatatacataaccccaaatgttagctgctatttgatattagcatgattatcattgccagtattgttacttccattttaaggttaaagaattggaggctcagagaagtgggactccccagcctggccaccgcgtctcgggtgcacagctcctccatgcttgcagttgcctgcgaggccctactctggctcacaccagggcctgctctaagttgtgactggagaatgagaatttgggatgccagcccagaggcaaggcatgctctgagagctccacccggggctcctgtgctacagggcaggctcttcttcagggggctgcccggggatagtttgacaaggatgtctctgtcttcctagatctcgtggctgtgctgtgtcccaaagggcctctgagaatgctggtagaaactgcccaggagagaaatgagcccatattccctgccctgatatactcatgtgagtgagccccccgtgcctctgcctgactcggggtcagcaggcagcctgtggggggacaggggcctgcttcctggccgtggctttcagagttgactgggcgatcccaggagggtctccactttcagaagccagggagggcagtatcttgttattacacagtaagaagcttagaaagttaggacaggaagcaggcatctgctgggatgtgctgcagtccctgacttcatcccgtccatcctccagcggcatgctgcggtgcaggttgcattcctgtgatcccgcagccacccctcagc

SEQ ID NO: 2584 - DNA, 1079 bp, Homo sapiens
ccctgtttgaaggaacttttaatgatctcgcctctctgcacacatttctttaactagaaagtttcctaagcaaaggagttaggagagcagggtggcctgacatctgccagccctgagctgtaaggctgtggatgctgagcaggtccctggactcagttgtgcacggtggcacagacactgccaggtggttgccaaaacatccagtggttccttcagcaagtgttcaccctctgcagaagcctgtgagggcctgagctcagaaaccactctcctttccttctctggctttggccctgggcactgtggtgggagagtggacagtttggctttgccttctctgtacatcaatcatgggttgcaaagagaatctcagaagtgcctcttcctgagcacagtggctcacacctgtaatcccaatacttcgggaggtcgagtcggaaggatcacttgagcccaggagtttgagaccagccggggcaacatagtgagactttgtacaaaaaaaaatttaaaaattagccaagcatggtggcatgcatctgtagtctcagctactctggaggctgaggtgggaggatcacttaagcccaggaggctgaggctgcaatgagccgagatcaagcaggtgttaggtatatcagacagctgagaagacgcaagtgtgccctggggttcaaactggtacccctgtctccctgttccaggaataacatgagtgccgggacaatgcatctttattatgagaggaatgagaattgtgtatcttgacatttgacaggagcttgctttcccccaggctgtttgaggaagggcagaggaaaatgtggtgccctaagaaggaaggacagaggaggccgaacactggcgggtggaatcccactgattagtagtgcaggtcagagacctgggatggggggcattgccgtcatggaagccacagcggggagcgggtaaagcagacagggatggtccctgatggtgacaactcgcaagaggttaaggggaaagaaaaactgaaaagcttattcaatttggcaattatggcagtgtttatcttcagaagagcagttttagggtgg

SEQ ID NO: 2585 - DNA, 1031 bp, Homo sapiens
acagttgcccgccaccatgcctggctaattttgtattttagtagagacggggtttcaccacgttagccaggctggtctcaaactcctgactgcaggtgatccacgcaccttggcctccaaaagtgctgggattacaggcgtgagccaccgtgcccagcccagttattttaactattgtatagtgttccattgtatgagttctactgtttatatgctattgatcgacctgtaggggttttgcagtgtttctgtattacagctgtgctgcagtgagcatcccatcacattgtgtggatttgaggaagtattggaattcccccaattgactggacattcccaattaccctccaagtatgtgtctgtttatccttccatccgcaatctgagagttccccaactctataatacttggtgtcatcagacttttcatcttgtctgattggatgggtgtcatttcctttaggttttataattatcttttcatatgtgtattggctgtacaaggttccttctctgttcattattattaatttttttagacagagtctcgcgctgtcgcccaggctggagtgcagcagcgtgatcttggctcactgcaagctccgcctcccgggttcatgccattctcctgcctcagcctcctgagtagctgggattacaggtgcctgccatcacgcccggctagtttttttgtattttgagtagagatggggtttcaccgtgttagccaggagggtctcgatctcctgacctcgtgatccacccgcctcggcctcccaaagtgctgggattacaggtgtgagtcactgcgcccagcccaagtttccttctctgttacttgttcatatcctctgcccatttttcacttggattttttgtcttacggatatttaagcctcttaaaatatatattctggagagatgctaatctttgattaattatatgcattgcaaatgtctggtacattgtggcttgcctctcttccctgcctttaggagtgttttgctggacccaagtaatttttaaatgt

SEQ ID NO: 2586 - DNA, 1087 bp, Homo sapiens
ctggatatgaaattctgggttgaaaattcttttctttaagaatgttgaatattggcccccactctcttctggcttatagagtttctgctgagagatcagctgttagtctgatgggcttccctttgtgggtaacctgacttttctctctggctgcccttaacattttttccttcatttcaactttagtgaatctgacaattatgtgtcttggagttgctcttctcgaggagtatctttgtggcgttctctgtatttcctgaatttaaatgttggcctgccttgctaggttggggaagttctcctggatatatcctgcagagtgttttccaacttggttccattctccccgtcactttcaggtacaccaatcagacgtagatttggtcttttcacatagtcccatattttttggaggctttgttggcttctttttactcttttttctctatacttctcttctggcttcatttaattcatttgatcttcaatcactgataccctttcttccagttgatcgaatcgggctactgaaattgaccacatagttggaagtaaagtactcctcagcaaatgtaaaagaacagaatttataacaaactgtctttcagaccacagtgcaatcaaactagaactcaggattaagaaactcaaaaccgctcaactacatggaaactgaacaatctgatcctgaatgactactgggtacataacgaaatgaaggcagaaataaagatgttctttgaaaccaacgagaacaaagacacaacataccagaatctctgggacacattcaaagcagtgcatagaaggaaatttatagcactaaatgcccacaagagaaagcaggaaagatctaaaattgacaccctaacatcacgattaaaagaactagagaagcaagaacaaacacattcaaaagctagcagaaggcaagaaataactaagatcagagcagaactgaaggaaatagagacacaaaaaacccttcaaaaaattaatgaatccaggagctggttttgtgaaaagatcaacaaaattgatagactgctagcaagactaataaagaagaaaagagagaagaatcaaa

SEQ ID NO: 2587 - DNA, 1035 bp, Homo sapiens
acccacctcagcccttcttgcattctcttcatgtgacagcgcagcttccccgcgagtttcgctggccgcgagcctcaggtccggacgcagtgggggcgcctcagttgcagggtgggtcctctgcagccgtctcacgtccctgggtccacctcagcccctcgttcctgcttcggggaggagacgagggccacgtgcagagccttgggtccctggaacacgcccgctgcttgcccgaccgccttcccgctgccgaatgcccgttgcccatgccctttggtcgccaatacagctttgatgcttcgctttctaataatgttgttcttcactcccagacccccttgcactgtgtgtctggggctctaggctcgttgccgctggctgcaggtttgggtgagaactttgacttccttggctggagccagctgttgggcttcgcaggtgggaattttgtgtgaacttgggacaggggatcctttttgatcctttcttcctttcgcttttctttggcctttcctcttctccaaactctggggggtcttgtgagtggtttgggcttactcccctaaactcgaacctttccgaggctcattctcacccattgcacagaggtaacagcccctctgccaaaccctctttgggcgatggggagtgctgcaggggcaggtttgggtgttgggactccccatttgggtgagagatgtcaggttcctgaagggtgagaggcttgtgtgcagtcttccagcctgagtcgggcctacagcctgttgaaaaacttgtgcacgttcacttgggccttggatctacgtgacaggattgagtagctggtcatgccaggcctacctgattgccaaaggatttgaacattccttgatgccagcctgccagttgtcacgctgtggatgggtaggtcatcctggcaggagggctcttgggagactcttcttttggaggaaggcctttctcccgaggagagacaaaaggggagctacaggagcagcatctgtaagactcaggcggctgggtgcggtggctcac

SEQ ID NO: 2588 - DNA, 1038 bp, Homo sapiens
aacagagcgagactcaatctcaaaaaaaaaaaaaaaaggctcaggcaatggcttagagtgttttgttcagccttgcaaatggtgcggactatgcagaatcgtaatgatttggggcctaatgttgagcaactcaaaggaaaagtgaaccaggcagaatgggcacctccctcagagccagtgtgttatctaagacaaagtttttcaacctgtggactaatgacattttggacccataattcttcgttgtgggagacctggcctatacattgtaggatgtgtagcagtatccctggcttctgtctactagactagcaccgctccccaccccttctagccgttgtgaccatcaaaagtgtttccagacattgccacgtgtcccctggagggcaaaatctcccttgattgagaaccactgaggtaaaactctaaaaagagttgtcctgtgctgccaggggtccctctgggacctgcccgtgagtaggtgagaggtttaggcaaagggtagtgttatgcctcctgccctaacccagtggtaaaagccatgtagattgggctacctgtgcacctaggagggcagaggcaaaacctgcaagcagaaagttaggaggtagacacccatgggcatgtactgtgcctgctaaatgtgtggcagtgactggctgggttgggggtgctggagaattagaagactggtagcttctcggggatactgcaagactaggggatttgcacatgaataactatgggccagttttaaaataggaaacatgcttaagctgagtgctggcacaaaggctaactcagctatccacaagtggttcttcaaggagatgctttattcatcctcactttttgctcagacagctctgtgtcttgtgatgtgggaggggctgggcctgcatcttcagggagtgagtggctgggtgcatttcaaacatacgtatgtgtatttttacacagcagcgtggacatgggtatgatttgtggagttcttttgtagttgcttgaagcatcagtgtcaaggtcagtgaacctttt

SEQ ID NO: 2589 - DNA, 1047 bp, Homo sapiens
caggaggagggaggagagctgtacagaaagttggcattggacaacccctcccagccccccaggcctgtcccttcatgagcagtacttaggggccaccctggcctggataatacagtaccaggtggcttgcctttctctggcttcacctgggggcctgtgggtgttgggcagctctgtgtctggcgaggtgagcccatttctcagggtcaggagcagaactataatgggggggtccttgccccaacacgagccttattggggtgttctcattcaactctggtgaccttccaaatttcctgggacagctgtggtttttactcttgccctagaatatgagtcgacaaatagtaaatattttgggctttatgggtcatagatctttcttgcaactgctgaactttgctgttgtagccaaaaaagaaaaaaaaaagaaagcagctagggacaatacatatgtaaacgaatgagctatacgtaatctataaatgggtgagcaggctgtgttccaataaaactttattgacaaaaaagcaagcagtaggactggatttggcttgaggaccatggtttgctaacccctgccctggaaggacactaattatgtgtcttaatttttgttgcaaaagatgtggtcactgcacctactacccagttctaaactaggatcctgtttttttgaggatcgggggtaagcaccctttcattatttccgtcttttaacccagaggccaacattagggaaggcaggcagacccgctgcttgttccaagtgatttttttccccactgtcccgagaagggcagttgagcctctctctccaaattggaggtgccactttccatccgcctggtggcctgttaggagcagttgtcttctgatgaaggacagtggctaaacaaggagaggcaatgtttatgccattccaatctgctgcctaacccttgcccgttctgctatggacaagcacttaggggatggggaatacatttgtgtgcttgcttactttttaaaattttaataaaagatatttaagattatttttatttt

SEQ ID NO: 2590 - DNA, 1048 bp, Homo sapiens
agccctgggagaggtcagtgaacttgtgttgaaggaacctccggttgactttttattttggtttcatgcctggctagtggacactcccaaacatgagcacctgtctcccacccccactgctttatcatttatggtcactcttttggctgcccctcctcagaggagagcaggcaggcacacggaggccttcaggaggctgctgtaccaaggaggcacagagcccaaacacttcatttcagttactcacaggcgagacccccaaaacgtgctcatggagcagcaggaagaagtagggtaggtgggagactggtgttcctagcgagggcctggtacttgcagatgaagtcacggtgctgataggatttttaacttgtgtattacatggtttgagggcttttatttctttaaaatcatgatgaaaatacctcctggtgtagctgtgtgcctggttcttggtacacccctggaagggatttgcagcgaaattgtgggatcgttgaattatgaggcactttgggattgtggtgcattagaagtaggattttaagacctaagttttgaaaacagaaggtgagaaaagttctggacagatgtttccttctggtagttattccccttccctcctttctacttctgtgagagcgtagactcccttgcagaaaaatacctggtcttaagctggcatggtggtgcaggcctgtaattccagctgcttgagagcctgaggtgggaggatcagttgagccttggaatttgaggctgtagggtgccatgattatgcctgtgaacagccttgacactccagcccgggcaacatagtgagacccctctcttaaaaaaaaaaaaagtacctgatgttgatgaggtgtgaagggttcactttgcatggtaaggggaggtgtgggtgtggcccctaaacagtaggtcagcgatatttgtcaaaggggggtgggtacaggctgtggttttgaaatgagtctacatgttagtctgctcacaaatgacagactgtgtttattagcagcatctgtttattagcagtctgtgt

SEQ ID NO: 2591 - DNA, 1067 bp, Homo sapiens
tctgctatgattgtggatttacctacttttagtctattgacttgtgctttatatggtttgaagctatgttatttgttgcctacagattcagaattctttttttttgtttgagacagagtcttgctctgtcgcccaggctggagtgcagtggcacaatcttggctcactgcaacttctgcctcctgggttcaagtgattctcctgcctcagcctcccgagtagctgagactacacgtgcgtgataagtctcgatctcctgacctcatgatccgcccgcctcggcctcctaaagtgctaggattacaggcgtgagccaccgcgcccggccagatttagaattcttcttatatcctcctagggattgacccttcattcttatgttatgcctcttttcatctctgtgaaagtcctcattgtctgatattactatagctacattccagctttgttttgggtaatgtttgcatgttaccttttttttttcccctgtactttcaacttttaaaatgtccttatgtttaatgcatatctatgagcagcatatatagttggttttttgtgtgttttaagtgtagactgataatcttacaatgagaatatttagtccatttacatttaaatgcaattgtggatgtattggagtttatatctactaccttagtttttgtttgtttactatttgacctgtctgttatgtccccctttttctcacctgttttgccttcttttaaattaatcaaggacttaaaattatagtcatgcgtctctctttttttttggagacagtctcgctcggtcacccaggctggagtgcagcggcgtgatctcggctcacagcaacctcaggcaattcccatgcctcagccactcgaatagctggaattacaggtgtgtgctgccatgcccggctaatttttgtagttttagcggagacagggttttgccatgttggccaggctgttcttgaactcctggcctcaagtgatccacctgcctcaaccttccaaagtgctgggattaaaggcatgagccaccgcacctggccctcatgtgtgtcttaacaagga

SEQ ID NO: 2592 - DNA, 1045 bp, Homo sapiens
gctgggcgtggtggtgggtacctgtaatcccagctacttgggaggctgaggcaggagaatcacttgaactggggaggtggaggttgcagtgagccaagatggcggcgttgcactccagcctggatgacagctccatctcaaaaagaaaaagaaaaaaaagaaaaaagagaatatatcatcatactttatttttttaaggtatttttgctgggtagaatattcgatgttgaaaatgtgtttcctttgatcactttaataatattcctctattgttttcttactttgattgtttttttgaaaatgtggctatcagttatattgctgcttctttgaaagttatgtcttatttcttttctctggctgcttttacgatttcctttttgtttttgttctctagcagtttgactgtgacatgcttgagtgtggtttgctttgtatttattctgcttggggtttacagagcatcttgaactgtggcttccatcagttttggaaaattttgatcatttcttcaaatactgtatctgtactattctctcctctctttctgggactccaattacacatatgttagatcttttccctctgtcccctgtgtctcctttgctcttttctgtattttccatgcctttttccatttatccttcagtcttgcaggtttagaggagatgacttatctcctctgtacctatacattgagaaatggacacctacagaagtgagactttaatggatagaggaggcactagagaagacttgccagaaggagttgagcactgctttgtgcatagctctgtggtggttcctggggccttcacacaggaacttacaatccacatcattaaggcagaaggggagagaggaaaaggggagagaggaagacaggaaacaaaaagtaaagaaagaggaagcaataatattatttgattctgtgtagaaaggattttgaaatttgacctgtgaaaacaaggagatgctcatatgagaaaaagcaggtcagtgggccaggaatgaagagtagagggaatggacctttgggtatcct

SEQ ID NO: 2593 - DNA, 1026 bp, Homo sapiens
gtgggcctgggcttcggggcactggcagaggtcgccaagaagagcctgcgctccgaggacccctcaggtgagccgggcccttcagtgggaggggcagggtgggccccgggagggttgagcctgtcagcccccagccccacctgtgctctgggagtgtcagccagctgggccgcatttgcatggggttccacgtaagtggcgtccctggggtgatgaggctgttcatacagacagattgacctgctttagagggggtgaggctggaggcccttcctcctcccagcccaaagtggccacccagccccttctttttggctgcctgcacatccacacgccttctgcacacctggacaccttacacaccccctgcacacccactgaacacccacacacaacccctgcacacccaccgaacacccgcagaccttaccccttccacacccagcgaacacgcgcacaccttacacaccccttgcccacccaccaaacacccgcaccttacataccccttgcacacccactgaacacccacacacctccttatacctcctgcacacccaccgaacacccacagaccttacacaccccttgcacacccaccgaacacccgcacaccttacccctgcacacccaccgaacacccgcacacgtcacacaccccctgcacacccaccaaacacccacacatcttaccctccacacacccacgcacctttttacatcctccacacacccacctcatacctgcacacctccttacacaccctctacacacccaccacacacacctgcttacacagcctccgcacccactgaacacccgcacacctccttacacaccctccacccacccaccacacacctgcacacctctttatcctccacccaccctccacccacccgaacacctccttacacaccctccacataccctccaaacacccgcacaccttgcacaccctccacacacccacctctcacccacacacctccttacacaccctccacacccaccaaatacctgca

SEQ ID NO: 2594 - DNA, 1055 bp, Homo sapiens
cccgtgggcagacacacggctgctgggtgtgtcttgggtggactctggcaggctcagacacgcatggtgggaggccctgccagcttaggcccacggactctgttctttttggccagaacagtgttttgttaaaactctgtatgagtgccacgaggcgggacgcatcctctgcactctgccacaggccccgccactcccttttgtatcacatcagcccagtccatgttaccctcgtgttcccggcccctgtgggtttgagtttatgcccattaccatgatgtaatccagtttacagcagagctttgaatgagaactcagcgccccgggcactgtgggaggaacccgggctggtggagggctctggtgtctcgccgccatttatccttcctctcttgccccaggtcatggaagacgcccacttggatgccatcctcatcctgggggaggccttcgcctctgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaac

SEQ ID NO: 2595 - DNA, 1048 bp, Homo sapiens
tgagacatggggcatgagaacatggcaaatcatggcttgattttcccagggtctgtgtcttcgtgtccctaacatctagtgaagggctggacaccacacaacaaaaaaatatttgttactgtaggctttggcggttactcataaggacaaaacactaaaccataggctagaagttagattctgagtgcattaactcctgacactccaagtgggcctttttacagagggaaaaaaaaaaaaagaggcccagaggttaagtggcagaatgaggatttggaacaagacagtctagtcttacagtctacactaaggggaccaaacgaagggctggcaaactatgatggtccaagggccaaatctggcccactgcatttttgtaagttttattggggcacagccactctcgtttatgtacgtagcaggctaagactgtttttgcactgaaatgccagagccggggagctgcagcaaactatatacacaaaggcacaaggatttcttaactggtcctggacagaaaagggttgccaagccctgttctaaagcactgcacagctgacactacagtaaaccaacataacagtatcagccacaaatgtcaattccatgggccattggaaccggaagtattctccgaataactacttagctgccaccagttcaggagttcctttaaccccacccctggaccttccctgtatgttcttagatgaaccattctaactccagaaaagcagtaacagtccgtcttgtttaagtgacacaaaatcaaactgctcccacattcacactgtcagggccactcaggaaacctcacgcagccagggtttggtcttgtggaccgaagtaacagcaacagcgaagttctggccagaagaggggagttgaaagcttcaggagaattgaacatcattcttacccgagctaaggaagaaattaagaaagtcctagattaaaccacaggggcaaactaaccccatgtccttttacggcataaagaagcagcctggatgaggaaggaggccagcagaaagaagagaagtgacag

SEQ ID NO: 2596 - DNA, 1032 bp, Homo sapiens
ccacgtgtgaatgaagtctcaggctttgtgaggagaaagagcagctccacaggcagctaattgtctccagagctccaaatctgttcctcccacgtcatgatgggcatggggcggggggaatgttgcattgttttcagaggaatcaggtacaatccctggaaggatgaatctattttgctactttctgttgccaggttgggggaagtgctaggtggttcgcctttatttgtatggggtactcagatgccctgccactgtgttacttgttttactaccatagaatgagggttcactttcaaacttggcatgtagatgctatttgccaccagcacagaggaggactgctgacttgggacagtgtacttggcagcctcaggtgtatctggccaccccagtgtgacccactgggcccgactccaggtgctgtagtcctgctagtatgtagggagtcatctgattcctcacccgccattgctcatgggctccagggtcttggcaccccaacccagcccccttctgctgcttcatgccagctgtgggaagatgtggactggtgccttgtccacttgagctcttgtgggtgctccaggtctgttgacaaagcagtaagtggcagccactaaccttgagcttctaggatgtattcagtggacttcaagtgcctcttagaagcctgattccattaactcccccaaaacttaatgcaatttgaggctacttctcattctcatcttagtgttacacaaccattaatctccattctatctgtagacattcactttctggacatgtcttgtataattggaaccatacattatcagtcttttgcttctggtttctattagtttgtttgaggttcatatctgttgtagcatgtagcattatttaattcattttgatggccaaataggattccaatataaaatgtacttaactgtttttccttatattaactggttgacattttgacatttgagtatttccatttttcatatttggttataacaaacaatgttccagtgagtctttgtg

SEQ ID NO: 2597 - DNA, 1042 bp, Homo sapiens
gcagttactgccctcaggacagttgatgatcttgtgatcatcaaacctgtatgagtcctcagacttgccctcaggtaaatttgaataaaacaaagacacgtaaaaactggactcttgacaagaattaaggtattccaaattagaatttataagccacataggaaatcaaccaccagaataaaggttcagaaaaactagatatttccaaaacgtcaaatactaaaatttttaaaatatttaaatgtatataaaggaaaaaatgggaaattgaagtgatatgtaaagatcaaggagcaacaaactttataagccatacttggaaaagaactaaaccaaatataaacatttgaaaaataaaataaagttaatatacaatgcacagtcaaaacattaatgcataaagatcaaggaaaaacaaactttataagccatatttggaaaagaactaaaccaaatataaacatttgaaaaatataataaagttaatatacaatgcacaggcaaaacataaaaataagttaatgagaggattagtgaactgtaagatttagctgccaaaatgcattacagaggaacgatgaaatagaaatatgaatacagatggctagtacctattagttatttatttaaatcctctcgctcctccaattctccaccctccaataggccccaatgtgtgttgctcccctctgttttaaaatacgtagatacttcataacaataggtttattgaatgctgattttaccataaaatttgtgacgattcaataactacattaaaatttacttgtaactttttgtgaatatatattttaatccaacatcaatatttgaaacctttaaacagcaaaaatactaacaggattatctttgaaaatggaacaccatttccttcacttttttttttttctctttgagacagagcctcactccgtcacccaggctggagtgcagtggcaagatctcggctcactgcaacctctgcctcccaggttcaagcgattttcctgcctcagcctcctgagtagctgggactacaggc

SEQ ID NO: 2598 - DNA, 1025 bp, Homo sapiens
gggacagatcaatacatgcttcttactattaatataatcacattcttgcaatgagggaacctccaggcttggctcaggtatggttcaccctatctatggagctttactacaccttcctccttccaattagaaccagcccctctatgtactacagctctcctgagccttcacacacattcataatagtggcagcatgttctgacacttaaaaattcctgaaataatcttagtgtttattgtttacttctttatatatttgctcctatgggttctgtgtacttcaccactatattcccaataccaagcatagtgatgcccttggcaggtgctcagtaagtaactatttaatcagtgaataatagcactgtctatggaaggaatgcagaaagtagtaggttagagcaaaccttagctcagccattcactattaaggtgaccttgggcaagtccctgattttttctcccttcagttacctcatctgtgacatggggaataactaaacttacctgacaggtttgttggcaagaacttaataagtaaaaattaccaaagagcttcaaagcactggctggtatagtgaaaatgttccatacatgtgaactattgacagtatcatttcactggtcgttgaaattttttttatccttcctttcactcaacattaagccctgaattttctctcactttgttgcatatacataaaccatttttgagttatgttcaatattttatactaaaattatttaaaatgttaataattaaatactattagttgataattacttttcctatatgctgcataacttttgtagtacagaaatgtttatttttgaggtaatctactttattaacctttttcaatcatactttttgtactttttatccagtttataaagagcttttattctccgtggaaatgaacatagtcttactgtcaggtaataatactaactgcagcattcttttgcatattctctccaatcatctggaagatttgaggtaataatctcattttatatatttt

SEQ ID NO: 2599 - DNA, 1052 bp, Homo sapiens
aagcatacttggagtctgtatatatatttactccttttccttctcctgtgttctagtgcccaagtgagggctattaattctgccagctgagtgctagtttctggagtgaggggattactttcaagtattccattatcactggccactgcataccccgcctttcgaagtcctttttctacaaaggaacttccatcagtatacaagttgagctcaggatccgtcaagggaacctctagaaggtcccctcgagcggtgtaggtttgaacaatcacttgttgacagttatgttctatcttttcttcattgtctggaagaaatgtgggtgggttaagagttgcacaagtgcacagtggcagcactggcccttcaagtgatagagcctgatatttaagcaaatggttgtctgacagccacagtctcctttagcagtgagtatgccgttcacatcatgagatgtccacacagtaagatctcttccctgtatcattttaactgcttcagatgctaagactgctactgctgccactacctgtaaacaatgagtccaaccctttgccactacatcagtttccttactcaggtatgccatgtgttgtaagctggtccctcggacctgtgtaaggacttctagagctattcctgtttttttttctgtgacatataaagaaaagtcttgctccattggcaagcttaacactggggcttggattagggccttctttagggcctggaaagccgcttctgcttcaggtgtccattctactaaatgggtattggctttctgagttcccgtaattagtgtgtataatggcctggctatttcattgtacctgggaatccatattcaacagcagccttttatgccaaggaaccctcttaattgcttcagggttttgggatgaggataagccagtataggctggatacgttcctcactgagggccctggtgcctttggataattttagccctaagtatttaacctgctgtaagcagagctgagcctctggtttggaaaccttgtagccacaggtggcgaggaagtttaagagc

SEQ ID NO: 2600 - DNA, 1069 bp, Homo sapiens
gcgaaggagagaacccagagcctaaaatatcccactagttctagaaaagagaaaatttcttgcttggtttgcggaggcaggagagactggaggagggatgtgcggtcagttgtgagccctcgggttcacgggctaagagctaggcctagataggtgactgagggggtgcatatttttgctttcttaggggagacccaatacccctgttctgtcaagaagtttaaaagagatagtatgggtgtcgaagtctctttgggaggggctacacaggagcagattgttaacatattgaaggagagtggacggttttagggataaggtagagaggtcgtgagcaagggcctgtccaaaaaggtgggggctgtctctgaaacattgaggtggtagtacacaccaggtgagctgacgtgaaaggtgggtgtcggggttttcccaagtaaaggcaaagaggtttggggaattagagtgtaaaggaattgtgaaaaaaagcatcttttatgtttagaatagaaaaatgggtggtattggagggaattgcggaaagtgaagtatatgggtcaggaactactagacagcttggttaatgagcctgaggtcctgaactaagcgataagttcctggctttttaacagatagaactggtgtgttaaaaggggattttgttgggcagagtaggtgactagcaaggaggtgagaaacgataggctttaggcctacaagagctgcttgggggatgggatactgcttctgtgatagaaactgggtgggctctttaagggtaatgcagacggtggtgtggtgttttgcgcctaaacagcggggttgactacagatgggggataaggaaaagttgcatgttttaaggtgggaggttggaggagtagaagaaagttagaagtaccacaggggtctaggtggatgtcttgggtactatgggaaatgtggaagtagggagtaatgtggagttttgaaaggatgtctctgcttaggagcagagttgggcatgagggcagaactaagaaagagtgagtgaaggaaaaggttacgtgtagggagcagaagagtggag

SEQ ID NO: 2601 - DNA, 1047 bp, Homo sapiens
atggggtctgtctttggtgggcttattaccaggggcttgtgtgcttgtgaattctgtcttattccttggccaactgagttgccttcagcactttgatctatagggcagacacttggcctaataccaagtgtttgtatgtgtgtggctctcacccagtacttgtgaggtttttaccaagtcacaggtctctaggttggcaagactgtccacagaatgtagcttaaaggtctagaactgagttattcacctgcttcagagaccacagtaaatgtcaaggtctgcagttctgcatctatggccgtgaatgagcatctgaccccagctctctgactgggtaggacctcttcttgactatggctgggaggagttaatgacagttacagtgttacttcagaattctaagtggaatcatgttaaatgggccatttcctcgtctgtagccaagaccagcgtcctcaagtttgccacctgaaggaagacttgctttctgaaaaaggctttccttggtcttgtgcttttagcagggtattacaaccccctgcctgaatcacaaagcaatcataaatgtactttttgtgtgacagggtcttgctatgttacccaggctggtctcaaacacctggcctgaagtaatccttctgcctcaccctctcaaatagctggaattacaaatatgaggtatggtgcccggctctgtcacaaaggcacttatgtccatagatgactgataaatttttgttgctttgggagatatacaagaagaggacctcctgttccaacaacttgctgattttactcttcctatatggtttcactttccatttagttttctctttgcatttcaaatttgtgtggaattttttaataaacatatatatttgggaaacctagtggggaaggtatgttcttagtaaatcttatatgtattcatgagtgcttataaattatatatgttcccaataaatgaacacttttattattacttgatgctcatattttctcttgtgacaattttggcttaaagtatactttgtgaaatataacagt

SEQ ID NO: 2602 - DNA, 1056 bp, Homo sapiens
ttgaaatttttaatatagtgaaaaattggatttaactggagagtttgaggacatttttaagttagaaatgcaccatttgaatcatttaattggcataattgggatgtactctacacagtttataggattaaattactgagttagtaatgtttgtatgaaagaaatgttattagattctaccacaaaatatagtaaacatgaaatcagttagaataggtaaagcattaataatggtaggctatatatcataatcactatataaagaaacatcagaatttggaaaccccttaagcaaaaatatatcttagaaatcttaaggacacttaatggcaagcaaaaaagtttaaatttagttttttataaattacatatagcacaatttatgtgtacatgtagaatcttttagtttttagtgtttatgtaatatattagacaataataaacatttacatttatgtttacatttatatttaatttttcaaatttaatttaaatttctaaatgcttctgtggatttaaattttggaataatcttttcttccccattgatactggaatcttgggaagtttcttactcatatcacaatatgttttatttaaatggatgcagcttacattgcagagtttatataaataatcacataacaagccaattccttagtcattttctgtattaaaaaactcagagatctagagagcttttggattgaaatatttccttggtgattttggatgcaaacctgatttctgtgttcacaccatggccagagatgggactgttagcaccacctgcttctttaatgtcgtccatatgatcagcatcagcaccagaaactccaggtgtcccaaacttaaagtgaaagccatagagtcctttggtgactcccatgttctgtgctggttctagaacatgctggtaaatatcagagtttctatgcttatggctgataagtagacatttttaaaaatcataaaaactgtattttctatatagttcagctaagtttatgaaaaagatgcagactcagtatttggagcattgctatcgctccatga

SEQ ID NO: 2603 - DNA, 1076 bp, Homo sapiens
ttgattttgtatcctgcaactttagtgaatttattctaagtatttttaaagttttctatttataagactatgatatctgcaaacagggacaattattttctttctttccaatttggttgtctttggttttgttttctaatttctctggcctggaaattcagtagcatgttaaataagagtgatgaagttagatatatttgccttactataactcttagaaaaaaggcttacaacttttgaaggtttagcatgatgtcagatgtccatttgtcatatatggcctttattggcttgaggtatgtatgttctatatgtaatttgttttgagattttgtcataaagtaatgttgaattttctaaaattctttttctgcattcacttaaaagttataattggttctgagatccttcatctttctcagaatctaggaggatgcatctgtacctagaggaggacacaaaggcatcatatgttacattctcgtgacatataatgtctactgcttataatgtctactgtgagtttctgactccccaaatgaaattgaggcccagaaactttcaactgctttgttcgttgaataatgccaagtgtctggaaatgtgactattcagattaaatgcttaatgtgtgtgtgttgactaaataaatctcaaccagaaccttctcagatattttgttgaacgtgggacctttgtttttttttgttgttttgttttgttttgtttttgttgttgttgttgttgttgtttaccagcaggggacccctgttttgtctatgtcaagaacaaagaccaggcaaaagaaatgtcaagccgcatttacaaatgcaaaaatggacttgtttttgatatgcttttcccaacaataagggacatgagtcattggggcatgttacagagagtttcagtaaaattcagaaaaaaataataaatatgaacagccacagcatgcccagaagcctttttatggagccaggcatggttgacctgctttccatgtctcaaaacattagtccctacaagaaccctatgaggtttatcttcttttcacccattttgagagaagaaaagtt

SEQ ID NO: 2604 - DNA, 1026 bp, Homo sapiens
aaagagccttggagaagttttatttttttctgtttggaaagaatacacagagcaagatgatttacaataaaccttttgacctaacgcacatacttgttttctttaacattaaggggagtcttaagaaacagctacagcagtttctcacctggcaaagacaaatgctgggaaactgcagggccaaggatgtgagcagatgacgcagggaagagaaaccccaaataagtattaaatgactgaaaggtgactcaaacttatctgttaaacaactggaaatgcaaggaattacatgagtttctttgtcacacagacaccagattggcaaaaaattaagtcttaacattcaagggaggctggatgtagggaaccagcgatattgagagactgctggggacactatacttgccacagcccttttggaaagtaatctggctatacctattaaagttttacccatgcatattctttcaccaagttacccctttctgcaggtgattactatatattatgggctgaattgcattttctcccaaaaatgtatgtgttcccatgttttaatagtcagtgcctcagaatgggaatatatttggacatatgatttttatagaggtaattaaggttaagtgagtttattggagtgagccctaatccaatatgactggggtctttataagaagtgatggtaaagatacagaaacagaagatcctgtgaacacagcaatggaagacagcaatctactagtcaaggaaaatggcctcagaaaaaacaccccagccatagcttgatgtcaggttcctagcctccaaaattgtgagaaaaaatatctgttattaaagccttgagtttgtgatgctgtattatgacagcgtagcaaactgttatagtttgttaagacacatacaatatgtttcctgcagcacgactgaagtggaaataaaatgtcttcatgccagtttccaccagcattgaaaggctgaaccactgtgggaaacagctttgattatgaaataacataaagacgtgat

SEQ ID NO: 2605 - DNA, 1347 bp, Homo sapiens
ataattgctttccatttcctcagctttaagatgtcaaaatatgaattagacaattatgtcatgactaagcctgagcatattttgtgtatgtaaagctattaatattttttgtgaactacaacatatcttttgccaatttttctattttgtggattatctttttctagtcaataatcttgtgattattatttaatccagggtcccgttatcctctaggcaactgctctctcctgggagggtgtgcctggtcaggtttgcctcaccttttgtagctaccctatcctgtatgccgtttggctgtggttttcttcttcaatccaatcctatctacatttcatgttttaatgatttttcctgacttctagtttagtgaggatacatcttaattttcagagtgagttattctttctaagaatttgtggtaaagaaaggttgccacagatgacctgtcagccatcttaaatcaaaagatcagaagttatctgacgtatattgcattatttagtctgatacttctgaaatggtaaatgcttctctttggcaagagagaacacaggaatattggaggatttgcctcattaatgtatactcatcttggcataattgtgctagactgattattaagctaaagagggtaaacaaaaaagggagcccaaacaggtaaaaagtctaccttcaaatcactgacagtattatctaatggaattttactaaaggccccatcctggcttttgagctgcattaatctattgtgtctggatactatttacatattcatatgagtcattttttaagttgtgaaacttctatagtcagcgttcactaatgagtcctctgggaactaaactgttttttaacaagcttaactgaggtaactggaatcaaacaggccataaattacacagggtagccttgacttgtggcttaggggaagtatttttctaagtttcttatgctcagtgacagatatgtgcccttgcagcttctccttgagtaggccttgctgcagttcgacaggggatatcctgctcatgaactgtggggttgaaaagcatcccttgctcactgtaaagggtccacgctctctcctttttcttttcttttctttcttgcttttttttttttttttttttgaggtagagttttgctgtttttgcccaggctggagtgcaatggcaggatcttggctcactccaacctccgcctcccgggttcaagcaaatctcctccctcagcatcccaagtagctgggattacgggcatgcgccaccacagccggctaattttttgtatttttagtagagatggggtttcaccatattggtcagctggtcttgaactccagac

SEQ ID NO: 2606 - DNA, 1052 bp, Homo sapiens
cctaagatggtgtgtgtggggctgaggtatcacccatgggctgtttactgggaccctcagttcctcgtcctggggtcctgtctggagcgtgagtcttggggggctgctttctggctcaggtagaaagtttactccctctgccctcaggttccatccagtccctcttctgggatccgggggtgcccacttgggtgggtccatctgggagccgaggatctcccagtgcagtgccacatggacttgtgcctgcgtgttgctggttcttcctacctctgctgggagggtgctggtactccctcctcatcaccccatagggctctggcaccctaattgcatggtctctcagcatgccgctgctggcatactatccaccttcctggatttgccagtctgcccgcttttcagtgtcaggctgccactatatttgtctgtttcctttgtctttggagaagtgtgtgttgagtttgccgtccttctctattgctctctaccccttttttaaggacacgtccttgagagcctgtgtgtgtgtctgtgtgtgtctgtgtgtcgtctgtatgtgtatgtgtgtctgtgtgtttctgtttgtgtctgtgtgtatttgtgtgtgtcatctgtgtgtgtgtgtttcagtacacatagctcaggtttttacatgctttcaattacttttattatttcttgaaaagtcattttgaagcgtgttgtttctcgttttgtgattgttcggaggaaagtgagaacttcctcctagcacccacagctgcagtgggcagaacctctgtgtccctggaatcccgccttggcattggccactgtccctcagccctaagctggggtcatattggtgcatcagtattgcatgcaggttagttggactgaggtcacatcttgtacttgactaagaggagatcctttcagtcagagctttgctggcacaaggccggagccggaagatgacagagcccccgacaatcccagctcttctgtgtagatggcaggtgtgtgttttgccctagtcagagtctgcagggggccagcagctggagccc

SEQ ID NO: 2607 - DNA, 1084 bp, Homo sapiens
gttttggtttcctctttaggttgtgagcccattctgagttaatgtttgtgtgcggagtgaggtgaggacccagatttattcttctgtgtgtccagatcgagttttcccaacaccatctggtaaaccagctgttctttccccattgaatggtcttgacacccttgttgaaaatccgttagccatagataatatgagtttatctctggtttctcacttaattccattttgcagtctaatgtcactgttttgattactgtagctttgtcataaggttttttgtattttttattttgagacagggtctcactctgtctcccaggctggagtgcagtggcatgatctcggttcactgcaatctccgcctcccaggctcaggtgattctcccacctcagcctcccaagtaattgggactataggtgtgcaccaccacgtccagctaattttttttttttttttttttttttgtagacatggagtctccctatgttgcccaggctggtcttgaactcctgggctcaagcagccttcccttctcagcctcccaaagtgctgagattatgggcatgagccactgtgcctggccaaaaaaaagtttcaaaagtaaaaaataaaataagttaaaaagagaaaacagcatataggataagaatataaagaaaaattattctggcacggctatatagtgtttgtgtttgaaattttattacagaagagtcagagttaaagaaaatcgtagtttgtaatatacaaaagttacaggaagctaaggctcacctgttattgaagaaagactttttaaaataaatttagtggagccttagtgcgcagtgttgataaagtccacagtagtgttcagtcatgcctaagccttcacgctcactcaccacacacccagggccgcgtccagtcctgccagccctgctcacgggaagcgctctacactgcgtgccatttcgtatctttatgctgcacatttacggcaccttctccacgtttagatgtgcaggtagttagcgtggtgctccagctacttgtgctgcttggtgctgtggtgtgccatgcaggcctgcagcttgggggggt

SEQ ID NO: 2608 - DNA, 1072 bp, Homo sapiens
taggtagtgtaaccttcatggcggcttgctaggactgtatataaaagaagaatatgatgtatgtttaataattattggcattgatgtatgtcaaatggtactctatgtctattgggttcagtacagtattttatttgttttccctatcatttttacctttgaacatctgggtcagggttagacagatttaatacagcttattcagctactcttagtgtcatcctgccaaagacactccagtcagagagccagagcaggtcctggcccagcctcccttggatgtcccagggccctgccaccatctgtaaggggtataggacttctggcggtgacccgggatgtggtctgggtcatgccccacagcatctctatgtgcaatgagtgtatcctcaggaccgggggcaggtcaccctctctgtgaaacagataaaatgtgccacgttcttagaacaatgtcagcttacattgcatatccaataactcagctttcattcaggatagctataggatggtaaaaacagaagacaaagttgtgtatgtactttaatcccaaatttgagttattcgcaagagtgtatggacatagcgacgggggaaaaagccagataggagtgtgcttgtgtcactgatggtgccagcctaacagtggtctgtattatgggcagattttgttttattccttaacttctctcatgtttcctggttttctacatgcagttattaacagaaaagacaaatagtggtgtctcctgatagcactgcacgccatggtcatggagagggcagagctgatgcaggggctagtgggaggcattggagctgtgggtcctggcaggggccttgggccatctccccagccgtcagctcatgggagccctgtggccctgaaggacatttaaattctaaatacacttaaatcacattttagtatggttgacgagggacatagggactgagaccagatcccgagcggatccatgtccctggcttccaggaggcctcctcacaggatgtgggcacagggacagtgtgagtgtgcagcccagccatcccttccaagggctgtgcctgc

SEQ ID NO: 2609 - DNA, 1050 bp, Homo sapiens
ggggtctcctctgtccctgacccctcgctgttctcaggacttcacagtgtgggtggggtctcccctgtccctgacctctcactgtcagcaagtccttgcaatatcaggtgaggccttttgtgtcacttgaccattccttgtccactggacctcaaaactaacatgatatacagtagtaagaatgtagaaactttcccactaaaatcacgaccaaggcccatacatccgctctcaccatctcctttcagcactttaagctctaacagatggaacaaggcaagaaaaggaagttaaagtttaatgatactgaaagaagaaacaaactctctttgttcacaaatgacattttccaggtagaaagtgtaaaaagggatcaagaaaatcccctagaataatgaacaactattcaagatttcaaaatatacaaaagttaatcactttcctatataccaacaatggatgagtggatttgaagttaaaaacaaagtacttctactttagcacccccaaacaataaaatacttaggtacaagtctaaaaaaagtgtactctttctatatatatgagaaaaactacaaaaccctgatgaacaaaagaagaaccaaataaatggagaaaaattccatgtttatggataagaagactcagtattttcaacatgtttgttccttccagcttgatctatagattcaatgcaatttcaatcaaaatccctgcaagttattttgtggatattaacagatgatcctaaagtttttatggagaggcaaaagacccagaataatcaattcaatactgaaggagaggagcagagttggaggactgacgctacctgactagaagacttactacaaagctgcagttaccaaaccagtgtgttattggtaaaaggagagacaaataatagaacagattaggggacccagaaatagacccatataaatatagtcaactcatcttctgagaagattcaaaggcaccacaatgcagaaaatggtcccacaatggtgctgggacaactagatgtccgcatgtgcaaaagaaatcaaa

SEQ ID NO: 2610 - DNA, 1011 bp, Homo sapiens
tctgcatgagggcagtgatcaaagcattatttacaatagtaaaaagttataagcattgtaaatgtcccccaggagaacatctgccttcaaataatgtttccaagaaactttaactgtttaaagacatgaggaaatgtctggtggaagacggcagtttaacctgtttacactcactggtttcttcttcctttgaagatctcactaaaataatcatgaatgaatgaaaacatagaagacccatagggacaagttgatcaggagaagctcactcaagagattacaacaaatctttgaaagaaaaaaaaacagagaagaggtaactgataagtcacggcagagagagctacaagaggacggatggcagggtctctgggtagcaacctgggactctgctgagggccaccagggctgggatgaggatggagtggaaaacaagaggacgggttaagcagctgtattgtaagacttctactccagctaagattaagtaaaaaggatcaaatttaccctccctcctgaaacaactgaaaaatctagacaaaatggatggaaccacaatttccaacattagccaacaggcagcacaggataacaggccctaagaggggacagagcgaggtgggtccaggcaggggccagtagtctccctgaggagatagagccagagtcccagagcctgttctgggctgagtcctgacactttcctacccccaaaatccatatgttgaagtcctaactcccagtactttagaatgtgaccagatttgaaaacagggtctttaaagaggtgattgagctaaaatgaggccacaagggggtccctaatccaatctgactgacgtccctataagaagaggaagtctgtacacacagacaccaggctgcgtgtgcacagaggaaaggccatgtgaggacatagcaaggaagtggcatctgcaagccacaaggagaggcctcaggagaaaccagccctgcccataccttgacctcagaattctggcctcctgaact

SEQ ID NO: 2611 - DNA, 1050 bp, Homo sapiens
tgttggagtgggcagttgtagttcttgtttcagaactagtggtcagcagttttctttgccggctgttgcaaggctggtggttctggcgttttccgcagtgtgttgggaggagtgtgagatgccgcggtgcagttgtgtgcggcccctgtggccctctgctgttgcgttagccattgtctaacacgtgtgaccgcatggatggtgtcctcatttaatttgaattttcaccagcactgcctaggtagccagaaccataaggtcctgaaatgccgtactattagctgggtccaaaattgagaagaattgagtagtgtaaatgttagtcacacatctcattggacacattgttagagtgtgttgtccatgttttcacatgttggtagactggagaatagctgtcacttgtcttcaggcgtatcttgttgaaaataaatccaaatcactgcagcagtaggaatatgctgttgcctgtgaggcagattttcggatttgctagttgaaaaagatttgaaacagttggtttggacaacagctgagtcacacaatgactgtgagtgaaaagcaaaaactggttctgtgcccctcacagttctggttttgtacatcatgtggtctagctatgggctgtacctcttgcacaatatggagaggacattcagacatcttcaactgctcatctgcccctacggaccagacaggcttgaaactataggaagatgcatttgacctttcatttttcagttcagtagaatttaatatggactgtcagccgctgcggtgatcatggaagtagacctaagagaaaaaaacttgtgcaagttcacacgtggagtagtatatgaccatggtttcagagaactgaagcagttctttttagattcttcaaattaaatgtctccttggtgtatttaaacctgctgttactcacaggccaggctccaccaagctttcctacacacttcttcctgagctgtgaccattctcctgagcaagaggctgcagccagcctgggctggcgggcccatactgtctctcataggcattctctcc

SEQ ID NO: 2612 - DNA, 1107 bp, Homo sapiens
taaaaatacaaaaaaataggccaggtgtggtggtgtgcacctgtagtcccagctacccgggaggctggggcaggagaatggcgtgaacccgggaggtggagcttgcagggagcagagatcgcgccactgcactccagcctgggcaacagagcgagactttgtctcaaaaaaaaaaaaaagaaaaaaaagaaacagcatgaaattccttgttgatgggaaatacccgaaaggcctgcctgggttttcagagagcttccagaaagctgaattcatggaggttcctggagaatggcacagccaggagggaaaggtagcgccgtgtctcttccctcatacaccgcccactgcatctctccatctgtatcctttgtaacatcctttatgaaaaaccagtaacctttagtgtttttctgagttctgtgagccactctagcaaattaattgaacccaaggggaaggagttatgggaaccctgatttatagatggctgtccagaagcacaggtaaaataacctggagtttgtgattgcctccaggtagacagtgtcagaattgaactgaattaaacgacacctagctggtgtctgctgcagaacgcagaactggttgcttgcttggcatgtagggagaaacccctgctcatgtggtgtgagaagcgacctgtgttataagagtgtgtgagaaactgagtttgggttttcctatgtcctcaaaatagtatattttgaaagccttctaggcagaatgtattaaaatagtttttactccctgaagggatgccagcaagctagaaagattcatttccaaagggcttccagtggtagcatggctagacatgagacatctttccatttgtgtcatacagcaagttatttttgcagtaccatatacgctatgcgggaaacttttaagtattttataggtttgatttaggtacaaatggccaagaagctatcatctatactcatcctggggattgggaacggaggcagttagatgtgcctgtgctttgtaccttctgtagatgggaatgcagttgctcactcaccaatcaaatttattgatttatatttaaaatactatgaatacatcttctggcaattttgg

SEQ ID NO: 2613 - DNA, 1025 bp, Homo sapiens
ctgctctctctccatgtggggttggctaggctgctgctctctctccacgttgctgtgggctcgcatcctctccctggttccctgggggagcttcttagggagggagcatgtgagagatctgaggccctgcagtttgggagttattttcattctcccctaacacttgttggatactttggctgggtatagaattaaagggtttcgaaagcagtgtttcagagtcttccattctctggggcatcagaggtgtcatttgcccctgtgcattctggagtccaccttgcacctttattgggtctcatctaggtccttggctttgcgcttcagccctttgaggccgaagcccagattcctgggtccccactctggaacagggaaaaatttcaccccgtaatttcgtacgttctttctttttagggtttctgttggttgatatcttaagttactcctcatcttcctttttcattctgtttgtttttgttctgccttctgagcaccttcattttgaattttccttttcagctatttgtgtatctatcaggtttctctccttgtcctttgttaaaatagtattctgtcttcagtctcctgtcttggttgcctccttgcagattccttttatatttgggtctcttatgttggtggcctttcaaaggcagacaggcctgtctcttggtggggggtgggggtgggcggagctccagttgcttgtgtgtggatctgctggggcatatagaactctcaggaattattctggaatttcatggctcaagtgtgttgtcatggctcagcgcaggcctaagccctgctgcagctgctcccctagaccaagcttgtccaacccttaggccgcatgtggcccaggatggctttgaacccgacccaacacaaatttctaataaaacattgagattttgggggtttttgttttggtttggttcaccagctgttgtgttagtatattttgtgtgtggtccaagacaattcttcttccattgtggcccagggtagccaagattggacat

SEQ ID NO: 2614 - DNA, 1360 bp, Homo sapiens
ctggtcccatgggcactcctgcttctagagagggggggccagcccatagatggggcatcgatgcccatagatgcggcaggggggctgtgttcccatgaccatttgacactggctgcccggcaggcctgatcttcgtggtggacagcaatgacagagagcgtgtgaacgaggcccgtgaggagctcatgaggatgctggccgaggacgagctccgggatgctgtcctcctggtgttcgccaacaagcaggtaggcgcccgggccagcctggggaatgtgaggagccagtgtgggttccgcctggtggtaggggttactggaggctggtggggcccctttctctgtcctgtggacagcccttcccaccaacccttccttcccccaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctca

SEQ ID NO: 2615 - DNA, 1031 bp, Homo sapiens
cagtcgtgggtgtgggaggggcctgcaggcatgcctgggttgggggcagctggccctgggcaccctggtgcaggtccagtctgccctctggatggcccctcctcttccccagattactactttgtaaccagggaggtgatgcagcgtgacatagcagccggcgacttcatcgagcatgccgagttctcggggaacctgtatggcacgaggtgggccatgcgtgggtgtgggtgggctcccagggttgctgttggcaacagggatccaggtagtgcctgctgcctgcccgccatccacaccacccaccccatggttatgaatgtggccaggttgtggcccagggccaggctcccacgtctgtggcccacagtggctcttttcatgaggctgctgggcccggtcctgccaccgtgcattgtcctggcagggtgaagggtgcacaggacacctcatgctcactacaggcaccttggggagtgggtggcctctgttccctgtaggcggggcagggcgtgggggtagcaggtttgagatgctgtcgggtgctgggtccaggccaggcctaggctcagctgtgggaggagaacgctgggcccgggagggcctgggtgtccctgaagctcctgtaggcctcagagagccctggcacccctgctgacctggcacctctccccagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggtgtgtgctgggcagggttgggggctgggggccagggcatgccaggctctgattgccaccccctttttaggagcagcggctgcggcagcgcaacactgaaaccgaggagagcctggtgaagcggctggctgctgcccaggccgacatggagagcagtgagtgtgccgtgggatcaccagggaatgccaggaggggagtcagggttctgaggtctgt

SEQ ID NO: 2616 - DNA, 1049 bp, Homo sapiens
cctgtcccagtgcccgaggtggccttttgatgtgagagggccaaaacttccaacctcagatcatgctaaggctgccgtttctggtacctgtgtcctgtgaaatgccatgcaccccgacgacacctgcacagaatgggcctgctggaccaccctgcctccgtagttcataaagactcccaagctgtatcacttgggaggcaggtttaagagctgttctccctcctcttcactcagtggccttgcaaataaatcttttctcttagctgggtgcagtggctaacgcctgtaatcccagtgctttgggaggctgaggcgggaagatagtttgagctcaggagttcaaggccagcctgggcaatagcaagaccttgtctctacaaaaaaaaaaaaaaaaaaaaaaaaaaaagctggtcttggtggcaagtgcctgtagtcccagctactcaggaggttgaagcaggaggatcacttgagtccaggaatttgaggctgcagtgagctatgattgcatcactgtgctccagcctgggccacagagcgactctgactcaagaaaaaaacaaaaaataacaacaaagatctctaaatctgttttaattttgtgttttgacaggcattaggattaaggttaactaaaggccattgagaacccgcagaagcaggaaaacctgtttgcctcccccattagctgcctaaaaaaataaagtgcctggcctggcgcgatgacttatgcctgtaatcccagcactttgggaggccgaggcaggcagatcacctgaggtcaggagttcaagaccagcctgaccaacatggtgaaaccccatctctactaaaagtacaaaagttagtcgggcatggtggtgggcacctatagtcccagctgcttgggaggctgaggcagaagaattgcttgaacccgggaggcagaggttgcagtgaactgacaccgcaccattggattccagcctgggcaacaagagtgaaactccatctcaaaaaaaaaaaaaaaaaaaattaaaaagtgccctttcatgaaggaatttccagtg

SEQ ID NO: 2617 - DNA, 1196 bp, Homo sapiens
ggacagtacctcatgcgctgtctcatgtgcgctctctctttcgctctctccttttgcctctgtctctgactctgtgtgtctctttctctttttgtctctctgtctttccctctcccctcccatgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatcgtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaa

SEQ ID NO: 2618 - DNA, 1030 bp, Homo sapiens
ccaggaagctaacaggtgcagaggaaaagtgccatggaagaaaaagaagaaaaaggtcatttactctcactctcaaacaagttattaatgctataaatggagacacagcaagcctcatgtgctcctgtacccatctccttgcgggtaacacacctctcaccctagtctgtctgcggaattccacgaggacatccaggagggaaggggtttgattttctaattgctcataaagagctgtagcccagtctctagctggtgactgtcatgaaactccagaatgctgggggagaaaacccagactcggattaagcaaattcgaggtcagaacgacatcaagggattcccttaatgtcccttgctttcctgctgtccccatggggacttctacagtcaggggctgggggctgggcccaatcctcagagctcttcagctgggatgggcaggccaagaccctcatgagtctcttgtgagcatttcttgtaaccttggtttagagagcaggtgttggtaaaaagttctgtgaccttgggcggttctacccagcacagccatccaggttgggcatttacgtgtgtgattagggagttgtgtgggcacaggctcttgtcctgtttggttcttgcattgcaggaaggccctgtggtccttctgcccttggggatggggagagggtggaggaagcagagacactgaagagcaaaccacatcctgaccatagacaatgctcacctggcaccgagagctgctgcagcttccctgggaagtcctggcaactttgggggaatgaatttagtttcctgccaactccaggtagggtgtgacccagaccaaccacgctgtctccaagcagtgatgtgaaaggcaacctagacatctggcaaaagccgccaagtcccccagtttccagagattcttccttttgttttttgcaaaaatatgtaactgtacctttctggcagttgcagcagaaaaaaaaaaaaaggcttcctgaagagtgtgatccccagtgtggaacaccccagggctggg

SEQ ID NO: 2619 - DNA, 1021 bp, Homo sapiens
acaagtgtttgcaaatgtttctgcaaatggcagtggtctggttcttcctgtagagaaccacagtcagaaatgttgtaaggaaaacatggtctttagcaatttttggttacatctttgcacttctttattttcaagtgctctttagcccaggcttagtttctttaacctgagtaaggagcacggagcactaggggaagggtggaatgtccaaataagaaaagcaagtgggggtcatgaatcagtaagaaaggattggaagagttcaggagatagagcttttatgtttcatttttcgtatacgcatgataacaactgataaaatagagcttatctttggcatctccacttcagacacagttaactgaacttttgagcttcacagattgattacattctgatcataaggctttgaccattagtattcttatttcatggtaacttccaagtatgtttttactttgcaactctgaattgaatcttttcttctaatagaggaaattaatcgaaaactagtagaaactaataaatagaaaatgaggccagaggtgatggctcacgcctgtaatcccagcactttggaaggccgagttgggcggatcacttgagctcaggagttcaataccagcctggccaacatggcgaaaccccagccctattaaaaatacaaaaaattacctgggcatggtggtacgcttgtagtcccggctacttgggaggctgaggcatgagaattgcttgaacccaggaggtgaagtttacagtgagccaagattgtgccactgcactccatcctgggcaacagagtgagactctgtctcaaaaaaagaaaatgagttttagaaggagcaagcaggacagttgaagtttgccaagctgaagtaaaagtcacctagaaccaagtcctaggctgtcactttgacgtatcagtggccatatttatacagcattgttccttaaaagtgaaacagtcaggctctcttctggacatttgcctctgagctggtgaaggaatgtttgccta

SEQ ID NO: 2620 - DNA, 1049 bp, Homo sapiens
actaatgtgcacacgagtcccctggtgtattaaaatgtagatcctgacttggagggtgagggagatcggcatctgaccagctcccgggccgtgcaggtgctgttggtccagggaggcatgtaatgactccatgctcgagaactttgaaagcatggttttttgaaaaaacaaaatattctttctcatggtcatttgaactgtaaagtattccaatccatgcctgtgactttactgctgatgctctgatgactgtaacatctatatttctagtcacatccttcactcaaactacagatctttttttcagctacctaactacacctgggtggcctacaggcatctgaatgcagtacgtcccaaacccaacaaattattcacgcctatgccccatcttctatttttcctgtgtttgcctagaagataaagttagagtccatttttaattcttccccatccttacctcctggatctattgggtttcagagtcttttgagctgacttcttaacatggtttaagttactgtttaccctgaaagatgcaaaggaaagttaaattagggccagtttacatgattaaaaggtaagcaaattgggtttcattccaaagttcttcgtcgtagtgacttgagcagctgtgctgactatcttacagcttgccacacagcatctgcaccactgtccctaggcagcttccacagcacctggaacctgggttcatgaggatacaagagcctcctgggccaggatgggagtagttttccactttagaagaactatatatctatatataatatagatatatataatatatatagtttatatataaattatttacaatttatatataattatttataatttatatataattatttatatttatataaattattattatatcagtggaaagtaacaaagagttggcctgctaagtaactgccttcctcaaatcagcctcctcagtgtgtgtgatcccaacgaatgggtcaggaaaatcaaagacccaatcacgaacctggagcaattgttgggagtctgtgctgcaaatg

SEQ ID NO: 2621 - DNA, 1048 bp, Homo sapiens
tcaccagagatgctgatgatcagtcagtggacacttggcagcctttatcttacttagcttctcttttcatattcggcccttataagaactgcttccccaaatctccactgtgttggcttacaggtattttcaacttaatctctgaattggcaacttattattttaccttaaagcctattccttctcagaaccttcagcatctcttatctcagttttcgtaatcacagaccctaagcctttaattcctaaagaaggaaaccttctttaaatgactccattctacccaaattctagtgctataccacagcacttagccttttctgccaggaagtaggacacatgaaatgcatcatacagtcagaggccatacatccgtgcttcctttctgacatttggaaatcttgaaagcaagacgattgcttggggaaaaaactaggaaggcagaggtcatcgtgtctgctgaatatggcttaattttcttgaacactcaaggtcatcattgactattgactgctgcacagaatgtgctgtgctattacggccactttctagctcatcccctgctgtccccatctgcctttgtgcctgtagttcacagtcctactttagtatatacctttgatctactgcagtttggggcattaggtaatagaggctgcttgaagtgaatgtaaaacaagtcagtcaattccaaatgaggtgtctcctgtagagttaatcttttttggctttatgtttgctatttcagtggctaggagacctttttttcctggtctttattttgtctgtgttcctgaatggctgacatttgctcaagattgaattctaattatttgatacctttcctattatctcatttgacttttctcatacggaaagttaaaagtacattagtaggatgtatctgttttagattttctgttttggggtgtggtctttcccttcaatcttaattcattctggagaaaacccttatcaggtgaatataattataaactgagtgagaaaaatttattgtgaatttgagccctcaagttaacgttcacta

SEQ ID NO: 2622 - DNA, 1061 bp, Homo sapiens
gtcatgctttttaagtcagtcttccaatctttgtcatttaattgatgtatttattccatttacattattgtaattattgatattgtatgactcaggtttgccattttatttctcagttttcttttccagcctgccttgactggccattttaaagaattctgtttgatttaccaagagtgctgtggaatgtatctctgctcatagctttttcagtggtcactctgtgtattacttcatatatacataacttatcatagttatatatatatatatatatatatatatatatcatagtttactgttgtcatctttttatcctgtcttgttttaattgtcttaaatatttcctttacatattttagaatcatatagataatactatttttcttaaacagttaaacataatgaagaaaactcaagataagaaggaaagcctattgtatttgcccatgtttttgctttccatgttctttcttccactcagatgttccaagattccttcctttatcattttcttcctgtttagagaaattcctatagctattcttttgcaggcagatgtcctggtgataaattctgttaatttttttttaaatcagagaatgtcttcatttaccctttattccagaaaaatagtttcacaggacatagggctctgggttgaaaggttttctttctttgagcacttgaaaaatacagtcactctcttatggcctccctggcttcagatgagaaatctgctgttattcgaattgtatttcccttgtagatatggtatcatttttctctggctacctttaagactttttatttgtcttcagttttcagaagtttaattatgatgtatcttgtcatggacttctttgagtttatcctgtttgagttcattcagcttttcaaatctgtagatttatgtctctcaccaaatttaagttttcagtgctgtttcttagagtgcttttttcaaccactttctctttgtcctctccttccaggactccagtgacatgaatgttagatctttttcattgtctgcaggtccttgaggctctgtttattta

SEQ ID NO: 2623 - DNA, 1498 bp, Homo sapiens
tgggcacaatggcgcatgcctgtaatcccagcactttgggaggccgaggcagacctcctcacctgaggtcaggagttcaagaccagcctggccaacatggtgtaaccccttctctactaaaaataaaaaaattagccgggcgtggtggcaggtgcctgtaatcccagctactctggaggctgaggcaggaaaatcgcttgaacccgggaggtggaggttgcagtgagctgagatcacgccattgtactccagcctgggcaacaagagcaaaactccatctcaaaaattaattaagtaattgaagttcaataattgcttcaaaaataccataaccacctttaatcaccatcatttttctggaagcattgattaaacatggtggattcaattagacatttatgtcttccctctcagaaccccactgaaatgtctgttaagtaactgaaattgaagtaactcaaaaaggccaagattgagtgagtgcacaattatgattgagagatttccaaaaaaatcttaaagataggaagtagatggtgctctgacagcagaaggagctccaccttaagtactgtaatgggggaagccatttcttcctctggagtcccagaaaaggtcaggatttggaagcatcaggttctacaggaggtagaggttacagaggttcatgtttacacacgaaataagaggttcagtcttttacgttgaaatggagtctagactcaaggtcataaggcccacctgagggcatggggtcaggcctgaaaagagggaaattaagtgaaaatgaaagcctctggcccccaacccacctcccctacctcttccctggtcgctggcagccaggtgtgtatgtcccacataggagaaaggagccttctctgcagaaaaatgaatagtcagaaaggaaaggcttgaaggtagtgacattttgctttcccagtcaaacagcccagtctctatccagtcatctgaaagtgaaaccctccaagcccacctgctccacccacacataaagagcttcttttagactttttcattccttgctcttaatgatcaggcagaattttgaagaaagtttctatagcaaaagagagagctcaaagtaaagaagctggaactttgagggagtaagaaaaacacactaaaaccacagtatccttaggaagaagagcagagattgcattggagtatgtaatagaaacaaagtcatacttaaaaagagcaatcagaataatatgttaaataaactcatggtgaaaaatgggagagatgacataaagaatcctccagaattaatccagaagatgcaatgactattaggagttccagaagagagaagagcagagagaataatagaagaaaatgtttcactgaaggaatgagattccagattaattggcccacctaaaatcaaacatagtaaggaaaaagtccagaccagagcgtgccatgtgaaatttcagaacaccacagatgaagtaaggaagaccagaaa

SEQ ID NO: 2624 - DNA, 1024 bp, Homo sapiens
ctgacacataggagggaccccagggcttgtgggaaaaaatgatcacagagccaactgtgtccctaagtctttcaagggtatctgcatatcactggtgcagcctttccactgcaagatcccactttgcaaaatttccaaacaggcagttaaaacccttccttcctgcagtaggtcgctttgtttttgaatattgatgaccttccgggattgatagctcacaatatgtaggtctcatgttttgttgtcaggtaaacaacaacatgttggggattctgtctgtgcactcctacttgactcctggcacatctcacagcacagcctgtgaacaagcagttatgcctgctgtgttctccatcttagcagaattcgatattgtaggaatagggagctttacctcgagggttgtcagatgcaattgaggatataattgtcaataaacctctgatctaaagcctagccatgatcagctgttatagtattttatgatgcctcataaatgattaggggtgaaatgtgttgaatctctcacttctgttaattacacactctaagttacagttgacaagtccccatgttgaagcagaggccagaactataattagatcttggaaacttagtaactctgctgccttttcaaaggaaaagaggaatgacaaatagttttcctaccctaattttaagactcactcttttcacctgacacttaaattctgaattctatttaagttctttatgtgtgtttctatctgattttccaacttcagccctatctgagctgtgagaacttgactcctgcacttggagagagcccactgtgaggatctgcggttgccgagggctccttttgctgttcactgcatctcccgtcccttgtcgaagtataggactcaatgcccacctttcttttcttccttaaaaaccatagtgtgccagagaaacgctagataatatttagtttaacaagaacctatttctaatactatccattgaaatgtctataatagtaaaaccttgaaggggcata

SEQ ID NO: 2625 - DNA, 1051 bp, Homo sapiens
aggtgagaggatcacttgagcccaggagttcaaggctgcagtgagccgtgtttgcgccactgccctctagcctgagtgacaaagtgagaccctattaaaaaaaaaatcagtaaaatgtaaatccttgcattcctgatgttgatacgcatggcttcttttttaaaaacgttcagtcttactagaggtttctcaataattttttcgaagcaacagctcccggcttcattcatattccatttttgttttcaatttcattgatgtctgctttttgtcttcctttgttctgctagttgtgggttcattttacttatcgttttctgttactgtggatgctcagattattgatctgaaaccttctttcataataaaagcactcaatgcaataaatttccctctaagcactgcattatctgtgcccacgtattttaatatgctataatttcacttttcttccctttaaaatatgttctgatttctcttgagaattcctctttggtgatttatttatgactatgttgtttaacttccaggcaatttcagattctcctgttatccttctattactgaattttagttcaattccattatggtcagaaacatactttgtatgatttcagttattttacattcattaaagtttattttataaaccaggatatggtcttagagatatgttccacgtggccttggaagaatatatgtattacgctgttgttgggtggagtgctataaatgtcagttacagccacttgattaatgatactcagttcttccatcttggctagttttctattagttctattactgttaggagtattgaagtcttcaactgtaatggtgaatttgtctagttctcctttcagttgtcagatttccttcacatattttgcctcagcacaatcttctttgtcatgttagcctttttccagtaattcacctgtccaccatagccatctgcttcctgtcataaccctgctttccctgggcgtatggagaatcctatgttctattgttccatactgtctcactttttagggattatgcttgcctc

SEQ ID NO: 2626 - DNA, 1045 bp, Homo sapiens
aatgaccatttagtggaattagatcatttaacgaatggagaaaattgacaaggataatgacatggtattacagtaaagaatgatgtgaattaatcatagctcactctcatctgttggggttgtgtagggaatctgatggatgatcacagcatcaacagtgtgcatggtaggcccacactgatgtaaacacgcagccagaatcctcttaggtgcatctaaagggtatggtaagaagtcagcacagccagcatacccagcagaatgatcagcagctagtgctgttccaagcactttacatggcttagcttgttcaatcctcatgacaacctatcatcctcattttgcagatgaggaaactgaggtgcacacatacaaagaaaagctagatgatttgttcaagatcataaggagccagagtgtgaacccagatagttccaaaaggatttgtgtgcttttcatcagtatgatagcaaaggattaagagagggtccttggggaactgggtgaaacgctggaatacttttgcaaaaacgacttctttctgaatatgctgcaaaaagtcagtaatttgacatgacgaatgtggtattatgctatcaaaaattttgttggacagattatgccaaagagaataatcccgacacttgacttactctctgttcactctcacacgtgatgcagcactgtccagcagtggtcagcagtggtgggtgtgtgctgtgtctccatcgtccagtatggtcaccactggccacagctgtcttgaccacttgaaatgtggccagtatgactaggaactgaatatttaattttatttaattctaattaatttaaatgtaagtagtcacatgtggctggtggtgctctgctggacagtgtgtggttgtgattcagacctaaagatgattgactataaaagaggcatgttttgtcatcaaaatctcattttcttttttttttgagatggagtctcgctctgtcactcaggctggagtgcagtggtgcgatcttggctcactgtaacctctgtctcctgggttcaagc

SEQ ID NO: 2627 - DNA, 1061 bp, Homo sapiens
taaaatttaatgggttttatgtatatatgaagccgtccccacaatcaaaatatagaatattttccatcatccttaaaagattcctcttgtttctttgcagttttttctccactctggtcccagccccagtcacccatctgctttttgtccttatggatttgtttgtgttttctggagttttataaaaatgtgcctaccattgtgctgaatgacagcagggaaggtgctctggtgtgtgctagaacttccccatgagctgtaactcaagctgtggggacactcatgcaattaggattcttgggaggagtttgttaagaggccctggacggtcctgacaccatatggtaggaaaagaactaggaatcagaagtaaatctaagaagacagtagaatgtctgctaatgataattgagtcctatgtctgtccacctataaaaggcacatacacaaacaatttctgaaatgtaaggaggcaaagacataatttagggtatctcattttttaaatcatatgatgtcggtagatgattttctccacttaagataattttcaatttgttttccatttgcctttattatagaactccatcttggtgttttttttttttttttttttttttaagtaatcctagatttcatcctaaaaatcttgattacttttctggttagactcttaaaaacacccgagcactcttgagttttttaaagtgtccttccctttgttgtgtagataactgtttggacatatctgttctcccttattctgtctgcaaaataagccaattaaagagtctgggaaaacatgtaacacttgagataattttcacccatattaaaagtctaacatagaagagttaaaatgtgctgtttttgaactaattggttgggaaacactttgttgtctgtaggaagcatagatgacctgcctacggtcctaaagtgtgcacgcctggttgaaagaatgtacagccacatcgccgcacgagctgaggagtttgctgtgttttccccatttatggtggcccagtacgtgttggaggtacagaaggtaaaattgggtt

SEQ ID NO: 2628 - DNA, 1055 bp, Homo sapiens
caggccctgtggcccagaccaggcatcttgaactatatcccagaccctcctcatgaacagaatcactgctcaaaagtcctccttttttcacctgccctgtgctctagtctagattctgatttcttgtggtgagttggtgttgccttggatttcttgtgcctgctcagatctgtggatttggccctaggtcctttttctttcttcctgttggcctcctcagctccctccctcctttctgccaggtattccctgcaggcctcagcgtcagggctacctctattgacaggggatccttgggcgttcgggccatagtttttctttggtgaataaatatgtatggcttacaaaacatgtgtttctaaatttatgaaattatatgtatgtttatacattcattcgtgctttcatttagccaacatttattaagttttttacatagcagaaaccacttcataactgtgagactctggataaatcacttaagtttcctgagtgtcattttcttctctgtgaaatggaggtaataatgattggctccggtgtggtcctgcaccttgaacaagatagtggactttaaagggcttcatcagatgccagcccagaaggtgtccagtgggtaagaatgtcccccctgatgccatcccttcatctggttcccagtggggaatatgatgaagtggctgctacccaggagctcatggccattctgcttagttccagtatacacgagctctctggggatggcacctctcactctgccatgcagtggtgagaagtaactattctggaattgtcttatctcagccctacatactattttcagtgtctgtgtttcatttttcttctagaacatgcctcccagagttgttgaaataattaagctaggtgctatatgaagagaacttagtgtgtggcacataaacaataagggttcaataaatagtggctgtcatcatcctcgtcattctatagccaatgagagaagtgagttgaaataaaacctggcttaagagccagttatatttgaaattattagtgttggctcgttgcctgtg

SEQ ID NO: 2629 - DNA, 1050 bp, Homo sapiens
cttattagcagctttagaaacttcactatatcagtaaatcagcatcaactagatacttagagctaacttacaatatcatgataaccaaataaaaagagttttcaccatggacaagattcatcaacagtgactgcgctatttaagctcttaactaaggcacgagctctacctggtttcagaatcctcgggaagctggattcgtcatctggagggttgcttgcagaggatgacattatgtgaaaggagctgcattattctaaagggtatttcatgttggcctttccaccaagattaggttcattttctcaaatgtgctacctgcagctctcttcttccttcaaaaccatgtcaacatgaaacacaatgaaagatatataaatcgcaaatggcaaaaaaccattcacaagcttcaatattttaacttttattggtgccagattacctggaaaacaccttacaaatgatcccaacatacctgtgaccaattctacacactgtccctggatctgtcctcctcttcttccagtatattgaagtttaagccaggcacatggctaccaaacataaagactagatatcctagtctaccttgcagctacatggtcatgtggccagtgggatgtgaggtgaagtaatgcacacacctttggggtcattccttcaaaagtaagggaaatacattgtccttcctgctttctggagttcagccaccttggatcatacagacgaggcaaatgcttgggggacggtcgatgaccagggagaaggagcctgggtcccatgccttgagtgccatgcctgctgaggcagagacattgattatagtttgctaaacaccttcgagttccctgactcccctccaggagtcaggcagaactatgttcaactgtgacatatgatcgcttctgggctggagcacacacaactctccagcctgatcctctcctctgagacaggtggggatgatggagatgcagatgtaggtaacagctccacatggcaccctgatgatctcgcaccatctatattgaccacctaggcactggcttg

SEQ ID NO: 2630 - DNA, 1031 bp, Homo sapiens
cctcaacttctgggctcaagtgatcttcccacctcagcctcccaaatagctgagattacaggcatgtacccctgtacctgacttctcattttgttcatccattgttatactgatttcctttattttttttgtgtctttctttaatgatttgatcatactttaaaccgtttttttaaaacctttgtctagtaactccaatttctgtccttcctccaggatggtttctgtcaattaaccttggtcctttgaattagtcatatttttgtatttttttgtatgccttgtgatttttcactgaaaactagacatttgattactacaatgtggtaactctgaaaatcagattctccccttcaccaggattttctggctccttttcttttttttttctttctgttattgaagtctatagtagcctgtttgtttagtgacattcccaagctatatttcaaatactatattttttgttgacatggtaactaaagtctctgttccttagcttgagttcagctagtgttttgacggagaattccttgaatgctaggagctgtcctactctttgcaaattgactctgtgcttgggatttccttcaactccatgctaggcttgcactgtgtctagggatcagtctaaggtgaaagcttaggttttctcaggtcttttctgagcatgcatcttgttctgggcatggacatgtctgtcaaaattccccatttacttttgagtgtcctaatttcccagagaaactctacacagattttgccttaggtagtctgttatatgttgacctgtaatcttttctcccaggcatcttagggttgttattttggtttgcaatattttttagctttttttggcctcagtcctgagttaggcaaagcagagagaaaatcaacttgcatcaatttttctgtgttagcccctatacaggttagaatagaaatgtggctcagacaaatgtgacatatacaataacttgcaaataaagtctgctctgatccctccagaattggggaaatggtcttgcact

SEQ ID NO: 2631 - DNA, 1079 bp, Homo sapiens
ccatggctggcagttttctgtccctaactcttagggaagaggaatggccaggagggttgggggtagagttactgaatttccagagttcaggtcaggacatgcatttgggcagggacaagggtactttcgggactgtggttgctctggttcagtttcttaactctggcaccattgacatttttggctggcttttttttttttttaagacagttgtactctgccacccaggttagagctcagtggtacaaccagagctaactgtagcctcaaactcctgggctcaggtgatcctttcacctcaccctaccgagtagctaagactataggcatgtgtcaccacagcaggctaatttttaaattttttgtagggacagggtttcactatgttgcccaggctgggctcaagcggtcctcctgccttggcctcccaaagcattgggattccaggtgtgagcgactgcactgggctggatcattctttgttgtgcaaggctgtcctctgcattgtatgatgtgtagcagcttccccagcctctccccactagatgccagtagttctcccacccctgatcttccaagttgtaacaaccaaaaatgtgcagacattgccaagtgtcctggcgagggtgggaggtgggcagaattgcccttggtagagaaccactgccttagtccgttaattttgatttcattccttctgtctgagccattatggttagaccttcttgtaatgagactgcctttctgtgtggtctggggtgaaccactgtggggagggctaatatattaatacgttttaattttcaaaatttaataaacactttcatggcactcactgtgcatagaaataaaagggctgcatttcatctcagcccttttatttcttctagtgtactgatgaaactgaagcacagaaaggttaagtgactttcccaaggtcacagagctcacaggtggcagacccagggttgtctggtggaagagatctcctcagggcctctggaggcagtggggtttttctgcaactcctggccgagggtttctgccagccagcagtgaacctggcttgctcctgctcc

SEQ ID NO: 2632 - DNA, 1033 bp, Homo sapiens
cggaaggatagttgcagtattaaagtggtgatcacgtaggctcatggggaaggcaggattggagctgagactaagagggagccattgtggttccctctgcttcagaggtagcccctggtttcatcttcgtccagcctctttttcggtgatctctctactccttggtttcttttgctaaacaaatgagccagttttctttcccgaaggatgttgcctttggttggctagtggtggagtttccctccatgctgtagacatcttggtcacctgttcttgttctggtctcctcgatgaggcatgaatgcatcctggttaaaaggttgtgtgtactctcataatcgcttcccttactacagacctgcagctgctcgaggcagttttaatttagactgctccagcagtttaatttgctgatcagcttcgtgggatatgcttgtggaacaatctcatttcttgattcctgagctgacttctgtgaagcaccaagcatcgggtaagtcattcattgttaggtgcaccattgaagaacagtacacattcttaaagtgctttctgcacatattgctgtttaacgagaaatccccctgggtccctgtgcaccttttccagcacaggatttccgctgtgatgtgatctttgggagttgctgcgggtgggagtggggtttgttgattcatatttgcaggaaaccagagatcagatgcctgcctgatacccaggctttggagaggggggttattcttggcaatgtgggtaacactgagcttctgtgatagatagtattgtacttggggacagtaaaatggagatgtgacttcatggccaatctcagggaggcggaactgtgggaagttgtggctggtcctggttctcaaggtgagggcatgcaggtgcttttcatagaggccattctcatttatgaagggtcattagatattttatcggattggtaggtaccaatcccataaaaccattgggatggttaggcaccgtgcgtccagtgtacttctggataaaacaactggagcattta

SEQ ID NO: 2633 - DNA, 1057 bp, Homo sapiens
ttggtccttcctgttggcttcctgttgccccagctgtagctgttgaattcagtcttcagttatcccagcactggccagccagcctcatcgtccacactccctgcagatcccaccactcctccaaggaagtctctacctcagggccctttggctacgcttctaaggttaagtctaaccggttccctcaggcctaggggtggtggctgcttcctgtcgttgctacttccctgatatctagaattttcctttttctacccagttacctggttactgactttctacccagttaacaatttatattaaagcccttctgttcaaaaagcttatgtagtttctgcgttctaattggatcctgactaatacatctgactttcaacattctttagtaatcagtcagcaaaatgatttcatgagatagacgtattatatttaattggattacagttcaccttatattcctttagttttttttttttttttttttgcactgatctttctgattttcgttaggctcgtctatgtaatttgagacataactcctctcattagctactttctaaatcatcagacttgagttctttcctggaaagatcaccacagatggctaatgtcattcattttgttggctcttttggctttatagtagagggtgacaattcttttgtttttggtttttttttttgagctggggtcttgcatgacctcactgcaacctctgcctcccgggttcaaatgattcttctgcctcagcctcctaagtagctgggattacaggcacgcgccaccaagcctggctagtttttgtatttttagtagagatggggtttcaccatgttggccaggctgatctcgaactcctgacctcaggtgatctgcctgcctcggcctcccaaagtgctgggattacaggtgtgagccaccgcacctggccaagggtgacatttctaaaccttatctctaaattctgtgtccattattcagtattcctttaacttgtagagcatggctattacgtgtttaagcaacatatatctctaaaaagattcgaggccgctta

SEQ ID NO: 2634 - DNA, 1048 bp, Homo sapiens
tgcaagtttctcaaaaatgtgaatacaccaatggtgtttcatgaatccaccaagaccatacagcactatagctttgcctggagagttttctctcctcagcaaagctctccacctgtcccaagctgtgattcccaagaaatgccagctgggaagcctggtttgagggtagcatatgctccattgccatggccaagtcagtacaagccttttagcaatggtgcgttccctcagaaggtttgctgtggcccatttagccatattttggctttggttcctggaagggaggtgtctgccttcttcctagtggtgtgctgcccaccaggcatgcccagtggctcatctgtctctgcagatagcttggctgaacccaaaagggctcagtccttcctgtgggcttgatgcctgtaggaagggccagtcttgtccccatgtctgcagtgtgccacagcctcctttccaatttgtttccattataggattatgagacctcctgactctaaggaactgttttatctggggcttggtgttgcgggcacagcacctgtgaatagttaatgacattttttattcccaaccaagacctaggctcctttagggcaagggccagtgttgatctgaggatatattcccagcttctcacacagtctgtggtgcagactaggagttccatagatcgttgaatgaatggtttaaaaaatgaagggatcaagtcctggaagtggttttaatttgctgtgactccaggtagcttgcttaaacactctatgttttctaaattttaaaatagagctaatatttctcaaatggctccataggacattggtgacactcagttctgcaccagctctttgcctggtaatgtgcaggatgggggatgcccagggtatctttttattccttttttttttttttttttttttttttgagatggagtctcgctctgttgcccaggctcccaggctggagtgcaatggcgcgacctcggctcactgcaaactccgcctccgggttcaagtgattctcctgcctcagcttcccgagtagctgg

SEQ ID NO: 2635 - DNA, 1108 bp, Homo sapiens
agctttggtcagtgaaagctgcttgaggtgggccctacatcccattggcgtgattgtcatggcctttgaggaccgtgttgctgtatactgtggtaagattcccggggtcacattgtctgttcctgccccagacctggagtcagcctttcccagagagccctggttctctgtgctgggaagcgtttgcggttcgctattgggctcagggcggcctgctttcctgttcctcccctgtgccctcggcacctggccggagcatctccaagcgtctgccaccatacactgcagtcctcactagcctcttgcatgcgttgggggtgggggtgggggtgagtgggcggtgttaaaggctacacctgggattctccaggcctcagcagctggtgttgtaaggttacatagtaacagtgttaaccagcttgccctgtcttttctcaaagttccacccattcagttccaggggtccaggacgtgcctatcaggaacagcccttggatgcccttggatgcctgccttgtggatgtcatctgctcccatgtcagccatctccagggctcttcccgagaagagggcagtccccgccaagggtgttgcctctcaaacctgccaaactacaaaccctcttggtacctccacacatccctggagtcggctttggggaacactgtgttccatgtctaagtggagtcccgggcctctcccctccagtgtcgcctgtgccagctggacacgaagcagcagatcagtcatgaaaatggctgctcagctccgatctgcccttccttccgcaggactcagggacgcacagctccccagggctggtcacccaaacaacagcattcctttctcctcggcctctccccaggctgcttgggagagaaaacttccctcatcctcctccgcacacactaaatgccctgccggtatcttctttccagtgactgtggccccaggtcgtcacacatggccagacacagctgaatctcaggctagatcatgttggcactgcttccaccccttggataaaataaaattcccagtgacttccttaatattttgataggctgagtggcttatatgcaaactttgatgtaaacactaggccaga

SEQ ID NO: 2636 - DNA, 1042 bp, Homo sapiens
ttgattcttgcctaagtagaggttttgggagctgttgggctggagctttcaaagcttgcagtaggctgatcttacttctctacctatattttacctgttctccctaggtgatgaaactaggagggcccatggctacttctgctacatggggcacaaaacatgcttcagaaatatttgagagactgaatgaagcctgtctctggtctctagggtatattacgttccctttctattctaatgatgagtaggaggaaagataccactctttcttgtaaaccaaactgttcttgctttcaatggggatttttattaagaagcaaaaactgatctcttttataaatgcatagataccagtgttttacacagtacaggcttctggttttaagagaacttttgccatggttcagagtgatcttactagcctagtatattggtttgttttacattgctataaaggaatacctgagactgggtaatttagaaagaaaaaaggtttatttggctcacggttctgtaggctgtacaagaaacatggcaacagaatctgcttctggtgaggacttcaggaaacttttcatcatggtagaaggtgaaggggagcaggtgtgtcacatggcaagagagtgagcaagagagagaggggaggaggtgccaggttcttttaaacaatcaaatctgtgtgaactctttcctttaccatggggagagcacaaagccatgcatgagggatccacccccatgacgcaaacacccccaccaggcctcacctccaacattggggatcacatttcaacatcagatttggaggagacagctatccagatgaaatcacctagttaactctggtgttcttttttcaggaccctttcccagtgagttaaaattaaatttgtgagtttattaataggtcacacagcctatttggaaagtaagtttttttgccttcttgtgagaagacctgaagattattcctctacactaccctggtggaacgccaaccttgaagaattagaaataagtccttctgcttctcccatgggtc

SEQ ID NO: 2637 - DNA, 1121 bp, Homo sapiens
tccaaactttgttttctctgcagtagatagcagctgaaactcagttttttctgccttcttaactgttgcttttcatgttggacttggttcctgtgtggttcagaagtcagccaaagatttaacaggaggttattgccagatttgggtcctacctcctttccaggatctccttcagtttccagataccagaagctctgaactctctatcctctaacaactcaagccaaaaaaggctacattgcagtggattggagcgcatcctcgtggaaaacgccgtataaacacggagcttactcagtgttattttcttattttaaggggttggatcctatctagtttctgtctgcttctggctttcaaattgctgctttttatattttgctcagagtttataattgttactggagcaaaggtttgccccatacaagttgttttgcaattatcacaacttaaaatctttagtctttttccctgttctagcatacagccacataggaatcactgaaaacccattttgactgtggaaaaaagtacttagcagacttgtcctcaccggttatgaatagttgcatcatcttcacatagaaagcccagcatatatagcaaaagccatttatgaccacaacatccagggataaatatactattatttattttattttattttttatttattttgagacagggactcactcttatcacccaggctggagtgcagtggcgcaatcatggctcacttcccaggctccagtgatcctcccacctcagcctcccgagcagctagaaccacaggcgcacgcacaggccaccacccacggctgatttttgaaatacactatttgtattttgtgtcataatgaacgtgcacattattaacacatcacaagtatataaattgtagaatttgaccaatagtataactaattttgtgtaaaaggcagacagcagggctttgcaacttatgttatttagctcctgataagtcttagaagacagagatagtcacaacactgttgcaaatattatcaccactaaaatcaacaccattagcactggaagtctctgggtgacaccttccttagcccagttagttagaaaactgctgctgtgtcagaggaatg

SEQ ID NO: 2638 - DNA, 1054 bp, Homo sapiens
aataaataaatgaataaaaggagctagcactgagtagcacatggagatcattccttggggctgcctagttatccttttctattacaaagacagaaaagagttgctttgcgtttaggaatttttaagtgatttagtcacttaaaaacttgagtgatttgaaaacagtatgactggagttgataaaacctttaaatcattaaggctgaaaggaacctaggacattctggaatcaaatcctttcatgtccctgttggggaaatccaggtgccagatgttacaagtatttaagttaataactggttaaaaactgactaggcataggttaaggcataggtcacttagcaaaaccccactaacaatgtttagtggctcttctgagaaatgatatgtatgatccagtatcccccagcactttaagtactcattgttgtatctgtatattttttaatagagagaaagtaaaaattcatcagtctcatcaccaaaccagttgtgccataacactctcataatttgatgaattcgtctgtcagtatctatttctgtctctctctcttgtttgctcactggctctccttctgcctctacacacatatccactatatgcaattctgcaaactattttattttcccacaagtccaggacatcatttctgtcaacatgtaagatgcacactcatgtttttagtggtcacagaatatttcatttgattccttcctcatatttagtcataaagtttctcttttttttttttttttttgctattataaacaaagcagaagtgagcatattttcacatgtatatttcattcctaattgattgctgccttgagataaatttctagaagtagagctgctgggtcagagaataggtgcattcatatgttcttatctgtgttgaatggcattatggataatagtccatattctacttactaaaatgaaaaagtatatatatcaccttatatgaaagatataggccccatacagaaattattttaataatggtatctcagatcagttgaaagtttcgccattttaaggaattatttt

SEQ ID NO: 2639 - DNA, 1143 bp, Homo sapiens
ttttctaaatgacttccaataagactaacattgaagagtatcaggagcttttccttcctttccaaaaaaaaaaaaaaaaaaaaatgacctgatatagaatataaagaatacttctgcaacatacagtcttaaagtgttggaagtccagagcctgggagaaatgccgtgtccctgacacacactacctgtggtaggaagaggcacgatgcctagtcactgggtctttctctcgttcctgtcacctgtcatgaggccactgagcaaaggggctggtggacgggagctggtggtcatgtgcagtgaagcaggtgattctcacgttgtttttcagggttccagaccatcaggatatagcttttggggccttgcagcagggaactaactgcctcgacactttgggacactttgctgatggtgtggttggagtttatgaatgtcacaatgctgggggaaaccaggtatgtgcatggggaagccaggtcacctgcaggcccagagagagcaggagttgggggggtcctgatgttagaagtcccagctgccacctttctcctgggatgggtgatgtctatgaggaagcacctggctcctgctggccacagcctctttggcagccagcaccagggccagatagaatgtcacacactttggtgcatcagctctgtcatcagcttcggaccaggctctgctgcagcggcaagggtgcactggtcacagttgctggttgcagggccctggtcttcctgccagctctgtcctctcggccatgtgcactcaaccgcaaagcacccattctgcctctgcgtctggccccagaatatgatgtctacacctcctgcctggtatgcctatacaacagattcttaactgtgggcactaaggcggctgctagttatagcccctgcctgttagataatagcttaagatagaagatactcagtattaattgcttccattgcacacatacacaccttttctgagaggcataaaaatgcacaaccgccaggcgccgtggcgcacgcctgtaatcccaacactttgggaggctgtggtgggtggatcacctaaggtcaggagttcaagaccagcctggccgacatggtgaaacccatctctgctaaaaataaaaaaaaaattagccaa

SEQ ID NO: 2640 - DNA, 1091 bp, Homo sapiens
cacagagcgcccattccttgcctctgcaccaacttcaggggtcagcaaagggctgtgccaaggagtgaacaagatcgggtctgcagggtgtgtctcccactctgcttttgcttttccttcttgctgttgtgcagccattactgttctcacatgtgggctttcccttcctttccagcagtaagtgctgactccctgctcactctctgtccccctccaatggccacatcctgggattgctcagagaaattttttttttctttttttttttttgagacggagtttggctgtgttgcccaggctttttttttttttttgagacggagtttggctgtgttgcccaggctggagtgcagtggtgcaatctcggctcactgccacctccgcctcccaggttcaagccattctcctgcctcagcctctcaagtagcagggattacaggcacgtgccaccacacccggctaatttttgtatgtttagtagagacgggattccactatgttggccaggctggtctcgaactcgtgacctcaagtgatccacatgcctcagcctcccaaagtgctggggttacaggcgtgagccaccacaaccagcctgcccagagaacttttacaaaatgctgatgccaggtgctatgcccagagagcctgatctaatttgtctagggtcagagggcaccaccagatctctaagagctaacaagtgattctaaatgaggatttggcctgctgtagtggtacacacctgtaatttcagcactttaggaagccaaggcaggaggattgcttgaggccaggagttcaagaccaggctggacaacatagggaagctccgtctttacaaaaaaaaaaaaaagattagccagttgtgatgacctgtgcctgtagtccaagctactcaggaggctgagatgggaggattgctaaagcccaagaggtcgaggctgtagtgagctgtgattgcaccactacactccagcctgaacaacagagtgagaccatgttcctaaaataatgtaaaataaattagggccgggcacggtggctcacgcctgtaatcccagcactttgggaggctgaggtgggtgaat

SEQ ID NO: 2641 - DNA, 1030 bp, Homo sapiens
ctattcctttttcacggaactgaatctagtgtgctaaattaaagaactatttgaactttcagtggcatattaaattcagtagccacattgtgttttatttaaactcagcttatcttgtcatatcattcttgtctcccaattttatcacaaaaaataaaataatgaactaatatattttcttctgtctttctctgcctcaaacccttccctaatctgaatgatggtagaaaaaaaggccaggatgaagacagtgaggagttgtggtggcgaatcatgtgctctgctttaaatctttttttaaaagttgttattttattttcagactcccagggaagcagatgagagtgcatggtttgtcagcccatgtctcccccacagttgtatctgtacagcctaatccaaggaagtagttttgaatgtgacctgttatttacttcactgtttagaaaatgtgtcacagggaggagggtgagtgtgaggaagcagatttgtaaagttttctttattgttttctctgaaatagatcgtttgtacttcccttttaaatgcttttttaaaaaatgatttttcttttaataggtgattatagagcagtttgttgaatctcatcccaatggccttcaggtcatgtataataaactcctggagtttgttcctcaccattgccgccttcttcgagaagtcacaggaggtgccatctccaggtaatttaaacaaccctgtgtggacccccacctccctttcagtgaccgcacctgctaattgcaggtgcacgatggacgatgactgtcttgtatgaactgtcttgtatgaatccattatgaatcttgttatttcattgtttctactggtgatactgtgaggcagattccattagcctcatttcaaagttgtggaaactgagatgaagctgagactgaagaccacatttccgaatccaaagcctagcctttcttcttctctgcactttttcctaaatttagtttgaagtcagaattgctttccttccatgattctaatatgtcataat

SEQ ID NO: 2642 - DNA, 1104 bp, Homo sapiens
tggtacatctccctgtcagttttcatgctatcttatttataaaaatgaagtgaatactcacatggtttgattctttctcttctctctctttcttcttcagaattttctccttctttctcctttgtgaggcaatgacgaactatgtcatttaatctgctgtcaattctaattccagtgggctggggtagggggccctagaacatgagcactgccatttaaagagcaccagacttagagtgcctgggtctcagatgggctttgccatggaagacacggaagacatatcacagaaccactttgggcatttatgtatctttaaatggggacattggaagaaagatcttgtaagttccttgttaactctagaaactgtgattcttacgtgttgagcttctttatcttgattacagttttcagtacatgctccctgttctagttagtgttctaataatgaaaattttccttttgttttattttagaaatataccataagtatggattttgtcagaagattggaacggcagtgtggatcacaggctagtgtaaagagattaagagcccatcctgcctatcacagcttcaataagaagtggaacttgcctgtttattttcaaataaggttggtcatctattcaccgcccccgccccgcacccttctaaaacagaattggaatgccagttaaggatgttgcctcagttagcggctccttttctctgatcatcataataagctttgggagacaaaattgaaagtggagaaagagatataagaagtattatggttgccaaagtctggcttgcatgacaaaaagataagttttcttttttggtaattggagagctcagaacacaagagttggaaggagctgactccaagcccagcctcattcccacccaccatgtcctcattcattgtgaaaagagaaagtaggagttatacagcagctctttttttccattttccctatttcatcgtctgcctcaaataatgaacctgtctcacatctgtttttgctcgtctgagatacttttcccctagagggaatggggagaagcagagctttaagtgttctttgcagctggttccatctattagtttatgag

SEQ ID NO: 2643 - DNA, 1032 bp, Homo sapiens
tacattcctgaccctgtatccttgcttctcaaacagtggtctagtgatcagcagcattcacatcaccttgtgggtgggagcttgctagaaaagcacaatcccagaactcaacccttccacccactgcccccaacagaattagaacctgagttttacgagatcaccaggtgattggtgtggacgtgaggccacgggaagcagtgccctagtttcggtgccctgagcggtgggtggctgtgccagccagcacctcaacccagtctggctccagacatcaccttcttgtgctggctcttcttattccctcatgttctccaggcagctttctgtggaccccagtgttacttttgggagggatggaagttgtccgtgtctcaaaactagaacgttaatagtatccttttggacttgagttctgggtaacttactgtttcttttctgtttttttcctgtgcatctttatctcctaccatcatcattccaggaggtcccaaccacagcttcctcctatgtggacagtgctctgaagcccttattccagcttcagagcggacacaaggataagctcaaacaagcaataattcagcagtggctagaaggcactctcagtgaaagcactcataagtaagtaaattaaaagcagaccttgtgggccttgcttagaagagtctgcggcagaaacccccaaggcaatcaagcactgcgtatggataaggcagtgagactgcctagcacttcttcactggattagtcagagtgtgtgtcccactgtttgcttcctccctccccacacccttgtggacggcctgtgggctggcttcctctgcctgggcttcagcctcggggccgggccatgtgcacagtgcccccgcatctccaggccctgcctgcgttccctgcaggtgccgttctcccaggtccagccacattcttctgggaggccctttcgttactcagaccctgtcagtccaaagtggctctaatcataacagatactcaaaggacttaggttggtgaaacccttgtaatcaa

SEQ ID NO: 2644 - DNA, 1020 bp, Homo sapiens
tattttgaaggcaatgagctttatttaaaattctgaaatacttttacactctaaaagatgaactgttcctagaactgattggaaatgaacttgttacttgatctggggcatgaactacagatgtccaccctcgatacatgaaagacaaaattggtctatagttttctccatgttcaggattaaaaatttaagcaaaatccacacacacacatatttcttaaattctgagggaatgctatgttagacacttaagaccatatgtgtgtgtgtgtatatatatatacgtatatacatgtatatatatacacatatatatataaaatgatcttaagaaacttaaatacttaccgtggttgaattttcgttggaagtgaatttttatcttaaaaatctctttttttggtccacaaagccagttactctatttggtgttacacacaaatgcctcttttcaccaataaacgtgtcttctattcaaggtactatgaaaccgtgtcagatgtattaaactctgtgaagaagatggaagagagcctgaaaaggctgaaacaagccagaaaaaccactcccgccaaccccgtcggtcccagtggtggcatgagcgacgacgacaaaatcaggctgcagttggccctagatgttgagtacttgggagagcaggtaacccatcagccgccggcagctccagcgagcctgaaaccaaattctgagagccgggcagttacttggtggctcgcgtgatcccagagatgctgtcgcagtggctagggaattgcttcctgtgttaagactaggagtcggggctcccaaattactttgcccctaggcagtatgagacggcaatatgagaattcccgttttgaagtctggtggcgtgctctctggtgctgttgccatctgcttgtttccccagtgcccatgctcacggagctcactacagtgagactttttggtccagtgcctgatacttaattggtgcgaaccccaggcttttgaaatgcttgctggtttagcttaaaa

SEQ ID NO: 2645 - DNA, 1045 bp, Homo sapiens
aatgtcaacccttgttaaatccaacatattgcctggtcttgtccctgtacccatgcagcagtacgttgctggggaaaaacaaatttgtgacgattaacctcatataggcctttcatgatttctggcaatcttatttcggttttttttttctttctttctttctttttgagatagagtttccctctgtcacccaggctggagtgcagtggggcactctcagctcactaaaacctctgcctcccaagttcaagcaattctcctgcctcagcctcccaagtagctgggattacaggcctgcaccaccacgccgggctaatttttgtatttttagtagagaccaggtttcaccatgttgaccaggctggtcttgaactgacctcaaatgatccacccacctcggcctcccaaagtgctggggttacaggcatgagccactgcgaaaacagaagagaacttccaccaggtttgcaacaacataaacccaatactagcatttgttatttctttactgtactgtcttcttctgccttctgctggatcattcccaccagcatgcatactgttacttcttccatcaaaaaaaaaaaaaaaaccaacaccaccaacaaaatacacttgctgccacttccccctttagcttctgctctttttcttcttaattagaaagcagaccttctaagatatgtttgtactgtctatttcctttcctagtttctcttgaacctgctttagtcacattcccacccgcatttcattagaaactgttcttgttaagatcaccacttccactttgctaaatccagtagtcgattctcagttaatgatcagcagcattttacctcattacttcctcctccttgaaatgctgtgtgcgcttcccaggattcagtgctcttcttattgtcttcttacttcactggctgttacccctcaatctcctttctgcttttgcttcacctcccttacctcttaatcatggtgtattccaacgcatagtcatcgtgcctctttctgtctgcatgctttcccttgaagagctcattct

SEQ ID NO: 2646 - DNA, 1043 bp, Homo sapiens
cctgaccgcagctttattttccttatattctctttccagtggtgtgctacagcagtcttctattggcttgcaagagctgattgttaaattttcatgaagtttgtgagcccattcttaaaacacagccattattaaaaattaaatagccgggcgctgtggcttacgcctgtaatcccagcactttgggaggccaaagcaggcggatcacctgaggtcgggagctcgcgaccagcctgaccaacatcgagaaaccccgtctctactaaaaacacaaaattagctgggcatggtggcacatgcctgtaatcccagctactcgggaggctgaggcaggagaatcgcttgaacccgggaggtggaagttgcagtgagccgagattgcgccattgcactccagcctgggcaacaagagtgaaactctgtctcaaaaaaaaaaattaaatattaaattatgtaaatttacgattaaatcctgtttttaaaaaaggtaataaatactgataacttaacattttctcattattgtactattacctgtgctcttgagattatttgtctatcgtgctggaaggtggagatcctgtatcctgtataactgtgtgctactgctcatttctccccagctttgcgtttgctggggtcagattggaagctttaaatctgccctggtgggagcgtatatcccacaaaaattgacaaatgctataactcagagctctcccatatcaagcgttaaatggttaaacattgaccaacatactactggtggtatcactaaatgaatttaccttgtttatttgttgtctgtctttccataaggacacgtaggctctcagtgcagtccctgcctgccttgttcatgctgtattcacagcctgtaaaacagtgcctggtacactgtgagctctcagtcactatctgttgaatgagtggatcctccagagcagttaaaagggaggtataagaaaggcctatttcactaacagtagggagaggcctgctctactaagtaagatgggggagagatagttcccctaaggctt

SEQ ID NO: 2647 - DNA, 1034 bp, Homo sapiens
aaaaaaaaaggccgggcgtggtggctcacacctgtaatcccagcactttgggaggctgaggcgggcggatcacgaggtcagcagttccagaccagcctgaccaacatggtgaaactccgtctctactaaaaacacaaaaattagccgggcatggtggcgtgcacctgtaatcccagctactcgggaggctgaggcaggaaaattgcttgaacctgggaggcagagattgcagtgagccaagattgcgccactgcactccagcctgggtgatagagcgagattccgtctcaaaaaaaaaaaaaaattgtacaggctacagttggaaatgcgtttttttttaaagaccagataattatttgaagtcaagtacctactgttctttgatcaacccaatactgaatacctcctctgtgctgggtactaccagggatatgaagatgaacaagatgccatccccatcctggacgttcccctgggttgcagagggcagggtgggtgggtaatgtgtaaacaagttgtgagggttcagtgaacagagacaaggagcaacatgcatgctgcagagggttcctgagagtgctgcagaggaaagggaccatactcaggaagacttcacagaagcgacttttgaacccttcaggaagaccaggagaggatcctcgccaaggcagggatgaggaatgcaagatgggaggcttgggccccagagattcatcagtgatattaaagtgttggcccagatggggtggtgggtagatggaaaataaagatggacctccccgcctcctccccaccatccaccatcagaagactggaggtatagaaacaagttaggaggctgctctgtcccaatgagaaatgcaggatgcctgagatgcctgagccgcagcagtggaggcactcagggcacagccaagagatgaggaggatttactgacaaaaatgccagtcaccaagagagagacaaatcagacacctgttctcagtgctgtgatgggctgggtctggtaggaggcaaaggatgtgttaattat

SEQ ID NO: 2648 - DNA, 1029 bp, Homo sapiens
gcgtgagccaccgcgcccagccagaaattttttaaccatagcataattctaagtatttttaggacttgctgtatgtatttcctatttaaattaaggagtggttctgcaaagtaaaagaaaatccatcacccaggttgtgatttgtaaggctcagaaatgttgtgtttgaaaacattttgaatgtagagcagatgcttctctggctactatctcacaaccagaattgttctggaggttggggaaatagctggtattctgttgtctgagggcatgtggctgcatatattcagataggcagtgtatccattaacctagatgagggggtacatgtattcagatgggcactatacccattaacctagatgaacattatggcttcctcttcccttctaggactttgaagaaggctgttacctgctttgtaaaagtgaagccatacaagtgactacgaaagacatcctagttacagagaaaggaaatactgtgttagaatttttagtaggactctttaaaccttttgtggaaagctatcaggtatgtaaatttggcaagttctccttcatgccccccatatcaaatataataagacattctcaccctgtgcttatttccagtctgaagggcaggtatcttccccaggcaaatggaagaaggagagagagtgactaatacgatcagtgatttcacctcaccagtgagaccttgctccccgcattcaggaggaagcttggttcattacagacccaagaggacaacagcttagtgatgccatggtcacagtattcacaggaccacagttacacccacgcatcatctgtcatactgtgtctcatgtcttaatgaggccttcatgtcagtcaatatgtaacctcgaggtttgatatatatcaggcactcagtaaaggcaagacttgagtgatacataaagtcagttacagattaccagatgtttatgttggaaagaaaaagttcaagtgcaagttctgaaagcgtttgtcagagctcttgggagtagttagagagatggga

SEQ ID NO: 2649 - DNA, 1047 bp, Homo sapiens
tctatagcctaggtgtgtgtatatatatatatatattacataggctataccatttaggtttgtgtaagtacactcttaagatgtttgcacaatgacaaaattgcctaacaatggatttttcagaacatatccctgccaagtgaggcacaactgtagttacctaaatcatagagaagggggttcagaaaaggaacagactttatctggttgaggaggtcaagaaaagctttataactgtacattttgttactaccatcaccactcctgctgctcactattgagcacctattgtgtgtcagactttggactaaacgtcgtctttaccacagccatgcaaaatgaggatatcccattttagggatgaggagccacttggagcctgtcccaggtctcatgctgtgattgtgggtttaggttccagtttccctgactctaaggctcttgttctgtcccctttaccattcaactcatcactcctgcgattaaaacatggagaggtgagcattaaaggacgaattgtacttttgacaagcagagataggacaggaggctactcttggcagaaagcatgggaataatgtgaacaaaagtgagttcagacaactgggggcatatttaggactagaggtagttcattttaacccgatagaacagtcatggaaaacagaggtattttgggactgtgttgtgtatagatccttgaattaagactaaatatggaaaatgatagatatttaaaaagttcagtaccattttcaagatgttttttaatgtttaattaaattgaaccaaaaatcaggaacctaaatttgtttctcctttatgagaatagatctttatcattgctctaatttagaacattgagaaacttttgcagtacctttcttgaatttgagtcttcttcgttgagcggcatttacttgaaaaataaagttctggctgggtacagtggctcatgcacgtaatcagatagatggattgcttgagcccaggagttgacctgtctgggtaagatggtgagaccttgtctctacaaaaaattgaaaa

SEQ ID NO: 2650 - DNA, 1022 bp, Homo sapiens
ccctgttgacattaggagctccttgtatattaggaatagcctgtgataagagttatacatatatttttctgagtttgtctttttacttggtgtttttttcctatagaattttaaagttttgtctgggtgcagtggctgacgcctataatcccagcactttgggaggctgaggcgggcagattgcttgaggtcaggagtttaagaccatccttgccaatatggccaaaccccatctctactaaaatacaaaaattagccaggcatggtggtgcacacctgtagtgccagctactcaggaggctgaggcacgagaatcacttggaccgaggaggcagagcttgcagtgaggagagattgagccactgcactccagcctgggcaacagagtaagaccctgtctcaaaaaaaaaagaattttaaagtttttatgtagttgaattcattgatttttctggattttgatatatagtcaaaaaggtcttcctagaacagggagttcttaacctgtgattttcagagctttagatgttacacaaatttgagtaccccttctctgaaatgcctgggactagaagtgtcttggatttcagatttatttggattttggaatatttgtgttattcttacaggtggagcatcccaaatctgaaaatccgcaatgctccaatgagcatttccttttgagtgtcatgtcattgctcaagagtttctgattttggagcattttggattttcagagttgggatgctcaactcatatgcaatattttgtgaatgagtgcttatataatttttatagaatgaggtgggttttttgttgttgttgttttgtttttgtgagacagtgtctcattctgtcccccaggctggagtgcagtggcacaatcacagctcactgcagcgtcaacctccccaggctcagaggatcctcccacctcagcctcctgagtgtagctgggattacaggcatgcaccaccacacctggctaatttttgtatttttttgtagagacagggtttcgc

SEQ ID NO: 2651 - DNA, 1028 bp, Homo sapiens
gtgcccatagtcatttaggagtcatttcaaatggtgctctatagtcttcagtgccaccatgctgggagggctgaccctcttttcagtcaggtcttttcccttacctgttttctgcttgggttccaaataggatttttgtctagagggtgaaaaagaaggcatcctacttaaggcctgaaaagcacacttcagagaattttatttgactcaatgaatgatgcttttctgactgagcaccttcttggtgccaaaagcactatattagccactagggacacaaaaaattaaaacattcagatcctggagaacttttcagtctggtaatagaaatatttataaacagataaaatggtacctcataaggcttattacagagacataagcacagaacttggagaatgtggagagtgagcttagcagaagcttcactgggtaagatacttgtgttgttagcgtcagtcaggcatttatagggagtaatgtagtcctttagaaccctttgctatttttacttatagggaaaacttcaatttagcagtgggaatgattcttattttagtatggtattacataaaatcttatctttatcctaatttttgatcatttacaaatttgatttctgaaacttttagtgttcatgaagattttctgtggttttgtttttaaaagatttttttgtcctctaatcccatgtgcatctatctttacacagtttatgaagtattaactgctgctgtttcccattaaaatcaacttttgaacagaaactaaatatagttgctttctctcctaaaatagaacttttcagaaagctctgggaaagtttcaaaaattaaaaaaaaaaaaaaaaaaaaaaaagactgcttatgtaaattgttttcttgcagttgttaacttgcttattgaatactaaaaattctgtctccactcaggtataccatacttttcacgatgaggtggatgagtatcggcgacactggtggcgctgcaatgggccgtgccagcacaggccaccgtattacggctat

SEQ ID NO: 2652 - DNA, 1009 bp, Homo sapiens
tttagttgttcaccattcataacactgttagcagcccttttcgttttagactggttggctgttcacaaattttgatattccttaaagcattaaaacattttaataaatacttataaataggtattaaaatgtatattatgttcaatatatagttatattttcatagaggatcatttctctaaatgaatgtaacaaattatgtgtaattaaatgcttcctgagccaaaaccacacaaggttctggggctgtgaagtagctgagatggtccatgtcctcaaggagctttacagcatagttggggagtaagacaaatgcacattaatctccttagagtttgctaagtgctatgacaagggtttttgctgggtgctgtgggtaaactgtaggaagaaaaattagctctgcccaggacttcgggggatgtttcttggaggagacaacatccaaagttgaatcatgtagagtgagtcgagttagcctggttaaagaagggtggggaagaacctttcaaagggaagaaggaacacaaagtcatgttccgagggaactgaatgctattccaagtgaatagagtaaaatgtgaggggcaaaatggccaaaggagagatggcagataggacagatctagctaagtagtacaagtttgaggccagggatctcatgttcctcactttatgtctggtttgtgtgatacctgctaataagcatctcttaattaaggtggggcttggaaaggcttataagccagtcgaggacatgttgagaagtgtttccaatggatttttctggggacagcatagataagagggggaagggtagtggcagggagggagaggaagagacaattttttgagaaacaggtagtaaagtcaggagttggtttcaggttctagggaatgatggaaatagttgagaaaatggaactcaatttgaaataagccttactacatctgttaaacacttgagaaaatttgcaccctaaaaattctgatattcccccaaatatgt

SEQ ID NO: 2653 - DNA, 1028 bp, Homo sapiens
tgtctcaaaaaaaaaaaaaaaaaaaaaagacaaagttggattttttttctgtctcatagatatgctgcaggcacagattatggtgactgctgtcttttgtctttatggtttttggaagactacgatagagctttagatttaggaagcagccaatattccttggaaaaccagaaactcaagtaccttcctcttaaatgtaaacacacaagcaagaggtaccagacatttaaggaaaacttctagcatgaaagaaaaaaaattgaaacagaaaaaagttaaatactgtatcaattaagagattattacatatattttcttaaattcgagaacaaaaaagagctcctgaaatttaggaacctgacaacagacaccatatactcaccagaagaatgggaaaacagatgtccccagtcaagacagatacacagtaactagagaagaaaataggttcaaaccagtagaggtcctgcctggacaaaggagtgccagaaagagagaacagagaatggatggagaaaatttaaatgtcccaaaatggtggggtgattttacagtctgcattcctagcacagaggttgacaagtggcacacattaaagcacactataaaactatggcgccctggggataagaatattctatgagcttccacaaagaaaaagattacatataaagaatcagaaataagaatggcttcagatttctcagtatctacacactggaacctagaaccagtgaggcaatgctttcaaaattctggaacatgatttccaaagttaccaatgaaatgtggtggtaaaacaaagatattggtctcagaaaatttaccatccatacatttctacaggaagtattagagggcatgctccattcagtaaaccaagaaagatgaagacatgggatccaggaaacaggagagctgaccgaagagtggtgaaggaaatctctagaacacaggtgaagggagacccaagaaagacagctgtgccccaggcgttaagagcaaccagtccagattggtgcaagtta

SEQ ID NO: 2654 - DNA, 1039 bp, Homo sapiens
ttgcctctcctcacctaggccagctgagcctctcccttcaaagcgcacttgcccgtctctccaatgtagcaccaccttcgttcctcaactcctgtagcacttagcctccatgccatctggcatttatttactataaactcccaagtatctgttatttattcatctaaaaaggacgtaaccaaaccaaactcaggatttcataaaaaggaaggtctatgaggcagttactgtgtcagaaaatctttacagaagcagcagggggcagagacagcactgggatgccactgggaagagacatgggattgaaaagggcacatcatgtgatgtgacagtctttctttggtttccattcaggatttcttacaatctccagctacaacctgcttagcttgctactcagtacgtgaattaggatgcaggcaacacacctcagaaggcaggaagaaaaaaggcacagctgataatcaagtcgttagagtcaaccatcattactaaagccaactctccacccagcgcatctaagcctgtgcctcttcttgccaccctagcatctcctaagccagatacagcaaatgaatgccggaagctcactatcagaatgttccaagacctttccataataaaaaataagtatttttttttaatgtgctatttttctacaaatatttactttcatgataatgtctacaatatcttgttttcacagccagagcattttaattgagtcaggataaatggtttttaaaaaagcatttgaaataaagcactaaatataataggttgcaaataccttgtagaaaaagtataatgaaacagatgctcattatttgtaaagctaataggatcatttttctaacattaactcccacacatggtaacctgttctctacttttctttcttctgtttttctcttcacttctactctctggttacctctgatttttctactctgtatccattttcctatgttgtccctcaccaccttttaaaaaacccttttccttcttgatctttctctctcccaagtaaaatactctt

SEQ ID NO: 2655 - DNA, 1076 bp, Homo sapiens
ttcctgtccacatgaacttcttgtgctgcttggatgtcctttggtgtggcatctggcctccttcagagagagagagtgcaagagagcaaggaggaaaccacaatctctatgtcctaatctcagacatcagacactgtcatttttgtcacattgtgtttgttagaagggaggcagttttaaaaactgtctcacattgaagaggaaggaagttatgtcccaccctttggagggaggagtctcaggttatttgtggatatatttgaaaaccaccacagtatctactgtgatcgtcagaagtttaagacagctggccgtaattgaataaagagcgtactgatacagaaggtggagttgcggctgggtgtggtggctcacgcctgtaatcccagcactttgggaggccgaggcggggggatcacgaggccatgagtttgagaccagcctggccaacatggtgaaaccctgactctaataaagtacacggtgaaaccccgtctctactaaaaatacaaaaaattagccgggcgtcagtagtccccactacttgggaggctgaggcaggagaatggcgtgaacccaggaggcggagcttgcagtgagccgagatcgtgccactgcactccagcctgggcaacagagcgaggctccgtctcaaaaaaaaaaaaaaaaaagtacgaaaaattagttggtcgtagtgggaggtgcctgtaatcccagctactcgggaggctgaggcaggagaatcgcttgaacccggaacgcggaggttgcagtgagccgagatcgcgcctttgcactccagccccggcgacagaatgagactccatctcaaaaaaaagaaaaggtggagttgcttctaaggtggtgtcctcattacccgtctgctgaactacagttttttggtttttttttttttttgagacagagtctctgtcacacaggctgagataataattaggcacgatcttggctcactgcaaaacctctgcctcctgggctcaagccattttcctacctcagcctcctgagtagctgggactacaggcgtgtgtcaccatgcctaatttttttaaatt

SEQ ID NO: 2656 - DNA, 1076 bp, Homo sapiens; identical to SEQ ID NO: 2655

SEQ ID NO: 2657 - DNA, 1076 bp, Homo sapiens; identical to SEQ ID NO: 2655

SEQ ID NO: 2658 - DNA, 1076 bp, Homo sapiens; identical to SEQ ID NO: 2655

SEQ ID NO: 2659 - DNA, 1059 bp, Homo sapiens
cccagtaaaggtggaaaagcaggaagacaacagggaaaaaaattttaataaacttgaaaaaaaaggtccaagtttctttttttggaggtgtttatattattaatatatgtggttaaagtaatttttaaaactttatgtaactctttgttacgtgtcattttgtgataatctcttgtttactaagttcattttttacaacttgtacagtattcccattgtgagactaagtagtaaaacccagttaatacatacctatatttaaagaggaaaatattttagttgagcctttttgatttccatgtaatttagaaataagatgattttattctcttcattttcataaactgaataattattgctttcttacatatagagacagtacttttaggtacagactgtttttgctttctagccatttgtattctaagaaaattaaaatcatttcccttttttttcctttcataagatttaccaagtgttttggaaaagtttgacataaaagcttacaggtctgtcagaggagattttaaaagggatttcatgggaagtcttttttttttttttttgagatggactctcactctgtcacccagactggcgtgcagtggtgcagtctcagctcactgcaacctccgcctcccaggttcaagcaattctcctgcctccgcctcccaggttcaagcaattctcctgcctcagcctcccaggtagctgggacgacaggcctgtgccaccatgcccggctaatttttgtatttttagtagacatggggtttcactatatattggctaggctggttttgaactcttgacctcaagtgatccacccacctcagcctcccaaagagctgggattataggcgtgagccatcgcgcccggcccggaaagtctttaatgagaagcactagcttccagacaaaatttcatgagatagtatagtttgttcaactcaaacccaggatctttaatgtccgagcaaccactttgctatcaaagttggagttaattgcattaaaaggagttatcagatcaatattctactgttgttgaatcatctg

SEQ ID NO: 2660 - DNA, 1059 bp, Homo sapiens; identical to SEQ ID NO: 2659

SEQ ID NO: 2661 - DNA, 1059 bp, Homo sapiens; identical to SEQ ID NO: 2659

SEQ ID NO: 2662 - DNA, 1059 bp, Homo sapiens; identical to SEQ ID NO: 2659

SEQ ID NO: 2663 - DNA, 1041 bp, Homo sapiens
agtttgatactagctattagaatattctgtgactttgtgaggattagaagacatcagcagtaggtacaacttaagagttaatattttaataaaaataggtctcagctgggtgtggtggcgcatgcctgtaatctcagcactttgggaggccaaggcgggcagatcacttgagctcaggaggtcgagaccagcctgggcaacatggtgaaaccctgtctctactaaaaatacaaaaattaggtgggattggtggtgcatgcctatcatcccggctacttgggaggctgaggtgggaggcttgcttgagcctgggaggcagaggctgcagtgtgccaagatcccaccaccgcactctagcctgggcgactaagccagaccctgtctcaaaaaaaaaaaaaaaaaaggaaaagtctgtaggggttgggtggacttaagaaagaaaaattcagagcagctagggattttgtgttaagattattcattaagatatagctattgtctgtgaaaatatatgatatattttgattgttagagcctgttacattaaactttatttggatgatatgcgtgaaaattttaatattagataaatgttaaaatctgcataacctattttctcgttcatttttgaactcatggcagtctggctttctgcctcacaattattgaaatgcccttgttaccttcatattattaagtctctgttttcttattttacatttttgtagcatatgatactgttgactacttaattctttttcgaaagttcctgtttcagttttgtgacttttgtttacatttttttctctaggactttactattttatttttctacgcaggctttgtatatttgatagacttcgtgattgcaagtaaaagaaactaacttaaactagtctaagcagaacggggaaattaattataaaaaaagccactatcaactagcagatttcttattttatgcactattttctattacagttgtaatcatattattcatacagttttgactagtaaactgagaaaatagcagacttcaga

SEQ ID NO: 2664 - DNA, 1041 bp, Homo sapiens; identical to SEQ ID NO: 2663

SEQ ID NO: 2665 - DNA, 1041 bp, Homo sapiens; identical to SEQ ID NO: 2663

SEQ ID NO: 2666 - DNA, 1041 bp, Homo sapiens; identical to SEQ ID NO: 2663

SEQ ID NO: 2667 - DNA, 1030 bp, Homo sapiens
tttccctcttgttgaaaaattaacagtttgggggaaatgtcctccatttcaaagaagaaatacatgtttttttcttaagtttagtttatatcactgataatgataagaattgtcattttttgagacatttcggtacacaaaactaagtttatatcctaattaatgttttaattcttttatccaagaatgtgaatgatgggtaaagtggatgttttgggccagttaagatatgtttttagccactattctttatattcacaatctcataggtttttgcaatacctctaaatcatagatatttttaccacttcacaggcggggagattgaggctcacaagttatgctcagggtcataagctagcacgtggtaccattggtttcttcccacatggatttcatttacctcttaactttacaacctaactcctagcaaaggctttattttgcttaccccaaatactgaggttttcctcataaacccagcacacactgtggcccttttttcatagcacttctcaacttctaatgtgtaatctctttatatattatatttcttcattatctctctttcccttactagaatgtagactctatagatctctacaaagatttcattcctgtttttcactttatatatcccagacacctaataagtctcccgaaatacaaatgttgaaaagaatgaagaacaaaactaattttaaaaggctttttgttgttgttcagccatatgctttatctgatgatttgctttcacaagtttatattttactgttttttgtttcttccgaaagaaagcaagtttccaggagctatttcttagacatactagcaggaataggatcaatattaatgtttagggaagttccaaagctactatagcagtacagagaaattcgatgtaggttcagcatattggcaaaattgtgagtgcccactggaaaaatgaactatgatgtgaatctctgtaagcttttggagtaacagtaggaagagtgtagtggatggaataatatagctaaaaattgaa

SEQ ID NO: 2668 - DNA, 1030 bp, Homo sapiens; identical to SEQ ID NO: 2667

SEQ ID NO: 2669 - DNA, 1030 bp, Homo sapiens; identical to SEQ ID NO: 2667

SEQ ID NO: 2670 - DNA, 1030 bp, Homo sapiens; identical to SEQ ID NO: 2667

SEQ ID NO: 2671 - DNA, 1157 bp, Homo sapiens
tgcttacatcctagacataggcatggtatttaacctctttaaagcttcagtttccccatttgtgaaatgggggtaattgcatcactactaaatctgtagcattcttttgagaactgaaaaaaatggtcaaagtaaagcccttggcataatggtaacagacaatagataagctcttaattttaaaaaatgtttaaaaattttttcgagacagggtctcactctgtctcctaggcaggagtgcagtggtgctatcacagctcactgcagcctcgaactcctgggctcaagtgatcctcccatctcagcctcccgagtagctgggactacaggtgctggcaccatacctggctagtttcgttgattttaattttttggcagagtctcgttatgttgcccaggcttgtctcaaactcctgggctcaagcgatcctcccgcctcatcttggtttcctgaaatgcggggattaaaatataaaccaccgtgtctggccggtaaactcattactgttggcttttattatgatttttatttgcctcccagtacctaggtatttaattataagaggaatgccctttcagaatccctgtcatagtattgcagttagcagggctagctccactgcattcctgagaagtgatgcttgggaggctgatatctctcctgcatcctgctgctgccctataaaggaggagggcagtggggctcaactcccagcctgcacacctcctcctcttccttagcttgctgatctttctcttaagggctttttcctccctctgcctaccccggtaatgactaccctcttttccattttttttaaacttttattttaggttcagggttacatgtaaaagttcgttacataggtaaactcatgtcacagggttttgttgtacagattatttgatcacccaggtattaagcccagtacccaatagttatcttttctgctcctctccccccacccaccctccaccctcaagtagacaccagtgtctgttgtttccttctttgtgttcataagttcttgtcatttagctcctgcttataagtgacaacatgtggtatttggttttctgttcctgtgtgactttactaaggacaatgacctctagctccatccatgttcctgcaaaagacatgatcttgttcgttt

SEQ ID NO: 2672 - DNA, 1093 bp, Homo sapiens
atctaaaggaaggcaatccagcagggatatggcaaccccacaaagttgtcatggaaccagactaattccagttatctgctttgccattactaagctgtggctttgtcttcaaggttcaagatggcgtctagagctccagccattgtatccatagtcccagatgcctgatgaatgaaagaaaagtctcctcttcccctttaagatttctttaagtcccataaaacattttgaaaccagattggaagtcttttaaccttctgattccaacctagagcaaggaaatcccccaaggagtgctctaccatgtgaaatcttctcttccccatgttgtcatgatcctgccctcatgtgctctgactattgccaagccttggatttcatttctggaataatgccttgctcaatattagaaccactttagttaggatttgggggaggcagcatgattgaagaacgtgagtgctgttgacgacagtattgttggtgaaagcagctccagttccacaacttacgatctgagacatcgtgtggccattcatgtacaggctttcagaactgagagaactttggtagactaatcaagatgagataggttatccggtggcaacaaagatacctacgtctcagtagcttaattcaatgtatgcttccttttctcttgttcatgttttatgttttatagaagtttacaggcaagatcctactcacagaggctcttgggatcaaggctgacagaagctccatctgaagacttttatactatagaggcagaaaaagagtgatgaatcaagcactggcttctaaagcttccgcccagatgggaagcatatctcctctgctcacatttccctgaccaaagccagtcacatggccatcctcagcttcagagaggttgggaaggcattcccactatgtgtctggatgccagcaactcagaaatatttggtgagtgcctctgtggctactggtagtttagttcttatgcctatgttccagttttgtcctctgaaaggccaaatctgaaattcaaaatcttacaaacaggtttatacttgaaaacgggtaaacattctcataacataaagcttaataa

SEQ ID NO: 2673 - DNA, 1121 bp, Homo sapiens
gtcctggctcgctgcagacttggcatctccagtgcctgtatccctgaatttgtggttgaacttaagtttggggagtcccagtggccctaatgagactggaaataccaccctaaacaacctcctttagcagctaaactgacaataataatctgttgtttactgcacaggattgagatgagtgtagcaatctcctagacgaagggccaagctgctcacccacctgggtggggtggtcagtctagggcggcccaaggggattcttgggtcacgatgaccctggggctgataaccaactcacaaatacataaatcaacaacatgaggctagcttctgctggggctttgttgtctggtgggcctgagttttaatcccggctgacctcttactaagcgattgtgggtaagtcattctaatttttttctctctgagcctcaaattcctcatctataaagtgagcatgaaatcctattctagtcattctgagggacaactgaagtgatatatgtgataatatgaaatatgatagatgtgatatatagaactgtaaaacttttaaaaagtaaaatgcctgttaaattgttaaatatgtgtaatatgtgaaaaactcctggcaaatatacctactaatatccatttccatatagttcttttatataaaaggtagagcagtatatgtaaaccttctaataaaacacttagctataactatgaattctcatgtgctcttcctgctgtcagcctctcctcctgctgttaaatctttgcaaggcctcctctagttgttatgttctgaaaagattcaagtttgtatcctagacttcaaagttatgtctctcctatgtggtgtgtagtgtatcaccctgtacttggaggtatgtgatacaagaaactaaggaactaaaataattctttttttttttttttttgagatggagtctcactctgtcgcccagtctggagtgcagtggtacgatcttgctcactgcaacctctgcctcccgagttcaagcaattctcctgcctcagcctccggagtagctgggattacaggtgcccgccaccatgcctggctaattttgtattcttagtagagatggggttttaccatgttgaccagactg

SEQ ID NO: 2674 - DNA, 1151 bp, Homo sapiens
ctcaattaataattcagttgccccataaaatatagcctcactgaatttcttgtcttgtcttccaagacattaagtcagggcttatttatagccatggctctcttccctggctaagcatccgggccacctgccccagcaggtgagcccttggtccaaggtggtcctggactcagcatgtttttcagagttctccaggtaattccaatggttagtcaatttatcattcatttggggctgattatcagtcttccatgtggataaaaccagttaatttcctgtggatcttttttgaaagccttattaagaggagggagccctgttttgaacttgtgtcatgagctctgcctgtctctggaggtggcaagggtgctcgtcttcattctggtctgtgtcgcatgctgtcttcctctgtctccctactctttctcaaccttcttatttactattccacacactcgctgggttagacaaccttttctgttgttctgctgaaggttacaatttggagtcgattcctgtagtcttcctttttctattcactttcaaaaaagatgttgcaaagtccaagtttcttcctcatgttccgtttctctggggagtgctgtagaagtttccataccttcctgcttctggccttcttagtattttaataactcctgccttgttcccaggtttctccaagtatctggggaaagtagaaacctcagagatggggtctggaaatgtaaaacgttgatgaatttcagggtcacccttgtgaaagctattgattggtcagaggtattctggaaaagtctgcaaaatccagaagctaatttctattttaaaatacaccctataactcttgagtgcccactcatcctcagctggctctggggaatggtgtctgagctcacggtctcatctgtgggagctgcatctcatcaacctattttggaaaccagcatacttctggttctgagaattcagcttaaaaacaatacctagtttcctgtataatccccccaccaaaaaaaagtttgcaatgtgccccatgtctatctgacacattttcacttgtttcttcattgatgatctaggtctgtccaccctgctctatttcttttctatttatctccattatcttagtctatttgggctgctgtaacaaa

SEQ ID NO: 2675 - DNA, 1025 bp, Homo sapiens
gcttagaagccaatactagactggccaaatagagtggcatgttgagacttaccctgagattttagtttttaatgcagcgaatccattgggatcacttataaaaaaggattttaccctattaatctttactagaatggatatttttaaacttaatttttttgtgcttctcattgtaggagtcctttgaatgtagcttccctgagtgttcattcagttcattagttattgagttcttatagtggatgacatcttgctagtctataggcttcatagggttttaaaaaatgaatacgaaatattcccaaacctgattaattacatacagtagaagagggcgtctgtagacaaaacccagagatcaaggcagaatgtaacaactctcttgagagtactacaaaatgccatgtggttcagagaaaggacatcacatatggttgtgaggtcagggaagaattttatattaaagtgacatgagccttgagatgggccttgatgaaatggttggatttcaatgggtgtggattttagagaaagggcataagaagtatgcatctgtaattagaaacctgtgcatttgttctgggaagagtgagaggtccactttgcaggtgtgtggagaactcacaggggtgcaatgaatgagtccagagtagggctgagggcatcttgggaaaggcctctgagaattttactctccatttgaaaaggaataagaggcattcacgtttttggagcaatactagatgggatagattggaagtatgaaatatttgaaggcagaaaggcccatcactaattgtagttttcctggagtaaagaaataaaatgcttaatgtggagtagtactggaaatggggaaaagcagacctgaacaatattctcagtttataatctgtaagagggtactggggctgaggaaaataacaagtttaaaaatgaccaagatttctagccttcatttggttcactctcttaacatgcattgagttcttgctttatgtcagcactgctctgggcgcttggac

SEQ ID NO: 2676 - DNA, 1025 bp, Homo sapiens; identical to SEQ ID NO: 2675

SEQ ID NO: 2677 - DNA, 1025 bp, Homo sapiens; identical to SEQ ID NO: 2675

SEQ ID NO: 2678 - DNA, 1028 bp, Homo sapiens
ccaaccttcagaccccagaatggtagatccactgatagcttgcaccatgcacctggaaaagctgcagacactcagtgctagcccgtgaaagcagccaggagggggactgtaccctgcaaagccataggggtggagctgtccaagaccataggaacccatctcttgcatcagcatgacctggttctgagacatggagtcaaaggagatcatttcagatctttaagatttgactgcccagctggaatttggagttgcgtggggcctgtagcccctttgttttggccagtttctcccatttgggatggagcatttatccaatgcctgtacccctaatgtatcttggaagtaactaacttgcttttgattttacaggctcctaggtggaagagacttactttgtctcagattagattttggacttggaattttgggctaatgctggaatggattaaaactttggggtactgttggaaaagcatgattggttttgaaatttgaaagggacttgagatttgagaggggctggggtgaaatgatatggttaggctttgtgtccccacccaaatttcatcttgaattgtaatccccataatccccaaatgttaagggagagaccaggtgtaggtaattgaatcatgggggcagtttccccagtgctgttcccaggatagtgagttctcatgagatctggtggctttataaagggctctttccccctgcgttctgcacttctccttcctgccaccatgtgaagaaggtgccttgcttccccttcaccttctgccatgattgtcagtttcttgaggcctccccagccacactgaactgtgagtcaattaaacctctttcctttgtaaattaacgagtcttgggcagttctttttagcagaatgaaaacagactaatacaatagagtctagcaatagagtggagaacaacatagttacaagctctgccctcagggaaaagaaaacaataatcacataaataattagaattgtcataaatactctgaaataaaagtaaaa

SEQ ID NO: 2679 - DNA, 1028 bp, Homo sapiens; identical to SEQ ID NO: 2678

SEQ ID NO: 2680 - DNA, 1028 bp, Homo sapiens; identical to SEQ ID NO: 2678

SEQ ID NO: 2681 - DNA, 1034 bp, Homo sapiens
cacacacacacacacacacacacacacacaaccctcagaatatgtgcctgtactgttcaataacttacacattgaactaggagccagggatctgggattactgaccagtggcagtggtcacttgttgtaatgtctttgttgcacttcccagcctaatggccatagtgccctgcatgggtaggagttcccctccctgagagaagtctgggcattagcactttagtgagcttcaaaaatctagtcagtcaactccctaactaggtaccagtgaagatgcactacctgctagcattttgcaatagttttatccactcatgcgaggttctgtgtagggacaacccatgtaaggcccctgttttacctactatggctgcatcaaaatcaacacaaacttagtgatttaaaagaactatttatgatattcgtggatctgtagatcagaaattggggtggggcacagtgaggagggtgtctctgctccacaatgtctgggtgttagctgaatgacttgaagacaggggctgggaccatctgaaggttcagtccttcccaagtctggctgttgactagggctttagctgaggctctcatccagacatctacaaacagcccgtccatgtagctggggcttcctcacaacatggagactgggttccagggtgggtgatctgaaaagacatgtcaccttttatgacctgactttgcaagtcaggcagtgtcaccttcactatgttccatacattgaaggaatttcaagggccatccaggtttaacaggagaagtaataaactctgttttttgatggtggagaggcaatattccagaaaagtgtgttgctatgaccacacctacactctgccatacctgggcatggcatggaaatggccaaggaagttttgcctagtccctcatttatggactaagaggcaggacctgggcaactttgcacagctgatacccatggttcttttttttttttttttgagatggagtctcctctgttgccaggccggagtgcagtggtgcgatcttgg

SEQ ID NO: 2682 - DNA, 1034 bp, Homo sapiens; identical to SEQ ID NO: 2681

SEQ ID NO: 2683 - DNA, 1034 bp, Homo sapiens; identical to SEQ ID NO: 2681

SEQ ID NO: 2684 - DNA, 1038 bp, Homo sapiens
tatatttatatgttctttgtatttttaaaagtacatataaaaataaaggacccaaaaaaatcacactattttcaggtctctgatataactggtacgaagatatttgttgttctaatctttctggaaagcaaactaggtgagtgtaaccaaagttataaaattattcgtagcttctcttatccctggctggtcaattttaggactctatctaaggaaatatcttctctcccggaacagggaaactaaaagtgcgcttcatggctgaacatttataatcagctgaagtggaagcctgtgaggggtgtggccaggaaggctagtgtgttacataggactgaggtgtggcactaggaagcaatgctgcctgggttgttctctgaggagaggctgtgaggggaggaaagggtgctccccagttggtgtgtacaccccagatggtgtgtacatcgtgattctgaccacgtggctgagagccacctacagtttttacacactccttactccagcagctgtaggtggagtttctctgggagctcattaggactctcctcacactgggggttggggaggggttcctgaccatcttcaaacctgggcccctattgttctaagtctgtgtctctatcaatttagaacaatgtaaagggggtgaatgtttgtttacttacttatttctttgtttccctctaaagttgcttgaatttatatagaaataaaaccatgttacacgttatagtggttctttttttaagaccttgagtgtatgatcttgtactatttagaaaagcaggctgagtgtctacatgcttcagagtggctcagcagctgacatctttctctcaactgaatatgaataacttgcatttttaattaaaaatcacagatttatttttgagattcctgaagttcttggattataaaattccccaattctggacagattgaggattttatgtaagctaaggttttaaaatgaggatttccaattggtagaaagtaatgtatacatgtgtgtccaaattcttttgtgctgaaact

SEQ ID NO: 2685 - DNA, 1012 bp, Homo sapiens
accttccaaaactcattttgaggtgccagaataagttttattttggcttttagatgacagcctccagaggaatggcatccacaattactcttcgtctctgggggcagcaaaatgtccacagcacttgggaacagtcgggtcagttggagtggcatgcccccaggaagacagaaaccttcttgtacagttgtctgtttttattatcatagacaggtggttgatagctgttttatttctcccaaatatggctttcgttttggaggaaaaacttggaataagtagtgacttacttcatagatgctctgcccttctccccgaccccaccagtggagggtgacattgctccttcagctccccacttctcagctctgggacatcggtgagttccccaggaaggatgcggacgaggacaaccatgtacctgccctaagtggggagaccaggcgtgtgtacagataaacttaatagagaggcaaaaatgaagcatgtcagaaacacagaagtgcggagattgttcagacctctcttgggtgattacagtggactccttattgatcttttagctaataaaatgaatggaaaaatatttcataagtgtacaatatgcagtaggaaaatagagtactgtttacttaaaagtctgaaaaacactgctgtactgcttccgtgcaatcacaactggggtttagacacccactatcttatcttgtctattccaaaaggagtctaacatttgtttctgactccacagccagcagtctttctagcacaacttgtgatcctccctggattagactctttcggctgtgggagaagattcccacctctgtgtgtgccttcgaaggcctttaggatctgggcccgcagccccgtctgtcactggctgcccctggttgccactgatccctaccaccagccacactgtaccatatgctgctttggcttttggaatttgaacaaaatctagcttaactcagacatgccctctaggactatattgctgtcatcattt

SEQ ID NO: 2686 - DNA, 1017 bp, Homo sapiens
tccgaatccatttttgagagtgcccttcacattcagtacttagtccatcgtttaggcacctgtgaggcatgatctctgccctcaagaaaaacagaccatggggcaatcaaaatctaggggcagggaagggagagatctatgtgagcagtggtagtggagaggtgtccaaaggaaggggttcttgagttggctcttgaaggaggaaatgggaaaaagaagggagaacattccaggtaagaaaatgagctatgaaaaggggtcagagtcagcgtccccttgctaccagctgaacatgcgtagtgtgaagatgagactgagcccgtgatatgggggaaatgtaccacacgaattagtaatattatctagacttattcttcacaatgttgggtgaacagagtactttccaatgaatatgcatagtgtgaagatgagactgagctcatgatatgggggaaatataccacacaaattagtaatattatcttgacttattcttcataacgttgggtgaacagagtactttccaaaaacacccgagaactcttccagttttagacaagatagagtagacacacttgtgtttatttttcctgctaaggatgttatttataatacaagcataagaagacctgaaaagtgaagagaaaaagacagactggctaggaacctaaggacctaaggaacaacacaacagacacaactgaaaatcatttgtcatgccaagaatcaggaatacctaaacctgagtgaggaaaggccatcagcagatctcaacagcaaggtgactcagatagtggaattatagggcaaggatttgaaaacagctatcataaaaatgcttcataaaattacagatacacatgaaacaaatgaaaaatagtctcagcaagaactggaaagtttcagcaaaaacctagaagatagaagaatcaaatgaaaattttagaactatacaatagccaataaaaaagtcactgaatgggctcatcagcagaatagagatgacaggagaaagaa

SEQ ID NO: 2687 - DNA, 1026 bp, Homo sapiens
tcccacaaaggcctgggaacctgatcctggccgtaaatctgaaagtaccacagccctcaggagaaccaagagatagggaggcaggctggggaaatgtcatcaatgtgcacccaggcgtggtggagctggtcagccccagctggagtgggaccccatcaagatggagcctttcctggcacctccgggaggccgttttgcgtttccgcccttcatgcatctgaaacaccaagggccatgttccttctggtgcttgtccttttgagcttggtgtttcagccgtgtctgttttgtagactttgattttgtcttaaatgagaaagaaagctggtgaaggttatttcaaagttaaatagctagtctgaggggcttatcactgaagccagttgtgcttatgtggggtgggagtgtcactgcctacttgaaagtatgcacttgtgtggaacagattcagggtggcccctagcacttggggctgcgggagcttctgcacactttccctttaacggtaaagagacaagcttggagtgtttaagtggttcgttcaggagcacagtgatagcggtgacaaaggagatttgaacccacgtctgcgtggctccaaagttcactctttcatcactccctgctgcgtccttcttgaggctttagcatttttagtgtgttttgtgcccccagacctcagagttgacatttagcagtgataaactgctgtaaatccaaagaacgtttagtgtctcttgtggtgaggtcctgaaatgattgttgtattagtcaaacagaatgatcatggagcatgtatggagatgtcagatgcaatccctgtattgtaaggcaatgacatttaatgaaggataagatgaattcacagataactagaactcagggccaaacgcacacagcctgtagcaacagtgtcatgctgagatttaaaggaagaagaggtgccgtggcagaactccacgtgaccgtcccctccctgcacgcagccaggatgagaggagcagagctgagcgccacctccctgtc

SEQ ID NO: 2688 - DNA, 1543 bp, Homo sapiens
aaacaataatttttctttgaagattccagatgattcagcaaatatagatatacagcaaagtttgaaagctacagttctgaggaccagatttatggattccttcttatatgttatctgggttgatatagaaattcttccatggctacagactatatccaaatcaagtaactgtctgctgataaatgtatggtaagtcatagcaggagccaggtgacagtatgcctgatgtattctggcgtatgactctgggaaaaggaacatctcagagcgtttgttcctttcacattggaggacaaatggtgttatttgtggtagtaggtttgagctctgtctgactccactagctttttgaatagggtgacgtgaggattaagtgagacagtgtatgtctggggtcggcaaatttctcctgtatagggccggatagtaaatctttttggttttgcagcccatatggtctctgtttgcaactatgtaattctgctgttgtagccaaaaaaaatccttgacaatatgtaaacaaatgaatgtggcagtgttccaataaaactttatttacaaaagtggcattgtgctggatttagcctgtgggctctagtttgccaattcctcatatatgtcaaagaatttagtaaactgtaagacaaaatttaaatgcaagctgttgactatattcattttaatattttacttagaaacacttctaagtgttttacatttaaaatatttgtgctttaaatatttcctaatgttgtgtgtgtgtgaactcattgatacctaaacattttctacaactctttacagcctaataacgttactatttttattctttctgcaaaatcaggtgtcacttaatcaggtatttgttcatcttggttggaggtgagggtctttttaatttggctaacttgggtgattccaggcagcctgcagtatgaggaaacagttctgagccttgttccctgcaggtgtgctgagatctgtacactttggcaggcctgctggtgacttgggttgataagttgggtcaaggtggaggcataaagtattaaattgctcttgtaactgtttcactaccacggttcattactagtttgtgcattttttaagctattggaaaaagagcaaatcacattccatttcgggaagtatcttgatggcatataggatgtttgaattgttacttctgaagatttggcttcacgtgattttaagtggtttattttgtttcagattttctgcaaataatgcatctggttgtattaaatatgttatgttcttgctaatatattaatgtagaatattatgaaagatttctgcctcagtatgctttattatgtaccttgactattaaaatactaacatgatagaaatttagagctagactttacatacaatgaaatgtaagtgattttctcattaaaactgagtatactacatgtccatgtaaaggcttgtcccatgaaagatggattttatttcagtatatgagcaatgtgaagttctgttttagcttatcacatctgttttttctttacagaag

SEQ ID NO: 2689 - DNA, 1367 bp, Homo sapiens
atgtaaatgacgagttaatgggtgcagcaaaccaacatggcacatgtatacctatgtatcaaacctgcaccttgtgcacatgtaccctagaactcaaagtataataataataataataataataataataataataaaagcacatttgttgtagttgcagagctacacaagagctcagggacagatgctggcatcagcttcactcccgggagttccccctgtgcatcctctacattggcaggaggctggcattgagaaaaccagcaactggatgaccactgtgtttactttttgctacattttgagctccagtaaagcaattatatctcctacattatctttatcagttaaagaatctataagcactttgcaaatttaatgtaagataatgtttgataataatcagctatggtaatatatcatctaatttcaatattctccacttcagtagaaaacattctgtacttaggtcagaaaataatgtattttttcatatcaggtaaatttttacagacttctgatcctacttgtgatatctcaggaaatgtttcttgctcttagaaatcatttactttctcagaaagagaactactcataaagagctctaagttgtgtcttaaaataacttgtaacttcaggcacagataacccactaaagactacaaaatctgtgctgtaagtaaaatggtaaaatgcaagtttattcttgtttattctgccaactacagtgaagattgtgttttacatgccacagaaaaattgtgacagaaaaattaaaagaatatgcaaatgtctcacttttgatttttctttagttttgctacttgagaagatagaacatgatgacatctgcaataaaactttgaagattacagattttgggttggcgagggaatggcacaggaccaccaaaatgagcacagcaggcacctatgcctggatggcccccgaagtgatcaagtcttccttgttttctaagggaagcgacatctggaggtgagcctttccttttgcaaacatcggcagaaactgcttgctatgctttatttcagtaagtcccaaagtattcagtaattctcagcataaatagtcgaggcctttttgaatgaatttttatggttttgatcaaaataattgtaatgacaacggaacagataatttgatgtttgcattgtcatatgactccatttcagaggagaactttctagttaaatcacaagtttagttaaaactggttataatttgaattaacactaaattcccaagattttgtaggatgcgccagtaaattaaagtgaattttccgtgatgcaatcatggctcattgtagcctcaacctcccaggctcaagtgatcttccctcctca

SEQ ID NO: 2690 - DNA, 1189 bp, Homo sapiens
catggatgcagctggaggccattatcctaagtgaattaatgcaggaatagaaaaccgaatatcacatgttctcacttataagtaggagcttaacattgggtactcagggatataacgatggcaacagtagacgctggggactaagagaaggtggagggaaggagcggggaaagggctgaaaaagtaactcttggatactatgctcagtacctgggtgacaggaccatttgtatcccaaacctcaacatcacacgacatacccaggtaatacacctgcatgtgtactccgtgaatctgaaataaaagttgagaaagaatttaaaaaaggatagatgtaaaaaaacaaaataaaatcctgcgttaatcattaaagttccatttttttctgtttttaacagcttcgttgagatatgattcacataccacgaaactgatgcatttaaattgtacagtttgatggcattttgtatattagtaagttgtgtgtccatcatcccagttgattgtagaacattttctttcatgcagaaagaaaacctgtcaccccttacctattgtccccaactcccccttccctctcagccctaggcaaccactcatttatgttctgtatcttgacttttgtttattctgaacattttatgtcagtggaatcttagaatattcctttgtgactggcttctttcactgagcctaatgatttgaggttcatctatgtcagagcatggatcaatacctccttcatttttatggcttaatcatagagtattactgtaccacatcttgtttacccatttatctctggatggacatttgggttgtttccaatttttggcgactgcaaatagaactgataacaaacattcctgaacacatttttgtgagaacgtgtgttttcagtttccttgactatatatctaggagtagtagtgagattgcttggccatatggtaattctgtgtttaattctttgaagaagcattagaccattttccaaagtggctgcaccttctttttttttattcccaccagtagagtgtcagggttccgatttctctccatcttccttgtcacttgtcatctgaccttttgattcgggccgtccttgtaggtgtaaagtggtatctcatggttaaaattacaattttaggattttgttattacttttttttccctttttttacataaa

SEQ ID NO: 2691 - DNA, 1023 bp, Homo sapiens
gaatattttccacacgtgattgcttgaatctgcagatgtggagagctgactgtattattaaaaaaactgagaaactaccgatccctggcgctgcttagttgtagggtcaaacatttctgcatatctccggaacccattcatatacaaaagcacattgtaggatatccggatgggcaaaagcagggcaggtcatctctttgaattatagataccattgctgtaaagtctctttcgatgatatttccataaaaaaaagtttcattcaaaaagcatggctttacctatgcagtgctagggattggtgattttatatttcttgattttcttctcttctcctcccttccttctaacagttactgtactacagagtaattgtcttatgcacttagatattgttatctaatttttacagctcttattatcctggttttgcaggttaagtagccgaggcacagagaagttaagaaatttgcttagagttgtaaaactactaagaagcagattttaggtccagggctgagatccatgactcccgactcacagccctgagtcattacaattctgagttctcaggagagcgtttcattatactatcttctacctggtttaagagaacagaaaaatgtgtactatactttagaagtagttccattgaaaaagttacatttcttttcacattggtttttcatgggataagccctcctctctctggaaagatgatccatcctagattattcatttcctgaaacttgcaagaagcagagttatattgctatttttttaagttttgttatttgttaataggaatttctttgaatttagacaattttagttattctatgtaagttttttttgtttttgttgaatgatctatgagttaagtttacttatttttgaaattatgaagatgtctcctataattaactataatatagatgatttttaagaaaattatcaaaaggaaacacataagctttggaaaataatgattttaactttagctaatagttacagcattgtata

SEQ ID NO: 2692 - DNA, 1079 bp, Homo sapiens
cattttcactaggtacatgagtagagttcaaatacagtattgaattggctccaaatctgctattttaaatttgaattagtgatcagaaatgccttatggtcttaacaggtgtgattttgccaggatcatgtctattttatccttatctttaaaaattgttaactaactctttttgtaagccgcaagttgccttccttcattgttaggctatttttgatttttagaacttctcatgtggatataacattttagaggctttgtttgagttacatgactccatatcagtaaatgatctggttatggtggcttaaccccctgaaacatggtatccatagtaaagcatgggaagcacacgtccatttattaaatgcggtataatatagacagcaacagccttctctaatggtcattattatgcatgcctgtgacatggacactatgtaaaataaactattcaaactattaccaatggattcttaaaatcttcaggagcagatactataaatggaagcttccagtttggaatgacaaatgttaagttgaaatacacttcagtgtaaaacatttcttagcaactctaaactgcgttgagagatggtattaatgtgatttttgtttattttagaatgctggcaacaagaccctcatattcgtccatcgtttgccttaattctcgaacagttgactgctattgaaggggcagtgatgactgagatgcctcaagaatcttttcattccatgcaagatgactggaaactagaaattcaacaaatgtttgatgagttgagaacaaaggaaaaggtgagagaaatttttaaacagcataatgtactcaaatttatgaaaactatggaaaatatgaggcaagaagcactgttagcattattcaaaaatatctttagatatcaatatttgttgattctcaccttctttcaggttaaaaataaaacaaaaataaaacagaagggtactcaatatgtataattggggaaaatacccttttattagaggaattttcaaagtaaaaaagagagagagagcaaatagcataatggacactttgtatgcattaatcagct

SEQ ID NO: 2693 - DNA, 1542 bp, Homo sapiens
tcacacatgtgcccaaggaaacgtgcttaaagttgttcacttaggcatcatttgtaatagtgcaaagcttaaaacaacctgaatatccattaacaggggaacagatgcctaacctattgtattcttacgcaatgcaaaaatgtatagttcagtaagtcctcactcaatgttgtggataggctcttggaaactgactataaatgaaatgatgtataatgaaaccaattttactataggctgattgatagaaacagttaagttcccacgacatatttctggttgcaaacacatctccaaactttgaaataaagaccaaagcccttctaatattaaacattgaaacaaatgtgagctatacgtaacatttaagaaagactaatgtccgggtgtggtggctcacgcctgtaatcccagtgctttgggaggtcggggcaggtggatcacctgaggtcaggagtttgagaccagccttcttctaatcaacttcttctaaagacattttttaaagtagacataaccatcattctcagcaaactattgcaaggacaaaaaaccaaacactgcatgttctcactcataggtgggaattgaacaatgagaacgcttggacacaggaaggggaacattacacaccagggtgtgtcatggagtcaggagaggagggagggatagcattaggagatatacctaatgtaaatgatgagttaatgggtgcagcacaccaacagggcgcatgtatacatatgtaagaaacctgcacgttgtgcacatgtaccctagaacttaaagtataattaaaaaaaaaagaaaaaataaaaataaaaataaaaaaataaagtagacatacaggtaattcactctgtcccttagatttttcagtatttggttacattgaaaaatgcacaacaggtaaatgcaacgtaagaccatgacaccactaatgagtacttagagttcatcaaggagaggcaccaatcccacctgccctgttctgctcaaacccatggagttgcgtctgactgcgagcatcatgtcctaaggagcctcctggcatgcatgggagaggatgggggagcctgggagtccaagaacaggaagaacacacagcacacaagggggtggggactgctggggctgcccatgcatggggaggactttcaagtagggagagaagaaaccagttgcttgttattccagagttacgcagtaggacttctgggtgaatgctgcagggatggcaatctggtctccaagtcaacgacttgctagcacttggagctggctgacagagaaatagactgcttgggtgactgcctgtttccttctccaggacaagactgaatgggaagtctttatgggattctgaaaaatatgatagacctccctcaccccccaccaggaactctgagtcagacagccctgttggcattcgggctcttgtgcctgatgggttttttttttttttatactttaagttctaggtgtgcctgatggttttgaggcctctgactctgttactctgtacctcctcatcattggagc

SEQ ID NO: 2694 - DNA, 1030 bp, Homo sapiens
ttggccaggctggtctcaaactccagatctcaggtgatcctcccacactggcctcccaaaatgctgggattacaggcatgagccaccaggcccggccttattttaacgtattttaattattgacaactatttataaaactggaagatataggcatctctagtgagttcataattatatgttgtattaaaataaaagcatgcttcaagggtggatgtcagctctttctctactttgcgatttgtagtaatttattttttggttgatttttgagctaccatgtagtagtgtctatttttactttgtgttttatttttgtgcattgttccttgaaatacagcatttatgttaccctgtaagcctttggatttacaattaaagaatatataatgcttttttttggcttcgaagtttccagctgcatcttttttgatgaagtaaaaagcatagtgtacgtgccctatctccctttcttgtccacagattgcttaaggtaggaggcatcagacttggaattaatggtgagtaacttggctgtggtctgtgttattcagtaagccgtagcctccgtagatactgggtcctccctaaactcctggctccttatctctgtgtgtctgtatttgtgcattttgtgcatgcacctgtctgtgaccccccacacagaggcatgccaccgttaatgattaacagccactgccagggatctggatttgccattaccagagtggcctgtgccaagcaattcaacaaatattactgctagtaatctcatcaaccgaaagaatgtttttgtgcttcatacttttgaagtattcaaagggttctaataccccagttttaaaatttacttttgaatgtgttcaaatttattcagaaggaagattacttttgctgctttctcttcaatcttatttttttcttttctgaagtcttaggcaagtgattttttgtttattattcacaaatttgttcacagggattcatgatttagcttgggacctggaattaaaaatgtttttttattcaatt

SEQ ID NO: 2695 - DNA, 1047 bp, Homo sapiens
aataaatacatttctttattattagctctccctagtctcttcgtgatattgtcccatttatttgtgggaggatggtcttcctgtttattttctttacgataattgtactgataggctcagattactctttgagtccgtctgtaaaaagtccaagtattagtagatttgaattgcattctagtcccttggtttgggtctagtttcttccaggagccctaatcttactgtgttttttcatggatcagaatcgttgaggtgggcctatttaaagtgtggcctgtttatataaagtaggaaatgtttgcacagtactcatagctctcaaagctcagagcccaacactccacctgagaaggcatctgcagtttccaacaaagattgtggtattagggtattctaagattaagtttatctggaacagtgtaaataaaagcttgcagatgcgttgatttttatgtgagtgcttgatttcttagcagagtaatttagaatagaaactggttcagcactgcaaagaatatttatgtctctggtaaagaacagaacactttatggaaatgaaataaaaatggggatataattttaaaactttgtagagtcctcagttttactgtttaataatttttcctaataggaataaaagtatttttaattcttagattttctctttcttagaagttcagtacttcaaaaaccaaaaccaagatgaggtctaactttaatcagtatcataagagaggaacttttgttagctaactcctgagatgtgtaatgaagtgataatttccatgtatcagcgggatctgaaaagttctttgtatacagaatatattttcctttggcttgcaattttagaggtggcttcattttcatttccagcaggtcttcaacagactcctaacaccttagcttgattttctcccttactctctccaccaagatgttttattccttaagcaaagttgtaaataccctaaagaaattctaagtcgtctgaactgcagtcttgtgtaactaaaataattatgctttaattaattgagcttg

SEQ ID NO: 2696 - DNA, 1049 bp, Homo sapiens
tccacaaggatctaggatgtcatctggtatctgggacactgatattgttgtcagcactttcaataaaatatatcaagtaccctgaggtactttcccatgaaggtttaaaatccttcagacacaaaaatcacccagtaaatctagggaagcttttttaaacattgtgataacaacatacaaggattactaaatcattttagtaatgtgttaggagaaactaaagggaatagaaaatatatcaatcaatcaatacatatagatattattgactgataatcaaaatatatcgatcaatatagcagacatagcttgattcactaaattaagttctttaatattatatattctacttgttgtaaggaaaaaacaaatacctccatggtattttgtgattctttctagtaccagagcaggatgatgacagagcaatgcagacttcacttttatagaatctgtatgaaatatctctatgtctatgtctatacctgcctatgtgttatatgtattatatattagagtgctcggacggattctagtgttttcctaagatgtttgttaatggcatggtaatttgatttaaagtgcaacagtgacagttttgttttatgtcgagtgtgtataaattgccttataaaatatgtattatgaaacactggaaagcttgcagaatcctgtgactaatttaggttattgcagatgtcctcagttgatcaaaaaattgctagtatgacatctgggtgcagtggctcatgcctgtaatcgcggcactttggttagctgaggtgggtggatcacctgaggtcaggagttcaagactaccctggccaacatggtgaaaccccctccgtctctatgaaaaatacaaaaagtagccgggcatggtggcaggtgcctgtaatcccagctactcgggaggctgaggcgggagaatcacttgaacctgggaggtggaggttgcagtgacccgagatcacaccattgcactccagcctgggtgacaagagcgaaactctgtctcaaaaaaaaaaagaaagaaagaaggctgggca

SEQ ID NO: 2697 - DNA, 1030 bp, Homo sapiens
caggcacctgtaatcccagctactcaggaggctgaagcaggagaactgtttgaactcaagaggcaaggttgcagtgagctgagatctcgccactgcactccagcctgggtgacaggagcaagactccgtctcaaaaaaaaaaaaaaaagaatgttttctttctgtttacaacataaagtatgcttttcaagtggaagtatttaggtgtttttggaaggttggaagcactctgaatcttaggtgttgttaaaatgcagccttgtatctttgctgctctcacccgtggctttccacgtgttccatgttggtttcctgatctgtgcttagtatttattgtcccatcatttgttccaaataacttgtcaatcagatcctgtggcttggttcttggctttcttctgttattgacaggagggctcctcttgctgtaaaagttctcagagcatttgtttctgtcgtgttgtaacaatcaggtggctagctgaacatttataaatgactttagtctaaactgtttcctttctatggttaagaattttttttctttgaccacctctttcccccaactaccaccacctagtctagtcaattttttacctcaactgctctgccctggtcaagtctttcaaaaggaatgacttggggctaggtgcagtgactcacgcctgtcatcccaagcactttcagaggccaaggcaggtggattgcttgagcccaggagttcaagaccagcctgggcaacatggtgaaaccccatttctacaaaaatatacaaaaattagctgggcatagtggtgcatgcctgtagtaccagctactcagaaggctgagacaggaaaattgcttgagccaggggaggtcaaggctgcagtggactgagattgcaccactgcactccagcctggataacagagtaaaatcttgtctttaaaaaaaaaaaagtatgactcagcagatggaggagcctcccatttggtctttcctttccgtttggtttgtcttccaaatctcctccagcctgctgtgtatt

SEQ ID NO: 2698 - DNA, 1067 bp, Homo sapiens
gcctagagcacaaaatgcttttaatttacattttctgttttattcaacaccacgaccaccatgtgaaatattgttgttcactttagcaggtgaagaaacaggctcagagcagttccttactggtttgaggtccatagcgtgttatgttatgagaaccaggactcatttaaatccagggccatttcaatttaattttatttatttatttgtgtatttatttgagacagagtctcactctgttgcccaggctggagtgcagtggcacaatctcagctcactgtaccctccacctcccaggttcaagtgattctcctgtctcagccttccgagtagctgggattacagatgtgtgccaccatgccggctaatttttgtgtttttagtagagatggggttttgccatgttggccaggctggtctcgaacttctagcctcaagtgatctgcccacctcagcctcccaaagtattgggatttcaggcatgagccaccgtgttcagacttaattttaactatctcagactgaatgcagataactcttttttcccaggttataaattcttcaatgattcgtggctttcatattttcctttgtgtgtgtgtgtgtgtgtgtgtgtgtgtgtgtgtatgtgtgtgactatatccaacatataagctctgattcattatttgtgtgactatatccaacatataagctcagaatcattatttattgacctgaaccccgagaagtaagaaaccaaaataagaaatcgatcctgcaatattctttgcagttagggtctgaccatttttgtttttattgctgtgtgctaaatacatggctatgaagataaaggaaaaccatgaaataccagttctccctttttgcctccaacagatttccagcacaagataaccgtgcaggcctctcccaacttggacaaacggcggagcctgaacagcagcagttccagtcccccgagcagccccacaatgatgccccgactccgagccatacagtgtgagctttctgcactgccacgggggctcctgtgttgacttctctcctttcacttgacttggatt

SEQ ID NO: 2699 - DNA, 1033 bp, Homo sapiens
aaagttgaaatgcagccagcttagggaggcgcatccttggcgctccttctcagaagtaacatggtggaaaggttctaatcgagacagtccacacagggccagctttgtgtgtggcagctgttggctcaagttctccagcctggatgttgctcatcttcattgtgaccctgggtgctccaagaatgcctcttgtcttcatgtgtgtgcacacccccattcaattctgacagcctcattgagtggacccttttatgatccccaaatgcgggacagagaagttaccattaagctgacccaagttggtagctactaactggtgaagctggattcagacacatctgagtgtagatttcaccatccgtttccggcctcttagtacaggaaaagttcaatcaatgtggaaacaaaagagaaaccagaggagcaaatcaagaggggaaggaaagtaggaagggacgaaggtgaggagactaaagccgagagtgtagatagctctgggagtgtagatcagtcagtcagtcatatagccgagatgaacttgggtctaataacccccagctgaaagcttttccggttctgctgccctcacttaaatgaaaactgctgatccgtttatctgtcattctactgtaaaactcttttaataaaaagaatgaacagctgattcaagattgttacacatgcacacttacatttaggcatgcatctacatttttttttttttgaaatggagtctcactctgttgcctaggctggagtggtgccatctcggctcactgcaacctccgcctcctgggttcaagtgattctcctgcctcagcctcccgagtggctgggattacaggtgcccgccaccacgcccggctaatttttgtatttttagtaaagacggagtttcaccaccttggccaggctggtcttgaactcctgacctcatgatccacccgccttggcctcctgaagtgctgggattacaggcgtgagccatcgcacccggcctaagcacatttatatgcacagacacgtgtatata

SEQ ID NO: 2700 - DNA, 1028 bp, Homo sapiens
atggtcatacatatatgatacaaatccagagttattggtgcagaaatggctacccgagagcttggtaaatttgccttggtttcttatgttaaatgtattgtgcttcccttctgtctctagaatgtggctcttcagaagacagacaatcgacatttaaatttttccaaacaatgaaaaactaaattaaaaacattgcttgatatttcatttaaaattgcaccttgcttaaggtttactgaataactgaaatgtcagcaatttaaaataaattcaattgtgtgataaaatatctcacctataatagaagaaaaggaaaatcatattatttggcaattttgcagcattgtggttgcctaacaggtatatccagcagatgagaaacagtatgaaaggattgtattaacatggtaagttttgccctaaggaaaacgatcttgcattctggattcttgcagcaaagtctcagatacttaatacgttttcttgttttatcatctgttctatgattcggcttcactttgtgtggttattgaattatgtaacagagatttggttttcccaaaatgttatcacatttgaaactatgattgctttgtgttcagtccttttggaacacgtagcttccagcttaagggtagagaaatatatacctaaaatcatcaatacatgaaagaaaaaggatggaaactatgtcctcagttttacttctaccaaaacatccctgtatgtgtgtgcatgtatgttggcgtgtgtgtgtgtgcatgcatattagtaaatgtgtgtttgcatgtgtgtgttggggagtgtatgtgatctgggtgtttgtttatctctgttattattcccctttagctttattttagtcaactctacattatgatgaatttcaaaatgaagctgtattaaaataattgtaatataacaattcaatctcacatgttactgcagatagttaacttttgctgcaatctattgtacatttgcaattttctgtgttagtaaacttagcagaatctggttatttattt

SEQ ID NO: 2701 - DNA, 1046 bp, Homo sapiens
acagaaagtttacaactgggtcacaatgttgggtaaacatttcgaaggatgcttatagcgtgtggtgttttcttactaatgatattgtgaggatagaacaagaataagaacagttttgaggaaaaaggtttgcttttatctgggtgggatttttcgtgactcatgtatagtcttaacatcatattgtctaattaaatgttaaaaattagtttataatcttgaatagatgaaatattcttcccagaggagaattagaaaaagggatagtttctgtttaagaaaggggtggggtgggaatagacgtcttattattggtattcagattgctttgtagttcctaagaaagtctgtattcatgcaaaacaagtgttcatttaagaaatcagtgcaaggggcacttaaggataaactaaatgaaaaaggtgcctcttggtttgtaaagttagcacatcaatgaattcttgttatatgaatacaactattctaaatgaaaagtactcttctgttggctttgtactgccccattatttgacacatttgatatttcttaaggtttcaaaattataattacccattatttgattcatttgatgttttttaaagtcttcaaattatcataggtgccctggccatgaatcttataatgggtgagaaatcttttcttccctacaaggggaaataaagagatgttaaattgtgtgctggaaacaaacaatattttaaatcacttgctggaagcagacaattttttagagtaaagctgatgtgcttcattactaggaaaatattttctggaaaagcgccaaccaaataaaatgagttgcaatcgcttttcgttttttgggtggatattagacatgttgtgctttttttttttcttttcttaacacttctagtccttttgaaggcaaatcactgagataattgttacctaattaatcagtacagtcaatccttgacttattcagaatgctaacaatgagcattacaaagatgctgttattggtagtcattgttgtaacacaggcccatgagtgcttttatgt

SEQ ID NO: 2702 - DNA, 1019 bp, Homo sapiens
agttctaccctcagtatttcaaaatgtgactgtatttatagataacatctttaaggaggtgattaagataaaatgaggccacagtgagaaggtggccatctgcaagccaagagaggcctcagaagaaatgaagcttgcagacacattgatcttgaacttgaagcctccagaactttgagaaaataaatttctgttgtttaagccacccactggtgatattttgttaaggcagccctagcaaactaatatagaggtacatgatagtttttatttagttgcacaaaacccatacaaatagtggaggacaagagacagaatcttttaagtctttagtcttgcaacgaacaattttatatacctgaatgggatgtcattgttttagagcgcaatatagtaatccacgtccttgaatcatcaagaaaaatatctcaacatgtttctacttaagaaggcagggaagtgtataataaattctagaaacatttccacccaataatggtcaaagagaagagattcttagtgtttaaatctgtgaactcatacctgtctataaaacataccagtttttagtattttgaaggtttggggtttttttttaactataaatttgttattatctatgcctattttatagcccctggaagatactgctactattatcaataacgtggaagaaatgatgtctttccttttatgacataactgtgagtcctatcaaggacagaatctttgattgaaccagtatcctaagggaactctggtgctctcagaacaagctattttatgacattgctcattggagtgttactgtgtgtgactgtcattttatagcccccggaagatactgctactattatcaataacttggaagaaatgatgtctcttcttttatgacataactgtaagtcctatcaagaacagaatctttgattgaagcagtaacctattgggaactccggtgctttgagaacaagttgttttatgacattgctcattggactgttgctgtgtgtgagtgt

SEQ ID NO: 2703 - DNA, 1031 bp, Homo sapiens
cattggccagttttacatagaaaggtggaggaaaagttttatggttttatggctggctttggggaaatggggttctggtctctaggatccaccttggggaagaggtattccagattttatggctagcctgggggaggatgaggggtgagagataggagggcaggagaaggtcggagaaaaacttttgcttctgggaccttgattttgggttatcattttctgagctccagcatgaacaaagagataactaagggaaatgcacaggatgttaggtggtgataggtgctcaggaacaacaatgcagagcaaaggagatggggagtgtgtgattagtgtatggtgaagggggcagagtccaggatcgtagtcttccataaagttgcccgtgaaagccttactgagaagatggcacttacgtaaagagtgagaggaggtggggagtgccttatgcagttttctggggagctgtgttccagaacaaaggcacctattggaggtgcagctagaaagtgactgtggctggagctgagtaagaggggagtgatgaggtcaggaagaaggggagggagcagatgctgtaggatgtcctaggccactgcaaaacatctggcttttatctgagctaggggaaaagcaccaggagattttgagcaaagggttgacacaatctgactgactgttccaacgcgttcactctggctggtgtaggagggcaaggctgaggctgagactaaaaggaggctcttctgatgacccagggggtcatcggaccaccgatgcctctcggtgactcagaaaagtggtgatgagaagtggtcagattctggattcatattgttggccaaaccatctggctttgctgatggattggatgtgaggggtaaaagaaagaagagtgaagaatgacccccgggtttctgacctgagcccctggcaatgtggttcttctttacagaccaaaggaaggccatggaaggagaaggtgttggataaagaatctcaagcaggttccagaacctgctgaacttgag

SEQ ID NO: 2704 - DNA, 1040 bp, Homo sapiens
atggaagagcagtaatggttatggaaacaaggcaggttcactgggctgtgtttttgagcaggtgaatggggctaagaccccatacccaggaagcgagctggcatcagaagcagaagactgaggtcatttttatggatgggagatgtgctggtgggtttttagaagagctcatgtcagttggcatccatttcttcagtaaggtgagaaggtaaggaaaattagaaacaaaggacttttaaaaactcaccaatatacataccaatttttctgcctatctctcaattttcaccatcctttctttcaagctagactctcagctccttcaaattaaaattttccatttggcaatgcaagtttatcttttcttaaagacggaatgaccagccttttgatggaagattttatgactctggtgtcttccaatgacgtgaccagtgatgaggtttgcatctgtgtaaaacctacagattggaattctgctttctggtgcaatgtagtgttggaatgtaatgtcgttttgggaacctcaggattgagagcaaacccaattcaatcattggaggagcaagaaactcattttacgttttaaatggttctattcactgggctgaatagactcaatatttaaaacccttaagaccagtgattctcaatgggttgtggagggagagggataggcaatttgaagactcagtagtatatttaatatttactatttatcatgcaatttatagaaatgaatgcttgacaatgtcgtgggctgtggaaaaatgaaaaaaaaaaacacagggttgtcctctcctgcttctgttatatttatttttgttatgttgtttatccaaagggggcattgattataacagttagtaaaatactggtgtggctattcacctttgttagcttatatgtcttaagtggtacaaacaaagccaagtaagtgtctgatgtgagatccttaaaaccgggaggcctgggtgctccttcttcccctgactccagtattcctgccctggacagtgagcccacctgaagctctttcc

SEQ ID NO: 2705 - DNA, 1029 bp, Homo sapiens
cagaaaaggggaagagacagagggggaaggcatgtggagacagaggcagagattggagttatgcagtcacaagctaaggaagcctggagccactagaaactggaagaggcaagaaagccttttcccctacagccttcggagggactgcttcgaggcactgctaataccttgatttcagatttttgccctgcagaaattttgagacaatacatttctgttgctttaagccactaagtttatggtaatttgtacagcagccacaggaaacgaataccagtgtctcataggcttggcgtacattagggggtggaggattggaatcatgggggaaataacagaagctgataaattaatccaagagaaaaatcacgtggcttgcatcaacagcagtgggaatagcgagaagtgctctatttagaacattctgaaagtagaaccaacaggatgtgctgatagattagatgttggagacaagggaaagaaaaaaaagcttcttggtatttggtctgaagaactaaacagattgcctaatactgttacctgaaatgaggaagactaggggagggacaatttgggctgaggttttcagggtgagaggtgagaggtgatggtggggatggaggttgcctagggtgtaacatggtgaagacttctttcatggacgtattgattttgagatgcctacgtcacattcaaggtggaagtttgaataggatgtcaggtatgaatttggagctcagaaaagagatgaaggtcagtaagttaggagtcatttgtgtgtcgatccatgagtctcaaccttagctctataatggagtctcttgaagagctttccaaaaaagatacccatacttgtgctccatcctgggctgattaagatgaaatctctaaagtatttaagaactctccaggtgaggctaggggcagccagggtggaaaaaccacaaatgtaagcaccgtatttaaaggcatggatctagacggaatcacgcagggagagctgcctagaggataagatgctgctaatat

SEQ ID NO: 2706 - DNA, 1105 bp, Homo sapiens
ttattattattttggtaggccatgaggtgaaagagataggaaaagccgagtgcagggagtgagagcagatggaaggtctgaaggccgagtcctggagggttctaatgtggtggggtcaccaagaagaaagaaccaacacgggaaacagacagaaattcttgaactgggaggtagcagtgagaatgtggcatgtgtgaagccagaggaagaaagtgtttcaggcagaacaggggactcagtttagtcaagtggtccttagaagttgagaaagatgaggatagaattaattcagggatttgtgaagatagaagccactggtggccttgagacgacagacctgtttgagaagagcggcttggatggaagctcacattgaaccagctgaggggaagcgagtgcattttgagcctatagatcttcccaccaaactcgaagcagtgagtgacgcctcttattggcacattgcttctgctatttccccttaaaatctggcatttctgagagttagaaaattttattcaaagtgactttattgaagcagatgtttaatcttctggaatgtagtacatggatccacttattaatgtgtcagttttataaacggcatgtcatctgtgcttctgtttctttcctctaaatcgttttcttttgactttgttccagatgaaatcctcttggtattttcctgggtatgtgtgatggtttagcgttgctagccattcatcttgagggaggctgttctggtttaatgaatcacagctgcttcagacgtgaatgtcagtggtgctgtcaaacctcattgcctagtatgtagttggggctcaggaaacatgagttgaagaaacttagggtgaaagtaaccctgtggtggacactgcagctgccttggggagggtgaggtgaatgttttgaggtctcttcagaggagggcacaggagccatggctgtggattggagagtttctgccctttaccaactcctgtccttgttacctgctcatcgtctgttcagtcctcggtgctctccttagggcctcacgatgctcaacagggagggagggctgccttgtcatttaagttttggctatgaattctctgctccactc

SEQ ID NO: 2707 - DNA, 1023 bp, Homo sapiens
agcgattctcctacctcagcttcctcctgagtagctgggactacaggcacccaccaccatgcccggctaatttttgtatttttagtagagacagggtttcaccatgttggtcaggctggtctcgaactcctgatcttgtgatctgccctcctcggcctcccaaagtaatgggattacaggcatgagccaccgcacccagcctaggattcttttttaaaaatcccaaaggctcctgggtctgaaagggatggcttttgtgaaacattcaactgagaattaaactgtaaacaaggaagtaagaagggcccagttcctcttctcagtggcaaaagtcctccaagctccacattccatgtttttgaaccaaaccacttggcagtattcctgggaattcttcaaattatcatctgttgagtggatccagggcccagaaagcacctgggccacaggagggactcaataaatatttgttgaatgaatggatggctgctgcacgaaatactgacctctgggacagggagctttgaatatgcctctgtagtgatttgtatcatttacctctttatgctgacttcctgttatgtggaattgctctactctttcctagttcttccatcacaagtgcttcctgaaccacagactggaccagaattcttggtgataagctttggtttggcccagggtttcttgatctcagcactattaaccctttgtgctgtataagtatttgttgtagggagctgtcatgtacattgtaggatgtttagcagtatctctgacctctgcctattagatgtcagtagcttaccaccctgccccctaagttgtagcaactcagtatcccatggggggcagcctttagttgagacccactcatttagggtaacccccaaatttatgctgcaatagaactctcttctgttgcccagtaatgctaaacaagcaggcctaccttacaaattcctgaccctctccttcctcacctttcttcctggaccactttttaggttttcaggatggcca

SEQ ID NO: 2708 - DNA, 1029 bp, Homo sapiens
atggggatgaaatgaaatgtttcttcatggtatccacagcatctggaaaaggttcctatgattttgagcaaattgttcaggtcacatatctcagggatgttgatacagtttggctgtgtcctcacccagatctcatcttgagttataataatccccatgtgtcaaaggcagagccaggtggagataattgaatcatgggggcggtttcccccatactgttcttgtggtaatgagtaagtctcacgagatctgatggttttataaacaggagttcccctgcacaggctctctggcctgctgccacataagatgtgactttgcttctcattcaccttcgaccatgattgtgaggcctccccagccatgtgtgactgtgagtcaattaaacctcagcaatctcaggtatgtctttattagcacagtgagaacagactaatacagatacattcaatgttttaaatagccaaaagctaccactttggggccaaactatgataacttttaaagtggaagatagactttcagaacttcttaaagagaccaagctggtacatacaatttgattgctaaatatttgattctttcccagtagtcactggttttctttaatagttgaagtaagaaatttttgactgtacaaatactgcaactgaccaggaagaaatacttgacagagcccagtgcggaaaagagtgctggagcagtcacggtgtacaactgctcaagctttagcacttgaagggcactgaagatgctgttgatgtagcatctactgaagcaaagatttcttcaacaagattcttttatctccccacaaattcaggatacatgtttcatctgaatatccagaactcagacaaagccagccaacactggctcatgtttcaaatggcctataattttgtttggacttactaatagaatacaaataaaaattaagaaaagatatcgaatgaatataatccaagctctctgtcttggaaccagatatacttgtgaacagttgcaaattatcccattgctgtgaaa

SEQ ID NO: 2709 - DNA, 1059 bp, Homo sapiens
cagaagccagcatggctgcagcagaatgagggagtggaagaagagatgagagctgggtacaaagcatgaggagtagaggcctggtaaggactttgcttttatgccgaacgaagtggggagctaccataactgtcattggaccttcctcctgtgactattcacttgtatattaagtttcctttgcttcctttgctctttagctaccaaccataaaagtcacagcacagcttggaacccacaggattgtaacctcagatgtaatgctgcatgttgaaatttttggttaatgggcagtcattgcaatgatctcaatatacttttactaacagccttaagataatcataaaaataaaagtgtaaaaatgcttagaattggtcattaaaaattcatggatttcccaggaatatgtacatggagtcctattggatctgcattgtgccatagtcagcttttttacatgttgctttatatggaattcaggttggtgatgggtggcatagaggaacattatgagactagggctaaatagatgaatgcatttaaggaaaaatgaaggttagtaattaaaaatgattaagatttatcttctctgtattccacattctagagtcctaggaacggattccttggaggctctgttgtcccagatgcctttgcactggaacatattcagcatgtacctttcttctctcgttccttgtcttctctcactcatctattagattcttctaaaaagagtttcagcctccaaagatcccattatgatagctatttagtcaacaccaatggaggacaccatgattgctggtattgaattcagggaaggcagaaacatgctgtcaggagccaggttttctgaagctaaaatactgtttcagatacttgcttatgatgcaccatcatttgcttttccctgttatttgcctctgtgttaggactgtatgctctgaatgaaagagaacataatttcctagccagaagtaggtccctctctggtcaggggtctaaaggtgttcattctttcatccttttctcttctttttgtccttgatggtaaa

SEQ ID NO: 2710 - DNA, 1101 bp, Homo sapiens
acatcagtgagaattctggtaggaattgcactgactaggtagattaatttggggaagtattgccatttaacagtgttaaattttctcatctagtaacatggtatcctttttcattcatttaaatcttatttaatttctttcagcattttagtttttagaatgtaacttttgcacttcatttgttgaatttattccacagtattttattattttttatgctattgtaaatggaactgttttcttaatttcattttcagactggtcatttcaagtatatagaaatgcaattgattttttatcctgctagtttgctgaactcatttattagttctaatagctgtttagtggatttcttaggactttctgtatacatgattatgtatctgtgaataaaaatagttttactttttcctttccaatttgggtaccttttatttctgtttctgtttcaattgctttggctagaacctccagtctaatgttgaatgaaactgatgagagcagatatctgtgtctttctttatttttgagacagagtctcactctgttgcccaggctgtaatgcagtggtgtgatcttggctcactgcaatctccacctcccagattgatgcaattctcctgcctcagccttctgagtagctggaattacagttgtgcaccaccaggcccagctaatttttgtgttttttagtagagatggggtttcactatgttgaccaggctggtctcgaactcctgacctcaggtgatccacccgcctcagctacccaaagggctgggattacaggtatgagacactgcatccggccatgtgtctttcttcttatttgagtgggaaggcatccattctttcactgttaaatataatatttgttatgggtttgcatacatacccttatcagggtgataaagttcacttctagccttaggtttgttgagcgctttaatatgaaagagtgtcacatattgtcaattttttttggtttgctttgggtttttttttcgaggatttttgctttatatttcattcacaataccaatttatgaatgttaaaccaaccttgtattcctataataagtctcagtctcacttagttat

SEQ ID NO: 2711 - DNA, 1085 bp, Homo sapiens
ccctggaatcagccaagtctccaaggagcaatggtttatcttatggaggatggtctttaaaaacagagatctagtgactaatggaattactccaaggtagattgccttcttattacctgtctttattcttgtcaccaaaagcaaaccaaattcagtaagagaaagttaatatttttaccttagagcatctatgtaacccaagctgtagaatttctggtgcttcaaaaagcgaggactaagtatccctttgttgggcctacccctgctgacactaagcatgactcttagctctgagtgctatattcagatgttgaccccaaacagctctggtttgaagggtttcatgcaagattcaccctaatacaatatacaagaggccaggtgcagtggctcacgcctgtaatcccagcattttgggaggctgaggtgggcagatcacctgaggtcggagtttccagaccagcctgggcaacatggtgaaatcctgtctctactaaaaatacaaaaattagctgggtatggtggcacacccttgtaatcccagctacttgggaggctgaggcacgaaaatcacttgaacctgggagatggaggttgcagtgagccgagatcgcaccattgcactccagcctgggtgacagagtgagaccctgtctaaaaaaaaaaaacaggctgggcgcagtggctcatgcctgtcatcccagaactttgggaggctgaggctggtggatcacgaggtcaggagatacagaccatcctggctaacatggtgaaaccccgtctctactaaaattacaaaaaattagccgggcgtggtggtgggcgcctgtaatcccagctactcaggaggctgaggcaggagaatggtgtgaacccggcaggcggagcttgcagtgagccgagatggtgccactgcactccagcctgggtgacagagtgagactctgtctcaaaaaagaaaaaaaaaaagactatatatgtgtgtgtgtgtgtgtgtgtgtgtgtgtgtgtgtgtgtgtgtgtgtgtgtgtatatatatataaaaccacaagaaactgtgagatacacagaaagagctcataacc

SEQ ID NO: 2712 - DNA, 1031 bp, Homo sapiens
gtgcccctgcactccagcctggcaacagagcgagactccatctcaaaataataaaataaaataaaataaaataaaataaaataaaataaaataaaataaagtaagtgacttgaacacaagtactgagatactgcaactgtctatctgatagcagatctggctactaagtgactaatgggcaggtagtgtatacaacatggatatgccggacaaaggggtgattcacatcctgggcaggatggcagagatcctctcgcactactcagaacagagcacaattttaaacctatgagccgtttctggaatttttccatttacgtcacaatgcctatgttatttatctcatctcatttcatctcatcacgcaggcatttaatcatctcgcatcatcacatggaagaagggtgagtacagtacaattagatattttgagagagagaatatattcacataaattttattataggatattattatatttgttctattttactattagttcttgttaatctctctctgtgcctagtgaataaattaaactttattataggtaagtatgtatgtgggaaaaaaacatagtagttgcaggattcggtactggccagtttcacccatccagtggggggtcttggaacatatccccatagataagggtgtctactgtagtggaatgatatcctctgatctgcttctccccattcaatctagacgcttaggcttcggtaaatcacacaaaagttcagaaacggcagacgaacactcagggggatgctcataataaaaattcggcaatggaaactatgcgatgtattgtcttactcacccctcctttgtatatctcgaagtcaggttcaaggcaagctacggaacctccttgctcatttaaaaaataaaaagaggctgaccctgtttatctcacaggcctaccctggtaaattttgcccaaatgaaattcaatttaagcctcaagttgccaaggagtcaccattctcctgggttggcaaaagggtttacttatagaatccttgatg

SEQ ID NO: 2713 - DNA, 1027 bp, Homo sapiens
tgcactaaaggttggcttccccaggctctggtgagatgctgttcatgaacaagaaaggagctcatgcccacggccctgagcagcctgggagactaggaatagagccgttttgtccactgcggtggagagggctgctgcagtgaatgactgagacctctggaaagggtttcggggtgcagagcagcctgttggaattagacgttatgcttgctcaaaaaaaggagtttcattttcattaaatggaaatatttactgcccaggggcatttggtgaaaaacagtttggtattgggaagtggggtcaggctctgtgcctttgataaaactcatgccagcctcaaaaaaaaaacgcatgatgtgtcgctatatggggggaccctatggttggaggtcttacaaatccaatggggccagtgtattaaatatggcccttttcccatagagttggtcatcatgatgtttaccatgtttcagattcaaggtatctgatctcaccagggtcacatggccaaatatgtaactctcattaaaagattgagttatatagtcagtatggggaaatctctattcactctggtgaactgtgacatattttatttatcatttttaattatatatatttaaggtgtacaacatgatgttttgatatgcatatacatagtgaaatgattattacagtcaagcaaattaacatatccgtcacctcactcagttaccttttcttatggtcagagcacctaaaatctgctttcttagaacctgttcggtataggcacaatattattaacttatcatcctcatgctgtactttagacctctagatttcttcatcctatctaactgcaactctgtaccctttaagctacgtccctactctttgtaccctttgtccctactctccctgactctacctctgggaaccactgttctctctgcttctatgagtttgactcttttcttttcttttctttttttttttttttttgagataaaggctcactcttgtggcccaggctggagtgcagtgg

SEQ ID NO: 2714 - DNA, 1031 bp, Homo sapiens
tctatgtgggcacgtggacagatgtggatgacaattgttgttcttgaccctaaggaactcacaactgagtgggagacagtctcctattaaaaaaaaaattatatatatatatatatatatatatatatatatatatatggaggaaatggggcgagagctgagggcagactggcttggctgtagtttggctgtgaagacagggcacagtagatcttgggactccaaattcagctgaaggccagatgggaaggacttggggtgcccgatcaaggagttggggctttattctccaggcaagtggagcctccagaagtttttagtataatcagagctgctttcaaaagtaggattcatggtactaattatgtaactggctacagcatacggtcccatttcacataagaggtggaatgactgtcaggtgtttgtttgttgggggacaggatgcctagttcctgagcagtagcaagaactttgagtgtgaatcctgaagtattataaaacttgttgaactgtcaactttttgagactacatcacactcttctgttgataaaaagcactttaattgtcattttcaccaaactcaagtgttctgaaaacatgggaaatatcttcttttcaggaaatatttgtacaacttttcaggcacagtggtaaatgctaaggcattgccaagggagccctaattagcgatgcccagcatctccctgccttcctgctgtcaggcctcacatttcagaaagctgatgcatttcttaccctgaaccccagacacattccagcctgttgttcctatcaacagttgttctttatagagtaaggcccctttggaaacaaggtgacagggcccctcatcctaggagagagatagtgcttcattcgttccacaaaatctttccagcaccttctctgtctcaggtgctgttctaggaactgaggatacagcagtgacaagagcaagtggaaatgccctttaccttcacccttcctcctacctcatagcagtctcatttcctgtctgatttcttcg

SEQ ID NO: 2715 - DNA, 1047 bp, Homo sapiens
caagtcactattgggggtttccatcactttgagtatttgtcatttttatgcattgatatcatttcatgtcctctcttctcattagtttgaaatacacaaaatattgtttgctaagcatcgtcaccctagtctttttccttagtactcttttcttctatctaactgtatgtttgtccccattaaccaacttcacttcactcctaccctctaccaccacctacctttcccagtctctggtactattattctgttctctgtgtccttgagatcaagtgtttttagctcctgcatgagtgagaacatgcagtatttctctttctgtgcctggattatttcaattaacagaatgacctccagttccatccatgttgctgcaaatgacatgatttcattcctttttacagcggaatggtattccattgtgtatatatgccacattttctttatccatttgtccattgatggacacataagttgattccatatcttggctgttgtgaatagtgctgtgataaacatgtgagtgcaggtatccctttgagatactgatttattttcctttggataaatacccagcaatgggattgcttcctgctatgggatttgagaacctacatctgtttcagttactattactctttaacaaactaatctgaaccttaatggcattaacaactcctttgttggcatcaagggatggcttttcccctgctccatgatgcttagagcgtgtgctggagggggcaactcaacagctgggggctaggcacatctgttgtcttcctccaatgtctggaagttgatgctggttgtcatgggccacctaagctggagctgtcaacctgagggtctacacttggcctcttctgatggcctgggcttcctcacaggagggtggtccgtggtaatcacactgcgttcatggttgcagctcagagccccagagggatcagtggacacacagcagaaactccattccttttaggacctagcctcaaagtcacatagtgtcacttccaccatagtttatgtcaaggcagttacgag

SEQ ID NO: 2716 - DNA, 1092 bp, Homo sapiens
ctgttctcaacacagaacagtccttgagacagaagcctcctgtcactcccctactcaaacccctgtagtgcccccaccacatcactcaaaatgaaagccagagtctatgtaccccacatgatggaggccctgatccttctcctcccttctcagctgggtctctgtcccaggctccacccacactccagcctttcctcaggtcccctgccctttgtgtttgctcttcctccatggctcttcccatgacgtctgcaggcctcaccctcttactctgttcaggcctttgctcaaatatcaccccttcaggcttttcctgaccctacagctcagcagtcccactccctctctcctgcccagctctgtttttctctacaaggcataggagcattgacacactatttactctatatgtgtttgtttgctctctgtactaggatacatgaggagagggactttgttttattcactgctgtatcccacaacctagagtagtgcctggtgtagaatgagcactccatttctcaaacaacttaaatattttttaaagttctgcatattataaaaaaatacagtagaaaatgggcaaaagattttgacctgcatgtagaaaagacacaaatggccaacaaacatgaaaaaaaaatgctccacttatttagtagtcttggaactccaactaaaactaacagtttatgccttttgtgcccaccagaatggcagaactaacaaagcagacagtatcaggcgaggtgaggatgtgcaagttctgaacctacattcattgtcagtagaaggataaatatttactattccttttgaaaacacttttacatcatatccatacagtcttccatcatgtaacattggggatacattctgagaaatgtatccttagggatttcgttgttgtgtgaacatcatatagtgtacttacacaagcctcgacggtatagcctgctgcacacctaggctataatgggatagcctaattgttcgtaggctgcaaacctatgcagcgtgttacggtactgaatactgtagacaactgtaacacaatggtaagtatttttatatctagacatatctaaacat

SEQ ID NO: 2717 - DNA, 1151 bp, Homo sapiens
gagctgagagctgaagggctagcaggagttaactaaggaaagagaaaaggaaaagacattccagacaaaaagactaacttgtcagaaagccctgtggcggaagggagcttttccaatatgaagaactgagcctggagagatgggatgagggggagtgtcgaaccttttaggctttgtaaaggagttttggttttctcctaatagcaatgggatatcttccaaggaatctcaatcaaaagggagagatggctccgattggaatgtcatccctggctgaagagtagaggaagcgaaaaaaagaagagttaaagaggcaaatgcagggaacccgacgaggaggctattgccgtagtagttcacatggtgaaaagaatggagcgtttgtattaatgattatggattcactctttgaacaaatttctggcagctttttagttttgaaagtgagaagtttcagactctcactgaggtattctgtagttttttcactctaaaaggaaactagtagagttcatgtaacacacactaatgcctctttacatttaactttagtatgtgatagctgaaatttccagctgtgataaattgggaaatcctttgatttaaaagaaaaacaaaggcgggtgagggtgagagtatatgccacggtgtgtagaatcctttagactcttaagaagacacaaggcggctgggcgtggtggctcacgcttgtaatcccagcactttgggaggccgaggcgggcggatcacgaggtcaggagatcgagaccatcctggctaacacggtgaaagcccgtctctactaaaaatacaaaaaaattagccgggcaaggtggcgggcgcctgtagtcccagctactcgggaggctgaggcaggagaatggcgtgaacccgggaggcggagtttgcagtgagacgagatcacgccactgcactccagcctgggcgacagagtgagacgctgtttcagaagaaagacacaaggcaagttggttgtcgatacctggaaaaattgaagttcttatgttttcataccactgaaaatgcttgtatgtaaatatcctctgggacaggaaattgacttaagtgagtattcttaaacatctctaagtgaggaaaggaaatattttttaaagcataattagtgtttt

SEQ ID NO: 2718 - DNA, 1031 bp, Homo sapiens
ttcggtcaaatgtgttttggaggctgtgagaaaatatacaaacgtgattcttgctcccaacttgtagttgagaaaagatagatactaacatttaaatagagaagtatatgagatccttttttaattctacttttaatgatgttcgataataatcttttagctaagccattattcttcctgttttgcatcttcttttcttacttcaatccctgataataaggtcacgtgtcagagatcaaatagtataggtaataggttacctaaataggtatttgcataataggttacctaactaaataggtttttgcctaataggtatgttgattatttcgcttacttgattctttatgagcctttttttccttgcgacgtctttggtattaattgttagtcaagatggatgtagaaattttccatatgggatgtttctctttgaattcatgttgttaaaatgatttcttttggtggagtgctgatcttttttatgattgtttcatatagataagaacagactacaaaaaaatatgcctttcaatcctgaagagtaacctgaactatacactagttttgtgctttaattttcatttgtaatctgccttcaataaagagttaagctagtggaatttatgtcttagcttgttataacacaaacacgaatatttgtctgcttggcattaaagggtaaagatattccatagctgggaatcttaatctgaggtacgtgtaaacattcagggactatatgatctctgagaatttgtatgttgtaagtctttgtggcagtgtatacatttgtgttgcaacttattaacacatacaccgggcttttttttttttttttagaagattcatagctttcatcatattctcaaaaggtttctgtgacccatgagatggtttacagtatggggaagcatcaaagcacttgcacagttgatggttatatgtgtgtgttattatttcagccacccattatcatgtgcttaccaactgcctaacagtgcatacatatgtagaagttttattctttt

SEQ ID NO: 2719 - DNA, 1071 bp, Homo sapiens
catactcatcttagtgctcatttaaaaaaggatatgtttactaattagtgtaatcagttaaatacagaggtatctttccaattctttggatgtgttttgacatttgccgtcaacaaattaagccttttgtggttgattaaaataggaaaagcttaatataagttatgtgactaagaaaacaacttaaaaaccaagacaacactttgaccaatataatcacttgaatgaagaattttctaattgagatataatttacataccacccatttaaagtgtacatttcagcagtttttagtgtattcacagggctgtgcaaccatcacaatttaattttataacattttgatccctgcgaaaagaaaccctgtactcattagcaattagtccctgttcctaaccactaatctactttctttctctgtagattggcttattctgaacatttcgtataaatggaatcatacaatatgtagtctcttgagattggcttctttcacttaacatgttttcaaggcttcatagctgtagaatcttgctttgtttttttgagactggagtcactctttcgcccaggctggagtgcagtggtgtgatctcagctcactgcaacctctgcctcccgggttcaagcagttctcctgcctcagcctcccaagtagccagaactacaggcacacaccaccatgctcggctaatctttgtagttttagtagagatggtgtgaaggctggtctcgaactcctgacctcatgatctacccacctcagctaatttttcatatttttagtagagacaaggttttgccatgttgcccaggctggtctcgaactcctgggcttaagctatccgcccgcctcagcctcccaaagtgctgggattacaggcgtgaactaccgtgcccagcaacagaatcttctttttaaaccagactaggtgtcttttcacaaacaccctgcaatacaaattcctttgcagtttgacactgaaagatgattagtttcatgtgatctttatgtttctcctttttgacagattagctttgaagtttaaatccaatggagaagactcaag

SEQ ID NO: 2720 - DNA, 1030 bp, Homo sapiens
taggccgggtgcggtggctcacgcttgtaaccccagcactttgggaggccgaggcgggcggatcatgaggtcaggagatcgggaccatcctgtctaacacggtgaaaccccgtctctactaaaaatacaaaaaattagctgggcgtggtggtgggcgcttgtagtcccagctacttgggaggctgaggcaggagaatggcgtgaactcgggaggcaaagcgtgcagtgagccaagatggcgccactgcactccagcgtgggcgacaaagcaagactccgcttcaaaaaaaaaaaaaaaaaagtaaattaaaataaattaaataaattaaaataattaaaataaattaaaataaattaaaataaaattgtagcattgtataaatgagttagcactaaagataaaatatatacaatttaagacagtattataacgattaagaaaaaatctgagtataaattctgatagttcagaggaaggcaagagaggatccagcaccgtgagaatgtcattaatattgggagaaattctcaatttattgagactgaaagtcacctatgagtatcaatttaatgaggaagttggaagaatttgatgcagtttcctgtgtcacatcatggctccaataggaatatattatttagctagtgactgctgcaacaaaccaaagatcacaccagtaattcccagctggcttggaatgtcatagcatatatggacaattaatgtttcctgacttactggatctgttctttcagcccatcttgcacacaactgccagattaatattactgctttttatgttgaatacctctgttcaaaaatcctttgtaggacaaacaccttagcttcactgtcaaagctctctataatctgcttcccgtcttatctcccatcattccttaatagggtttacttcacctaaccctatctattcattcttaactaaagatatccagccaggtgcagtggctcaagcctgtaatcccagcattttgggaggccgaggcagaaagatcgctggaggccagg

SEQ ID NO: 2721 - DNA, 1045 bp, Homo sapiens
tgatggacacttgggttgcttccacctcttgactaccaggaataatgctgctgtgaacttgtgcatataccgtggccttttagagatgtgaagtctgaggcacagaggtgctaattcacttctccaaagccaaaggagatggtggaattgggatttgaacccaggtggtctggttccagattctgtgttcttagacattatgtatgcggattcttttcatgaatagaaagcacaagattctctacacttaacaaatggctgccggaagtatctggtcatgctgaagctgggtgcgctctctaggaagtaccttagggaggcttttacatgtgagtgcgagaagcactccatagcatgtacttctgcgtggttgggaacaatctaaatgtcagcagaagagtatgtacattccttgtggtctgttcatataacaaacgctgtaaggtgtgaagatgaatgtcctggagctccatgtgtcaccgtagtgaaatctcaccactgaacaatagactgttgaggaaaaagtcaggtgcagaaggctctgcggagtagaataccatttatatcaagtttcagaatattaaaaaatgctgtaattgtttagggatatggaaatatatggtaaaaatattaagaaatgcttaagattaaataaacaccaaatgtagtataaggccctggggagggccgggcgtggtggctcacgcctgtaatcccagcactttgggaggcggaggtgggtggatcacttgaggtcaggagttcgagaccagtctggccaacatggtgaaaccccgtctctactaaaaacacaaaaattagccaggtgtggtagcaagcgcctgtaatcccagctactggggaggctgaggcaggagaatcacctgaacctgggagggagaggttgcagtgagtctagattgtgccactgcactccagcctgggcaacacaacgagactctggctaaaaagcaaaaagaaaagtttacctctgggagtagagggagaattgtgtttggagagggccccagaggacttcagttgc

SEQ ID NO: 2722 - DNA, 1031 bp, Homo sapiens
tgtgctcctctcccagatggcgttcccccatttccctcagctctctgctcagatgccctcttagaggaggtggtcttccctgggcactgcatatagaacagccacacacctttcctgcatgccctgctctgtccctgagcacagacaggcctgcctgtgacacactgttgaggcccctgtgtcgtgatcgtctctccccgatgacactctgctttgctcactgcgatgctcctggccctaaataattacttgcagaatagacgagtgcattgaataatttccacacatacacatattagatgagagtgtagctcctccagtagctggcccggtcctgctgcaagctcctctgtctttctctgcggggacctggctaagctgtgccccttcctgatggtgctgcacctgcacctagcccctcacctccacttgtgttgtctgtcggctttgcttttccagccccactgtgttatcctctctgaatccctgtatcaggggcagttggagtgatactgttacaactgcttccaggctaccggacaccctctcaattcctaagtcatgcgcttttgcacatgtgtcccaagttgacccctcttctctgccctgtagatgctatttatctggagattcctatggtaatggtgccccatagaaggtcatgtgctggggtgaggcttgtgtgtataccttaggtgcttcagaaatcaaagttaccctcactgcttttcccctctccttttgttggatagtgctaggatggtttagcgttatgacatttggttctttgtcatttgattgtagatgtttgtctcaagttttgagtatataacaatgaacttttaatttatttttagttttttgagacagtctcactctgtcacccaggctggagtgcagtggcgcagtctccactcactgcaacctccgcctcccgggctctagagtttctcttgccttaacctcctgagtagctggaattacgagcgcgtgccaccacacctggttaatttctgtatttttagtagaat

SEQ ID NO: 2723 - DNA, 1045 bp, Homo sapiens
tcataaatatataatgaaaactttaaaaaatgtataattaaaaaaataatgaaagaagaaataattgttgagaaatttatgaaaggatatgaaaaattagcatatcctttacaaacccagattggcatttagaattgaggaaaggtgtgtaacatcaatttacttattttggttaagcaaattctatcaaataataatatgtgcagttagtatctcctgttccacctcgtagctgctttacctaaaccatgcattgacacgtacctccaaggcctcaaagtgcccacagtgtgtgctcccacagcattaaaatgcacccccttaacattttatttatcaccccccaccactattccaggcctgaaacagtcttatgaactgtccgtgaggcacttgtttgctgaaacagtaactgagctgaattcttgtggtggttcctatgaacacccgggaagaaacagccagcagaggccgcctgagcctgaaccgagtttctcttccaggtgctgcggtgtgtcgcggggtgcccaggcctggaggaactctaccttgagtctaacaacattttcatttccgaaaggtaactagcacttacttaaatgcatctatccccatttaatcatcattctgagtaaataaatggtctcaattatatctaaccttaatttttagaaggatttgcaaacaagaattaggaaaaatgcttattattcattgccttcacaaattagaatttcactaattggttctaatcaaaggaaactcatcagaattaaatatttgtgaagacatgagttatattagttttgcatcagtgtattaacttgctgtttcttttttttctttttctttttttgagacagagtctcactctgtcgcccaggctggagtgcagtggcgatcttggctcactgtaacctccgcctcctgagttcaagcgattcttctgcctcagcctcccgagtagctgggattataggtgcctgccaccatgcccggctaattttctttatttttagtagagacggggtttcaccatctttta

SEQ ID NO: 2724 - DNA, 1032 bp, Homo sapiens
ccatggctgaaaggggccaacgtagagctcgggctgtggcttcagagggtggaagccccaagccttggcagcttccatgtgttattgagcctgcaggtgcacagaagtcaaggtctgaggtttgggaacctccgcctagattccagaagatgtatggaaatgcctggatgcccaggcaaaagtttgctgtgggggtggggccctcatggagaagctctgctagggcagtgcagaagggaaatgtggggtcggagcccccacacagagtccctactggggcactgtctagcggagctgtgagaagagggccactgtcctccagacctcagaatggtatatccaccgacagcttgcactgcgctcctggaaaagccacagacactcaacaccagcccgtgaaagcagccgggagagaggctgtaccctgcaaagccacaggggtggagctgcccaagaccatgggaacccacctcttgcatcactgtgacctggatgtgagacttggagtcaaaggagatcatattggagctttaaactttgactgacctgctggatttcagacttgcatgggccctgtaaccactttgttttggccactttctcccacttggaacggctgtatttacccaatgcctgtatctccattgtatctaggaagtaactagcttgctttcgattttacaggctcataggcagaagggacttgccttatcacagatgaaactttggactgtggacttttgggttaatgctgaaatgagttaagacttttggggactgttgggaaggcatgattggttttgaaatgtgaggacgtgagattaggaggggccagggatggaatgatatggtttggctgtgtccccctccaaatctcaacttgaattgtatctcccggaattcccatgtgttgtgggagggacctgggaggaagtaattgaatcacgggggccggtctttcttgtactattcttgtgatagtgaataagtctcaggagatctgatgggtttatcaggggtttccgcttttgc

SEQ ID NO: 2725 - DNA, 1044 bp, Homo sapiens
tctaccaggctcaggtggaacttcagcgtccactgtgaaatgatgttggtcccaaggagagcaatttaaagtacaggttgagtgtccctaatctgaaatgcttgggaccaaaaatatttcagatttcagatttttttggattttgaaatatttgcatatacaggccgggcacggtggctcactcctgtaatcccagaactttgggaggccgaagcaggtaggtcatttgaggtcaggagtttgagaccagtctggccaacatggtgaaaccccgtttctactaaaaatacagaaattagctgtgcgtggttgcaggtgcctgtaatcccagctactcaggaggctgagttgggagaatcgcttaagcctaaggggtggagattgcagtgtgtggagatcatgccactgcactccagcctgggcaacacagcgactctgtctcaaaaaaaaaaaaaaaaggaaaaagatatttttgtatacataatgagagatggggggattggatgggacacaaatctaacacgaaatgtatttatgtttcagatacaccttatacacatatcctgaaggcaactttatacaacattttaaataactcagcataaaacagttgtaactgtgttttgactgcaatccatcacatgaagtcaggtgtggaattctccagttgtggcatcaggttgattgatgctcagaaagtttcagattttggagcatttcggattttgaatttttgggttagggatggtcaacctgtataaagtacaagtagacagttccctctcttctccagtaacaagatagtagcctctcctctgcatctatagtctttgccctgcatccccccagccagaaatgtaggtcaaagcatgagtgaagatgggcataggaggagaacattctgtctgatcggaccgtggaactgattttatcttggaagcagttgaggctggggtaattagatgtcttctagaggtggaatataaaagcactggtcagaaaggaaattgtttaaaaagctttcaacctctgagcacggggact

SEQ ID NO: 2726 - DNA, 1043 bp, Homo sapiens
tttgtcccagaggggcacctgccagatgccagccagagctctcctgtatgaggtgtctgtcagcccctactgggaggtatctcccagtcaggatacatgggggtcatcgacccactgaaggcggcagtctgacccttagcagagcctgaacgctgtgctgagagatctccttctctcttcagagccatcaggcaggcacatttaagtctgctgaagctgtgcccacagctgccccttcccccaagtgctctgtcccagggagatgggggttttatctataagtccctgactggggctgctgcctttttttcagagatgccctgcccagagaggagaaatctggcagtctggccacagtggccttgctgagctgccatgggctctgcccagtttgaacttcccagcggctttgtttacactgtgagggtaaaaccacctactcaagcctcagcaatggcggatgtccctccccacaccaagcttgagtgtcccaggtcgacctcagactgcttctgtgctggcagcgaggatttcaaaccagtggatcttagtttgctgggctccgttggggtgggacctaccgagccagactacttggctccctggcttcagccccctttccaggggagtgaatggttctgtctcactggcgttccagatgccactggggtatggggaaaaaaaaaaaaacaaaaaacctcctgcagctggttcagtgtctgcccaaatggccgcccagttttgtgcttgaaacctagggccctggagaggtaggcaccagagggaatctcctggtctgcgggttgtgaagactgtcggaaaagtgcagtatctgggccggagtgcacagttcctcaggttcagtccctcatggcttcccttgggtaggggagaaaattccctgactccttgcacttctcgatcgaggcgacaccccaccctgcttcggctcaccctccgtgagctgcacccaccgtccaagcagtcccagtgagaagaaccaggtacctcagttggaaatgcagaaatcacccaccttctgt

SEQ ID NO: 2727 - DNA, 1033 bp, Homo sapiens
tcttttgggtagataccagcagtgggattgctggatcatgtggtagctcaatttttatttttgaggaactgccaaactgttctccatagtggttgtactaatatacattctcaccaacagtgttcaagggttcccttttctccacatccttgccagcgtttgttactgccttttagatataagcgattataactgcagtgaggtaatatctcactgtagttttgatttgcatttctctgatgatcattgatgaacactttttgatatgcctgtttgccatctgtatgttgcctttcgagaaatgtctgttcaaatcttttgcccatttttaattttgattactacaccttttcctaatattctggttgttaatcccttgtcagatgggtagtttgcaaatattttctcccattctgtgggttgtcttgactttgttgtttcttttactgtgcaaaagcttttaacttgatatgatcctatttttccattttgctttggttgcttgtaggatattgctcatgaattcatttatttttatttttatttatttttgagatggagtcttgctctgttgcccaggctggagtacagtagcatgatcttggcttactgcaatctctgctttctgggttcaagtgattctcctgcgtcagcctcctgagtagctgggactacaggcatgagctaccacacccagctaatttttgtatttttggtatagatgggtcttcaccgtgttggccagcctggtctcgaactcctgacctcaagtcatccacctgcctcagcctcccaaagtgctgggattacaggcatgagccactgtgcgtggccaagaattaatattatttttaaatttttgtcttaatttcaaaagtttttggggaataggtagtgtttggtcacatggaaaagttgtttagtggtgactgctgagattttggtgcacccattaccttagcattgtacactgtacccaatgtgtagtcttttatccctcaccctcttccacccttcccccaggtccccaatt

SEQ ID NO: 2728 - DNA, 1112 bp, Homo sapiens
ggaatatctttttccacccctttaccttaagtttatgtgagtacttatgcattagttgagtctcttgaagacagcagatacttgatttgtggatttttacctagtctgccattctgtatcttttaaatggagcatttaggccatttacacccaacattagtattgagatgtgagactgttttattcatcatgccagttgttgcctgaatacttttttttttcattgttttataggcctggtgagatttatgctttaaggaggttctattctggtgtattttgaggttttgtttcaagaattagaactccttttagcatttcttgtagtgctggcttggtagtggcaaattcttagcatttggttgtctgaagactttgtatcttttccttcatttatgaagctttgttttgctggatacagaattcttggctgacaattattttgtttgaagaggctaaagataggaccccaatcccttctggcttatagggtttctcctgagaaatctgctgttaaacagcttttaaaattctttcctttgtcttgactttagataacctgactgtgcctgatcatctttttgcaattattttcccaggtgttctttgagcttcttgtatttggatgtctagatctctagtgaggccagggaagttttccttgattattccctcaaatatgttttccaaactttagatttctcttcatcttcaggaacaccaattattatgtttggccatttgacataatcacaaatttattggaggctctgttcattttgtaaattcttttttgtctttgtggattgggtaattgccttgtcttcaagttctgaagtcctttcttttctacttgattctattgttgaaactttacagtgaattttttatcctccaagtgcgtctttcatttccagaagttgtgacagttttttattatatctgtttctctggagacattttcatccatatctgtattttaaaaaagagtacttaagttggttttcacctttctctggtatctctttgagtagcttaataatcaaccttcttaattatttatctggcaattcaggtatttcttcttggtttggatccattgctggagagct

SEQ ID NO: 2729 - DNA, 1042 bp, Homo sapiens
gtcagagtccctgtacctgttgcccggttcctatgggccagggcactgatactacatgccttccgtgtggagttctgagattggctgcccaggtcattaattatgggttcagggttgtaagatctaaatccagtgactcagcaactcctaatgacatctacctggttcctccaagtctggattctctacctctagtccttgagctatggctggaccctgtcttctgttttctcaaactgattaacatcttgctaatactaattctctagctccaaacctggtctgcccttttggaccttggatgtcctaccactcaaaatattagactatgtccagaacagattttctgcccctgaacttaagtggagatcagatgcctataagattcccaaaattgccccctttttctattgattcctgttactatgaccttttccccatgaatcgcgctaacctacaacagtccctccagtctcttggcaggcccaagttacagtgctccttgaacggattaactgcattaatggattagcatgcatttatcctaaacaaatagtgctttaccagggccattaaatatgtgtaacttagtatcctttgagtgctatctccttggtgaattcactagccaagagtctgggctccaggtttgcaggtttaagctcattaaagggaacagaacacacacccatttggaggtatattctatgaaggaaagccatagcagaagttaaatgataccagaatgttgcttggaatgttaactccgctctgaccagtgttaggggaatgactttaattgattaatagcatcaatctatgacaatctgatggcattgtcaagacaacactaagattcattcatgttgaggacaccttctgcactagatgggtgtctagttggccatttccctttggttgatgtattttttcttttggtgcattctcactacaatctaggtaggttataatgtcttaagttatatgatggcaggaatgtttgtctgttttgttcactgctatagtcccagctcctataaca

SEQ ID NO: 2730 - DNA, 1045 bp, Homo sapiens
atgagaaacatcctttcacatacatgtaacacatatactttaattttttcatcaacagaaaaaacaccttggatctgcctattcctaaattctaattcaatgaacaatgaggacattttaataaaaagcttggactcagtggaaaaaataaaggttagtaatggcttcaaaagagaagacaacacatatacctgtaattttccccataatctgcatttgtcacatccaacacagtccattatacgggagatattcttgaaatgtaatcggaattcctcctagcaagcagaaaatattttcagtctaattagacttttaaaattgaaccgcatttggctaaacgataagtaagttttgatgcttattaataaatcagttgtgttttttgtttgtttgagaaggagttttgctttgtcgcccaggctggagtgcagtggtgccatctcggcttagtgcaacctccacctcccaggttcaagggattctcctgtctcctcagcctcccaagtagcttagattataggcgcatgccgccatgcccagctaatttttgtatttttagtagagacggggtttcgccatgttgtccaggctggtcttgaactcctggcctcaaatgatctgcccacctcgacctcccaaagtgctgggattacggtgtaagccaccatacccaacccgagttgtgtttttcaacagtaaagaaaaatacttgatacttgtatactataacatggtacataaaatactgacattaatggaaattaataaaattcattctgcatattaattcactttccactgaggagctactttatgcaaagcaccaaaatatgcactatgggagatacaaaagtaaataatacatggtctttacttttaaggaacttaattgctgcttccatttgttatctacatacaaccaacaataaatatgtctagtttatgtttcacttatttttgatcctttgctttgtgtaagcctatatcagaaagctagtcctagaacaatgatcaatttttgtatcactccttagtaccacac

SEQ ID NO: 2731 - DNA, 1034 bp, Homo sapiens
ttacaggcacctgccatcatgcccggctaatttttttgtatttttagttgacacggggtttcaccatgttggccaggctggtcttgaactcctgacctcagatgatccacccaccttggcctcccaaagtgctgggattacaggcgtgagccacagcacccggcctctcccgaccctctatcagtcgttccttcttcccccaccccctccagttacttgaaacagttctcttcatagatgctgttccacactctccatgcagaggtccctttatagccagtgtaacgctctgggttcagcaataggtctacatactgagcagctggagatctctcatctgaacaagaaaaaattcataaaaaccatccatatttcaccatttatctaagatttaacagtacaaagcaaaccggactactcaaaggtaagaaaaatgtcatgcttttcaagtaatctccaacttaaatggtatagtggttagtatacttgtgactgtacttgatgcaagatttgtaataacttggacaaattccttaagagaagaaaaaacaactcttccatttcctttggatacgcagtgctcttttaagtaatataacatccccttcaccttattagagacatgaatcatttcttaagttttaaccacccaggattgaaaagaccaaacagaatcataacctgctttaatatttcatatgatttcttctctaagaatatatccacctaaccacgcacttggaaacattttgtaacatatattgtattaaaaatagagatttccctgctactctctgcttggactcatgaagtaaacggctccataactttgtgatccaaatctgattattcataaagctataccatgctctagtttttaaaagttatatattactatttttactgatgtcaacatattgaagtgttttttttgctctcaaactaaaacatagtaggcacaactttcacaaacttgttgaaatatttaaaactaaataaccattttccatattgaaacccaaatgagtatttac

SEQ ID NO: 2732 - DNA, 1046 bp, Homo sapiens
tacaactgccttggaaaattatttggtattatttctaatgttgagataggcatgccttatggttcagcaatcctgcctttacaggtagacctagagaaactcttacatgtgtgcacaatgagacaaaggacaaaaatgctagtgcattactgtttgaaatagccaaaaattgggaacaactgaaatgtccatcaatagaggaatggctaatatgtgttatagtcatacaactgactacagctattaagatgatgagcaaaatccacatataccaacagagaaaatttcaaaagtgtaagactgagtaaaagcacaaactgaaaaaaagtttgtaacctaaagaaatagaaaaatattattaatattatttaaattaaaaaaaatttacacacaataaattacatattacttgtggatacacatgcaataaaagtgtaaaatatattacttgtagatacacctgcaataagaatataaaatcacaggatacttcagaaaaatggttagctctgggaggaaggaattagaacgaactgggaaatggctgagggggtttcaactgcttttatatggttttatttatttcagatctgaagcaaaaataaatacaataaagtaaaaacaaaagattacacgggagagagagcaagaagaaaacgcaaaggaggcacaagaaggagacagagagagagggtatgatgatctttattatggatgcgcagtagtgaaaaacaggaaataaacggttctctaaaaacatatcaatggcaaaatataatactctcataaaaggacaagaacaataattaaaaatgaatatcttaataccatctgaaagtactctgctcaaaatatcttgataattatttactctatacaatataattctgaacctgccaggctaactagttgaaacagaagactaaaaatagctatgtgataaaacacctgctgactaggggatctgacactatagttacatttaatagttgttccagagattccaaaaacagtactgaagcaatttcaaaagaatctagaaatgt

SEQ ID NO: 2733 - DNA, 1032 bp, Homo sapiens
taaaaactacccctgaaaaataaggtatggaaaaaatgtaccccagcataataaaggtcatatacccacagctaacatcatactcagtggtgaaaactgaaaagcttttcctctaagattagaaacaagacaagaacgcccactcttgccacttctattcaacatagtactggaagttctagtcagagcaataaggcaagaaaaagaaataaaagacatctatatagaaaaagaaatgagaatgtctgtttgctgatgacatgatctcatagagagaaaactttaaagactccaccaaaaaatctagtaataaactggtgataaattctgcaaagttgcaggttacgatgtcagcatacaaaagtccatagcatttctatacactaacaatgaacaatcccccccaaaattgagagatcatatttacagtaacatcaagaaatgaaatagttgtaactttaaccaaggaggtgaaagatctatgcactaaaaactaaaacactaatgaaagaaactgaagacataaataagtggaaagacatcccatattcactgattggaagaattaaattgttaaaatgtccatatcacctaaagtgatctacagattcaatacaattcctatcaaaattcctatatcatttctttacagatacataaaaaacaatacggccagacacagcagctcacatctgtaatcccagcactttaggaagcagaggtgggaggatcagttgaggtcagtacaaggttttcaaggctacagtgagctatgattgtgccactgcactccagcccaggcaacagagcaaggctctgtctcaaaaacaaaaacaaaaacaaacaaacaaaaaaagaacaatcctaaaatttgtatggatccagaaatgactctgaatagccaaagcaatcatgagcaaaaaatccaaaggtggactcattgcacactgtgattgcaaaatatattacaaagctactgtaatcaaaacagcatggtactggcataaaaatagacacatcaaccaatggaac

SEQ ID NO: 2734 - DNA, 1026 bp, Homo sapiens
cggggtttcaccgtgttagccaggatggtctcgatctcctgacttcatgatccacctgcctcggcctcccaaagtgctgggattacaggcgtgagccaccgcgcccggcctcttttctttttttctgagtcttgctctgtcacccaggctagagtgcagtggcatgatctcgactcactgcaacctttgcctcccaggctcaagcaattctctcacttcagcctcctgagtagctgggactacaggcgaccaccaccacacccagctaatttttgtatttttagtagaaatggggtttcaccatgttggccaggctggtctcgaactcctgacctcaagcgatccatccacctcggcctcctaaagtgttgggattacaggcgtgagccaccgcacccagccaaagtaaggtagactaatgctacccttaagaagtctgaggaacttgaacttaaatatagatgctgtttgggggtgccttttagaacaacgtgttaattaaatgtagaagtagttcagtttgaacacgtgaagagaaaacaaacaagtactaggaaatcactaaataattcaaaagtagaaaggtctgtcctaaaactaggaagccaatatgttgtatttgatatgatttcctacctcacggattgataatgatgccatgtgaagagttgtccctgttcccacgggaaactcctcatcctcccacctgtgtggtttgctctgtgttctcatcccgcttgttcaataaatacactccccgcccccgctccccaagccttgacagagaccctcttgggaatcttctgttacagtaaactaaaaaccaacctgccctcccctcccagtcatggcaagaatacaatggtaacaactctccaaaacattttttaatcttttgtgcataagaggatagaggggacggagaggactatgaccatgggagcatttggaaagccacctgagaaaagtcgctgttaaattcaagttctttgccagtgtttcaagaggccgaggcaggaggaccac

SEQ ID NO: 2735 - DNA, 1062 bp, Homo sapiens
gatgctattgacaagatcaatagagaattcaggaagaagaccatcagatgtgtgtgtgttgttaggattgagttttctttgttggttggttcagaaagaggagataaaggtgtgtggagtttggggtatgtgagatttgttgtgccagtgagactgcttgtgtagatgacacagcactaggtactgtgcttaggattcatgcattgggaggttatagttgaagccctaggcatggatgagactgtcaaggaaaatcgtccttataggaaagcggagaggttaaccaagatgaaaccttgaggaacacttactcttggaggtcagaggaagaaaggagctcagaggtaactagaggaatagccagagaagaaaaccatctgtgctcaaggcaacgattctttccttcatagcactgatcctagttcatagtcacatgtttgctgactatttcattgtcttcacccattgattaggctatgccccttgagggcagggactcctgtgtctttttgctcataattgtatcttcaatgcctactacatagtaggtcccaataactgtgtattgaataaagaaagggaaaagccaggggagggcatcgcttcacatgtcgaggaaggaatggtcaccaccctcaggaggcacagcgtggtcaagagggagacctaccaagatgtcattggatttacttgcaagagttaagaagtgagtatgagaatgtttatgcagttctatccagaaattcattaaggtagcaaagaaaaatattaaaatgttatttgaagatattggaaagtacagaaaaggcttcctttctacttttcaggatgagaaacttcaggattttagaaagaaaaaggatcagcaggagtggaggattaaaaataatagagagaagggggataatacgtgggatgttttcctatagaaggtagaggggattcattttcttagcaaatatttattgataacatatgtttggtagaaaacacacagcactagattttcctcaaggaatctgtaagctggcaaggaagtcaagatatatgcacacataattt

SEQ ID NO: 2736 - DNA, 1008 bp, Homo sapiens
aattctcttgtttccatagaccgcctttttcacatatatccatatatttatacattttgttgtaaactctagtctataggtatttttaattcacattgtatattacattctggaatgtacaaggaactaacacaaatcaataagaaaacaaattagctttagacattgaagaatctcccccaacccatcgtctattatttttgtctatggtgactttcgtttaacagaaatccttggtttttatgtaatcaaattcattgtgttttttttttttaaattaagaggttggtctttttgagtcttaagaagttccttttcattcgaagtcataaagttcttcccaataaattatacaataagtttgtcaggtttctgaaaaaccaaagcagatgtttttaaacagcttttgatctcttgcctatacggtggctcaacaaacaagatgccagaatttgcatgtgtggggctgggttgttttgtggtaaatagtgaactgtcttaaagtccaaaaacaaagcttattatttctggattgaaaagggaatacagtaagggccccatggaaaagtactaagactttttatgaaaatgaggggtggaggcactctgagtggttagatttgctcaacttgtgtgcactcgctcagtggaggagataggaagaaggacatgtaaataataggatattgattgatattgattaatcattttgccgatgccaaaggacatacttcactgtctgtggaaaagattgcctttttctccctaggaagtttgaataccttttaaatatgaaatttcatgtgcatgacctatttccccactgccacacctcatgctcacactaggcttatgattcagtcacccacttaagttcacgtgatgtcatttcagggagaattgcagctacatccttttgagaagaaagcgattcagctgggcatgtaggttagagtctttagttcttagtcttctcattcctcctgtgaaattatctacatttaacag

SEQ ID NO: 2737 - DNA, 1050 bp, Homo sapiens
agaggtccagttcttaacacatggtctcattttagtatcacagttctgatgatgaaggcagggctgatgtttcctcatcttgctgaagcatggagaggacttgtctaaaatcccatagctactaaggggagctggggctaaaacccagatttcttgggttttcacaccctgctactattagcttaagcctatcaaattctgagtgcttattggctgataggatagtcacatcatggagtgcctaaattaacactacatgtgaatttaccgtgtcgactatagcttgaaatggcgcccactgcctgatgcctaccagtctttctattatacatgcttcattaagccctaccttttctccacatttcccaagaagtgattttctttggttcttgaagtacttttgtacagatcattggagcttaacttcgttcctttatcaggaagtgttttatctcacctgcaagttcagtaaacacaattagcaagtgaggtggctttggaaaggaatagtacaccctgaaagaaacatagtgcccagaaactagatattggatattgcaaatttttcttttaggttactagagccaccttcctgaagcccacttggagaaagtcactcaaaatagttctgtgaccaccatttagccccagttctcatattgtatacttgagactctggacagtaagacgaggcagggttgtaagtttgcacccaataccagcttacaaatattcttacattactggtttgggttttaaattatctttgcctcttctttctcatcttccctcacttttttgtcatttcaattaaagaaatatttgccaagtactgaccttagtgttgctaggcatgagttccaaggagctcagatagcttagaaccagccccatttgacttgagcttttctcgcctcttagcacagaaggaatgggttggcgtcattatggtttgttttgagtaacatgtattcagtctgatatgctatagggagttgttgaaggtgtttgagcaggggaagcaactggtttaaaattgttgtataggaa

SEQ ID NO: 2738 - DNA, 1232 bp, Homo sapiens
atgagacagagaatatatgcaagtttggttttgaatattagattgaggggcaggtgggtagttgaggtagccatatccagtggacagtttaaaagctgggtctaagattggggccaggtgtttttgatatttagaaggtcattggtgactttagaaagtaatttcaggagagtggtggaggaggaagccatgtcagaaggataagaaatcggtggttgctgaggtggaactgtgggagtgggaagggctagatgagggagcagtgggaggtgttggtcatcatgcgcttttccttaggtacagaaagaagggaaatagagtgagccagactgcaagaggattttgaggtggagagggtgtgagtttgaggagcctccaacagaaaacttctttgtacgggattaggtgaaatcacttgtggagtgaggaggaaaaggatttggtgctaaaaaaaaaagtagaaattgggacagtagatgttggaagtattgagggaggtcaagaaaaggtgaaccaaaggaggctgaacgttgcaagttttcagtgactccagtcagcatagttttgtggctttccagtaggtcgtagaaaccagaaagcaggattagaaggagtaagcattgggcccttttctggactgggaattagaagtcaaggagcatggggagagttgagaagttcaagggtgttagccagttattatttcatagttgggcagaggtgagtaaaactctgtttgcaggccattattagttctggcaataggtgagggagaaggtcaaagctaatattttaaagaatagtttggaattattgatggttttcaattatctctgctaaatcattttatttagggagtatctgcacagaattaacaaggaaagagagcaaagtcttgtatcactggcccattattgcctgttttcctcatctgtaaaacaggagtagtgtagcctaccttcaccttggtttcgtgcttcaccaggaattttgtgctgtgtgcaatcttgtattaggcattgtcacgacttaatgacctttttgggcagcgttttcctatatagagttatgagtgcatcttttataaactccatttactccttattggagattattataaatttctctaaagctcctccctcacacatctttttcacctttcattctttgaagtcaaactttcactttctttaaagaaggtctgaagaaaaccctgcgggatgagatcaatg

SEQ ID NO: 2739 - DNA, 1174 bp, Homo sapiens
tcagaagttgaacaaatttggatactaggtttgtggtctattataaaatagcacacaatatcctcatttatcagaaggcagtccaaactatctagacatctgtattagtccattttcacactgctgataaaggcgtacaagactggacaatttacagaagaaagagaggtttaatggacttacagttccatgtggctggggaagcctcacaatcatggcagaaggcaaggaggagcaagtcacgtcttacacggatggtagcaggcaaagagaaagcttgtacagggaaactcccccttatataaccatcagatctcgtaagacttattcactcttataagaacagcacaggaaagacctgcccccatgattcaattaccctcaccaggtcccctctcacaacacgcgggaattcaagacgagatttgggtggggacacagccaaaccatatcaacatgttagcattatacatgttataaactaccatatataaacatacttatattgagatctgacaaaacatccaagtatctaggtcaatttctaagcatcaagactatagaaaacaaaaagcattaaaatatcagagctgaatagtcatgataccatgtctggtagtgcagtgggtggagatgatgagatcaagcaaatatggtttgtaggtttttggtttatggaactttgtgtgctgtgataccacactttttcactaggagttgttcataccaggcttatgtgttgttgatgctctctttggtctagacctgccagtggggagctaacttacccttgctcttgggctgtacaaggtgaagtacggtaagtcttcacttaacgtcattggcaggtttttgaaaactgcatctttaagcaaaatgatgcatagcaggccctcaaataatgtcatttccttcaacagaatttcattataatgttgattagaaagaaaatactggttttgttacatattgtctcagtcaaagttgcaatttctgagaacctgtcaacgatgttacaagaggactttgttgtgtaggcttctctgttggatatctgagcattatcttggcttactgcagcctccacctcctgggtttgagcgattatcctgtctcactctccccagtagctggggctacaggcgtgtgccatcacgcctggctaatttttata

SEQ ID NO: 2740 - DNA, 1053 bp, Homo sapiens
gttcacgccattctcctgcctcagcctcctgagtagctgggactacaggtgcctgccaccatgcccggctaattttttgtatttttagtagagacggggtttcacctcgttagccaggatggtcttggtctcctgacctcgtggtccgctcaccttggcctcccaaagtgctgggattacatgtgtgagccaccgcgcctggcctaaatgataattttaaaaatatcttgtaaataatttctgaaagctgtcagtagttaaatattgcttatctttggatcagcaactatttctttttgttttgtttcctctttaaaaagaggagttgttttaaatgtctgtgtgtatgtttgtgtatatctatatttatatctgtctgtatatatgtttgcttcttttacttagacattcacattctaatttggggacagtagagtagagcaattcttactggtcctgataaatttagtggagtagccacatttttctggttgatcaaagacatgatttattaaaactgataatgttaaagggagtgcgaatgactaaaacaaatctttaagagtaattattttggagttttagtgctttatgtctatgtaccctccctactgtgtgtgtgctgtagtaaaaacagatccactggacctaattctctcctctcctagcccctctgcttgtgcctgctccttcttgccaaaggtgaaatcctttttctgttcaaattttgagtaggaagcaaggattgtgtgtgtgtagatttgacagagtaaaagacatctgtggatgtggggaagatggaaggaagtttgctgtttgtatttgtgcaaactgtcatatagctccaggttcatgtctcagaaagtaaaaacaacacagccagtgcatagctgatgggcaggcacataaaaggtacagtttatagattaattttctgccttgttgagaaaactaaaaggcatgattgttgctgcacacttggaagtaggtatataattatatgtatagttatgttaaatagacttaattttatagttaaaattagttttgaaa

SEQ ID NO: 2741 - DNA, 1048 bp, Homo sapiens
tttacaataacagtataaagcagacactttactgtctttgtaaactcagaggcatatgggaagttgccccaaggttgttcattcaggtaagtgatttgaacccaaggccgtctgtacccagaacctgcctataaccatctaatgagactgcctctcctaatactttaaatgtaatgaatagaacaaaaacagttcagagccttttctgtagtgatactttacactgtatgtttttacttcagtgtgatatatccacatgtattatctgatatttgcccctaaattggccagtggcaggggagatgttattatgttggtggataaggaaacaggcaccagaagtccacctggcttacctagagtcagctcattagtgatagacctgccacagtgactcctgtctctcaggtctcaacctggatccctgattcagccttgttgattatgggttctaggcctctgaatcaaagaaatgaagtaatgttgtaaacacaccattggtgggattaaaaaagcttactccatatagctttaagctaacatctgagcagacagctgtggagcacccctctttcaattctaactttgtccatggtttttgcctcagcctcttggttaaataggggttgatgattatttttccttttttctcagagatggtatgatttggtcctttaggttatttgcaacataaaactctgaaatatttcttcttttgagagttatggttgtaaatgtagttgtaacaaatagcctttactgcatttgaatctccctagagacgactatggccctgtttccacattggatctcctatctgctcagatgggctatggtgcaggaacttctctttcttattgaatacatttgtgtctgtctgtctcatgtcatccatatgcatttgcagaaatttttcaaaatgcttctccttttaaggtctagagcccttcaggattggaccgtacaccaactttgttaacattggagagcgctgtaatgttgcaggatcaaggaagtttgctaaactcatcatggcaggaaactatga

SEQ ID NO: 2742 - DNA, 1035 bp, Homo sapiens
atgagaattgagtctcctcagatgtctggacagactaacaacccactttccatgtatgtgaaggaaaatcattggctctatttctaccataggcaagggaactcagtgaattctttcttataacaggaaggagagaacttttaggcttatcagattaagacaaaaatataaaacaagattaaatcaagagattatgtcagcttttacatttgttcttcaaaaggtgaaaattgattttcgtgtcagtcttttaaacatttttaaatgagttctaaaattaaaaaaaaaatcttaccttgtttttctgccgttaagtttgttatgagaagtgatttttttttttcccctcctgaggcagggttttgctctgtggcccaggctggagtgcagtggtgcaatcatagctcactgcaacctcaggcttctcccacttcggcttcctgagtagctgggaccacaggcacgcatcatttaaaaaaaatttttagtagagaggtcgggtcttgctgtgttcacaggctgattttgaactcctagtctcaatcaatcctcctgccttggcttcccaaagtggtaggattgcagttgtgagccattgtgcctggcaggaagtgatttttgaagttcttcttttttaaagaaacttcctagtgctctaagagttgcatttttcaggttgagctcttggtttttttattaggcttcagcagattcagcagatttaagttagagtctatggtaggtactgaattacatttgtccatctttcatttgtgtcttaaaactctttactaaaaagtcttgtcattcctctgggagtaaatattttgagaatttaaggtacaaagaagcaagacaacttgttcaaagttagttagaatcagaggtatagccaattgtttatcagcttagtattgggaagagggtagactcgccttgtaaggcccaatcaagtcaatggactattgaccctactttcctcatctctaaaatgggatcatcaaaccccctttgtgaattgtaaagatgcaagtg

SEQ ID NO: 2743 - DNA, 1038 bp, Homo sapiens
agccccttgggctagcccattaggtgggcctcctttgaactgtttgggcttcggtttccaggtctgtctttgaggtgctcttggttgtattgaattgctttctgtgctggcccctgcctggctctggagaactaggtgttccaccctaaacaaccctgccttgctgagctgcttggcttcctttccaggacccttaccagggcaccatcgtgctggccactgttaaaggcgacgtgcacgacataggcaagaacatagttggagtagtccttggctgcaataatttccggtaagttaggacctcacctctttcaaccccttttccatttaaaaatgaaagccttttaacagaataattcttcaatgggtgggaagagtagggcatggcagtggatgttagaggttattttttatttctttttgcttgctgtgtttttgaattttctacgtgaacacagcatttcaaatgaaataagttagtaattatccgtgttcaaaaaggacataaagaatagtaaaagctattcaagtggggtggaaaccgtccagaggattcctggggttggatgttgggacagaggtgctaatagccggaatatcaggctccttcccatggccagtggtgttcatcatatcctctttttcctttcaataaacttagattttagaaccgagatcttatgagaccttggctaaacagttttacaggaaggccttctctgtacaagtctcagttggctttgcttagagccaggaccctgtgttcttggtgattaagctagattttggaatgttgtatacaagtaaaacccctttctatcttattataattaataaatattcataacaaaatcatttgcatgtgagagctgatgacctgtagtaagtatgtgtttcgcttagatttgaacatattctttgtaatgaaaagcctgatggaaataatgctttcccatatccatgtccagccaacagtccttttgagtcatagacttctttccaatgtgccattttctctagatagagaagaaaattgac

SEQ ID NO: 2744 - DNA, 1074 bp, Homo sapiens
tgtgaagactgcgtattaagcctgaggctttcctgcaacaaacccagttgctatgtgttgggcactgagggtttgcgtatctttgctaataagtctaactggagaaacactttctgatgaaacgttactttcattttacaaaaacaagtgaatgtgcaaacttcatgtcaaacactcctttggcttgtgtgtgataacacatagactcttccattggtgagtttaattttatggtgtcagctagtagacaagtgtccctggagattgtcttatggaataatgtgtacttttactgtcagtaccaggctagtatgcttgaaggaattacctagcctagtgagtgagtctagcaacctatcctgtatctaatccttttctttcctggctttttatcattgttgcagtgaatctcaaaaatgataacaatgttttttctttgtggggataaaagaaataaagagggctaaaactgacagttctgtttagagagaaaatgtattttttaaatggggaagatatgatgcaatagaattgcaaatttgaggatttgaatagaactaaggatgtattcaccaagaatctagtattacctaccatttgtttaccacttcccaatttatacagttctttagtatcactgatttttttttctttgtcacctttttgttgttgtcattttggttcctttcctttcttttctttcatccttccttttcatggttttgatcctactaccctgcctgttattgtatttctccttttatagatgagaaaacttaggcttagagaacttgagagatttcatcatagtcacatggctagcaagtgtcatgggcaagcacattcagggcttttggttctaaaagctgggacttcgtaatatgtcaccttactttacaatattttttttgacttgagttgtaaacaagtataatgtctaatattgacacaggcataccttgttttattgtacctcactttattgagctttgcagatacagcattttgtaaaaatttgagttttgtggcaatcctgcatagaacatgtgtcttgatggcatttttccaatagca

SEQ ID NO: 2745 - DNA, 1024 bp, Homo sapiens
cattctctttcctgctggagagtggaactgggcctctgtcctacatgggttgaccagggctgtgagcaacttcctttgtgcatcccagtaccataagtgtcatttcagtgtgtggaaatagtgagaattgccctctaatcaatagtacatttgactatttccccagcaagacgactttgaaggcaggctaattagctggaaattgaacttgtcacccaggcctctggctcagtgttcttggtcgttttcttacctcactgatctgtggttatgattctctcctgctgatctctccttctgggagtggtctttaaacacagaaatgttctggggctcagcccttggacctcttctctgtcttcactgtctagatgtgtgtttctcaaactgtaatgtaccttcttgtcacctggggattttgttaaaagtcagattctgattagggtaagtctggactggaggttctgcatttccgacaaactctcagatagggctggtgctgctggtacaggagcacacctggagtaacaaggcctggggtgggctgaagtcgtctcattcgttttgtgacttcagtatcatctgatgtactgacaagtcccaaattgtatctccactgtggatctctcccccagactttagacttacatatccagtggactccctgacagctccatttggatatctaaagaaatctcaaatttaatattttgaaaactgaactaattgccaccattttgtgaacacctccccagctctcccctatttcaagaaatagcaacttcatttttcttgctgctcaaaccgaaactcttgcgtcatcctctcgtcagataacccgcatgtaacccatcagttctcctttcacagtatttccaggatctgaccacttctcactacctacactgcttcttgtctggatttttgcagcagcctaaccagtctctctgcttctctaccccggacttgtttcagtcccaagtaaatctgttaaatctaagtcagatttcttactccactgttc

SEQ ID NO: 2746 - DNA, 1059 bp, Homo sapiens
attccattgttgattggaggagcaaccacttcaaagtaagttatactaatgagctttgtcctcacttcaaattttcttatatgccagtgtttgaaacagtgggaaacctgtgttgttttggattttcccttatgtttagtacattgactttttgttatataaacacaaacattttctggtgttcacttgggtgagagccagaatactttcagagcatgctatagaaaactttttgtgattcctattctttgctttttcttggatttctttggcttgcaataatctttttcttaacactctcacttgcgattcagttcctgagaattataatgaactcttctcgtgaaattaaaccgagtggagaagctgtgttttttggcacaaaatcattacttgaacttttgcccactctgtcttgaagcaggtgtctgactgaatgattacaggttcctttgaaggaactctaaccttgtagtagtttggagacagaaagcccatctagcaagaatgaactaaatggtcactttggggagttcctgaaaggggagctttgtgggaacctttgggttaacaacataaagaggtataaaatgtaaagatgagaaagttcaaatttgttcacatgataattattcagtttaccagatttttcctgggatcatgatcatagtgatatgtggtaagtgctacgttaactgtgggtactagactttttatgccatgtacagttcactttctcagcattatcatactggaacattgaacacagtggtcccatagcatctagtttatttttctgatgcagaaatacaataaaggtctggttataggtatgccagaaatacaataaagatctgggtataggtatacaataaaggtctggttccataggtatgccacaataaaggtctggttataggtatgcaaaagaaaagtgttccttttgcactacaaacaactgtacttttagccaatttgtatagggttgttcagaggaacagaatcaataggatatgtttatatatagagagaaagagatttattttaaataattaactc

SEQ ID NO: 2747 - DNA, 1026 bp, Homo sapiens
aacaccttttcatttatatattgaccatttggatatgctttttaaatatttttaaaaattgggtattctgctttattcttattggtttgtacacattctttagtttatagtagttacaagtcctttatcagaaatacatatattgcaaatagattttttttcaatctggcttgccttttgctatcttagtgctgtctttggataacaaaagtcttaatttttataaagtccgatttatcagtctcttcatatatggttaatgccttttgcatccaaataagtaagtcatctcctaggagagccacctttgctagaaatagaaagcattcaggagttgaagtgtctcagaagcccatctgagagcccttatgatttcccacaaaccagtggaggacttagcagtagctcattagctcaggacttccacgttttcatgaaaacatcgctgaggggagataaccctatggcttttccagacatcagtgacttgcagtagcgtgagtagaactggaactgtacccccaagatactcgaaatgaaggttaaggctgtctagtgcaggagtgtccagtcttttggtttccccgggccacattggaagaattgtttcaggccacacataaaatacactaacactaacaatagctaatgaactgaaacaaaaaaaatctcataatgttttaagaaagtttatgaatttgtattgggccacattcaaagctgtcctgagctgcatgttggacaagcttagtctagtggatgaatcgatatttggagagattgaaagagttcaatagatttggggtctttggtccctgagcacacactgggcataaaacaggagggtctcaggaggccatggagttcattaatctgccccagggccatggtctggcctccctaccactctgtaccccagccttcccattccaaaagatggctcttgactcactggcttatgcctgaatgcccatcttccagctcagttctcatagcctaaggctttgtagtcctttgcttccgttt

SEQ ID NO: 2748 - DNA, 1030 bp, Homo sapiens
atgcagggatggggcagtgctatgtttattttttaactgatgtgatcagtagctgccgtttcttctttctatgtaattttattttgtgttttgatggtagctattcttctatcaacttgataatcataataacaaataatatttagctgatcctacttttacaatttaatgagtagacttcacattttctcagattattggtttcctttccaattttagcagaaagtcagtggactatgaagattagcctcattccctcagcaaacatttagtgagaatgcacctccagacactgggctaggcaccaggggcatgaaggtagtgaatgtgtgattgcagctctcatagggctttctagtaagggaagtggatatataaattggaactaaaaggctttggaaagtgcagtagtagatgaatagaatatctttgaaaccttgagttgggagtttcttaacccagagggttcccaagaccaccttcaggttcaaagtttcactagaaggacacagagaacccagaaacactgttatgaccatggtttattgttgtgaaaggatataggttaaaatcaggaaaggcaaaaggcacataggatggaatgcaggagagaccaggtacaggctttcaggagtcatctcccccatagagtaatctggatggtgcttatttcttccgctgatgatatgtgacaacatgtaaggagccttgccaacccagaagcttacctgagccttcacgtcctgggtttttattgggggttggtcacataggcccagaatgcccatgtgtctagccttaattgttcagtcttcagtccctgcagaggtcaaacataagcatgagcgaaggtcccccaccataaatcagactgttagcataaacgatgtgacgtggcccagggtgccaggtatacagtgactctcttatcaggcaggctgtcccaagggtttagagtttgtctcccagaaaccagtcaaaggccagtcccttctttggcttgtgcagggtttgaacatcccaagcccac

SEQ ID NO: 2749 - DNA, 1047 bp, Homo sapiens
taattctgtttttctaataggtggagaggccaggaaggtctacgatgatgcccacaatatgctgaacacactgattagtcaaaagaaactccgggcccggggtgtggttgggttctggccagcacagagtatccaagacgacattcacctgtacgcagaggctgctgtgccccaggctgcagagcccatagccaccttctatgggttaaggcaacaggtatggaaggtgtactgacagccagcacaccgctttcgcttgtgagtttaagcactacacaaaagagctttgcataaatgagggtctgcttcacctcctcccaaatgaccaatcacatgcccaagaagtgaccagtcacacgcccaagcccaagccatctgtgaggacgagggagagaaggcgccaccatgggtgtcagaggcaggaccactcagcaggagtgaggcgtttaatattgtgttccatggatgggcgaggaccattgctgctgtctcaggtggtcacgtgtcaggatctcagtcttcttagcttctgaagaaagagaacactcacttgttcaaaaacgtaggttaatatctatgcatattattaaaatagactgtcaggtggcttcccttgaaaggggaagacaggtggaaacaaacatttgcagaatgtataccaggtgccaggtgcatagtaaggtgcttgatggtcatgcttttaatttccacacagccgtgtgaggcagtttaagtttgtgttttacagagaagatgaaggatgatggagattgtgctgggccccccaatatagagaggagagcccagcctgtacatatccccagtggccgttctttgactgtgctggctttttttctttcgagtgacgagaacagactcttctcagcaacttgtctctcatcccccccacctttgaaaaggcaaatatcatatgcatgtccctttagctgctgtaaaaaagagtgtcttaatcaagaattggaaccagaattcaccagagtcattaacaaatttaataatttgcagaaaattactctgttttactgc

SEQ ID NO: 2750 - DNA, 1191 bp, Homo sapiens
accctatgtgataccaagttttattgtcaagacagtgtcatggtgcagaggtaggcattctgagcaggggaacaaaataagggcctagaaactcacccgtgcatatgttgacctttgcaaaatgacctggtgacatggcaagtcagtggggacaggaaggaccactccctaagtaatcccagaacaatggctattcatgtgggaaaaaaagaaattttactttctctcaccttacctggtgataagttccaaatatgttaagggctttaatacaaaaagcaaaaattgtcagtgtttggatgaaaaaagccttagggcaggaaagaatctcttgagacataaagtagtaatcataaaggacaagatggttaagtcaattctgttaaaactcaaggcttatattaagcaaacacttgaagtgagaagatgatccacaacttgagaagacatttataatacaaataactgatgaaggattcataatcacaaatatagagaattcctatttaaaaaaatagaaaaatagtgaagactacacaagaggaaatagggcttttaaataaatagatgttctgtagcattggtcagggaaatatgaattaggaccacaatgagattccattttatatccataagatttgcaaaggttgggtctgacagtaccagttgttagatctgtagggacttgtacaacattgtggatgtgtaaacaggcaccactgctttaaaaaacaattatcccttacagacttgaacatttgcagacgttatgatcttgcttccaactcccacctgtatgtccagcaaactcttgcatgtggccactaggaggaatgtgtaagaatgttcatagttacatatttataatagttaataactggaaaaagtgaaatgtatgtctgtctacaggaaaataggtgaataattagatatatatattcattctacgggatattattcagtagtggaaatgagtgaactacagctatacctcacaataagaatgaatctcagaaaatattaaggaaaaaagcaagtttgaagagaccacatggggcgtactatttttattgagcccaaaaacaagcaaaaccaaagaatatgtagtctaagcatacgtatacaataaaactatgctattaaaaaaaaagaaggtaactgataaaccaaaattgagcatagtaattaccc

SEQ ID NO: 2751 - DNA, 1552 bp, Homo sapiens
cctgggagttgcccctgacccctccagtcttagctcctgctcctgtaacaaaataccacaaactggttagcttatagagaacagatgtttatttcttacagttcaggagtctggaagtccaagatcatggtgccatcatggccgagttctggtgagggccctcttctgggatgcagcggccagcttctcatgttctcacagtgggtggagggtaagcttgctctctggcctcctcttaaaaaggcactaatcccattcatgagggctccaccttcatgacctaattacctcccaaagatgccatctccaaacaccatcattctggggattccatttcaacatgatttgggggatacatcagaccataacacttttctttttctcaaccttcacatccagttggttctcaagccctggcgattttacgcgctagataggtcttaagttcatctctacgcctgccctggttaaggttctcatcatttctcctctggattcatctgcaacacaggctgccgggttggttcccacctcctagagctggaagagtgggctctctgattctttacacccccgcctcaatcctcctgctgcctgaataaccatctccccgtgacctaggatatatcccagccccttagaggcatgcaaagccttccatgtctgaccctgcctcatgtcttggaagccctagactgctgctgtaccctgaaggaggtacctgctcacattggcccctctgtctggaataaccccaccccggttccacccaagtcaggaaagcttcccaacccctccctcccaccaccccaaagctaagtgaagtgacccctcttcttgcctctgtaacaccgccatgcacatttcatacagcccttgctgaaacttcatctagttctctgttagacttaacattccctaagggcaggtttggaaccttactcatctttatatggcgtctaaaatagtgcttgctttatgataggtgctcagtaaaggttgtcttgaattgagcagatcctctagggacaggagttggatggagagcagactgtaaagcctcatgagggcaggggccctgcctcttcctgagctcaggatacccagagcctagctcagtgcctgccatgaaattgttcactccatcaagccttgttaaatgagttcggggcggggggagcatgatggttttctctctctcagaaagaaagcgctgtatcaaagccctagcaccctctctacacccaccttcagtatttcatattagatgcggcccaagtgatactttctttaccgtcccgtgaagacagcatattggcagccctgcaaaaacaaaacaaaacaaaaccctcagttcatggcatacttgctataaatcagctatgtgtattgtcaaattgtagaactgaaagtatattctgattcggtgtgtgtataaggaaatatacaccagtatatgcattaaaacgtcaagaagagctgggcacagtgtcacatgcctgtaaacccagctattcaggaggctgaggtgggaggatcggttgaggccagg

SEQ ID NO: 2752 - DNA, 1034 bp, Homo sapiens
tacaggtgtgagccaccatgcccagcctatttatttattcattttaagatagggtcctgctctgttgcccaggctggagtgcagtggtgcaatctcggctcactgcaacctttgcctcctgggttcaagcaattctcctacctcagcctcccgagtagctgggattacaggagcgcgccaccacgcccggctaattttttgtatttttagtggagatgaggccttgccatgttggccaggtcggtttcaaactcctgacctcaggtgatccatctgccttggcctcccaagtgctgggattacaggcatgagccacagcgcctggcctgttcttacttttaaatcttgtactatgtacatctttctgagcttcatcaagtcctttctggaatgaggcaagatttatgagtgatacttcagatgaaacataatagatttaaacacttatttcagaaaggaataaagacttacgtgtcaatatgaaaaaatgaaggaagataaagcaatagattaaatcaaaagaatgtaggagagaaaacataaaaataagagcaaacactgattttttaaaaaacaacacatcctagaacaaagcccaaatttggtctttaaaagagactgataaaatagtcagctatctggtgagattggtaaagaaaaaaatggtaatattgaggtgagaaaaagggatataactatagatacaaccaaaattaaaagaagataagaaaatactgtgaacagctttatggtgataaatttggaaacttagacaaaatggataaattcttagaaaaatatgacctatagggaaactgtctcaaaaacagaaatagtaagactgactagctcaatatatatataaggaaaataaatgaaagtagtagttaaaattttttacccaaataaaacaccgtgcccagatgatttttacaggtaagttctaaaaagctttcaaggaacacattgttctaatcttagacttagttttctagagcataataaaagatcaaatattctccaactcattctat

SEQ ID NO: 2753 - DNA, 1024 bp, Homo sapiens
aatgggtaaacaattcatggaatattcataccctggaatactattcagcagtaaaaggaatgaaacaactgatctagacccaacagtatgaacaaatgtcaaactcactctgttgggcaaaagagcccaaatgtagaagaacacataatttcatgatttcattcatatgaagtacaagaataggctgaaataaagtcagatgcagtgacttacgcctgtaatctcagcactttgggaggccaaggtaggggaattgcttgaggccagaagttcaagaccagccagagcaacatagtgagaccctgcctctacaaaagttgaaaaaataaccaggcatggtggtgtgtgcctataattctagctactctgaaggctgaggcaggaggattacttgaggccaggagttcaaggctgcagtgagccatgattgtgccactgtactccaacctgggtgacagagctagaccctgtctctaagaaaaaaaaaaagaagaataggctgaagtgttctacagtgatagacttcagaacggttatctgtgggagttggggactgactggaagaggacataagagcaattttggggataatagaaatgttccatgtatcttggttgcagtaataattctatgaggtatatatttatcaaacctcaatgaattgtacacctaagatatctgcattgcactttatgcaaatttaacctcaagaagaaaaataatttcaacaatatcgaactctagttaataggcttgcttttctcagtggcttggcttagcaattctaaaactattgtagatatttctctctgttggaggaagtagttacaaacatggaaaggagaaaagaccattgccaaagccagcattctctggtatttctttaatccgaatttcttaaaaaattctagaatttggaaacattttggacaaatgggaattcattgtaaaaatagattagaatcttaatacttacatctttgatatgtcagttctcacttaacattaatttcaagaccatatc

SEQ ID NO: 2754 - DNA, 1709 bp, Homo sapiens
ggcgaagacgagatccagttcctgcgaactgtaagcgccgtgcgtcgcgtgtgctgtcaggggaagggggcgtcagggcatccactagcggggtccgggcagagtgacagcgggcagcggggactcgcgggcggggcgagggggtgccccctgaggatgcgggaggagcgggcatcaccaagtgtgtgcaggtgtgcgtgttggggcgagggaaggcaagggcgcgtgtctgtgcgcgcgtgtggaaagctagaggatggagcgcggctagccggcggcaggcgcccgggctcggacccggggcaccggggacaggagcgtcggagctgcgggaaccgggagaggaggggacggccggtccggcctgcctggtggcacggctgggacctcccgggcggccgggggcagggtgcagagcagggtggcccgtgggggcgcggggagcggcgggaactcgggctgtttctgggaataccgccgccgggaggtttcttgggctttcgggctggacccgcgcgttgtcacggagcgaagacgttggttcgcttactccgtgtagcgtgcggcgcagctgaccgggggcgggggtgatggtgcaggacgctgcgcggaggtttcccccaagtcaaggtgctgcgaaagcggaggaggagtcgcctccgtggtccccgcggttcccggggctggtgccatccgtggtggtgctgtgaccgcttgcaaagcgtggaaggcatgggaagcgagcgtgtgtttgcgtgtgtgcgcgcgcgcgggtggtggtggggagaacatcgtgaacgtgtcgttctctaaatgctggcttattgcatgccaagtgaagcaaagtgtgtgtgtgtaagtgtaagggcagggtggctgcccgggaaaggttggctccacactaatacaattctttctccttaagtacctcttggcactgctccttcctttctctcatttgttcgaacactgcagatacttcccaggctgaggcattgcacacctccaagctgggactggagagcctctccagaaaagaaaatgccctaacttcctgctaataataacctagttagcatcctttcagtcgttccttctccacttctgtcctccttcccgaaggatgttcccttgcaggattccccagacttccccaacctagaactgcagcttctgctggtacttctttcctcagcagtacaaaaacaaaacaaaacaaaacaaacaaacaaacaaaaccacttcccggttacagttacctataatcacagaaaatcgtagatacggtggaattttggaatattaacttttaggtgtgaaaatagtcttgatgtatttgggtactaaacatatgaaaacagcgaatttgcaaaggaacgttgtaaacgactgtctctttctcttttgtgcattaaacggactgggagaaagctttgggaaggataaaaacccagggtccacatcagatgacaacctaatagtaatccagtctaatagctgcaggttatgcaccattgcatatgctttttgaagtactgttggcccaagaccgggcttggaagagcctcttcactaataccttggtcacggtgtataaacctgctagtaatacagttgtctttttcatagaaaatagactataagggtttttttttttttaagtaattaacaccacattagatttttctcaaaactaaggactattttat

SEQ ID NO: 2755 - DNA, 1050 bp, Homo sapiens
gaaggggaggtttcaggggaaggcagtgggatttattttggatgtatttattttgagatatgttatggactgaattatggctccctaaaaagtatgttgacatcctaatccccaggaccttagaatgtgaccttaatgggaaatagggtctttacagaaggaatcaagtgaaagtgaggccattaagctggcccctggtcctatatgactagtgccctcctaacaagaagggattaggacgcaggtccacacagagggaagatggtgtgaagatacacagggagcacacctgtgaggactggagcactgcacctgtgaggactggagaccgtacttgagaggactggagcactgcatctgtgaggactgcagcactgcacctgtgaggactggagcactgcacctgtgaggactaaagactgtacctgtgaggactggagcactgcacctgtgaggactggagcattgcatctgtgaggactgaagcacacttgcaaggactggagcatcgcacctgtgaggactagagactatacctctgaggattggaacactgcacctgtgaggactggagcactgcacctgtgaggactggagcactgcacctgtgaggactggaacactgcatgtgtgaggactagagactatacctgtgaggactggaacactgcacctgtgaggactggagcactgcacctatgaggactggagccctgcacctgtgaggactggagcactgcacctgtgaggactggagcactgcacctgtgaggactgcagcactgcacctgtgaggattggagcactgcaactgtgaggactggagcactgcacctgtgaggactagagactgcacctgtgaggactggagcactgcacctgtgaggactggagcactgcgtctgtgaggattggagcactgcacctgtgaggactggaacactgcacctgtgaggactgcagcactgcacctgtgaggactggagcactgcacctgtgaggactggagtactgcagctatgaggactagagactgcattgtgaggactg

SEQ ID NO: 2756 - DNA, 1040 bp, Homo sapiens
tttaaatcatggtttgtggttttttttttgtatcttctttgcctacccaaaggctgttctcccatgttatcttctacagcctttactattttaaggctgatatttaggtctgtgctcttagaattgatattttgtttatagtttgaggtagagatcagtccctccacctatggatgtccaattgatccaggactagttatttaaaaggctaccttttcatcactgcattgcagtggtacctgggtagtaagtcaggtggctgtaagcagggatatctattacttgactctcttttatttcattggtctatttgtcttttcttgttccaaatttataacttttaaattaactccagatttctgctgttttgttatatgttggtgttcatcttctaactttgctctaagtcttcaaaattatctttgctattcttggctcctttcatttcagtttaaattttagaattagcttataaatctccacaagatgagctgctggaatttttaatgaaatagcatcaaatctgtagacccgtttgagaagaattaacatcttttcgatattaagactcccaatctatgaacatggtatatctttcttttatatatttagatattttaaaatttctctcagtatttgcacttagttttccatgaaagactttgcacattttgggggtcagatttatttctaggtatttgatgtttattgatgtcaatgcaaatgtatctttaaaaaattgtttcttagactgtaaaaatataattgactttacatttgaccttgtatctagtaaccttgccaagttcacttattaattctaatagtttatagattcttttggattttctatatgcccagtcatgtcatctgtacatactgaccattttattttttgcttctcagttttcatttcttgttattgcctcattgtacttcccaggatctttgtaaatgctgactagaagacatgatagcagatctttgatcctttccctcagtttcagggaaaacttaagagaatttcatcaaggatttta

SEQ ID NO: 2757 - DNA, 1107 bp, Homo sapiens
tggtactttgaacctgaagtaagcaacgtgaagaacaggggacaggttagggctacctcaggtgttggtgctgaattatcgtaactgcttctgtgtgtgtctgggccgtgggccttctgaccaccaccttcctttggtttctgcccattttccaggctacattgtccagtgtccctgtttttttgagacagaatttcactcttgttgcccaggctggagtgcaatgccatgatctcggctcactgcaacatccacctgccagattcaagtgattctcctgcctcagcctcccgagtagctgggattacaggtgtgtgccaccacatctggctaattttagtatttttagtagagacagggttttaccatgttggccaggctggtctcgaactcctgacttcaggtggtccacccgcctcggcctcccaaagtgttgggattacaggcgtgagccaccgcggccagcccctgtcaattctttgaacacctgttagctagcattccaacttggttggtttctgtcatttgcaaccgagaattctgtctcttttgtctggttgtctctctgtggtcaccatgcctttatcagtctgtgtcatcccgggctgaagttcctcacgtgatatttagttgcttgtggccaaaacccgccttcactgcaaatgcatcggttcctcatcatttctcctctggaccagcaaggggctttcctctcgcccatccatctcccaccttttcgttttgtaggtagaacctggagggagcggcagtaattcatcatccatggaacgtgcctgtctgtggcctggacctgtgggatttggccggcgttccctttgcattacatttggtacttggaagcaagcatccctcagtagggacaaggctccagctgtccctttcattagggccctgccaaggacgtttcctttgttcagcacctcctcctgcctgcccttaggaccatcttccaaaaaactctgctctgccctcacccgctgctgtcccctcccacctgtaagaccaggccagctcagcacctttccctgtctccttgtctagcactgctgcttctgtgtgatgctccggcatggtgagttgaccaac

SEQ ID NO: 2758 - DNA, 1035 bp, Homo sapiens
aggtctcaggcttggagcctctggtactgggccactggtcttccttctctctagcttcaacatccttctgaagagcaattgggtcctttgtgaggatgcttcgaggttggaccaagtaaatgaatatctgtttggtaacattgttgacactgctgtatcgagctgctctaagaaagggaaacatttttggttcagaggacattcacagcactgtgcttgttggagtatttgtaccattgcctcttccaacagttacattttgctcttctttccctcaagagtagaagagggtggagaagaggaaatgattataattcattcctttcccctccctgccaatttctcacaatacccttattgggaggccaaggcaggtggatcacttgaggtcaggagttcaagaccagcctggccaacatggcgaaaccctgtctctaccaaaaatacaaaaattagccgggcgcggtggcaggtgcctgttgtcccagctactcaggagactgtgggaggagaatcgcttgaacctgggaggcggaggttgcagtgagctgaggtcgtgccgctgcactctagcctgggtgacagaatgagactccgtctctttaaaaaaaaaaaaaaaaaaaaaaggcacatttgaagttctgagtgtgaagtgtgcttcaggatagtaaatggaaatggcaaaagaaaatatccagtggaaatctttgccatctttgggattctctttagtttttgctcatttttgcctatcctgcaagggtaacagaaagctctgagatttggaggtcagacaaacctgtctggctcctgccctgattctgctccttgagggttctagtgcagggaggacctctggcaagttggaggattgtacctctctgagctagagaactggcagaaggacaaaatgtaatttactccactgtaagcccttggaaagcaggtaccttgtctgtttggcaccccagtggcagcccatgcccagcagctgtcattggttgggggtgggtggtgggtgagtgcaccctagtg

SEQ ID NO: 2759 - DNA, 1053 bp, Homo sapiens
ggcctcatgattcccatttttattttgtttaccttttctgttaaagaaatttttgcccaggctaccctttaggcagggaggagaacttccccctacctcttctttctaagctacaacatcaaaaaaaaaaaaaaaaaaattagctaatggctctccccttccaggcaaatttctaggattaaacgacttgatgcttttttgctctgatccaggcccacctttccagcccacatatagtaataattatggttttatgtttttagggctccacttttgtttgatttatctccccatgaggatgtaagcctcttaggaatggggatcatgattcttcctgacttttaaaataacaactgtttctggctcctatttggtttatgctccatcatgtaatttgctgtcattcttgtattcagctgatttatccttaatcctgtatctcggttgtttgcttttttatccctaagtgccctaccttgcagagccctggcgtcatataactatttattaaataagcttcacggaacctcaacggggactctgttcacatgtaccagcagtgtgctccttctcctttctgcatccaagacatgatcctcagtaggaattgagaacaaaacccagctctttagccaaaaatggtttctgaggttcggttttcataaattcagaaagggggcttttttcccctccatctggccataggatattgttggcctctcttttatttattttattttatttttatttttatttttattttttgagatggaatctcactctgtcgcccagactggggtgcagtggcatgatctcggctcactgtaacctctgcctcctgggttcaagcaattctcctgcctcagccccctgagtagctgggattacaggtgtgcgccaccatgcttggctaatttttttgtatttttagtagagatgagttttcaccatgttgaccaggctggtctcgaactcctgacctcagatgatccacctgcctcagcctccaaagtactgagattacaggcatgagccatcgtgtccagccggcct

SEQ ID NO: 2760 - DNA, 1156 bp, Homo sapiens
ggctggagtgcagtggcatgatttggctcactgcaacctccgcctcccggattcaagcgattctcctgcctcagcctcccgagtagctgggactacaggcatggaccaccacgcctgtagtgataccatgtttagttacatcttttataaagattttcctattctccttattaacaatattttaacaatattattctaatagttatggttcaatatttaaagaaaccggaactacttagtcttttttttttaaaagacctaattcacgtgaaaaaggaaaaaccccttgtgcaaaaaaaatgaattttagaatgaaaccattctgactgggtgaagaagtctatttctaatgtggggggtatgggctgaatgatgttcttccaaaattcataagttgaagccctaaccccctagtaccttagaatgtgcctgtgattgcagatggggtctttaaagaggtaatgaagttaaagtgaggtcattaggttgggtcttaatccaatagactggtgtccttagaagatgaggaagagacaccgggagggtgtgtgcacagaggcaaggctgtatgaggacacggggagtagacagccatctgcctgccaaggaagggcttccagaagaaaccactcctgccaacacttcatctcagatgtccagcctccaggactgtgagacaagacgttcctattaagtcagtcagtctgtggtacttggttaagatggtcagagcaaactgctacagtaattgggaaaactgcatgtgtgtgtgtgcatgtgtgtgcgtgtgtgtgcgtatgctctcatcttggtgcacctgcgccagcatctgaatgcttgagttggtcatggcacactgggccccaggtgtccagagacagatatccaggtgcagtgtcagatgggccgttcaggttccttgggtccatctctcctacgatggccagtttgtttggaggatcacatcggatgaatggaaggaagtggtagctggtctcatggccatggcactcttcagcctatcaaatataaatgcagaagtcaggaccacaggaacagtctctactaaagtggaggacctgccttccattgcctttcggtgccagggagacctgggggaaagcctttcacctggatgggaaggtcttggtattga

SEQ ID NO: 2761 - DNA, 1135 bp, Homo sapiens
agctgccattttctggtgtggagaagattgaaggaagagtagctttgagtgggaagaggaaaagtttatattttgacttgttaagtttgaaatacattttagacattcaagggcaaatggagaacaggtagttggacatctgactactttctgccacccccactacaaccttcccagcccaaggcactgccttctctcatctggattactgcagtgcagtagcatcccagctggtattcctgcttctgccattgtcccttttctatttccacgcaacagctagagttagttccttgaaaatataagtcagacttctgcttcatgtattgatggactaggcattttggacacatattcctgttgaaggcaaccaagaagcccagataaagtctttgaaaaaatctacttgaagacagatgttagtgatggctaataatatgatgaagaattactgtccaggattcgggagaacatggaaatcaagagaggagaaactgacattcggatgcatttttctggagatgtacacttagtctagagaatgttgctgagagttctagaagcaattttgacagattgaagagtctgcaggaatgcagatctctcttcagcatgacacttgccaagatatggaatccacctaagtgtctataatgggtaaagtatgagatatatatatgtgtgtagcataatgatatatataatatatatagtatgatatatagtatgatatagtataacatatatagtataatgatacatatatatagtataatagtataatgaaatactattcagccataaaaaagaatgaaattctgtcattcttggcaacatgaatgaactatgaggacattatgctaagagaaataagccaagcatctgaagaaaagtgccacacatcatctcacttatatgtggaatctaaaaaagtttaattcatagaaatgactagtacaatggtggtttccaggagcttggctggggttagggaggacatgaaatggggagattgtggtcaaagagtatgaagtttcagttagatagtatgaataagttgtgaataagttctggagatctattgtacagcatggtgactatagttaatgtatgcttgagaattgctaagagagta

SEQ ID NO: 2762 - DNA, 1029 bp, Homo sapiens
agccaataagcacatgagaagatgttcaactttgttagttattagggaaatgcaaactcaatctgcaatgagataccacttcacatccaccagaatgactgtaataaaggcagacaagtgttgtcaaggctacagagaaattgaaactctcatacactgctggggacctggtatagctgccacggaaaacagactagatttccttcaaaggtgaaatatagagttaccatatgaaccagcaattccactcctatatataccctagagaaatgaaaatatatatccacacaaaaacttgctcatgaatgttcctagcagcattattcagccaaaaagtgaaaacaactcaaatgtccatcagttaatgagtggatgagcatgatatgctgtatccatacaatggaatgttatttggtcataaaagggaaaggaatactaccatatatactaccacatggatgagtcttgaaaacattatcctgagtgaaagaaaccagtcacaaaggacaacatctgtgggattccactgatatgaaatatccagaataggcaaatctataaaggcagaaagtagatgagtggctgtcaggggctaaaggcagtgggaggattgggtggctaagggatgcagagttccttttttggggggataaaaatgtccttaaattgattgtggcaatcaactgtgtactttaaatgggtgaattgtatggtttatgaattatatctcaagccattatttaaagagttgaatgtgcaaaagtgagatcatagtcttacatgatattaagtagggagtgagtggtagagaggaaagatcctgttcctgagaagaagataccatgacaatatctctgtgagaggtacttggtgtctatctcatgggttccttttcttctacactgtttatgactagagtcacctcttctggcatgcctactgcctaatgactgtcttcattaccactaacattcatatctccaaaatatttctatttagattcatttttacacagcgcaaaacactaac

SEQ ID NO: 2763 - DNA, 1050 bp, Homo sapiens
taggataaaggagaatacccagtaatctggggtgtaccacagggcatggaggaaaggggaaccctacaacctgactgctgcagtgctgccagggttcctgccaccctgtgatgaggagctcttcattggtggggcagttgggaagagcatgctgctctctttgggcaaagagatttcccatgtcatagactttgatctcgtccgcactgtgagctccaggtcagacacacagagggaccgctaagccctagagtgcaacacttcactgcccattaacagtttattttatttttgcctgcccttgtttcactggaagctaggtatggagagagaatgccagaggtatcattacctctcacttttctctaatacagatggaaaccagcattgcaggtaatttcgggggcctctcggtagcaccggctccccactgggaaagacatgcattagatgcctgcctgaaaaactggccggctctcaataggtttagactatcgttcgaacaccttcttccttgaaaaaagaaggttcagtagttcctcggtgttcttaaacttaacattcacagtttgtcttcagtgagtaacccttaaggtccctaaccagaaattcataaatttgccagggcacaaaagtacctgcatttccctattgttttgctgttctgatttgatgatgcagaaatgtaaatcaatgtgaatcactatgtaaaacataaattgagtcattccttgaaaactctctgagaattcccattgcatttaggctgaaacccaaactttctgacatgagctgatggtagccacagtgtcagggtcccgcctgtatctctgatctcattccatcctgctttggctcacagggactttctgcaactcttaccctctcctcaactttggagagctttgtctttccaatgtagaccctgtaactcaactttggaggagattcctccaaatgctgtagctgctttgcctacagcagccagtggctggaattaatgtccctggctgtccccagcctcccataactgtccagtatggaagcatg

SEQ ID NO: 2764 - DNA, 1068 bp, Homo sapiens
ttattggccatctgcttgtcagaaagcctcttcctcatgaataaccttagtctctaatctcaaggagctgaaaaatggttaaatagggctgggtgtggccctatttaacattttccacaacttttaatttcatttcctatcaatattactcaacaacaacaaaaaattggttttgcaatccaaatattgtattaacaacataaagttggaaactttcagctaatgttcattctatttaaacatgctttgggttgttggtgcccaggatacagcaccccaaaatatgattataggagatcagaatatacctcaaaatacatgtttttggcatattgatgattttgagctggttattttgagaaactgcaggcacaggcagggaaggaggggtattgtaaagtggaagtgtacttagcctgttaagtagagaaacaatttccataggatagggttttgtgggctggaaagataaactgcaaggctcatcgtctaaatgcctgctgttcatagagttagaacgttctgcaggagtctaatggggctgttacaaaagggtggctactaagcaatctgagactctccaagggaaagaggcttcatctctacaactgctacttcagtagaaacaggagtccatcagaaactccatctgcttatccagtgctatttgatattatagttattatgtactctttatggactagagacggagaggttgaacaatagcacacactggccttagatatgttcctattttatcttttaatttttgacttgaaatatacaaccactccggtcaaacctctctactggttgctgattttgggaatccaccgtgatctctaagatacctgcaaccccattcctacatgcagtgttaaccagcagttctcccttttactgtccacctaaggaacatgccataccacattcccatcaatagcatttcctcaccagttacagaaaagaggttgtagctagcaaaaagtaccgcccacccccaaccccctaccccccccacccccacccctccacaactgctggtctttccagtatgcaggaggtatg

SEQ ID NO: 2765 - DNA, 1040 bp, Homo sapiens
atatataaatttcttatgtatggaaaatatgtattttccaggctagcaaatacagattataagacaatgccaaatgtcttccagagttttccaatgcatgctctcagtgataacatgtaagaattctggttgttccacatctttgccatccttgatattgtcaggcattaatatttttgcttatgtaatggatgtaaaataaaatcttggggttttaatgagcatttctctgattcctaatgagctcaaatatcttttcatgtggttactgggtgtttatctttcttctggaaatgcttctcatttgtctatttggttgtcatttttgttattttatttattctagatgctgtcagtgacatgtgccaaggacatcttacttcctctaatttttggcttgtcttttccattctctttccggagttctttgaaaaggcattcttatagtaggagaatttgtctgtcatttttctttgttgttaaggcttttttgtttttgtagttaaggctcttttgtagttaaggctctgtgtgtgtgtgtgtgtgtgtgtgtgtgtgtgtgtgtgtgtgtgtgtgtgtgtttaaaagagatccctctgtcttctaaggtcatagagttacagctttaaaaattttctcttagatgtcaaagttggctagttgcggtggctcacacctctaatcccagtgctttgatcacttaaggccaggagttcaagaccaggctgggcaacatagtgataccctgtctctacaaaaaaatataaaaaattatctaggcatggtggcttgcacctgttgtcccagctccttggacagaggtgggaggattgcttgagcccagagttcaaagctgcagtgagctatgattacaacattgtactctagcctgggtgacacagcgagaccctgtttcaaaaaaagaataaagtgtcaaagttttgctttcaacctttaggttcttaattcaccaagaatttctaaatttccatttatgtactatgtggtgtgagatagatatataatattattttttcaaa

SEQ ID NO: 2766 - DNA, 1027 bp, Homo sapiens
cacgaggtcaggagatcgagactatcgtggctaacatggtgaaaccccgtctctactaaaaatacaaaaaatattagccaggcatggtggcgggagcctgtagtcccagctactcgggaggctgaggcaggcgtgaacccgggaggtggagcttgcagtgagcagagatcgcgccactgcactccagcctgggcaacagagtgggactccatctaaaaaacaaacaaaaatatcttgaatgcttttgagtgactccttctaacttgtcacaatggtgatgttcagtgattaaaatgtggaatcctgagggagttcattgcatgtcacaaatcagtacttctactcccctcagcactaagcattgaatactgcttttttttgaaggggtgagggggaagaagctgttttaaattgcagatgtatttggatttcttttttatgtaactcacatttcttattttccaaaaactctggaaacgagttgcatatttccactgatgtcaaaactgatgatcctcacaaagaagcacaaatatgatataaaactataaaacaaaaatattgatagcaagactttgaccagattccagaagaatgtatttgttacatctctgtcactttttttcctcactgcatttctaatagtttaataaaaaatctcttatgaagaaaagattgcctttctcttgcgtcaaacattctcataacttttcattctatcttgaagttttccttttttcttctaaactttgaagaaacagaatccttttgatgtctttgagtatttgccattgattagagcacttggaaaggaattttgcttggaaataaatgtcttttccctgcattctaaatatttcctttgcataaatgcatttcatttcttcttttcttgaccttgacatagttgctggcagagtacagcaaggaactctatgaattttgagttccttggcttctactgatttccttttcttatcctggacattcagggctggcttggagagacccggattagaaatctaga

SEQ ID NO: 2767 - DNA, 1047 bp, Homo sapiens
tgtatgtgaacgaattgggtgtatatttcctacaaggctgcactctgaaataatgcagataaattctgtgcaagatagttttaacattttaatgtttgagtctgaagatactatgttttttttcaaaaccagcataaaccaaaatttttagaccatcatcaagtttttacattattttaacaatctactcttgaaaaatcatatctacattatttaaatatataagttattatttttaaataattcagtttaaaagtatttcttagggcttatttacaaatattttttggtggtccatttgcaatgagatgataagtgttgtcctttcacaaaaattaggtttttctgtaatatactttgaacaggaaacacatgcaacaatgaagaatatttaacaaaatccatagtgaataggtcctgtggaggatcacaaagccccagtagcttataaagtcaggtggaaaatatgttgtccataaatatgtgtaatacaaggcagtttgagtcatcaagaagtgtttcatggatgagtccatatctgagcttggagctgagggatggtagaaattggacaaaggacaaatgggagaaatgaaaatgtgtttgtgaaaagcagagttatctagtgtagtttaatagtaaccattatgtccaaactttataccaaaaatttaagataccagatagggagtttggacttaaatttttaaacagtgggattttttttcttctattaaatctctgacaggtctaacgtgatcttgagggaagtctaatttggtggtaataagtagaagggactggagatgaagagatgggggcagggggatcaggttagagagatgacatctaggaaattagagaagacaatcaggtgtgacgattaggaacattaccaagtaaaataaaaacaactaattttagaaattacattgagaaactgaatttaaagttcccttttatgtcagagtttaaagagtttttgcttgatttccagtatcagatatgggtattacagcttcttctttaggacattgatgctttaat

SEQ ID NO: 2768 - DNA, 1027 bp, Homo sapiens
ttgctataccactaacatccaagacaatgcatgttatgtactaggtagtaaggaaatatttgctgactggagggactgcaagatggaatttatagaccaaaatcaaggggctgaaaagtaccaaaaattctgtttctgctactgtagtaacagttttgaacatatgatagagcttttttgtctgttaaatacagctgtttttgaattgcctctctattgtgggagaaaaggaatgtttttgaaaggaaaagtcagaaaataaccttttgggttcggtaatcctccatcctcatttgcctgacacagtccaggttaatacctgtggtcacagcataatcactattagttccccctttcgttgtccaaagtgtcccagtctggatgagaaattacatggttatccctagtcatggtgtctttgtgaatcagataaaacttatagaatctatttacagaaggcaatacaaataatatgcacgcatacaaaatcttgtatttcatctctgatttgaagacttaaaagaagtcttcctttttgttgagttaaataacttccttttttttttttgagttaattcttgctctgttatccatgctggagtgcagtggtatgatcatagctctctgcagcctccaatgctgggtctcaagggatcttcctgcctcctgagtagccaggaccacaggcacaagccaccatgcctggctaattaattttttttttttttttttttggtaaagataggttcttggtatattgcccaggctgtccttgaactcctgaccttaagtgatcctcccaccttaacctcccaaaatgttgggattacaggtgtgagccacctcaccccactcatacaacctctttagtgattgttgcagtcacacattctgagaagatacacttttttgcaagtaatccctgaagtgtgagagaagggcaaagaccagcaggatctacataacttgaggattacagagaccagatggaacattctgagagtgagcatgaggtcagtactcgtag

SEQ ID NO: 2769 - DNA, 1074 bp, Homo sapiens
aacaaaaacatctatatttgcacatgtagttatcatttctagtgctctttttgtgtgtgtgtgtggatctgtattttcttcaggtattgttttcttctgcatgaaggactttctttaacatttcttatcatgcaagtctgctggagatagactcttttggcttttgtacaactgaaaatgtgttttttgccttcattttaagtgatatttttgctgtgtacagcattctagattgacaagttttttttttctttgggttgactaattttactccctattgatgattgtattttatagttctttatatgcctggttatttttgtttagttaccagacattgtgaatttgttaggtgctggctatttttatattcctgtaaatattcttgagctttttcctgggatgctgttaagttacctaggaagagtttgatttgtttggatcttgcctttagaattttctgggtgggaagagcagtgtttactctggggcaagtgattccccactattgagacaagaccctctgaatactctatccagtgtcccatgaattgtagagttttccagtctggctgctggggacaggcgctgttttaggttctgtgtgagggccagttgctgttccctctaatcctttcaggtgattctgttccctgccttgagtagttttctcatgacattctcatcagtgttctgctgaatatttgagggggaccttctgtaggtctccagggttccctcttgtgagccctctcctctctgtgtcctgtgaattctagcaaccttggtctcctggatgctcagcaatatctcttcaactcatggagactgtcaggccacacctgggttcccttcctgctccatggcctggaaattctcctaggcagtaaactgaggcagctgtaggactcacctgatttgtttccattcctcaggaattcctgtcctttattcattgctctccagtgtcttgaaagttttcgtgtttgtttggtccctgccccgccactccccattatactttgtttttttgggttgtttcagagggaagggaaatcctgccctgtcactttg

SEQ ID NO: 2770 - DNA, 1062 bp, Homo sapiens
tctagtctctttaaatatattaacttacttaatctacacaataactttataaagtgaataatattagtattcccatttcacagctgggaaactgagacatggtgaaattgtctttccaaggccagacagcatgtaagccaccgaggcaggccttaagggacccccctaccctcgcttaccatctggctgcaaatttcatgctctttcccttcataatagataatgtctcagttgggggccagcgggatggatagtgatggaatgagtgtgcactgtatgttatttgaatgtgatgaagaaatagaataactctctcatgtaaataggcaagttcaattgttgcagatctgtagaatttcagtgaaagtgaaagtgttttctggaggcttcgtaacccacctagcctcccttgtggctttactacccctctcttgagttacattgggtgatgcaggcttagtggcgaatgattcaaaatactactcttcattaaatcacaaagtgttttggtcttctggtagtactttctcatattctcaggtctgaagtgatttgctcagttttccaaaaatacatccactttgaaatgcattaagttgttgtatttcaccctacacatactgatatatctcacaactatataccattctgcacacagtgccctatctaaaattgtgctttttgtcaatgtattgcacaacctttctccttccttccccttactttacacttgctaactacaacaactagactattctatgcacctttatttgttttctttgcgatcactgggaatgatgcgcttggtttgtctttatactgcaggagaacttttaaaattgatgtaacgatgaagctgatgctatgctcagtttacatttctgcccaaaatgatagctctcaataaatatttgctgctttgaggtacacatcttttggaagaacttgctccaggggatccatcttaaaaaattctcaggtgtttatgtcttgtaaacctttgagtaaggctttagagcaaacagttacatctgccagcatttctgtgggtactgacgtttc

SEQ ID NO: 2771 - DNA, 1052 bp, Homo sapiens
tcagaattataatttattttctcttaggagaatgcttacatattccagataaaacatgaactctgtatttgagttgtagtatctttggagtactgttgtcaataatattttaaagcatttgaaaatggaatttattcttatttactacaaggtttaatcaagatttgaattgttttatccaaaataataccagaaggttgaaaggatggctgattaataccaataattttaaaaagtattatcattagacctaaaagattctagatatgtataaaattttagcttttccttatagcttcttgtaacttaagattttaatgtatagttagatcttgactgccctctagtggcatatattttcttagctatattgtttggagagcagagtgtatggttactttaggcctttttaggccctagttaggtgattggtggtgtgtcatgcctgggaggtacggggagcacagtctttgctcagtccttggccttaatcttgaggtagttcattaataatataattcctgaattgtttctgctttgaataccaacagacttgataatgtatgacaggaatatgtctcccaactattcatttttaaatgtccattattattatattcattataacagtataaaaatcacttatataacatacttacatgagttataattgcctatcaaacacataaatatatcgtgtttaaaatcgagcaaagcataaggatgttcgggggagagttctgtgcctttgacaggatgctacccattagctatttgtctgggctgctatatccggagcccggaagagtcttcgtttctagatacagtttggcaggtatatatggagcacttactttgtggctcaggtgcttgatactacaaggtatgcaaaataagtttgttacggattgcttggatctttttaaaaaactcctacaaacccagatttcactttgtattagtattttagcaagaggtataatgttgaactgttgcttctttaaaacgtagttgcaaactaccctaaactaacttaataaatatatactatg

SEQ ID NO: 2772 - DNA, 1033 bp, Homo sapiens
aaggatgccttccagaatgtggctggagattaagatggataaaaggtagaacaagtccaagttgaaaaggtcttgtgtgccatgtgaaaaggttagcatctattacatagacaagggaaatccattggaaatttgaagaaggggattgagcataatgaaacttgttttggaaaaatatgttgttattaatgtggaggtgggcaagaatgagaataatcagtagcaatgaggtgtcaataatttgatactgtctacatggaagacagtgattagagccatggaagtcagaatgaaaaatgataaatgtgaaaacattctagagaagaaatgaatacgcgaaggcccgtggtgggtgatgacatgatgtgatttctgcccagtgctctgaatgtcaaagtgaagaaattcaatgaaggacgggtaaacggcgggagtaactatgactctcttaaggtagccaaatgcctagtcatctaattagtgacgttcatgaatggatgaacgagattcccactgtccctacctactatccagcgaaaccacagccaagggaacgggcttggtggaatccgcggggaaagaagaccctgttgagcttgactctagtctggcacggtgaagagccatgagaagtgtagaataagtgggaggcccctggtgcccccctgtcccagcaaggggacagagtggggcaaggccagaggtgaaataccactactctgattgtttattcactgaccccgtgaggtggccccaaggggctcttgcttctggcgccaagtgcccggccacatgcacatgccaaattgtaaagaccatcgatgctaggaagaaactgcgtcaactaatgagcaaaataaccagctgacatcataatgacaggatcaaattcacacataacaatattaaccttaaatgtaaatgggctaaatgctccaattaaaaaacacagactggcaaattggataaagagtcaagacccatcagtgctgtattcaggagacccatctcatgtgcagagacacacatatgc

SEQ ID NO: 2773 - DNA, 1060 bp, Homo sapiens
atacaaatggatgagtgaagatcatgtgtagatgtgattctgagcctgaattcctcagctttttttcactggggcttagcactccctcagggacacacaagtggcccatggttaacggcagtatctggcacagccaagcctggggtgacattctggtctcacccatgagtacctagctggtatcgtgagcttgggtaaactggttaacctctgtatgctgcagttttctcatttttaaaatgaagctggtatgagcatcggctttgaaagaatgttgtgagtgttctggttatgatgcttgtcaatcacttaaaagaataactggcatatatttcaatataggtgagccataatttttgtcgttatcatcgttatgtggatcaataacctgatgaatgtcctttgtttaccatgaataccacaggaagacatgaatcctgatttcaggaaatttactgtccacttagggttttataatttgcatatgtaagacaaacttaaggacatgaataataccagtatcaacttgacagaatatacaatagagtatataagggctgatcaaagttacaagaagctgattggagaggggttaactgggtgggttttgaccccctccttggtagggatactaaagaaaacagcaaaaaacatttctgacaatttcaggcatatcccacaggttttcaacaattatttactcccaaattccaatttcttaccttgtatctgtttttcagtactacacatgtaggacaaaaactatttaaaacaaatgaaaaataagcttataacccggaaggggaatggagattagaatgaaacttttggaatgtgtttcttatctagaactaaaatacaagataggatagaggaatggtgcattcattccttcaacagatacttattgagcacctattatgtatgctgcattgttctaagcttttcaaatagatcagtgatgaaatggaaaaaaatctctgctgtcaaggagcttacattctaatgggggaaataaacaacatacttgaaactgggcaaatttcaaaagaaagaggtt

SEQ ID NO: 2774 - DNA, 1002 bp, Homo sapiens
ttttaatgaatgagtcaatttaacagtacaaattattcatcatattttttctaataaacttactgagaataatctcttacaagttggtatgtataaaaatgggattcatgcaataagcatatctttttggaacagaagtataattcttactgctatggttcagaagattataggtttaatataacacttcaatatgtagtttaattattacataattgtatattttataacgtaatatataagctatcattgctatatggtgactcacttgtttcactactttcactatggtaaaaatgtctttcaacctcatgctatgatacactttaccttctgttaagtaaaacaaatcatttgtatattaaattctattatgttttttctcaatagcccaagactattacaatgtatttatatttataaatattaaaatatttttcattatcatttcattatcacgaaactatgttgtaactttgaattactgctacaaaatattcaacatgcacaaataagtggatgtgggacaattattttaattttgacattagaacatgccatcttgatagaatactcattacccagtgaaaattagattctgtcgtttaaggtgaccctgtgttactagcataagcctcaaaaacatcacaagagagcccttgagtaacatggcagtattcagttgtaaactggttatccagatcgtcctgaatatttatgaaactccaatgagtatattacttctatttctactagacggggactgaggctctaggaagacaagtttgcagactgtataaaagaaaaatgcattttataattgttctgatatattagaccacacacacacacacacacacacacacaccatatacatgtatatatatttcaaagcaagcatttgtcaaaacaaaaataagccctttattcttatatttcttaagcattgaaaattagaaagcacacaatatctgaaattactatagaattttttatatattt

SEQ ID NO: 2775 - DNA, 1046 bp, Homo sapiens
ccaggctgaaatctttctaacatttgattctgtcatacactgttatctctttccatttgtgttaaccacaaacttaagtgtgattgatttctctgtttatctcagttggtagtgtgcagctgaaatttttataccctttcccagactggttaacctactttgttttcaatccatctaaacatacttttataaaactcatatttctcatctcctttcatgagattcttaaagaaatcaagatgttactgtgattgcttaaactcgaattctaactttggtaaaactgccaaagatggatgagtattcctcagtgatttgcttgataacccattttagactattgttgattattaatatcgaacttcctagcgggtagtttttggaagctgtctttcctcattttaaaaattagcatcccagttgtctggaactttcacttggccttcatggtttctcggtttaccaacagtcattctgcatccacggatgttacttttgctttgagtcttgatacttgagacttgaactcactttaagagactgttgtatgtgtcttcctccaccactgcaggtcccttggaaggcatcatttatatcttacttaggtttttgtttttcagttttaattgttttttaaacttaggaacacagagttgggttaatgataactctgaattcatgatacacagtcactgttagtccactagtgtctacttttaaagttacttagtcatttctaataatgtagtaactacccataaacccacttctgacaagaaacaacctagagaatttacgtgttatcctatgggcttctcattaacctataccctgtctccccacacaaagaaaccatcattctaaaccttgtgctcaagatgcccttgcttttcttttcatgtagttttcatttatttatatatagatagataaattttcatatatatataatttaagttgttactgacttttaaaagggcagtaggctgtgtgtaatattttgggctctacttattgaattaatagtgttttctaagattcctcca

SEQ ID NO: 2776 - DNA, 1023 bp, Homo sapiens
tgtatataatattggaagaattaagctgtaaagtcacattacacagtatatctaacgtcaaagcctctagtgcattaactgaattacttgaccctggtttagtgtttcttttgtctctgtagattagtcaaactttgataccatttttacagagtgttaaagagacagcattagaaactttgcttatcctatcaagaagcagaattctggaagatcattacactgtttgaaagatcagtaataaagagagtggataatgatgaaagatctgaacaaaaaattaaatgagctaaagcccacaatttgattattatttgtatatgtataattctgaagacctctttaaacatgaactgaaagacaaacttttagagctactaattttgtagcacttcaaacaaaaaagataacatttgtaatattttagattgtgatcacaaactataggatatcacatcatttagttctgtcatttattcatgcaaattttcttgaatacctattattttcagagaactgtactggatgtacagtatgtgtgtactggtgtggttaaaacaaagaaagcccgctctcttcatggatcttctaggaaacttcatgtttgtttgtttatttatttatttagaggcaatgtcttgctctgttgctcaggctggagtgcactggcgcaatcctggcctcaggtgattctcccacctgggcctacaggtgcacaccacgaagcctggctatttttagttttttgtagagacagggtcttgctatttgcccaggctggtctagagctcctgggctcaagcagtcctcccacttcagcctcccaaagtgctgaggttacaggcatgagccaccatgcctggctcatttatttaattaaaaaaaaaaaaaagaaaatttaggaaccactcgttttaaacaaagttgtagtcttagtattttcccatcactgtgagtcaactctacagaaatgtagctaatctacatttttcaagaacttaaatacaacagaaaaaaataatt

SEQ ID NO: 2777 - DNA, 1034 bp, Homo sapiens
aacctccgcctcccgggttgaagtgattctcctgcctcagcctcccgagtagctgggactacaggcacctgccaccatgtctggctaatttttgtatttttagttgagaaggggtttcaccatgttggccaggctgatctcgaactcctgacctcatgatctactcgcctaggcctcccaaagtgctgggattacaggcgtgagccaccgtgcctggctgaagttcttttgaaggtcacatgtattttgtaaattaacagagactcccttggtattttgactagtgttctgtttatgtgaaaaagttcaaataggctttgcaaaatgagatagagatgaatgccctggtggctccaggaagtatgcagttttttcaaatatgcgagaaacaaacgctttattttccagtgatgacagaagaaacaaagaaatttgatactctcagcctgactccttcccttgatccaccatcagctataggagtccaaagaaaatgaactatgaaccaaagttaaatccaacaagtcacatgcacagaacaagattaacatcaccattaacatcgccattactgaagcgaaagctggcccaaaccccactactgagtagcccatcctcattccagcaaagaaataactaactcagtaagtcttttggaagactcagggtcagggtgccatattgtatgttttccaagtccaaaccagactaagctataaagaagtaatgcccactgaccctttacatttctgcaaagcctctctcaattacagatgcttttattgacttccaaggtagcttggccaagatcattataaggcagctaggttcaggaggggataaaaaaattgtgtagcaaagtcttgaccctagatgtgtgtttataatctacaaatatgttaacttgtaaaatagagttgtctgagccaagttgttcttgggaatcagagggtgaagaagccaaatctttttggagagataccaggcatttcttcttttaagggatttcacttgagagatactttaaaggacca

SEQ ID NO: 2778 - DNA, 1052 bp, Homo sapiens
tagtggtcttatgtaaataatgcattgttggtataaaatatgacaggcagaagtgcttaattttaatgtttgccatagattttcttactcggtaaaaattaaggaagaaaagcagaccctgaatatacacatggtagcaggacgctgctatggggcctaccttctttgattattcactgttcagagaaataaaagaggctcttcagaaacagaattaagtatcgtggggaagccaaatttgatctggatttcaaaatctattttaaagaaataaaatcttagagaccatgcttcataagattttccagtggtcataggttgatttttattaaataaaagttttgttttttggactactttttatcaggtttgatcactgattttctcctaacgtttagattcaaacaaatgaccatatactatcgatacaggaactaaccacgggcatatgcagtaaaggatttcaaacccgcccttgattgaaagagagatttttctctacagaacaataatactactctcggtggtaaagagtacaacttctgacagatattttatccgttttctcttgagtattacggtttggaagaataatattcagtattatgaacaagaatgaaatatacttttatcttctttccaatgaaaacatactggtctggattaatgacaggtatcagtagcaattgtgaattgttttcttctttttgctgccaattaatattttctttcttttcagaaaatgatttcaagaaccactaatgtttatgtcaagaggaaaaggtttaagttaaagaagtgtcaggtttaacaaggaatatgctccacatattctatgactggaaggctaggagactttctggaagggtttatatatgtttcttctctccagtagattagaaagacatataatttggaagcccagatgcctgccagccagtaagctacctcaaccctctcaataagtatgaggatggatagaaaaggaagataaactaccaaggtaacaggtaacaccatagttggtgaggatggaagtgggaaaaacagta

SEQ ID NO: 2779 - DNA, 1101 bp, Homo sapiens
ttcatattttatattgatattgaaacatattgagtctcctcttcagtcatctgggtttcatttgtgtctaatcttacttaattagataccagtgtgctttgctgttacgtgaagagtgaatggggaaaatgctttatatgtagatgatgagcagagttgcttttgctaatttgggcttacactgaccccaggatatctcatttgtaagtgctgtgctaggatatttactttgtttactttgaaaacttagctttgacattcattatatgaaaatgtgatgtgataatcagcaagataaaggaacgtatgaaaatcaattatggtatcatttagtaaactaatttaaggagaagattgaggttttattggtacttcaaaatggaaacagaaactgtcaaatccagtcaaatccattttctatctaaggatcatattggcctgtgaaataatttgcaaatattgctttctaagccattttcacgggttcttttatttttgaatattgggcttcccaggatggtattcttgttcctctaattaattcaacaactatttattgtgttctgtcctatttttactctctgagataacacatttccagtcttgactttttcccctacaactttagctatcacttcacattgtcttcatccagctcagcgctgtgttttcaaatctttacctttatttctagctttctcctcctatccatgtttccatcaggcaccctgaatcccaaactcaaactcatgacccaaactgactgctccccaaataccacaacctacatatttttaaagaatcttatcctattctaagaataggtttatagtctcacattagatactagatttttatactaagaatctaaagaatgctattgtttatctgtggtctcagtgaatggaactcggagattctcagttgttcaatctggaaaactcccatggagcctaactccccatattttgctctaagcacctccttctaattcagccatgccacgactgtctcctaaatctcttttcttctatagcatctctattgtgttagtttaggctcgactcatttcttgactcaacatatgcaattttctttttt

SEQ ID NO: 2780 - DNA, 1051 bp, Homo sapiens
ggggctgtgctcaccattaaagtggggaagtggaaagctgacaaagtggatatatagggtattttttgaaaatagtcgtggaagacaatgtgaataatgatcgtgtgagacaagtatctttaaaatgaatatgtggatgtgaatatgtgtgtgtgcatgtgtatgctcatgggtgcgtaagagggagaggcaaaccttttagttgtatggtttagcattatagaagacagtaaggttggttatggaggctttccctgaagtcttccagcagattgtaaacatattaattaaaaaggtaccactttgggctagtcaagtcacttctgagctcccgcatctgagggatgcaagcgatttggaatttggaggccctgggatcccgttggtcctgagtgtcgcagagcagaggctgcagggctgatgctgttctcctcacagtggacagagctctatgtcctgctgctctcactggaccattaggagatgagtggtctggctgcccctacccccaagggattttcttgtgggcagcacggtgctgtgtgcagtctggagataacatagttttatgtgtccctttgaatcgccggctctgcttgttcatctgtctcaccaaccattcaggaacagccaagggatagtcacccatccttattttgattgaaagaggaaaagctttatgaatttttctcacattcattaatcatgctcagttactttttctgtatggtgcttcttgtaatttccttccctcaaatgcattagattccaagacctctaagtaattgacagctacttttctagggcaaagatattcattttagttgccatgtggggttttatctttctacttgttcttttccccagcacccttccctaaaaacctgatttaacggatgctgttactccgtcttcatggggactggtgcttttgcctatctattttctgttttaccttatcattaaggacacctccagtgaggtgatctctcgtgggattactaactccaggccaacacatgaatggctcaccagaccacactgtatctca

SEQ ID NO: 2781 - DNA, 1044 bp, Homo sapiens
ttactctataaaagtatagctgtagtactgggatgtaaaacgtacatcttatctagaaatcttgattttttttcatacacacacacactcaagtaaagctagcccagtgtttgatttgaagcccacatccagctgaaagtggggttacactttataaactaataaagagcaagattctgctttgacttggtaaaacattaaataggatgtgggcatatgcccactgacatctctctgctttatcttggtgtgctgaccctggtggcgttcacttctatattttactttgatacaccacagcttatcgtatgatctccttcttgtagattatcctcatgatatggagcatagtgaataccatggttactgtgagtttggcagggctattgtgcgattatttttgagatttgggaggctttcatggactacaaaaagatttaagagctctatctgttacaggagctaatgcttacctttatgaaggtgtgaatcccttgtaaagaacatcgaggctttctgataagtgtgcatctaaaaagaaggtaattctttttcagtatatactatttttcagtagtgatgtgctgctgaaacctattttgtaattctcatataacacaagcaaaaagttgcccaaatgtgcaccagtcattaaaaaatagaaaactaaatcaaggtatctcagggactctagaaacaaataatatttaatgtggaatcaaggcacagtgcaaactggtttccttcatgaacataataattcccctcctgagcagttgtgtaagttgggcctagcttcatatccaatttcttaaatagttgcagcagcatcttctcttggcatacttagtgtgaaaatctgcaggctcagatcagttagtggcagaaactgaaaaggcacactgtgctttgggttggccagagattcctctgaaggtctttgaatattggtcagtaaaaatactttgaaacatggtccttaggtttgtatccgattagaacccctggaatatcccaggtggtcatgtcaagatagtaaccatc

SEQ ID NO: 2782 - DNA, 1087 bp, Homo sapiens
ttaaaaatggaagggtgggtactatttagaaaatgattttttatactctattccactagttgatctagatagcaactttgatttggaccgaaagtaaaactggtagagggtgaaatttgcagatggttccaaattctcttgtattaagtagaatagatactactaagataatagttaattacagtatttactgtacttaaagctgagacctaattttctcagctttctatttaggatgaattgtcacattctggtgtgtgtgtgtgtgtgtgtgcgtgtgtgtgtatgcatgttgtgggtgtgtataaaattgtatcatagaggcagtgtaacaaagtggagtggaaagagacataggtttggaagaagacctaaattcaagtccctgcgtgttaggaaggtgatcacttcagcaacgtgaattactgggggttgagttccggctttcaaattatgttgtcttaatttagaattgtctgggtgccctggaccagctaacaatataggaagtagacaccactgccttaagcatctcatggctgtttctgcacatagttgcctttgtcaagaacacgttttgcacgttgttgcctttgtcgattacatgttttgcccttcctcctccccgtgagagtcttgttacccttctatgctcatttcaaacattccttctgaagttttcctccaaagcatttttagttatcttttgtttaaaaaatattattgattgtaaatgaaacttaagtaccttgtggaaaaatacacaaatacaaaggtaaaagtaaatatcaatcgtaactgcttgaatcagggataaatatcattagcattttgccatatttctttccagttttattttctgcaaattcatatttcccctccaaagaacaaacaatagtaacaaaaaaaccaacttaggaatttatttgtatacttttatattctcttttaacattaaatcatgtccatttgttcatatctttattcttataaagcatgattttcagatcttcatagtagttcatcccagatgtatagcataattaatagctcctcttttttttggccattggggctgcttaaaata

SEQ ID NO: 2783 - DNA, 1028 bp, Homo sapiens
gtattggtgtggtttcaactaagaaatagagcagattgcagataaaaagaaatatattgcttataccaaaatggaagtccctactatcttagtactaagctgataaatttaaatgctgagtatatttaaaactaatgtaggaatgaagatatataaagtaaagcataataattataataatagggcatattatgcctaaattccataaggtatcatcagtgtacaagctttataacccaaagcatttgattcttgaatgcattttgaaggaaccttcaaacttcataaatctttgatttgaaagatacttctttttaacctgcattagttttcactgcataagatcctcatcagaaacattaaggaaattgacttggtattgttatgggcataatgatccagactcaaaactctgaaatagaactctgtactttgctgctcatctgaatgcagaaagaagaaatgggagacccccccccatcagggtggaactcttccggctacttgcaccttagatgtacaggtcttacttactctcattataatgaaatggcacattgtattgaacaaagctgtaggggtctttttaaaagaattatgttcactgtagttagggctcattctccaccattaactgctcttctcccacaagtggtcaaggtttctggatttcctgtgacacaggaagaggtggacaggggattttgtaacacagaccagtggctagaaagatatttccaaagaagtagcatgaagtttaaccatcatcttgaatctggagtcctttttgtccctaaatctaaatgaaaaatcaagtacctattttcaaataacagtcataattaaagccaagaaaaaaaacatgtaaaaatcatttatattcgttttgctacattttctacttatattttaacaaaatatggctgaaaatacattggatttaaaagtaactgtaaggacctatttaaccctcttaaatttccttctaccctgtctaaaggagtcttcaaaggaatgtatattattat

SEQ ID NO: 2784 - DNA, 1033 bp, Homo sapiens
tctgactgagcagaaaattaaaatcccctacttggaactacctataaggaagaatgagaattcagaccctaggcattactgatgctcagttgaaggcagcttgtcaaagcactgctttttattaatgcccaatagttcttaaatacaaactatatacaaatggtaaaactatacttctgcccagttgaacctgatgcaggaaaggcaggtctcaaaattggggcttagcccaggagggttcttggctttacacaggaaagaattcaccaggaaagaattcaagggtgagccagtaatatgagacagcaatcttttattgaacattactactccttgcagaacagggctaactcacaggcaatgtgcccagatttggtaatgtatgggctcttggcaactgtatttatacttacttatattcatttttaattacatgtaaattcaaaggcaggttaattcaaattgagggatgcattatttagaactttctaggaaagaagtggcaacttctgggtcatggctgtggaatggggtgataacttcctggttgttgctatggtatttgtaaactgccatgatgctagtgggaatgttttatgctaaagagcaatgagagcagctagggatggctttcattgccgtctgctggttcctgccaatttgatttcttcacttcattgcctagggaccaaatcctgttttggtcagcagggttgtgaccaaaaaacaagtcctaccaatctcctacctcaaatccgtactatgtgcacttcagtagacaacttaatattgaatatatgtgtgaagatacgtacataaaaaaacacctaaacctaaacaacttagcaaaaatgtgtatatagttcagactttttttttacacatggcttgcttttattttttgtttattttttatgttccagaatacatgtgcaagatgtgcaggtctattgcatagttgaatatatgccctggtggtttgctgcacctatcaacccatcatctaggtattaagcccagcatgcattagttc

SEQ ID NO: 2785 - DNA, 1003 bp, Homo sapiens
gcataatcaaattattcttttttgccttatcacttatcagtttgaggcattctttataagttactttttactggatttattgttgattattttattccctccaccatatattatgttcaatgagggaaataatttccttcttcttctttcttttccctcatgctgctcctcctcctctttctccttctttttcatcttttttcttcctcttctttctttcttcctcctcttcctcctcctcttcttattttcttcttcttctaacctagaataccctgtggcatatattaggcattcaaaattatttgttgaatggaggtaacaatcttttattttattttattttgaatggaggtaacaatcttaatcaatgatttggctctaatgttgccaacagaatagacggcaccatttcaagaattactaatgctgattttatagtggtagaatctatgtcctgattctgatgtaaaaataaatatgttggtagagaaactttaaatctcatacatcctatgataaggattagaggatttaaattaaatagactcaagtcttgttttgttttttccagctggtatattatttgtgtaggtaagtttctctttttgtaaaaatgccatttaaataagaacctctacgtattagcaccttcacataaaaaaaggtgaaaatctctgagtaagataggacaggaagtgggagtgattcctctttcagttgagcagcctaaagggttgttgagggtgtttcttatacctccggctgactaaagccattagtctgttgtgaatgaagagagtgaaacttcaagtcctaataaagctcagggacaacccaaataattcatattcttttattgttaatatcttacaagatttctaatgcaacaaccacagtatttgtttggcttactgtgtctctgaattaataggggttcatgttttctcctaggttgagccagtttttttgggttctgtgctaaaatacgactccattctag

SEQ ID NO: 2786 - DNA, 1005 bp, Homo sapiens
ttgaagtctttttttaatgcaagtgggctataatactttaacattgcaatgcttgtttctttgcttctattcacttaatattgaaaaatgttttatattttgtgttctgcattctgttttatgattgtgacataggtatgcattatttgtttgcatttagaattagagaaagctttcactgggcaactactcattgcctcaggagtttatgtattttaaaaggaaggcgtcttttcacttgaagcaatgcccaagtatttattaatagcaaagttgttttcatacttcatgaggttctaactacctttatttgtataggctccaccctatatcataataaatgtaaaaaattgcactatatccaatgttaaatataatttttgttatagttacattttaaagtttatgtctaattgtattttgaaaccatttagttataaataaaattcctttctcattggctgagatttctgaacaagcgccatggtaggtgtaggatgcagcccaagtattctgccatctgagtccttgtctgtttatcacatatgtctccctcattgttcaaaggttgctttgcttttgagaatgttccccacatacttattgttaagtttatttttgtgggttttaataaattagaatttctaaaaagagctgttctgagaaaattcttgtttgcaaggatatttcctcctagatattttcatctctttttttttgtatgtcctaaaataagcaacatgagtacttttacatagaaggaagtgccatagctacaattgtcaaatccacaaaacaataagccttggtaattctgtgtcttagaacatttcgtatctttgagcaccaccttgcaagtgccatagaatgacaatggcgctgccgagccagcagcacaggaacacgaacgaaggtcaacatttgtgggttccattacttaactctggagaaaaaatggcaagtttcagcaagacaacagttttaaatgtaaaactattagacaga

SEQ ID NO: 2787 - DNA, 1063 bp, Homo sapiens
attcgtgtggttaaacctaaatttaatatatgtctttttaaagattgttttgtgtatagatttgtgtttataagactgtggatatgtccacacaacttatctctaggttgtttgtgttttgctgaacataacatagagtacattttaccatgcaactgttctttgcaaacatatttttaattgggagtttcttttcaggcaccccttcctcggtgcctttgatctatagagccagggtgtccttggttccaggcaggcatttattcagcagtaaatattaaccacttactaatcaaaaatatcacttaagccagcaggaaaaagctgtattcactcaggacatttgatcattttctgaaagatttttttacaagaaaaacttgagggaatccaattaaatatgttgtttgccgtaccagcagtattatatttcctgagaacagctgtacaacaggaattgccaaaattataattcatcacatcaaaactgacctttccaaatatttaagaggttgaaattttagctacatacagtttcaggagctcattagattttcaagagtatatctaagaatgtcatggctacatttcaaaatgtggtatttgaagacaggtgtttctaaatgatgttatcagatttttaaaaatattccaaatccattagtcattgttgtgcaatgcagagtgcagcattcctttcttagaaagatacatttacttttacgatggtatagagtctatgaaatctgggcaaatacttatctagactcaagagcacattcagtttttagctaagctagattctgaagaataattttgtttctttctgtactgatatagagaagaatcctgaactgtttgtgcagggcatcatttagcatagctcccctacatggtcaaacaaaattgagaaaagcaagcatcagaatataactgcctttagaaaattcacagtccacatctcagttttgacatttctgagtaatcccattataacagtaatggtaatatagtatttaacccagaactttccaaatttatttgaacaccatatctctttctc

SEQ ID NO: 2788 - DNA, 1046 bp, Homo sapiens
tcctcctcttcttcttcttcttcttcttcttcttcttcttcttctcctcttcttcttccttctcctttctcctcttccttctcctctcttccttccttccttgtccttctccttcttctttctcttcctcttcttcttttcttcttctttttcttctgttttttaaatctctcacatgtattgctgtgtttgggaagcagaaggtctcagtcagtcggggctgtcccggtgccgggcagctctgatgttagggctgaggaggtgcctctgttctgcccactctgctgcctgctgctctccactctcacctgctttgcatgtctctgcctgcacccccctccttttccagcagatcactagcagagctttagcttttacctcagctaacttaagagcttttgtcttctcaggtaactcaaaagagtttacaccctggattttgtgaacagtttgttaaattcctgagtttctgcaattcccattaaacacagccatatgtctttcgattgtgccacatcccctggagagggaaagctgaatgtttcctgtgacaaccaacggaaggaaatctggtcccatgccggtgccctcagagtcgatgggatggagtcctaagagaaaggaagaatacacactagtaaattaatttgtagtgtactgcccacttatttttaggcctgtttgtatttttaaagcacaataactaaaactgaagctttatatattaggtttccaaataaaataagttaggcttaaatctgagactggagttgaacagtgccaatgtcctcgtaaattttatacaatggaaatctaaatacatgcattttgcacttcgttaattgtagaatgcgcttaccattttcactattcctttagacactttaaaaatacatattcctgggccttacctcaggcctcctgaattagaatcactggagtggtacccagaaagctgtccctttaaagaaatctcaggaaatttctgatgatttcacatagctagggaaccagtaggatgaaatgttggttggtaagtgatccat

SEQ ID NO: 2789 - DNA, 1059 bp, Homo sapiens
catcttcattttttgttcattatacttgcagttaatgtacattgtacttaccatttgaccattagtgtggcttaattagcaaaatcactggctgggcgcggtggctcatgcctgtaatctcagcactttgggaggcccaggcggggggatcacgaggtcatgagatcgagaccatcctggctaacacggtgaaaccccatctctactgaaaatacaaaaaaattagctgggcttggtggcgggcgcctgtagtcccagctactctgaaggctgaggcaggagaatggtgtgaacctaggaggcagagcttgcagtgagccaagattgcgccactgcactccagcctgagcgacagactgagactccatctcaaaaaaaaaaaaaaaaaagaaagaaaaatcacttaagtatcagacaagcaattcaaatcccaactcaggccatttcctgttgtatgctaagtggatgagcctctcacaaaaataattttttcaatggtaaattggcaacaatggtgtctcctttacaagactgttgaaacgatttggtgaattaatcaatacctggtgtgttcgtggccatacaggaaattattactcctcctcgctgtctctgcttctctaattttatctaccttccctcccactcctgacttcttcttgcatggattatccattcgagttcttttgatacaaggttttctagactccattttctcatgccagaatttatgttaataggggtcaattatcaatgttctctagaaacctgatctctcaatagcaagtgcttaattagattgcaaatcactgaggtcacttctgttcaccctgtgagttttcttgtgttcacccaaccaaatgggaagtacattcagaataaatacattttcataaattgctcatttttgaatgcttcgtacagtccaatttctcttttaaaaatcttatccaagcttgtgcccattaggtttctcagagactttttgacttgtttttctgcttctttgtcttggtttcagataatacttcagtttaatcttctatttgttgcatccta

SEQ ID NO: 2790 - DNA, 1024 bp, Homo sapiens
caggggtgatacaatcagaattgtgcctagaaaatattagctcagctcagttgtgaagaatagactgaggggcaggagaaccagagtaggtgaggtgacaaggaaggaggcaaaatttgatgagtttggggattttagatgcctgatgtcttgaatgacctaagtggacagttgtacagtggtaactacagcatgtgagagagatgtgagagagacatggcattgcatgggatgaagattttgccaatagtttaagctgagaaagagtactgtggaaaaacttgctaaaaggtagacaaatgaaaagaacccagaaaagaaaagaccatggaggtaagggggaattcagggaatgatgatgtcctgaagccagagaaagagtgaattataagatgggagtggctaacaatatcaaataccacagattaagtgagtaaaaactgagaaggacccattaggtttatcaactatgagttactgattaccttggaaatatcaacttcaatgaagaactgttaagaattaaaggcatatttaaattggttaagagcaaatgattgggtacacactacatattttaagtagttagaacataaaaggacagagggcactataactagaagaggaaataggctatgcaccagaatttttgtcaatgattttatttgttttgttttgagaaggcgtgtgtgcagtggtgttctgataaaccaggcctccagaggagaaataaaagctctaatttgtagctattacagatgaccatggcgtaaataccgtcaccatggctggagtaaaactatcatggaagaatgcagaaggcattcagaataccttattgaatgcagatttgagaagatacctacaattagctatcagctccagtgcaccaccacatagaaaccaatgggatgggagaggttgaaggtttgtgtgagaagtgggattgctaataaaacagataaagagggaggaaggtaggatccagagtaaaagtgggaagattagttttggataagagaaa

SEQ ID NO: 2791 - DNA, 1029 bp, Homo sapiens
gtgacttccattttaatggcaaaattaataactacttcattcaacatgtattcattgaaccaccgtgtgtcttaggaactattaatattttagtttcttaggcccttaggtttcagagatgaacaaaagtgatgtagttcctgacattattcaggtcacattctagtcaggggaatggatacaaaaagaagtaaaatatgtagtgtacaagtaggtgataaatattctaggggaaaaatacaaaaagggaaagtgtgtggaatggggtggtgatgggggaatagcagattgcaattttaggtaggaatttcagggaaagcgtcactgagaggtgatggttgagcaacaacctggagaagttgagggagcggccggtggctatgggggagggacctttcaggtaagggaccagcaggtgcacatgccctgagacaggcatgtgaacggcttgttcccaaaaagcactcaggtcagccgggcagggcagcaagctaggggatgttcactgagactgggaagacgagaggacaggttgggagggaaaggtatattttagagattttcattttacgtgctcattgaatatccacggggagatgttgaggaggcacataggtagatgtaagagtcagtaatgatgcctggaagacatctgggctggtaaatacccatggaagtcattggtccctactgagtgtttaaagctgcagcagctcagagagggaagagaataacagacttttggggagttgtccatgaagagatgatccattggggtgggatcctgagccttgcatgagaaggtcaagaagcagaaattgaggaggaagacagtgcaggcgaagggactggcttagtgcaaggacatggagcaaggggtggtttggaatgataaggggacagggaggagtcagatgtggcatttcaggacatgacatggagaggcaagaaagggagtgggaggaagtggtgatgaggtcagagaaacagactggagagccagattgctaacgtctttctgtgacatgc

SEQ ID NO: 2792 - DNA, 1096 bp, Homo sapiens
cctggggttgcactggttcacagaaggatatgggggaagtccctcaatttagaaacaataattatctgattcctgtcttgtcagatatttctactaacaaaaaagaccaggaagtgtttcccttcacagaggaaaggacattgtttattaccatcagatgttttctaacagctactctggaatgtagagagggaaaaatttgagggaaggggaaaaatgtgagggaagcttatttaaactttagtatgcaatagttttggaaatctccttgccataggagagtgaatcaaactctatagagaaaaaggatgtgaaaaaaagaaaaagaactactatatagtctttatatgaattcagtctttctagagactctactgaattaaaactttgcactaagtgctatttgatatttttccatgttctgatagtctgtcttatctaacttgggatcatggctaaaaaaaaaagtttgttttacctcttttggtaagtttattttaaaaaatcagattagttttaagaattactgaaaaatcaagcaataattttatctttgacattcatgttaataataagttatacttattgttgactgtctgaaaagcatttgggaaactcaaagttctttttttatatttaatacatttagctttttaagaggtacaagattgtctgtgaaaaatgttcaagattctacccagatgggaggaattcttcagttttcaaagccttttctaaaacaattctgctgtgaaaaagtttaaaacacatattttcttttgttatatgaatagagacatactcctagggtctctttaaacggaaagtacaattcagctttaatttgtactctaagaacttccaaaatctcagtgccaagtagcagttgctgttttctctggatgtgtgtataactatggcaatgcccgcagggagtttgatcaagattccattttaggcggcctggtggaagaaagcacaaggtattgtaaaagaggaaatcgtggaatagcatcatgttatgagacacactagaatgtggcatattgcaccagtcatcatatgatcagggagaaatcgagaggcgaaacagact

SEQ ID NO: 2793 - DNA, 1035 bp, Homo sapiens
gagtcaaaagttatatgtgggttttcgattgatggaaggggcagggttggcacccctaatccctgcattgttcaaggttcaattgtatatgccaggtcttcctcccattccagaatataagctccttgatggcaaccccttttttgttgatccctctattcctagcacatagaacagccccatgcacacagcagacactcaataaatatgtgctgaatgaccacacagtagacactcaacaaatatgtgctaaatgaccttgcagatatgcaaggtggaaataatgcaaggtagaaaagtcactctgcacatcatcaaacttctcaacactgtactgtcttggggagaaaaatggctctgtgaaataccaaaggacacggattactttgtgactcttcactgacacagggagaaagaaaagttcttctaggcttgcaggccatcaaagacttcctgatgttaataagactggcactcagcttgggagatggctaatcttaaaattaggtgctggtaagtagaaatactgtcaatcatatgcaaagaccagtcaagctgtgggacatgtattatttgatcctaggggaaaactgagattttcataagtgtattttggaggcatttgcagcgaagcgttgtttgaagctgttagagtggatgagtgtctaaagatgaaagtgtagctagcaggaggcaggaactggacctcgggaagtagctgtgtttcacagacagggtgaagggtcagtccattaaaggaaacacagaagagaagaccagatatgctgaacaccagcaaaataatgaggtaccaatggaagagagaatgttaaaaagagaaaattgtttcaaatattggagtaaagtcttagcagaagaccttccagaaggccaatggaccgggaacttaacaggtcatgggtagacttagagagagcaacttaagtgatgaggagtggagtgcactggattgaatgagtttgagacagagcctgtgggaaagacaggtggctagtatggaaaatgttcatgatg

SEQ ID NO: 2794 - DNA, 1029 bp, Homo sapiens
agttagggcatttgagctacattgtttccgctctgtgtaggcggaggtcctgcctaccacttattactgttgccagtgacgtcttcacttggatcagaactgccatttgtttttaagagagtttgtttttgcagttgggtttcaaaaggaaaggagccgatgatgactttgaactccatagaatctttcctgtgcagtcacatccctccatggggcacgtgcaagttcatccccaaatcctgcaactcggttcgagctaaatgcagcgccttcttcctaatcgatgccgaggaggcagcagaagatagaattatgattcttcaaaatcttccctcgcctctcgcattgactgttttctgtgtcattttgcactcatatattttccccttaatctgtctctgtccggctgtgtcttgtgccagctcttttcttctctttaaaatgttcgcttttatcacttcctggtattactatttctactatttagtctctgctaattcttctcaaagatcattaactcatttccatctcctgttcttccacattctgaaactatcctctgcccgtttccttaactcttacataatttcccttctggacctaaaacaagtcataatgacaagagtaatagttaccctgtgttgaagattgctatgtttcatgacacactgggatacctatttcacacttggcatctcatttaatccctgcaaatgggaggatggtgtcatgcccttttcatggatgaaactcagtgaggttcattcagaccgtgaatcactggcagacctgctagtccagcgcagatgacatgacctctggtgttacctaagagggatatgttttgcttaatcatgaactataactcataggcctggagctaagttcgccatttcactcgggacccttcacttacccatatccactgaacagataaatacctttgactgcaggtctatcagcaagtacctattgagaatttatctgaagaagcttataacttaggtattatacatagacaagtggagg

SEQ ID NO: 2795 - DNA, 1048 bp, Homo sapiens
ccttcatatcttgcctattcatagtcaaattaaacatatatgtgtgaattaaaagtgtccttccttttaaagtgtttttgaattcgaacagtttatgaatttgaactgttttgttttattgatagaagccgtcctgactcaaaatcccaatagcatttcaaggtatcccagaggatgtgctgtgactggagagcagacccacacaatgaggttcatgcgttttgtgtttcctaggtagtctgccattagatttattttagctcttatgatgtggcagcacaattggcgccagaaagcgtgctgacatgctaaccgcaagacccattgtctcccatgcaggccatccaagaccgctgtgaaaattagcttccttgccagacactttgatcttgtcactcctgcaccgaaggctccttgctgtgccctaaagcccttcacatcagcctcagctgttgcagcccagcccttccctcaccacagattctcccctgatctgctgtcagcctcctctgctccagcctaacaaagctattcacagactcctttgacagcatctgacacttttgatactttgcttttcctagtacaattcaccagaatagaatgaggtaaagcattcttataaagcaaagtctctctctcttgcatgtgctggtttcattggctgcctaacctttagaaattagaaaaagatacaccggaatgggacctgcatattgactcatgctttgcatattttatgtggctatcaggccacctaatgttaaaagtttctctaggggaaatttctaggaggagaaggagctgtttcaatattactttaagcagcacagtttgaggatgttttaaagcctttaaaaaaaaatagacaatttgtagcagcagaagatacctgattatgaggacgcaaccaaactaatggatagattttgcaagtaagcaacatggaaaaaggcagaaggcataagtcagtgtttaattcatatcgatttatgagtttattcatttgtttaataaaaaagtctatcaagaggctgatatgtgctag

SEQ ID NO: 2796 - DNA, 1055 bp, Homo sapiens
atgggagtgggtcccctcatgctgttctcatgacagtgagtgagttctcgtgtgatctgatggttttataaggggatcatcccccttttgcttggcacttctccttgctgctgccatgtgaagaaggacgtgttttcttcttccgccatgactgtaagtttcctgaggccttcccagccatacagaactgtgaatcaattaaacctctttcctttataagttacccagtcttgggtatgtctttattcacagcatgaggaaaactaatacaagtaggtttccaattatgggatatcagacatccctgacacaggtaccatttttatatctgctgtgaaccccaagattcaggcccaaaggacagtgaagctacagaaaaaatgagaaaatcagagctaacctagcttaggaaaaataatactgatgaggaaaactcactttgactactttccagtgaggcagagaaaatgagttgcaaaaatgaaaaattatgcttcattttgaagtcagggtaatgtagcagatttaatcattggtctcagaaattaaagaaaatctgaagaaagcaatctggtgttttttaaattcttctttaaaaaacaattagttatttgaactagaatttccatcactctgaaagatcctaaaagttataagaaaagataatttctttttattcagggagaaccatgtgtctttgctatgttattgcaaatataagtaaagcattttattttatcttccaatattatttggcaggagcaggcaaaaccctaaaaagagggacttcagcccagtgtttatcaccctcactttgagaagaagctgttgcatataatgcaattgtctgacaaatgaaattgaggtctttaaggatcccaaatttgaccacatttgattaaaaatcttcctgaaatgtattaaacacccacagcccttttcaaatgggaaataaatagcaacatctgacaccttcttggggacccagaatcattgtaatatacttatggaagcagcatgtgctgttctcagcagtggcctagaacttagtttat

SEQ ID NO: 2797 - DNA, 1025 bp, Homo sapiens
tccttaaggttttcatcgttgttctttttcaactttttaaatttaatgatgtttattttctttctttctcttagtagagggaaactatcactaaaaattaacctctcaataaagtgttggtcttatcctatgagattttatttataaatatatattttatttcagtattctccccatgaccaaatgaatatttggagaagtagtttttaaatatgtgaagagttagaatttcgagttttattagagtaaacttaatgtcaaattctgttgtaaatgtattttttaaaatctgaactctgcccaattttgtaaagtaaatccaacatcttgaaatagtcttgtttttttcttttctttttttcaatgccaacagttgtcagtgatttggaaaatgcaatttctagccaagcatagtaccagtttttttgttgctaaatgaaaatattattttttcttatacatttaataaaactctctaagttccaatattataagacattgcctttttaagtagaatttaactgtttttgaatttaaaagaagaaaaaaataaatactcttttacctcttctgtttatttgtacaaaaaaattaatcagttagtgtattctgttgtatagatgacaaactgtatcttcaggaagcatgcctgattcacctgtgtgttcctcttcctctcctctatgcaaaaattcagcacaaaatcaatatttctcaaattagattaagttaaaaggagaagggataatggaagaaattccatcttgcctctaagccataaaaaataatttttgaaccaatcttatttacctttgtttctatccttttcgtagtataaaatcctagaactaaatctcaaaagaaagatttgaaaaaacaagaaggaagaggatgctatgtaatttacttaaagcttagatgttgtcccacattggtggagaagttaggaattgctctgtgttttcattttaaagattttacctacatcatagcttttatggaggatacatgtgatattctattta

SEQ ID NO: 2798 - DNA, 1023 bp, Homo sapiens
ggtttgctaattggccagtgttaagggaaggaatgcagggatcttaacgctacttcttctatcatgtaaaacccactcaaaggactcagtccacctctgtttttggctcttacccatggtttatgcagactgagtaaccaagctaagccagcaacggaggacaaccaagtacgttgtcatctccatagtgggctggtaattatactccagtccatctgaagcagcctcattgtctggggtgataaccaaggttcactgtctcatggccagggaagtcaaggacgcagacacacaaagagtgaagtaaagagtggaagtttaacaggcgtaagaaacagaatagctctctgctggagagaggggtcctggaggaatggatcaccggatccacagtggaatgcaggggggtttatagatgcctggtgaggaggtgttgtctgatttacatagagcacggaagattggttggatcaggtgtaccatttgcttagggcacgaaaaactggctaggactaggtgcactatttgcataggggtcaatttctggtagccccccctctaatcttttattatgcaagtaggttttctgcctgacctgtgccatgttgtccatccctctgctgtacacatgataacacaaacagggaagatggagcctccgtgttggacatgcctggcccctaggtagcccttttctattggcacagctgccggcgttcccctgtacaagcttccagcttgcttatctatgtttgcagctcgatttttcaggctgctttttattagaaaaaaaatgatttcttgggccgctttttgttgaaagggaagctctgccaaggactcttttacactatctgcctaaataatttctttctacctcctgtatcacattcactttatcagtggttcaggagagatgatgtttcagccagtcagtcctgggctgccacacctgggctgggatgggctgaggctgtgcttatgagctcaatcagaaatttaaccaattttaaatgacagtct

SEQ ID NO: 2799 - DNA, 1058 bp, Homo sapiens
cttgtttcctggccctatagggacattgtcttccttgataaagctgggtacagccttgatatgaatagattggggagcaccaggaatgtacctcacctgggctgtcgagaaaagacagtgtgctcagaagaggtatggcaggtgctgaatattcccttggagggacgaaggcaagaaaggcccctacagcaatgaggggagaaaatccacaacccaagtagaactaggatttcttatgtgtgagacaatacattgctcatttacatgtaaagtgtgtataatatttttaatccatcgtattcaggcgagcaagatcagtcatttcatttttgtataacttgcctcgaagctgcctgttgtggccccattctgcatagcaaatcaccacaaacttagcagcttacaacaaggttccctgttcagggtctcaacactgaaatcaaggtgttcgcccagctgagtttacgtcttaggcaagactaaggaagaattcattaccacaggcattcaggtcatcggtgcttctgccatggtgacctagtgacctctgagcagctgccacctctgggcaccagacaggagggcatgaggcacgcatcttctttgagtctgatcaatattatcagatgcgacctctttttcctccaaccttctccgcatttaaaagcaacagcagagtgtaaggcaagattccaagccctccttggcaaccatcaccaatatctgcccccttttaactctcttcttcacttccttctggcttcggaaactttgggatttttttttttttcctcattcgggacattacagattgagctgaagtcttctttgtccatcaccctcaatcctaattttatcttcctcctccaaaataccactgctaatatatgatttgcatgtaaatctttctatccttctatgacaattttaattatattaatatactaaaggtggtatctgtctatatgtctgtatacaacctttagtatacaggcatgtacaatctttagtatactattgctgtgttttattgtaaactaaattttatcgtgttgtat

SEQ ID NO: 2800 - DNA, 1082 bp, Homo sapiens
ttacccattacagcctgcagtcttcctcaatcttcctttagtattaagaaaataaatcacataaaatattcagagagcttcttgattcttgatgcttcccatttgaaagaaaattccccatgttgtgctgtgacttgtgaagtttccttcctgagatttgtttacatttttcctgctgcaattttttaaaatgacattgcagctaatcgctgctaggtagatctctttctcttatgggaaaaaatatataacttaaatgttttcctcccttctcttgtatgacaggtctgtgttattgtagaggcagaacgctagaatgatggtgtgttaaatgttatagagctcagttctagaagatatattgatttggcaagttggaactataattagtatagtgcaggcaaaggcaaacactagccatgtctagcacttgctttttgattcaaactgttcccaagttaacggcattttcctcctttaaagcccagaagtgaacagtcttgccagtcgataaatgtagaattggataaacagaaaagaatagggtaatcctatttctttctctctctcttttttaaaatcaactaacctggttgtttcttatactcacctcactccatccttgtgttagagactagtaactcttccccatcatcttattttggagggcagctgggtgtggcatcgagcgtgaaaaacaaacaacaaaggtataaaatcccttaatgttgtgtgaaggcatttcctcagaattgggaatttctttccttcaacttgatgtgattgcattttgtcttcctttattcattggctctgtacgacctctctactcccccatcaaagtgaacataaaacaaagaagaaaattaaagatactcttgtatgaaatgttatgccctatacttaaatagcagctcagtaacagaactatgcgttcattggatgcgcagtcaaggagtttcttgaaaactggagagggcgacgatataatgatacagggggttctgaggactggggtgtcaatgagggatgaggaagaatgtgcttatctatggggagagaaattttcgataattagtatc

SEQ ID NO: 2801 - DNA, 1050 bp, Homo sapiens
acttccaagtatccagggagttgcactagtacaagaattggagcttttcctttaacaaatcatacatcttaattttcttctcataataccacaatagttaattaataaaataatcttacttatatttgggaaagaaatttgggattaaataaaaggcagattctaattatacttggattaatattgttactcctactaatctcaaactccaagagtcagaatcccccgaagggcttgttacaacacagattgctggccccacccccaagtttctgattcagctggtctgagttgagatcagagcatttgcatttctaacaacttcccaggtgatgccaatgatgccggtcggggaccacactttaagaagtgctgccttagagggtagacgtgagaagccttggggatttggttgctcatgtaaaggtaagggagtgggcagagacaaggagaatgtccaggtttctggtctgagcactagggtagatagagggtgatgcaattcacactgtgtgtaaaattcacaatgaggagcaggttgtggggatgattggttcaattaaaatcctactgaatttgaggatacctctttaaatatatacaaaaaggccattagttttttgtatctgaggtcaggagagagagcctaggagaagagagattgacgactcttcagtgtgtagatgatacttgaagccattatgctctggaaagtgccagtagaatgggaagcaagaagagactgacgtatagataaatacttacccaataaggggaaaaaagctacaaagagaatgataaagacaaaaaaacaagatattttttaaaaagaaagaaggagtgttaagtgatattcagtgttgccaagaaatcaagataaagactgaaagctactgataataccctagtagagaggaattccagtggagcgctgagagcgctgcccagatttcagcaggctgaggtttggagacgaggggtgtagggtgtggtgggaagatgggaggtgaagtcagtccacgtgtgtgattagctctgtgcacttgggct

SEQ ID NO: 2802 - DNA, 1053 bp, Homo sapiens
ttgttggattatgataaagctaacatgcagtaaggggttcaagaagtgtgaacaccagccgggcgctgtggctcacacatgtaatcctagcatttgggaggccaaggagggtggatcacctgagttcaggggttcgagaccagcctggccaacatggcacaaccctgcctctactgaaaatacaaaaatcagccaggtgtggtggtgcatgcctgtaatcacagctactccggaggcaggagaatctcttgaacccaggaggcggaggttgcagtgagccgagatcaggccactgcactccagcctgggcgacaaagtgagattccatcaaaaaaaaaaaaaaaaaaaaaaaagtgttactacctacaaggcctacccagttaagaataattcatgtccgtgtcttaggagaacgtacgttctcactggagagagggagcagacagacaatgcatcaaagagaattctcagttcaaacacagtcaatgctgacacagatagtacagagtgctctgggaacacagatgaagcaataaacacccgtgtaagtggaggaaggccccattctagaaaggtggcatttgaagtggcacatgaaggttaagtaggagttttcaaggtggaaaagacaggttgttcttggcggaaaacctggtttctgcctcagagatacggttggctgtgaaagatcctgacacattgaagaaatggtgagcaattccagttggcagaaaccaaggtgggctgtgaaggatgggcggagacagggatgggtgatacctgttactaagggcatcttcataggcacatccgcaatcccaattccatctcagaatcattagaggtctcaaatatttgtatttactcatttttaaaggctagtcaagtgtagtagtgagaagaaggaaagagtagaacaaggaatttgatctgtaactgattctgaacaatcaattgaaatcaattgaaataactcactacccttggaccaaccagagatctcagatttgtagtagcaagaaaggaatatgctaattttttccttccttcctt

SEQ ID NO: 2803 - DNA, 1049 bp, Homo sapiens
agataaaagttgatgaatttgtgactcacaatctgtcttttgatgaaattaacaaagcctttgaactgttgcattctggaaaaagcattcgaactgttgtgaagatttaattcaaaagagaaaaccagcgtccatcctgtcgtgatgtgatgggagcagcctaacaggcagagagaagcgcctcctagaccttcagcagctactccagagaatggtgtgatgtgcgtcattcatgaatctctgtaatcaaggcaaggataattcagtcatggactggactctcctccacataaataattgctagctcattaaggaatattttaacataataaaagtaatttctacaaaaaaaatacagactattggacaatgaaattttcttgcatatggaagaaccagaaaaaatgttgatctgaaatattttaaggtgggaaccaaaccctcatcttacctgtaaaaatctcagcgaagcactcttagaatgcctacctttgagcattgttattttctggtggacacactatgataaattatttgtggattatagctctgagttattttaggtgttgttatttataacctagtgaaaagatggggaaatagctgctaaaagtaacttttctctttcttaagctagcaggcctgtagcctactttacgccacttttaggttgtgtttttaaagtttctcatatgcctatggtagaaagtttgttttctttaataggaagatacaatgtcattccgcaaaagccaaaacagatctgaagaatttaaggatgtggagtggagtcatgaaaatgcatccctgctttaacccaaaaataaaactgtgatttgctctgttaaacaattcttatccatcctgaccttgtccttaatactcacagtatgttgattatttatacttgacattcctgagaaaacaagggaatgtaggatttggtaactggtagctagaaactcatataccctattcgggaaaataacacatttgtgaaatattacacatacacatacacacacacacacacagaaaaagacatttat

SEQ ID NO: 2804 - DNA, 1053 bp, Homo sapiens
accaccacgtccagctaatttttttgtagagccagagtctcactctgttgcctaggctgatccagactcctgggctcaagcagttctcctacctcggtctcctaaagtgctggaattacaggcatgagccaccgcacctgggcttttcttcattttgttgtaataaattcccaacttcctcctggtggactgaccaggcataaatattgatttctgaagcatgagtgaggagtaaatagaagaacatcattgctattcatagatttctcctccacccgattttcctaaatggtaacatagatattagagttaagaattttgattttttttttctcattggctcatagagaggaagacagtcattagaaacttattttggatgcatagtagaagagcataacttaaaagcatggagcttgggctctgccaacttattagctttgtaatcttaggcaaatttcctaacaactgtattcagttttctcatctgtaaaatggtgatgagcatagcatgtactgtgtagggctgttatgagaattataggcatttatatgaagcattagaatgtagaatgcagtgcctagctccgtgtatttaatattatttattacaattattatcattgtttcatgtcattgccttattcatgaggtccctttcaaccgacaatgaccaacaatgtaaaaggttttattccagtcccccacccaaagttctgcacttgcctcccatttgcatcccagtctctggaggaatgaatttgcgccttttttctttccactgatgcactgaaatgagggcccacacttgaccttgaatctcccttttgagatgtccagtgcttttgaaacactgtttgatattcactaggtgggctgtactccctgaaatgaacaacaaatgagagagagggtgtaggaagtgttgttccaggaagtgttgttccaggttactgagtttatcgtaacacttacagagagcagtttctcaaaggccaaggcagacttcctttaagcaaagatcttcagagatcagagacctctaacatgata

SEQ ID NO: 2805 - DNA, 1057 bp, Homo sapiens
aaatgcagctggaaatgagaggtttgaaggcagttttctcagtatgaatgatgaacctaagagatttttctggtccatcagcgttgcctgcgttcttctgtggtcgtaatgtgagatccccaggactgcttagtcagaggcttgcagccgagttggaaagcatcctctctaagttattcttcagatgtgtgttcagacacctgttctctcaatctgagcacattggaatttattgaatgagttttgacttttactctttctgtagttaataattctgagagtgcgatatccctagaaaaaacacatgactcataaagcctttcctcaactcacaggagtagaaggctgtggtgttgccagagagtctgatgcttaaagcaaatacagctggcactcaagtgaaaagaacggactgtagctactccttgaatgcttttattgatgaccctgtggaattaggttttcaaataaaattacattcttgagacctcacttactgattattttaatttcaagtaatatgctctgaaaatctgctctatctgaagaattatgtcataaaactgaaatgcgactgtcttttgattctgtttattaaaatctttgccatttgaaatatttaaactgtaaagccttttatactctgtagtatataatagcttagtgtcaattattttatctaagaacatttgcttctaagttaaagattggtgtatggtaacatgcttcacctggtagccacctagtttctaactttttgcttttgaaattatatatacaatttttgtttcaaagcatttttctaaaactcttggtatctttctaatatacatggactagctggaagggaaatagaataacattttgatttttaaaaactctagctttgggtaagaattgaaaataacaggtaattgaaagtcaggtctttgaacattataatatttatcatttatcaatagtcacatctattacaaagtgctagacaataaaaaggaattagacgatatcagcactgtcttcccccatatgttgtatgatctatatgcaaataaat

SEQ ID NO: 2806 - DNA, 1060 bp, Homo sapiens
atggagctttctctagagcgctttacaggaaatatctcagctgactttctgaactggtactctctgagagccagccggcccttgactgatagccctggataaggaaggccagataagattctttgaagactctcagctaaattcagagccccaaatcctacatacatttggctactctgtagtagtggattggtggccttattttacaggctagtcagttaaggtttgagatgcgcttagttgctctgcttgtgtggaatagaaaagggggattgtaacattaatacagggccggtcgggattttagggtgcaggtaaggataggtcatagggagaatgaagattctagcaggttggttttttgttctctctacagtgggaataatgtaagaagcagatagtttgttgcccccaactctttttccatgttctcttctatcaaaatgatctgtacaaaaaagttctgtttataaaaattttagtctttcatctttgcagtctgttatcatctttatgaattttttgactcttccaccttcctggcaccacaaggctagcattgctatatttattaaagattcagatttggaattttgtcctcttatcactacttcctctgccatttgttagctctggttcttattgtatcttacatttgaaaacctttgaagcttatggggtatatcaattctttattttctcaactttttattatctaagtaccctcaattatcaagttgtttaaaaaataaataaaatacataacagaaattgttctgttacgcactaataaattgatcatttataaaagtagatccaaccccaaatccctctccttttaacacagaccatctgttattatccaccatcctttagtttggcagggtcagtttatcaatgatttttggatgttttaaaccacatgacacaaatgcagcataaagtgaacttgttaatcatgcagaagttggagggtttcttgaagtcagagaaggtgatggtggagaacttgaattgcatgaactgtaattgatttgtgagcacctcgtggagttagcta

SEQ ID NO: 2807 - DNA, 1051 bp, Homo sapiens
ggtatcatttgaaaatgagacagatgtggacttaagattctgtggtaagtcacgtgtgttaaccactttgaaatctcagggtgcaagccaggggacacatagaaatattaataccatctttctgtcaaggagtccttctggaagtatgacaacaaacagatataattttgcttaattttttgctatttgcatttttccttatttcataactaactgtgtctgtccttgtcgcccttcaggaagttgttgacatgaagtctgagggacaggccactgtaattcagcagctggaacagactattgaggatctgagaaccaaaatagctgaactagagaggcagtatcctgccctggacacagaggtggccagtggtcatcaagggcttgagaatggagtgacagcctcaggcgatgtctgtctcgaagctctcaggttagaagaaaaggaagtacggcatcataggattttagaggcgaaatcgatacagacttcccccacggaagagggcggggtgctgacactgcctcctgtggatgggctgccagggcgtcctccatgcccccctggggctgaaagtggacctcagacaaagttctgttcagagatttctttgattgtgtctccaaggcgaatatcagtccagctcgacagccatcagcccacacagagcatctcacagcctccaccacctccatcccttctgtggtctgctgggcaaggacagcctgggtcacagccgccccattctatttctaccgagtttcaaaccagccacgaacactctgtttcctctgcctttaaaaacagctgtaacatcccatctccaccacctctgccttgcacagagtcctccagctccatgcctggcctgggcatggtgcctcccccacctccccctctccctggcatgacagtgcctactctgcccagtacagccattccccaacctcctcctctgcagggtacagaaatgctgccaccccctccccctcctcttcccggagcgggcatacctcctccgccgcctctacccggagcaggcatactccc

SEQ ID NO: 2808 - DNA, 1030 bp, Homo sapiens
tgatagtgacgctactgttgaccttcagcttcaaacagggtttatgggacagtctccatcatgactccagataaacctattcagcaactccttggcctgggtcttggtgctgagctctgcacttcagatctgtttttggagggacaaaagatttttttaaatgtatgttagagaaaaatcactacaaagtgatggattgctgaagaaacatagttttatttaacttcattgtatttggaagaaaaatctgtccattccatttacttgagacatttaaaattttgtttaaggaaagtgtattttcaggatgcatgcaaattgttcccctttttatgggaaatgtgcactgattgtatgtgcagacattttggtaccttatgattcatttccagtaaaattaatagcctttaatgccgtggcatatgtttatggaggtatttcaagcaattcttcttatatacaatggaagctggaagttctgtttttgtttaaatatttaaaaatagccaaataatttttctgtgatctctgttctccttgaaagtaagactgtggttgaatgcactggtgtttaacgaggtgcctgtgctgtttttaccgtcatggcagagacgttttcagtgtgataatagaagattcctcagctgggcacattgccgtttggcataaggagaaagagggttattttctctggatgctcagactgatagaaatgaagaatatcttgtatttccaaatccttttttctccaaagagcttaagacaaagcattttatacttttctcatggagcatggatttaagtttgttctatgatgatttcttcatttctccttctttactttgaagcattacacaaaagattagctgagaaggtacatagaagtttatcagaatatagtttgacatagtttttcataaccaaatgagtgtgacactttgacattagaattgtctgatgtagaaccccgtctcttaaggaataaagaggaaaatagaaaaagtgatcttggccgggtgtggtggctcac

SEQ ID NO: 2809 - DNA, 1594 bp, Homo sapiens
gcacagttaaataaaagtttgagtggtatgagatttaaatacataagcttccgtaagcagtaaaagtaagagccacttgcttgtgtggcatataaatagtggttagaggcagacagccattgtggttaaaccttgccaaatgtgaaatgatgctacatttcatttatcccatggtaaaaaaaagaatcatctttgtaaaataagccataggtaaataatgtctaatcatgtttaaaggatctgtaaaggaacatgatacccagaatgtaaatttgcacatagaagtcagcaagagtgtaaaagaagaatctgatattttttaaaaagtacataacttgacattggtctaaccatttaatgcaacacaatgaatctctttgtgggtttcttctatgtaatctatcagattaaaattctttgcccagagaatgggagaaaaagtatgacagttaaatatttgttggactttagcctctggaaatctgatcagaaaaaaaatacatagttaaatgtgctacttattataagggcaggtaataaaaggatttgttagaattcacatttattacagatactaactttaaggattagatatttggtatcatgtttagtctttccgctgtgcttgatgacctaatccctaaaaaagactttttaaaaatgttcgaggtcaggagtttgagaccagcctgacaacatggtgaaaccctgtctctactaaaaatacaaaaaaattagccgggagtagtggtggatgcctgtaatcccagctactcaggaggctgaggcaggagaattgcttgaacccgggaggcggaggttgcagtgagccgagatcgcgccactacactccagcctgggcaacagagcgagactccgtctcaaaaaaaaaaaaagttataaaaatgtgtaataacgacaggaaaagaagtattcatcattcagctgctcttatatgggagtacataacgtaatacctgtaagtgttcttacgggaagcagtaattgccaataaaaggctgcttcttactatgttgaggaatctgggagaacaagagtggcacacttcaggtattgcctgccactgtattattggctgctatgaaaaggaaaaagagattacatattttatctttgatctttgctgcagttttatttattgcagatattcatttttagattgaaaactatgttttattgtaattagtagatatttcagtgcttgcagagtgacagactgaatgataatttgtgttatagaagacatgttttgtattggtgttaattgttccagttgtagttggcaagggtgtgttttggttgatttggacagttatatttgtcttttgaccaaagacataaaataatgtctgaaacactaaatatcttataataaaacaatttaaatttgttttggggatacataataaacatttggtactttgtaacttttaacatctgcttttaatagaatacattcctattgcaagccttaaaaatgtatttacatagaaaaccacatcaaaattcaaaactataattagacaagcataggttttgtggaatctggatttgtttaagatgttgaaagatt

SEQ ID NO: 2810 - DNA, 1041 bp, Homo sapiens
tcagttctgctctgatcttagttatttcttatcttctgctagcttttgggtttgttggctcttgcttctctagttcttttaattttgatgttagagtgttgattttagatctttcctgctttctcctgtagacatttagtgctataaatttccctcttaattactgctttagctgtgtcccagagattctggtacgttgtatctttgttctcattggtttcaaagaacttatttatttctggcttgatttcgttatttacccagtagtcgttcaggagcaggttgttcagtttctatgtagttatgtggctttgactgagattcttaatcctgagttgtaatttgattgtactgtggtctgagagactgtttgttatgatttccattcttttgcatttgctgaggagtgttttacttccagttatgtgttcaattttagaataagtgcgatgtggtgctgagaagaatgtatattctgttgatttggggtggagagttctgtagatgtctattaggtccacttggtcctaataggaccaaagatttcaagttctgaatatccttgttaattttctgtctcgttgatctgtcaaatgttgacagtggggtgttaaaatctcccactattattgtgtgggagtctaagtcttggcatgagtcttaaacatactcttactgaaacaccaggggttcagtctagttcgtgctgctcgccgcacagaaagccaatcactgagatgacaagtattgccaaggaagaaggctttaatcatttgctgcagccaaggagatgggagctcagtctcaaatccatctccctggctgactaaaattagaggtctatatagtgggggagaaatgtagcaatgtgtaagaaaacaagaactagcatgcagcaaggagtcaatcatggtgaatgaggggtctggtgtggtgagctggtgagttttagttctttgatacttatttagaggcctgaaggtgctttttggaggaaggaactcagataaaacaaatataagtttcaagcattaagaccaa

SEQ ID NO: 2811 - DNA, 1077 bp, Homo sapiens
acttctcaactttatgaaaaacattaatacacacatccaagaagttcaatgaattcctcatagataaacataaagagatccacaccccctatatcatagtcaaattgttgaaagctaacaattaaaaagtatgaatgcagtgaaagaaaaacaacacatctcatacaagggaaccccaataatactaacagcagacttatcagaattaatgaagaccagaaggcagtaggatgacattcaaagtactgaaagcgaaatgttcaaccagtcatcttacatccagtgagagtttttctaaaatggagacaaaagacagacatttccagataaacaaaaactgagagaatttgttgctaaaagacctggctttcaagaaacagtaaagaaagttcaagttgaacgaaaatgatatggtaatttgagatcacatatacaaaaacaaggagcactggtaaacattttttatctgcacaaaacatagtataattacatagttctcttaagtgatagtttgtggctgcagtgagctatgatcgtgccactgtactcctgcctgggtggtagaatgagaccttgtctctaaaaaagaaaaaagacaaaagtccgtgaacatctcaatagctgtagaatccgcagttaccaaatcgtatacactttagtgacacacacacacacacacacacacatacacacacacacacaaatgggactagaagggaacttcctcagcctgatagcatctgtgaaaaacccagggctcacattgaagactggatgtttttcaggaaaaagacaaggatgttcattcttgttacttctgtttagcaatgtgctagaagttctagtcaaggcaattaggcaagggaaagaaataaatggtctcctgattggaatggaagcagcaaaacattttgcagatgacatgatcttgtatgtaagaagtcctaaggaattcattagaagaaactattagacgtaacaaggaatctaattgtatttctagacattagcaattatcattgtgaaaatgtaattaggaaaacaactccctttgcagtattattaaaaagaataaga

SEQ ID NO: 2812 - DNA, 1059 bp, Homo sapiens
aaaatagcaatctgttatactcaacaacaatatggattttacaggcaaaagccattataaacaaagtgtttccatttatgatgctcaagaacaggcagaagttatctgtgacgatagaagttagaaggagacttttgtgtgggggagtattgaaggaggtataaatggagccttcaggagtgctgataatgtcctatacaatgatctgagtgatagttacaatgatgcatttgtaagcaataattaaatgaactctatacttgagtttcgttcactttactatagaataacaatattttaaaaactaaaatttcttaatagtggccactttagaaaaactttttattgaacagcaaaacgctaatttgagactctgggacaatagagttgaagatgtcttcagggataggaataatgaatgatttggctattgttggacgaggatgtgatagaattgtttgacacaatatgataaatttcttcaaatggatttgttaaagaaaggaaaaatgctaaatatatgatctctgaaaatgatgccatcagaaagaagactatttggtctgtaaaggcttaaaatcacatgttgaaatttttattctctgaaaatgagcatcataaattaactcactgacatgccactgtttatctctctttaacttccaaactctaggaggtctttgaagaatcagccacttgcttattcagtatgtcatttctaggaataaagattgtagactttcaaggaagctggacatgtcttcctccataggatagggtcaaatccagttttcatctttgtgtcttcacagtgctaaaagcaccagcatactctatggatggagcaagaaatcaaatcttgtccctataaaagggccagaaagaaacatcatgccattggccaaagagcaggaagtgaagcaaaacgcctgaataccgaatgaccatttactaaatcattaaaagtttattatgtgattctagtcaataaacatatgctcagtgattcatttgttttctgaatatttaacattttctctatcaaacttttcatctaaa

SEQ ID NO: 2813 - DNA, 1074 bp, Homo sapiens
tttcaaggagtttaaacatctgtgcatattttctttttgctttaaagagtggagacttaggatagttggtttaaattagaaaggcattttgttttaagagcctgctgatactgcagcattatagtgcatgttactgtgatatttttaaacaaactgtgaaatttagaaatgcaacctgctagaataaaaactttaataaaatatatacctaatgccattttgtttcttcatcggtttgtttggaatcactttggtgtattttcaactctggattttttttttaattgtattttttttttttttgtcaaggtcatcctaaatgtttcagctttttctaagaaaggaaaagttaatataaataagaaattgagtttctaattcttttaaacttatccctttaaagaaaaatatcaaaaagcctaagaagttcccttggttttttgttagcaaattcctgtgctgtatttagtgttgtgttatggcagaggtgtgtgtgcacatggctctcagggactgcctacagcagaggacaagtgaactttggagtcggacttagctgacaggaaatcccagcctgcctctctggctttggtctttcagccatttttcatactgaacatcattcatttctgtgactcaatacataatagttattatttttacagatgtgatttatgcgtgtcacgctgctgggacatttaattactctattcaacttgactgtatttagaaaaggctatggcgctactcctcttgtttaacagcttctattctaagagaagaatctaaccattgattgggttggatcataagtgtggctaatcttgtaggctaggtaggtatcattttctttattttagtgtgccttgctttttttttttttttttttttttttttttgagacggagtctcgctctgtcgcccaggctggatctcgcctcactgcaagctccgatctcggctcactgcaagctccgcctcccgggttcacgccattctcctgcctcagcctcccgagtaactgggactacaggtgcccgccaccacgcccggctaattttttgtatttttagt

SEQ ID NO: 2814 - DNA, 1949 bp, Homo sapiens
agttaagatttaaaatgactgctgttttcatgaaatagtatcagacagttcagaaaaggctcatggttcctgattctcattgggtcaaaaatctagagatgaatttatctttccaaagtaagaaaactgaatccaaatcaaggttatgagatagccaacaacagtatgtctaaagagttcttggagaaatcacactttgtaaattcccaaggggcaggagttggccaatgtatgggttgttctccttcttaattttagatgtttatttcttatcgccttctattgtctctgctgttcctcttgttggaataaactcaagtgattttacaacatcataaatataactgccggttattggattacaaaataaaacactagcacctggcatttgcaagacattttatgctttgaaaatattttatactttaccgaatttgtttatctcaagttatgggaatattgcatatggattattaactgtattctacaggtaggaaaatttagatcttgaggccaaggagcttgtccaaagttacatggatgctaatttaggcaaagacatgtcctgaaatatggatctcctactctgatacagatcaaatcattggaaatcttgagtttgggaattgttctctttgcctttccttctattcttacatctcttgttcactttggatttactatttcatatttacttatattctcctggtcattagggtattcttgggtgcatttgatagctcttattccttgaatacattgcatacctctggatataccaccttgtgctctaatgtcgtttgagaaacaacagttttcacattctgaggttctgctttgaaatttaccttaattcatctctatcgttgagtaatcttatctttttctcttcagagaaagatttgccttattggatctggccatttatcccttatttaatgtccacttttcagcaaggtcatgacatgccatttcagaagaaagcaatatgctcttttaactaggaatcaggaaactaaaacttttgttgtggctctacatttagactgtgtgcaaattatttactagcttgtaaaaaattgtgagattttactagcttataagaaattgtaagattttactagcttgtaagaaattgcaagaaacttcaagttatctctattggatatttaatgtggagctctttgatgtcatcttaattagctaatattccatgtgacacatataaaatgcatactatgtttaaacttccgaattagcaataaacaccatgttgactgatcaaataattatttaaatgtggttttggctacttgtgtaataaatatagttcacataaactttctactatgtcttgatatgattctaagttacagaagatattatcttgcagttcttgaatttaatagtagaatcacagttcaaccattattcaaatacttccttttcaaaagaagtattcagtggttcccaaatctgcaccagcatcagctgtggtatttttttaaaacatacatattccagggccctactctagagaaaattgacttttcagaaggttgagcaggatcctttatttaagaaggtacctaagtaattctgatgtctagccaaggttggttgtctaaccatttttccaagtttattgtgggacatctaagctgggcatagcagtttaaacaaggtttacttattcagcggacatttttggatgcttacaatatatcaatcattgtgctgagtactacagtaagcaatatgacacagagtttgtctagaggtaattatactttagtgaaaattgcccccaaatcactttatcatgtatatgttgcagtaggagagtatatagtctcaaaagagtaaagaagtggctcctaagtcagctcctgtaagagttctgtgggaagtacagggatgttcaggagaagcatcacagtggaatgaga

SEQ ID NO: 2815 - DNA, 1111 bp, Homo sapiens
tcatggtaaagttttgctggtgatgaggatgctaggtgggccagtcctcaatcactggcaggtgcttgaggtggcagtggcaggctgagcatgcctgtcctttggtcttagggtggtgtatgctggccctgatattagcaggttcagtcaggccagttggacctccaggtggcttgcttgggtgccagcagtggaagaagtgggctgggtggctgggagggtccttaggctcctaggcagtgggcatcgtgctgagggacgcagtagtagtggtgagacaagccttaggctcccaagtggtttgcgctggtgttgcagtggctatgacaggccacgcggggcagtctcaaggcttgcaggtggcatgggtgagtggatggtgtgggtgggtgggtgctagctgtggtgttagcagtaggttgggtgggtttgtcctcaggccctcagaaggagtgctcaggtgtcaatggtggtgaatggggcagggccattcccaagcctctgggtggtggtcttgggctctgggggagtgggatgggttttaacatggttaaatggtcctgttctctggcccctaggtggtacgtgtgggtgctggctgtggtaagtaggataggggtggaccccaggtcccccctacccctggcagaatagctggatgggggtggcagcgactgtgtggtggccctgaggccctgctgctggggagggtggagttaccatggcagcagttgtaaacaggtgactgggggagcttgtgctgtggctccatatggcggctgcaagaggggtgccccatcctcagggtgctcttaaatgcacagaggccttgttgctaggggcagcagggtcgttggcaaaggcttgtgctttggccctggctgcggttggaggatatcaggggagccccggggatgtggagatgcaggggctattgggccccaggccaggatgcagtctggtgggggctgacatttcaaaacagtgccctcctgtaactgcttgtgacacagcaggtgagtggaactcagtgcgcgctccctctggaggggtgccgctgcctgatctccgggtggctcccaatgttagcctcagggcctgtgcaggccgc

SEQ ID NO: 2816 - DNA, 1021 bp, Homo sapiens
tggtaatgttatttcaaacttagagtttctgtgtaaaccgaggttagtatatatcccgtaagtgtgatcaagctatctcccatgattgtttctggaaggattactattaatttgcctgtggtgttatttatataccttactaacagtctaattatcatgtgacattattatcttagttcaggctactataaccaagtaccccagactggtgggtgataaataagagaaatttatttctcacagttctaggaggctgaaagttcgagatcagggtgccagcatattcggttctggtgagggccgtctttcaggttgcagactgccatcttctccatgtatcctcaattggcagaaagaaggaaagagagctctcttgtgtctgttttataaggggactgatcccacgcacgagaattctacccttgtgacctaatgaccacgcgacctagtgaccaccacctaggatcctgtctccttgtaccttcacatgggagtgaggtttgcaacatatgaacagaaatattttctgtttggaattagagtggttcttaacattttataaatggctttagtgtcaatattttaatacttggattctactgtacaattgacggccattcttatgccatatcctcctatgatatttatgctgagagatactgcccaaaggtgaatagagtaatgaagtgtaaattcagagtgtcccttaagctgactagaacctaagaatagatttaaagcagattgaattatccaatggaatgccagtttacctattaaagaaatatggtttcaagaataacacagaccttataatcacaaaagcatttaactggctttctagcttacccctttatgaatgtggattctatttgttgggcttaaaatcttgtgtgggataattcataaatagcacaagcttggtatgccctgtcaattgatgagtaactcttaatcacaatttaagtttttattaaattgttttgatggggaggagacttcctcaagctgaaacatttgg

SEQ ID NO: 2817 - DNA, 1039 bp, Homo sapiens
tgtcaagagcagtgtaagtattttgcatgagtggacgtaagcacattgaggagtcaaggttttgtttagtaatgggtttgaatgtaaagcagttgtaaaaaatatttatgttcctaggtcaaatgcttctttatgttctgagctagaaaaaagtaatgtccatcagatatttgtgattttgtgattaatgtttcctaaagtgaataattttcattcttatgtctaatgtataattacaactttttaatataaaaacaatacaaaataactttttatattgttttaatataaaacaataatttcttttaccatatctttcccatgtctgctaatatttatccttttggaatctgaaggctaattattttctatgaattagacagtatatctttttttctttgtcatgttaagcaatgaaggccaataggtccatattttgaaaataacacaatgatgagtaaaatggcttgtaaacaaaatataaaaggtgattctactctgctgcatatgattttctccttgatactggtgtgtagggggatgtctaagctctcttgcagacctaatcattttttggtactacttctgcagttgtgtttgtttgaaattaatgtctaagcaattgtgagagtgccagtagaaatatgaggttaggaatgatggttagagtcacagactcaagtctgagacggtaaacttaaaaaataaaagagttacatttctctgataaaaaaatcatcacacaaaaaagtaggataaaggaaattctggacatgtttttgaaatattaagtttaataattggcttgtagaaataaaaatatgtaggactgtccttcctagataatgaaataatttccttcatgggggagagagagacttttaaaaatcttttctgccagccaacaatttgtttattgttttatatacagatgcttctcaacataaaatggagttatggcctgataaacccatcctaagttgaaaataccataagtgaaaagtcattcaatacatctaacctagtaaacatcaaagct

SEQ ID NO: 2818 - DNA, 1047 bp, Homo sapiens
catatggccacattttgtttcccagaggcaagttgttataacaaggtttagaaaataggataacgtatagaaagcatttatctcaatacctttcatacaataaatatccaataaatcttggccattcataataaggtaaacatagaataagcagtgggattagtttgataaagacagttaagcaataatcatagtagctcatctgctggctctagcacttctgtttctgcttagagacttgatttttatttctaaggaaaggctgaaaaataatgtgttatggctcagacattttaatgagacgactgaatctcattttagcattttataataacatccactgtgtttagtttctctgctcactcccaagatttccatatttcctcagggtgcttccctggctttctgagctcagcgacttgtagttcgttaagcaacctgatctgcttttgatctcttctggctgtcagcagcttttcttgatgtagtcatgccaaatgatgactctgttccagtgcctttcttgaataggaattgtagcatttgccacatgacttaaatcaactcaacatgcacggagcattgagtaattaagttaccggaactggatgagaatgttctcatgcaaattcttctctgtatcctctttctttctgttcttcctccctgtactcacacactctctctcttttcaatatctgagttgaaaacaagtttaaaattcatcaactataccttcaagttgaagcaatgtccattttccagagatttataggaaaaaccagccctcaaactagtttagggtttattttggcttacaactactagtttgtaactattacatttaaattgttcatttctgatatttccttttttccccttatgtttgaggacaggaaacaaataagcttttttaaaaataacattttacagtggtccttcccacctatccaaggttttactttccttggtttcagttacccacagtcaaccttgatccaaaaatattaagtggaaaatttcaaaaataaacaattcatatgtttt

SEQ ID NO: 2819 - DNA, 1023 bp, Homo sapiens
gcaactctaagctgtgattaacattgattgaacttgtagacttgtataaattattccaattccctactcaaaaaaaaaatagccagactcttcatgatcatggttcattccagggagtggcatgtcatgtccttgctttaatctgacagtgataaactggtgtttgccccacaacgtgccactctgtggatggcatggatgtattggaacccattgtctggtgggaatgtctgacatttttctttctttcctctggctgggttattctttgtatttggaaacctaatgcatgctttctgatactagcccttcaacatgatataaaatctttttgactcagagaagtctttaaattaaacaaaagttgagatgattggaattactcggttatgccaacagtctcctaacaaatgttttttaatatttggatttgactgcaatgcaagttttccaggaactctatctttgttctgtttttaataatgtttctaaatgacccttcaagtttgtgagattgtagtgttcggtattttttttttttatttacatagtcacataccaattttgaggatgataagtaatagccaagatgatatgttgtgcaacttgatgtgctacagttaagagaagaatggtgtccagtcttctaaatatattccttatatgtaagcacattgagcatatttatatgtggcattgtgtatgtacaaaatatatgagagttatgaatgtagaaactctagaacgtgacattctatttttacatttatccaacaggctcttccttcttaatatagtgaataagtaaagcaacaattaccaagaaataactgtacaggttttatatcacactgagctttggaaatttggatgtgagttttggtggtttacctcagtgaccactggagacttaatatccctattaaggaaagccttggccttgattatgggcatcattgaaagcactttctttcatacagggtcttagtacttcctctgcatttcagacacttgacacacaga

SEQ ID NO: 2820 - DNA, 1477 bp, Homo sapiens
ttgaaatcactgaaacttataattatatcaaagcatttactactcaaaatatttcaactttggaatgttccatctcttctaaagatcagatttatatcatgccatgctctgggaaagttcttgctgtttcaggaattctcctagaggctgacatggcttgagactgaggccaagaacactctgaagattggctccatactttattttgttataggttgttcaagtgtcattaatgatgatttaacaatgaattagtcatactacaatttgattaaatgttaggcacagcttttttaagatgggaaaatactatttaatcatttaagataattgtgaagattgaaacagaactctggtgaaattcataaatcacgttgaatgtcattttcaaattctgaggtcttcataacttagagtggaaaatctactcattgattcttaaccgaaatcattagtcctgtagtaaatattagggaacattgtaaactcatcccactcttagtagtgaataaaagtgaatcatgctttttccatctagtggggttgtggaatcaagaatatgtagcacattttttaaaaatgtaacaggaaataatataggtaaaagcatagaatattcatttttgtcttataagaagaaaggaatccttaatcctaggaggatttattcaaaaaagcaatcaagcaatttgctggatttcacatccaaaatataaacaaatgtcactcttattcttggtcacattatatgtgatttattatataatattttgaatctgcaatttatagaccaggcattgagactagtgttttccatactgaatagtgaaattatgttttgcaacacatttggaatttaggaattgtgctttcaaaacacagatgatcagccgaatatgatatctctggtagtcatttataatgatttgaaaggcagttagaggtgtttaggatttgtctagtagttccctggtaggaaagacgggattgcccagtcatactaactgtgtaagtaagtatctcttcagattttaacaaccttacgggttttttttttttttttgagacggagtctcgcactgttaccgggctgatgtccagtggtgtgatctcagctggctgcaacctccacctcccaggttcaagtgattctcctgcctcagcctcccgagtagctgcaattacaggcacccgccaccacgcccggctaattttttgtatttttagtagagacgggttttcactctgttggccaggctggtcttgaactcctgagcttgtgatccagcctcttcggcctcccaaagtgctgggattacaggcgtgggccaccgagcccagccaggaagatcttttaacctccttgttatgaaactcagatattaactttttttttaatacttctccatgttaaatgaaaacaatgttgtaaggatactaacctatatactgtattcttagaagtaggaaatgcttc

SEQ ID NO: 2821 - DNA, 1049 bp, Homo sapiens
ctctacaacagtatactgtcattctcccttctgttgtttgtgctattgttgtcatatattttacatctacatatgttataaccaaaacaatatattgctcctacttgcatttaagtcattatcttaaaaaaattttaaatgacaaaattgtattttatattcatcctcataattagcatttccagtttatttcactcatttgcatagatccagcttttcattaggtatcatttttattctacctgaataacttccttaacatttctcattatgtagatttacaggtggaaaatttatttagccattgctttcttgaaattatttatttcccatttttgagagatattcttacagaatgtagaattctcagttaacaggttttttttttttctttctgcagttaagatattgttcttttgtcttgtgtttgcatagtttctgacaaggaatctatattagttttccgttagtgctgtaacaaattaccacaaacttcatagcttaaaacaatacaaataataaatttgtaatttcttcaggtcagaaactcaaaatggacaaaaattatattagcagtgctgtgttccttctggagtatctaggggatacatttctttgcctttttttagactctagaagctgcccacattccttggtttatggcttctagctatcttccaagctagccatggctggttgaggttttcttgtgatgtatcactctgtcgctaactctcctacctttctctttcacttacaaggacccagtgattgcactgggacaacgaggtataatacaagatgagcttctcatcttaaggtcagctgattagcaaccttaattccatatgcaatttaattcccccttaatttattatattatattcccatgtaatatatttacagctggggattaataaattaattcccccataatttattatattatattcccatgtaatataacatattcatagctggggattgggacatggacatttttagagggccattattctgcctaccacaaagtcttgggaatttatatt

SEQ ID NO: 2822 - DNA, 1065 bp, Homo sapiens
agggcgtccatttcgtgtctttgcttactcatagccatttggaacaagttcagcagaagtatttcacattgcgaaagagtctggagccagacagcgactacagacactaatcactgggtcaaaatagtaacttagtaggacagcaaccaccagaaagtatttgtggaggtagaaatgtggagtcggatatattagtgccgttggagaagatatcaccaaatgcaaaaatgctgtaacagaaccattaaatcactatttgtaatcagtttcatgttcagtggcacaggactgtctgagccgatggtctctttggtaggatcagacctaaaaggtaatcttatgcccttaactctagaataaatagatggaaagagaattaaccaaataaataaaggctgcctcctaaaacatttggtgtttcttttattgtatggttccaagtacaggctttctttgcctcaaactgcagatctctagcatttgagatttgcggggtgggcaaaaggggaaacatcattgctaaaataataggtgcagcaattgatcaacttccctaaggagctgcaattttaggtctattcaaataagagttactggtattctctgaatattgtcattataaaccacttttcattgttgccttttttcttaaactacatcatcctgttcctttcctccagtgtcagtagagaattgattgctttattttactatcactctactccgctactacttctattttcagtagactctatctcggaacattttccttggcagtggatctcaaactccaagctatgaataattacccacagtatgtttggaataaaaaggtgagctttagaagaggattaagcattttttaaaaatcattcttttagatttcatcaggttctcactaaattcacatgaagtattatcttatcccttgtagcaattttatttactgctatgtctttaaaaagtggggaggggactaaggagctattagcctctgtgtttatcctgtaggcattggacttctccattctatgccaattaaaacaacttcacacacaaattaag

SEQ ID NO: 2823 - DNA, 1300 bp, Homo sapiens
cagatggttttgaggattccaagacatcagtggagaaagtaactgcaaatgtggtagaaatagaaagagaattagaggtagagtctgaagatgtgactgagttgctccaatctcataataaaatttgaacagatgaggagttgcttcttatgaatgagcaaagaaagtagtttcttgaggtggaatctactcgtggttaagatgctatgaacgttgttgaaatcacaacaaagaatttagaatactacatcaacttagttgacaaagcagcagcagggtttgagaggatttactccaattttgaaagaagctctactgtgagtaaagtgctaccaaatggcatcatatactacagagaaatcttttgtgaaagactgaattgatgtggcagatttcattgttgtcttattagccaccccagccttcagcaaccaccattccaatcaatcagtagtcatcaacatcaaaaagatattaagtcactgaagactcagataattgttaacactttttagtaataaagtatttgctaataaagtatgcattttgtttttcagatgtaattctgttgcatacttaatagactatagtataatgtaaacataacttttatatgcactaggaaaccagaaaattcgtgtaactctattacaatattcattcactttattgcagtggtctggaaccaaacccacaatatctccgaggttttcgtgtgtgtgtgtgtgtgtgtgtgtgtgtgtgtgtgtgtgtgtaaagaaagatagagaattgactcatgcgattgtaaaattggcaagtctaaaattagcagggcaagctgacaattctggtaggagttgatgttgcaatcttttttttttttctctttataaattttaacttttagattaaggggtacacgtgcaggtttgttacatgggtacattgcacgacactgaggcttagaatctaaatggttctgtcatccaggtattgagcgtagtactcagtgggtggtttttgagcccgtgatccccctgcattgttgagtagccccagtgtctgctgttcccatgcttatgtctatgtgtggtcagtgtttagctcccacttataagtgagaataggcagtatttggttttccgttcttgcgttaattctcttaggataatggtctccagctccatctgcgttcctgcaaaggacatgatttcattcattttatagttgcatagtattccatgatgtatgtgtaccacattttctttatgcagtccactgctgatgggcacctgggttgattccatgtctttgctat

SEQ ID NO: 2824 - DNA, 1041 bp, Homo sapiens
tagatggggttttgccatgttggccaggctggtctcaaactcttggcctcaagtggtctgcccgccttggcctcccaaagagctgggattacagggatgagccaccgtgcctggccggcgacatcttttatattcactgaacagatatcacatatttagtagttcttggcttgatataaaatattgtcttagcaaactagtaaacagaattctccagtttctgtgaaaagcaaaagctgaggtcaaaggcctgaaattataaaatcagaaatttcagtgagttgcatgaaaaaattactagcaaatgacaaaatcgttagtaaaagagccatcttttataattaaacaatgaaccccaaaattcaaaagtaaaaataagaataatgaatcatatgaaacatttgacgtttctccgaagaaataagtctgtgtgccattttctcagcagtcctatgtaaccggggcaacaatcagtagtaattctgtgcaggaaagcagtgtaactctgatcctctggccttttgagtctgaatcttatcttgcctcttacacatgatagctctatgaccttagaccaatcccttcaccccaggaaaatagtatctactttgtaggtgagaattaaatgatctctggcagatgcttagtcccaagtgatcaatagatgttaattgctatgttattttcacattatttttataatcagaaattataaaaagtttagtggtagaattagaaaccagagtcagatttcagactcgggcaatgtatttgtttgttgtcatgtttctcgctgtctccatggattgcagccctgggcagtctcggatggttatggagcatagattttggaatcagctctgtattttggtacctgcaccaaactgctggcaccatggctccgaggatttatctcaggttttgaatccatgtccttatctgtgagaaaaagaaaaacaatgtccacattataaatgtggtgatcagttcattacttaactgattaagtaggttaaatgagtaaaatatgtatgtcgagta

SEQ ID NO: 2825 - DNA, 1029 bp, Homo sapiens
aacaacatggcaaaacctcatctctactaaaaatacaaaaattagcctgatgtggtgacaggcgcctgtaatcccagctactcgagaggttgaggcaagagaattgcttgaacccagggagcagaggttgcagtaagccaagatcatgccacatgtttcaaaatagaagtctttttttttcctccaggagctaaagatatctagaaagattatatataactaatcttctgatgagaccgtaagatgatagtgaatttgtttaataaggaagcaaatagcacaattaaacttagagaattaataagtaatgtgctttatttggacattattatgtgataaagattggactgtatagtttaaaaatgtactcaatggatctcataggatcttttaaaaaatattcttaaagagaatacactacattccctctcctacttaaataatagcaaggcaattggaaacaaccagtaataaaaggcaagaaattgtaatggaagaacgcatatttgtagaagaactttaaatcacacattttaaaaaataaatactatttctgcatgtaatattgcttaagtggtattttagcaaagccaagattgtataacaaatgagttgaaatggaaaattaatctttcatgcaaaataaagacaaaaaaggggaaagaaagaaagcggaatgtgggttccactagtttcatacagtatgtaactattcatttgtcacaggagagaaaatatttaatcggttctgaactgatgcacacatactttatcatgtttagtgacttttagagtgtcagtttgtaaaatgtttatccaaggaatggacttctggcacatggataaaatgaaaagtgaaatgtttagttcataataggcatattttccagaatctttctgagtaactatccggagatgaatagaaagactacaggtctgtgtttatctggcttaggctggccgaccaggcaggctccagcctggtattaaaactgaagtgacatggaatgtctttgcaaaagccccaaa

SEQ ID NO: 2826 - DNA, 1061 bp, Homo sapiens
cagaatgaagttggtagagctagtcagtgggtggtttttatggaacccgatccatgggggtgtcattgcaaggagaagaaggggagttgggcttgggaaggagttatatacttatcggtgaggaagggtgggttaaaggctcataggagtgacatgagaactgaagagcatcctgggcagaattattttagtggctagtgccagtaggtggaccaactcatcatgaaatgttgtagctcagcttctgcatcttgacctctgagatatgttggccttaattggcttaggaaaggctaatagagatcctgacttacatttacactgagagaagggcttgtttcctttgggtgagagagaatatgagtacacacagttaaagaaatagaggggcattgtcaggctggaccagagaacatagaaactcagtcaaagtgccccagtagcttacaatggtgtcttcttggtgacattgtcttttcatgtttggacatcataggagatgggccctgtagattcggactagaagccaaagaatttttctttatgttataaactgcattcgtgccttcaaaaatgttaggatgccaaagaatctaattagcttgcaaatacttctatggtagtgcttgttctctgccttaacaactgccgtgaggctccttgctcactcttataagaaagatattccactcagtgtggcaatgctatgcggttttcaacatgccaggaatatcttacaaatatcgttgggctagtgaaacagagatttatccaagcactgaaggaacatttttaaaatgccaaatagtatgtgatgattattattttctttttttagcttcacaatctctgaatttaccccagggtgaaatttaggtttgtgtggacttggttgtggtgagtgcctcctacgtgagaaagggagttctgtcatagttctgattgtcaatgtcaccgaagctaaggttggatcgtctgtgccttttgtatctatatctaagatgaggaggggctgcagggctttggaggccttagccagctggctctccccatgttctggt

SEQ ID NO: 2827 - DNA, 1034 bp, Homo sapiens
atggtactttctagtgagcagatacccagtgaagattaaccatgctgatgctgaagaaccggctatagaattacagtgtggtcttggatattgacacttctagttcattcaagtttccatcgattaaaccacaatcatcatggcaaattaggatcatgtagcttggagttcttcggtttgtgtgaaaagctattgtatacaatttgttcctccttaaagggacatgtaaattgtcatcatcattatttaaatcattacatatatatgctatttcattttccagatttattgaggcttaattgacaaataaaaattatatgcataaggttatacaaagtgatgtcttgatatacattgttaagtacttatcacaattaagcgttaatatatccattaactttttgcggtaagaatacttaagatctttaagatctgttatcttagcaggttttaagtgtacaatacatattattattattataggtactgtgctgtacattaggtctttagacttgttcattttataactcaaagttataagtattctttgaccaatgtctccccatttctcatatacttattataatgtcacatcaaaattaaattctaaaattcttggtgttttagggcctatgattttgcaatttttaagagtaataattctgcagagccaaataaatgaaaacagcattacagctaatataattcctaaaataatgtaaaacatttttgttttacaattaggctttctaattataactataatttattaatacatagattagattatgaatacaacagaggtctgtctgcagaatccctttgaatattgtcttatgtgaagcctatgagcattttcatttcatttcattctatttcgatttactttgcttttgtttcctaagatctgtaataaaacacctaggatcccagataccttgaatgtctttctaagtctgaacactttaggtaatcaacctcatctgtcattttatcttgttggtaatactaaacattccctaactaatctttta

SEQ ID NO: 2828 - DNA, 1086 bp, Homo sapiens
aatcctatttatataatagaatcaatctcatactctcagctgacaatgaggggtatttcattttttacttgtatataagattccttttatataggatgaaatgcatacacactctgcatagaaattcttatgtgtttgtatattactccattcaatcatactatgattccaagttaagaactcctagataaattagcgtctgtagctgtaacagttgaggctttcaattcaaatgtcagataacattcttctgtgtattgtattattttctgcagtaattcaaatctttattgagttgaggtttgctcacttactataaggtagaatgaggtgatctaagtaggttttgtttaaatacatgtgtcttctccccatcagagtaaaagaagccgaagaggtgtgtagacagaagaaaggaaaatcactttataaaataaaaccaagacatgactctggaattgtaagtattactgatttttaacttgttattttctttggcttttaaatcctattttcataatatatacaaactcataatattttaattatttttctactaagtgtgaataaataaggagcttctgacttcaagaatctcctttttcttatgcctttaatcaggcccagaaggctaagagtcttgatattgattattcaaaacttaagaattgggctgggggtggtggctcatgcctgtaattccagcactttgggaggccgaggtgggcgggtcatgaggtcaggcgatcgaggccatcctgcccaacgtgatgaaaccctgtctctactaaaatacaaacaattagccgggcatggtggtgtgtgcctgtagtcccagctacttgggaagctgaggcagaggaatcgcttgaacctgggaggtggagattgcagtgagccaagattgcaacactgcactccagcctggcaacagagtgagactttgtctcaaaaaaaaaaaaaaaaaaattaagataaatctactgaatctactgagggtgtgcatttatgtggatatgtgcatgttggcaggggcagggtggggagaccatctttcactttctttgttacacacagatcacggca

SEQ ID NO: 2829 - DNA, 1074 bp, Homo sapiens
tcatgggatcaaatgcgataatacctgttgatcatctagcacagtgtctggcacacgagaggacctatgcagaggttagttcctctctttcctcaatttcttgaaaaaatagctgcagccatacctgaagtaactctttttctctgaaactattaaacggaaaatgcctagagaacatggttacccagaaatgccaaatatcagtactctctgccagtggtgccaagagcaccattaaaatgcttttctgaattcggtaccacttctgagtgatgctgagatgattcacagtgacatgtataaagctggcctcctttggcctctttagaagaaagatgttaaataaaaatgaacaaaatttcattcataccattctccagcagaaatgccacatttaagctctgtaatgtatgacttttttccttatggcatatcccaaggggtgggtctttagccatgttccgcaagactgtgcctgtcaccaaaaatcatgatgggacaccatccaggacaacacatgttaaagaggtaagagagactggacagatgtaaaacatgagctgctcccagggacagatttgaagagacagcagcaggctcttagagcaaacttgcttaaaaagcatggtcatcttaccttgctcatgagttgaatttaattatgctgtaatgccactgcctttttcatttctctaatgcattatcaaggacagtcagagccatttagcaatctacagagcccttcagtgatcaagaattgaataatggccactggcatggagagccaatttggagtgaatgaaaatgggccctttcagcaccccaggtgaatagaataagaggtcttcatattttgaacaaaaaccctcaaaggcctgtatttataatcttattcctaccatagatgagagagcagcaaaatcactgaccactgacccttgatcagtatgcaagatggctgctataacttggctatttgtcactcccaaacctcatgttgaaatttcatccccagtgttacaggtggggcttaatgggaggtgtttgggtcctgggtatgaatccctcatgaaa

SEQ ID NO: 2830 - DNA, 1038 bp, Homo sapiens
ccctagagaaactctgtgcatattgggcaggaagaaatgttataaagatatactctgaagcattgtttattatattatagtgaaaaacaggaaatggacctccatcaaaagggaaaaatgtgtaaataaactgtgaacaaaaggatggaagcactgcttggattcaccttaaatccctgttggtgacctctggggaaaggaggtaaaatggaatggaggaaatacataagtgtgaattttatctgcaatattttaattctttagataaaaacaaatatagaaataccagtctttgctcaatgggtagtagatacatggacccttattgtattattatttgcatttttctgtatttaaaagcttttaagtaaattacaaaataaaattcactgaggatatggaggtgcaagtagtagacaatcagaagactggctctttgaagaaagaatacagacagtcataagtcaagggacaactggggatggtgactcgacttgtcaactgatgggaatgatccagaaaggagagttaaggctgtgaacaagaggtgacagctaaagttttatattccctgcacatctgtgtgacaaatgtgagttcaattttgcaacctcaccttgggagagtgttgatgaagcaaagggttttatagaatgagggagtaatgcctcagaagcagcagtgatatttaatgagtcacctattctactacctggtactggggtatacctggtgttaaggaaaacacagctgggacaggtgggaaagtagggttcttgggggcagccagggttaagttaaaggaaggaggtagagaaatgttcaaagatgttgaagttataggggagtgtacggctcatgaagggaggatccagtggaagctcaggattggaacagatcaataagtataatgggtcataaagagatgtgagcccaggcatggccaactggaaaggttttcccttctggcatcaactgattttcgcagggatgtgaggtactatgggatcagttctgatcaacttctggggagaggca

SEQ ID NO: 2831 - DNA, 1048 bp, Homo sapiens
atcttttgctttttacttttctatctggttggtacttatgtttcaacagcaggggtcattaccaatgttatgtatttataaaatgagaacagaacaatgtacagctcatttctccataatacttcacttaaatcattttaggaaattaactgtattattaattgcctaaaaacaagactccaagcacctcctcagccatacattcccccaaatttttcctttaaagctggtaaaatactgcaatggttacacaagctttaactgtaaacttaacttacaaatatagtaaaattaacttatagtaatgataaaaaataaagtttccccatactgggtaatatttacttttatgtcagagatgaatacggaacaagtaagagtctcaaatgagcagcaatagagaactcaagggctttaattatatgatgtataataaaaagaaatggcataaaacacactgtactagtatcctcaaggattaaactataaaatgcctaaatatgtatctcattctgactgaattataatcaggtattcatcttcctgctacactttgtcaaccctgcacctctgaatccagtcattcctctgatgtgtatgccttaatattaaatagttgtccagagtgtattagaattaaatatatatttagcaacaagcaaatgccaagaatcataggacatcagcagggaccaatgaaggtattatatataaagattttaagctcgacatatcagaataaagagatcgtttttctgatttcaggagtgaacttaactcccttctctttcaatcggagttggcccattttattataattataaaaactgtaatttataggattatttcgctatttgttgaaaagccaatctaaagttccagaagccaccactttttaaatagtgctttatgtgttacatattcttacatgtaataaatcactcttgagatgcaagcaaagcgaaacagtagcatttcatttctcattaatgggtctcaatacaaagtaggagagtccaggcaagtcacttaactcctccaggtttta

SEQ ID NO: 2832 - DNA, 1034 bp, Homo sapiens
caccagcaccatgacagtttacaaatgtcatggcaacgtcgggaagttaccctacattgtctaaataggggaggcatgaataattcaccccttgtttagcatgtcatcaagaagtaaccataaaaatgggcaaccagcagccctaaggggttgtttatggagtagccattctttgttcctttcctttcttcataaacttgctttcgctttactctgtggacttgccttgaattctttcttgtgtgagatccaagaaccctctcttgggagtctggatcaggacccctttcccataacacggccatcacagcatttcctagaggccaggggtcctggccatgctaaccgtgtccatcattacggccactgaagtcatccggcagtgatggctggaggtgtttgcttcaggtgttggtcctttcatttcatgcatgccctccaaaaggagacgtgtggactagcagacagcattcctctggggacccttcaaattacctctcagtctctgacttctgtgatcgtttgctggagattttctcaagtgagaatctcctgagttcattgtattagtgcatttctggtaatgcctaaagagagaggtagaggaaaacgaaagctgaaacctgtcctgcttttgtgcaatcagtattttgtgcagtcacctcttatggggaaaatgtcatccctgtgtgggaaaaaagagtgggaggaccacatgaaggtgagttttcatgccaggttggttggagagggatcacactgcaggccaggagatgggtgacccctgagacccattcatgcaatgacccacatttctctttctcccttaagaaccctgtctataatcagggacacgcagaggttaaaagtacggactctagggccagactgacttcactcaaatcccagctctaccacttcccggcaagtggcccttcattatcaggcccccagactatctcatcagctccatcccctccgcactccccctcttacccagctaaagtggcttgctttccatttcctggaggaaa

SEQ ID NO: 2833 - DNA, 1028 bp, Homo sapiens
cagtgagccgctgtctacccagcgagacggagagctcaggacgcaaccctatgagttggaagccgcaggaggcggaaccgggttgcgggatacgcgttgacgtcacatcctctgggcggggccgcaaggaacccgcgcaaattgaaaggtcagcctttcgcgcgctgtgtaggcaagttacccgtgttctgcgttgccggccgtgggtgctctggccacagtgagttaggggcgtcggagcgggtttctccaaccgcaatcggctccgctcaaggggaggaggagagtcccttctcggaaggtgagaggagcgggctgtgcggaggctaatgggtgggttcccttgggggtcgacctgcgcgtcacctccgaccctcctctcgggattcgggtcttccaggaagggaaggagagggtctggcgtgatcttcccaacccaacagcggagcccttagcctgagtggagtatgtgttttgttccgaggggacgtctggcaaccagaggtctgcagttcagtgaacggagggagataagagagcagacgattccgggctggagcaggcgccagggttgccagacttacctcatttttccgcagaagctggcagtccaggttttacatgcaatctctccacctttaaatgttgacaagtacattttcccataatattttgcaggcctaaggaaacgtgtcgtctggaatgggcttgggggccacgcctgcacatctccgcgagacagagggataaagtgaagatggtgctgttattgttacctcgagtgccacatgcgacctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtaagagactgtttttctgaaactgtggcttgaggaccacctgcatccagatt

SEQ ID NO: 2834 - DNA, 1018 bp, Homo sapiens
agatgtcatctcttatctttctcagaatatgataattttttgaacgttttcttccgctctctgtaactgctgtgtacctttttcctgtgttgatattttctccctcatggtggtaacttctggccagtcatatttgaaggggccccgaaaagctcatggggaacattgtgtgaatgagtggggcttatgatgttggacttcattcttggatgatgtggttggtaacacattggatttgatttgtgaattctccaatgttggaatgttctctgcacagttacatttttccaaaaagagatgtctgcttagggtatctaaactttggctgtctgtattttgaaagcaggatagggaaagtgagttggggcaggccaggaaagggtagcatggttccttgccattcaatatttagccttttgtttcatctctgttttcagacaaatgaatctatcttcagaaatgcctgctatgtctgttactctttgtgggtttcaaaagttcaattgttctggttctgaaggcaggtagatgtttgttgactgtatagtcaggttggagatggggacacagggtcaaataattctctctttcgttagtcattcccccaccaggggcttctgtaattccaagactttaattcttgagcctttctccaggtttctgtaggtggaattggcttctctttgatattctcttctgcagacaaagtcttttaatttcttccatctatgttctatcttcaccgtggtttagaagtcacagattatctcctaatttttttgcaggttaattttgtgtttcttattgttttgaggaatgattatggaaagaaggagactgaaaagtgctatctttacacagctgaactattgacagtatttatcatttctttctttctttttttttttttttaaatttgagacagggtctctttctctgtcctccaggctggagtgcagtggcaccatcagagctcctgggctcaagcgatcttcagtaactggcatcaagcctcttg

SEQ ID NO: 2835 - DNA, 1027 bp, Homo sapiens
tggctgtccttctctgttagaatatcattgacatcctcttagcagatcattgtcttccaaaatttgtagtaattgtgaataacttatattagcattaaaagtgattgctttccttttttgtttgtttgtttttgagacggagtctccctcggctcactgcaacctctgcctcctgggttcaagtgattctcctgcctcaacctcccaagtagctgggattacaggcacacgccaccacacctggctaatttttgtacttttagtagtggcagggtttcaccatgttggcaaggctggtctcgagctcctgacctcaagtgatccgcctgcctcagcctcccaaattgctgggattataggcgtgagccaccgtgcctggctgctttccatttaaaagacaccgttttcctgaccacatttcttcagttgtggtcttatttcttgcaccatttgtattacgaagatttttatttatttatttatttatttacttttaatcttttttttctacagctgctagcaactcttgattttttttttttttttttttagaaatgagctaacaaagttgcttgactctcatcagaagaaaaacaggcctaggaatataagacacatttaatggaaaagtataggaccagcaaagtaggaaatgttattcaaggacagctgtttcatcaacagctattgtttttaagggtaacttaagatgtttatttataatttatgttgatacagaaggaaataaattgattattttctttctgcaaataatctttttccttttccttttctagcctgcccattcaagaagtcatagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtggtac

SEQ ID NO: 2836 - DNA, 1050 bp, Homo sapiens
ccaggcttggcaacacactgagaccctgtctccacaaaaaaaatttttaaggccgggtgcggtggctcacacctataatcccagcactttgggaggccgaggcaggcagatcacttgaggtcaggtgctccagaccagcctggccaacatggcaaaaccccatctctattaaaaatacaaaaaattagccaggcatggtggcacacatttgtaatcccagctacttgtgaggctgagacaggggaatcacttgaacctggaaggcagaggttgcagtgagcggagatcacgcagtgcactccagcctgggcgccagagaaagaatccatctcaaaaaaaaaaaaaaaaaaaaaaaattaagaaagctgtcagctggttattctccaaagctgcagcttctctgctcaaagggtcttactagttcagaatacattatcgtaaaacaaaaaataaatacaaaagaaattttttaaacattagtcaaatgtggtgacgtgtgtctgtagtcccatctattcaggaggctgaggtgggaggatcgctcgagcctcagagttggaggctgcagtgagccatggccacatcactgcgccccagcctgagtgacagaacaataccctgtctcaaataaaaagtaaaaagtctattgagagttagttaaatccatacatcaatttggagaaagtggacattttaacaatactgagttttctgattcattcatttaagtctttaatgctttgtagctttcattgtacagatcttaacatatctgttgtcaaattatctttatatttcgatttttgatgctgctgtaaatagtattttcagttttgttttctagttgttcattgatggtatatagaaataccattgatttttgtacattaatcatatatttgcaaccttgctcacgtcacgtattagttctagtatctcttttgtggactatgtaggattttctatataaatgactgtgtcacctatgaataaagacaatcttgcttctccttttccagtttaaataccttttatttctttttcttagta

SEQ ID NO: 2837 - DNA, 1028 bp, Homo sapiens
gaggtaaactatcatacttccatacacaatagaagtgttttgtttgtgctttccattttgtcacagaatattaaaaagtataccaaagaattagctgagcgtggtggcatgtggccgtagtcccagcttctcaggaggctgaagtggcagaattgcttgagcccgggaggtggcggttgcagtgaactgagattgcggcactgcactccagccagagtgcaacagaacgagaccttgtctcaaaaaaatttaaaaaaaaatgtaaagtataccaaagggttgagatttaataaaattaatgatttgtactgcttccatcaagaacatttttgagacttttttttaactgcaagtgcgcagaggtggagaatacaaatagtcctggtatgactcgtacggtgtgatgccactgtcttgattcacactgagttgtcagcagtttcactctgttctgctttagcaacatccatgcaagggtcagcacagtggaaaggatgaacaaagtctgaatattgtaagaatagttttggtcttggaaaccgttcaaaggatcttgggactctccaggggttgtggaacatgctttgaaaactgttgctagacagaaattaagggtgcaacagtattcttaaatacctttgagaaaaaaagatgtactggtatttaatttttgttgacaggagatagaattacctgtaatatcttcataacaggattaatttttatagatagcttccttccagaaaagaaaaaagagaaaacaaccgagaggggaataaaagacagggcttaggccaggcacagtggctcacgcctgtaatcccagcactttgggaggctgaggcaggcagatcacttgaggtcaggagtttgagaccagcctggccagcatggtgaaaccccatctgtagtaaaaatacaaaaattagccaggtgtggtggtgcacgcctgtagttccagctactcgggctgaggcaagataatcgcttgaacccaggaggtggaggttgcagtgagccaagatcgt

SEQ ID NO: 2838 - DNA, 1033 bp, Homo sapiens
ttatccagtttttcttgttactaatgtgagaatgaatcttttttccagcttcctccatcctaggcagaaataaagtcccaaatctttgttttttaacgggtcatagaggacccatcatcaccctttattcattccttgatcatctcaggctagagaagtctagggatacagctatatataacatgaccagaagaattaactgggccgtagcataatcacatatttgaaacaggtaagtgagtcatctgtggctagagacaagtcctggtcacttccctattctgccccaatactcaacttattacattcagatgttgcttaatggctagatgcagctttgagggtaatgcttctattaaatatgtcagttcagttttacaatggaaaattctgaagatggatggtggtgatggttgcacaatatgaaggtacttaatgccacttaatcatccccttacaattgttaagatgataaaaattatgtatattttaccccaataacaagatcttttaaggccgagcatggtgactcctgcctgtaatctcagcactttgggaggctgaggcaggcggatcacctgaggtcaggagttcaagaccagcctggccaacatggtgaaactccatctctactaaaaatacaaaattagccagacgtggtggcacgcacctgtaatcccagctacttgggaggctgagataggagaatcgcttgaacccaagagacaggcagagtttacagtgagccaagatcacaccactgcactccagcctgggctacaagagtgaaactctgtctcaaaaaaaaaaaaaaaaaaaaaaaaacaagatttttaaaattaaattttacaatccagtacaaaataaaagcattgtccatccttgtttctcaaaaacccagaaagaccttggtgatctggtcacccttccacattcttattattcagtgacttctcataccaggtactgtatgttgtatagcacctgaagtctttctaaacacatttcagtgtgttttatttatttatttatt

SEQ ID NO: 2839 - DNA, 1414 bp, Homo sapiens
tggatctggggcaaggaagtggtccacgtcaagagcagcatctttttctagacagggaagctaagtcctaaaaccatcctgcataaaagaagtgcactaggatggaacatcctggtctgggaacaaagagaactgggtctgtctaagcatctctttggtcctaggcaagtaagttaatctctatggacctcagtttcatcatctattacatgcaaactcttagttatgataatggtcctacctacattcctgaaacagcagaagtatgataaaatatgctggaaaactgcagagtacaatgatactttgataacacatcaggattttaatgctagtttcacctctttatctgggcaaattgctcaacctttctatttctcactatgaaaaatggcaacatatttcagggtaaggtgacccaatcttctgtccgctttataactgtggtattaaaatgtccttacttgagaatcacttgaacccgtgaggcgaaggttgcagtgagccgagatcgtgccactgcactgcagcctgggtgacagagcgagactctgtctcaaaaaaaagtcctcgcttgagactaattctatccagagctcctgagctaaggcctatgagaccatattatagtgaagactagtattacagtaccacattgtaaaccttaatttctttggcaaagataaattcttaactaatagtgagcaaagtgactttctctgaccaatatacagatggtgattccatttccaacctcagaactgacctcctgctgcccagggagcgggagtgggaagaggggagggagaggagaggcgtgatgtcactcagccctacagaggggcctcccttcaggctcctgcaggctatttggaagcagctggaagaacgagttaggtcctggttgcaggattttttttttcttttttaagtcagacatagacacagatgttgagtaaaatgctgcctccactgaaaatcccaagcctcagacctttcaagcagaggaagaacttagtaaagttctagaggtacctttctggctgactaggggaataaaagaagagcagctatggcttgccttgccatttgcttattcttttatacttgaaatcgtcacagcaaccagacaagaggaagttgctggaatctgggcaaagttcccaaagaagatcccagtgagacaccattggacttctattagggggacaccactggacttctgttagggggacaccactggacttctgttagggggacaccactggacttctgttagggggacaccgttggacttctgttagggggacaccgttggacttctgttagagggacaccattggacttctgttagggggacaccattggacttctgttggggggacaccattggacttctgttggggggacacca

SEQ ID NO: 2840 - DNA, 1245 bp, Homo sapiens
cctgaattgattctgaaatgcactagggtggggagctgggatgtgaaaatccagtcgtttataggtgagggtagaggggggtggatgccagctgggcaaccagtgtctgatcatccaccaatgctcatgattgaactagcagagtcaacaagccacaagggtggcggctgaaggtcagaacggggtgggtcagccatggggaaggcaggctcacaaatgtgcgaggaagcacacaaaaaacactattactatatcatttgttcatgatgccaaatgatatattttttccttttttttttttttttttttttgagacaaggtcccactccaacatccagactggagtgcagtggcgtgatcacgattaactacaacctcagcttcctgagctcaggtgattctcccacctcagcctctgcaatatctaggactacaggtgtgtatcactatgcccagctaattatatatatatatgtgttttgtttttttttcctgagacagagtttcgctcttgttgcccaggctggagtacaatggcacaagctcggctcactgcaacctccacttcccagattcaagcaattttcccgcctcagcctcccaagtaactggcattacaggcacacatcactatgcccgactaattttctgtatttttagtagagacgggattttaccatgttgatcaggctgaacatgaacttctgacctcgtgatccacccaccttggcctccacgaactcctgaacttatgactcctgatccacccacctcggcctcccaaagtgctgggattataggcatgagccactgcgcccagccaattttttatactttttttggaaggaacaggatcttgctaagttgcccaggctggtctcacactcctgggatcaagcaatactcccaccttggcctcccaaagtgctggaattacaggcatgagccacggccctaggctgatatatttttttcatttgtcaaaaaatataaaaatgtatcttttggatttttgtggcacctaactgtgggccactgtagcagaagactcagctcaggtttctgcatccaggtggggaagacaaacatgtacacagaaaactgcaatagggccgggtgcagtggctcacacctgtaatcccagcactttgggaggctgaggcaggcggatcacaaggtcaggagatggagaccatcctggccaacatggtgaaaccctgtctgtactaaaaatacaaaaattag

SEQ ID NO: 2841 - DNA, 1037 bp, Homo sapiens
gtgtctcttgtatagttgagtaatagaatttcattgtcgaaccctgacctgaaatacatgttttcttttatcaaagtagaaaatgagttgctgcaagtaaagaaactgtattagatattgtataacagagactttttttttctattaagtactaacattgcttttgtttctgttccaaactttgaaatcagtgcacttggacaaaatggaaactgcttttcaaggtcctacagaatatatgtttataaatgtatttttatacatggttggtaatgaatcaggtctctttcgtgccattgcagttagagggcctctggtgctggagtcctctggaggactgggctgtcagagtggggcagcggggtgcagcgcggggagggcttttctctttcttcgtgcctctggtgctggagtcctctggaggactgggctgtcagagtggggcagcggggtgcagtgcggggagggcttttctctttcttcatggggtctcagggcctctctcttcctctccacgtatgctcttcacaggtctctccagcagggtagtcagatatcttacatagcggcttagggctcccaaaagcaaacattccaagaggaagcagaagctgccagtccttttaaagatgaggcttgggtgtgacatggtataacttttattgcattctattggttaatgcagattacaggcccagtcagtttcagattagaagagaacaagggaatgaggctgggttccttggaggctatttttttttttttttttttctgaaacagtctcgctctcttgccaggctggagtgcagtggtgcgatctcggctcgctgcaaccccttggaggctatttttagagatgaactatcacagtaatataccttaaaatacttcattttagacagtttttgtgtgttctaggggtggtcagttgcactaaccaagaatctatgaggtgtggttggccagcagtatatagaaagagctgtaccgccggggctgccactataagcacttcagctatgcaaattttgatcaaa

SEQ ID NO: 2842 - DNA, 1006 bp, Homo sapiens
gggagcaggcatttcatgtggtgagagccagagcaagaagtgggagaggtgtcacattcttttaaacaaccaaatctcaccaaaactcagagcaagaactcattatcatgaggatagcaccaagattcattcatcatgaccgaaacacctcccaccaggccccacctccaatgctgggggccacatttcaacttgaggtttgtgggggacaagcatccaaactatatcaagactataagctacattgtgatcgattctatgtttatatcacatcagtgcaaaattgagtatggagaaggtaacaactgattctttgctaaatccaaacatgcttaatttggctttttaaaatttatgtatttatgtatttatttatttattttttgtcatagaggtcattagaacatgaggaaaccaatatgcctactatgcacgaccttgttcatactattaatgaccagtctcaatatattcatcatttagaggcagaagttaagttctgcaaggtaagtttctcattaagaatttaaaactaaataaatgaaagcttatattaactatagattgtattaaaatttgctgctataaatcttcatgtttgtagcaatacattgacaattgctattcttacgtgattgagagactgatgtgtcacaagagcttgtcagacttgggaatgatgctcttgaccataccatttctgattgcttgatttcccagtagttcattactatgtctaatgatttcataatatgctttcatatttcagaagttttccttctcaccccgcttgctgtagcccagcaaatggcaaatgctttggaatacaaataccaatcattctcccatacttgtcaacctactggagcagtggtacagcaatcagggattctaaactggtagaccaattcttctccgctgtcagtattaaggctcttactttgactttgaatgagaatggttcatagggtactgacagtaatgatcaagaaaccaaacacatcat

SEQ ID NO: 2843 - DNA, 1026 bp, Homo sapiens
caattctccatgaaatgttttactacaattctctcttatttggctaccatttcatagataatcatcactcccgtctatgcctttctatctcagagcctccctctatttaatcttccatcagtttttaacaagttgatggtatttgatcatgagtaataatatatcttatttttcagaatctactccattctttaaaatctcttggataacccttttaattaaggcttttctttgagcctcgattccttggagaaaaggaaattgtcagaaacgacacacttctgtgatatgccaccagcaggcccattactatataccccagccttctctttgttatctagctaatgttaggctgccttgtttgtctaaacatataattatatttcaggaaaaggagaacataagtcttccgtactttatatcatgctgtgccctctaataatcaacaaataaaaacactgcttaataatgcttaatgtgtttggttttgtttattataggaggaactctctggaatgaaaaataaaatacaagtagttgtgcttgaaaacgaagggctccagcaacagctaaaatctcaaagacaagaggagacactgagggaacaaacacttctggatgcatccgtgagcattattttaaatcataaattttattttagtgtgaatattcccttctgccctctctcctcgccttcttcgctgcttagattttctccctgaagtgtggccaaagtactatgttggtatttgtttgagacctcaaatatcaaacttcactgtggtggaatgaatcctcagatgaaacgatcttgtgatattttgctacagtttcctctctgagcataccgtttctgccttaccatatggaaagagccggtctgaaagcaggaagtgtgttatacaggaaggactttgctaagtctagaaaccgttcagaactttaacttagatttctgttggatttctctaaattttccttgaggtctgaaatctaataagtctaattagctgcatgatgtagcag

SEQ ID NO: 2844 - DNA, 1266 bp, Homo sapiens
ggttaaatcaatggctgttggcgattaagtcaatctccagtcctttccccccttgaggtgggggagtggggctgtaagttctagtcttctaatcatggactgcagccaccagtcatcttattagcatacgaaaggatactcttatcaccatggagatcctaagggtcttagaagcacttgtgtcagaaacccgggactaagaccaaatattttaacgaaagatgctcctatcacccatgtcactcaggaaattacagggttttaggaattctgtgtcaggaaccagggacagagaccacatatatatttggattcagattgacaggtttcagattctagtgctgccacttattagccacttcctacctctgtgaccctcagctactctatgtgactcagtttcctcctgtataaaatggaggcaacaatgaaacctatctatcccatagaactgtaatgattaaatgagttaatatatatgacatacataaaacagggtctggaacatagaaagcagcattttgataaaaattattattagccatgcatttatgaaacatggaacatgaaagacaaactaagagagaggtgtgtgcttcaagagtatatgtcttcagaggagtaaagaataattccatttgttgaatgcgctgaaatctagccctctttgcccatatttagattactgcctgtacctgaaggaattttactttgcaacacttgtagaatatgaccctaatagcctgaaaatgtgaagtgattcttgacctgtagtgtagaagcatatgctttttcttttcatcataggtaagaataggtattttatttgtaaaatatgcatgtttatttaaagttgaattcagttgcagttactggcacattttattttagggaaacatgcacaattcttggattacaacaggtgaagattctggggtgggcgaaacctccaaaagaccattttcccatgacaatgcagattttggcaaagctgcatctgctggtgagcagctagaactggtgagtatttgggtgcttttctcttatacatcttttttttctttttctcttttgtacttttttaaaattctggtaaaatatatataacaaaatttaccattataaccatttttaagcgtacagtttatctgcattaagtacattcatgtcactcaatcataaacattatccattttcagaactttttgatcatctcaaacaaaaagtctggacgtattaaacaatatctccattcccctccctgcc

SEQ ID NO: 2845 - DNA, 1047 bp, Homo sapiens
actcggcctcactcttctcccgtcactcttacaaatcttatctgtaggcatgcagaccactcaccagttgctgcttcataaatttataatccactttcatttctctttgaagaactggctttggtttatgcagtcctccctccccaaaatgttcccttcttaccctctacctattgaaatgtttccagtcttcagggtatagttgaaatgcgccctctcattctgctttcccgaatagcatgttttctctcttcccttttctgcattagaattcctttctcttttatgcctccccctagcactgtgtttatgactattggagactcatcttttttccttgtttatgaaaaaggtcaatttctgcatttgtgtgctctacctcacaagtgtttttcactttttccaagggtttcattctgggacttttctttctcttgtatcttttccctatcaatggtttattctttttattttatttatttttttgagacgggatctagctctgtcacccagggtggagtgcagtggcgcaatctcagctcactgcaacctgtacctcctgggttcaagcaattcgcctgcctcagccacccaagtagctgagactacagtcatgtgctaccacacctggttaatttttgtatttttggtagagatggggtttcgccatgctgctcaagctagtctcaaactcctggcctcaagtgatccaccatcttcagcctcccaaactgctgggattacatgtgtgaaccactgcacccggccaatagtttattcttagcagaatatattctttaatagctcccataaagcaaacaaacccaaaatatattctcctgaccctacattcacttccaactatcaccctacatctacattctccttttcataccaaactttttccaagcagttgtctatatttatgtctccacttctttacctcctattcttgcttcagtatgcttcagttgagcttcgtccccctgtagtccaccccaactgctctttttttttttttttttttttttttgagacggagtctcg

SEQ ID NO: 2846 - DNA, 1112 bp, Homo sapiens
ctctaaacctagtagcagctttgtataacatgtacattggttgattataccctcctcctttatattttctaagacacaatttaacataacattcagtaaagtacacaaaacaaaaatttacagctcaaagatttatctgtaaatgaacacctatgtgattatcaccactttatgcttcctcctagttactgccccttcatgccattaaagctaatcatgatcctgaattttctgaaaatactcaagtatgcatcattaaacacttttgagttctgttttttcaatgttatataagtggaattgtatagtatgtattctttgtatctggtttctgttgtccaccattatatttgttagattcatccatgttgttacattggccgaagtttgttcattttctttggtgggtctgctatatgaacatatgactttatccatctgctgtcaaggaacgtttgtgttgtttccagtttgcagctattgtgagcagtgctgctatgaacattctttcatctgttggtgtgtatgacacaaatttacgttgcatatgtatgttggagtggaattcttgctctcaggatatgtctgtgttcaacttgagtaggtaatgacaaccttccaaggggttttatcagtttacactcctacccatacaaggggttttatcagtttacactcctaccagtagtacatgagtgatacctttgctccatatccttactaatcatatagtattgtcaatttttctggtgaacttatagtgctatcttgtgattttcatttgcatttccctaactactagtgtgattgagtattgtttcatacatttattgtccatttgatgcctcttctgtgagccgcctattcagatatccttcttattatttttattaaggtatgtatctgacatatttatttggggagttctttatatattctgaatgcaagccctttgtcagtatacatattataaatatatattcccactctgtggcttcgcttgtaactctcttgatagtttgcttgcttgctttgatggctagaacttcagtttgttttccttaattatgtagttgttttttatgtccttttaaaaaagtttttttccaact

SEQ ID NO: 2847 - DNA, 1037 bp, Homo sapiens
tagtaacacctgagtgaatgagtagataatcctaaattgccaaaatgactacctacctgcaagcttcccaggtgggctcaaagctaccttgaagcatgcgttgcatttgccttacagaaaggaggagtgtgtcagcccagtggttacgtggagtttgagtgtaatcgttttgtggtctcactgttgaatgatgggcctaacaagacatctgtatattggagttttatctttgataattttctgtggttccatagtctaaatttggtgagttaatattctgaaacacttttgaaccagaacgactgaactctagtttctaattcaaaataggtaatgttttcagtttagatcatgaaatattagaactgagagggagctttacctcacctcttttgacaccatcctatagcagactctttattcatttatttgttttcttgttgtttattctgttgagcatctactgtgtgacaaacactactcttgacaagaggatattctgaaaatagataaagtctattaaacgtaagtttcccataagcagcaagtttgttagatttttatcctgttgtggatctgtctgtttgcatacttataaacactgagcttttttgatcattcttttttgagatggagtcttgctctgtcacctaggctagagtgcagtggcacgatctcagctcactgcaacttccacctcccaggttcaagcaattcttgtgcctcagcctcccaagtagctgggactacaggtgcgcactaccacacccagctaatttttgtatttttaatagagacagagtttcagcatgttggtcaggctggtctggaactcctgacctcaagtgatccgcccacctcggcctcccaaagtgttggaattacaggcgtgagccactgcgcctggccttttttgttcattctttttccttggaactttggctttggtgactgcatggtatcaggaacagataagaatctcattgaatagttacttttgctcttcattaagtcttagtgatttaagaaaggtgact

SEQ ID NO: 2848 - DNA, 1090 bp, Homo sapiens
tttcaaatgaatttgaaaccgtggtttagtcttcaactctttaacaaaacagggaacaccatatgtaacagtccagcatacattttttgctttttatgtcttgaaagtttcctgcctcactttctctttgtctactggatatttttattcagttgataaattgcaaatatcctagaatattttatatgggacttatttaatcaatgagattgtatccttgctattttacatgccagagcattttggcatttggttcacttctactcccaataaacagcttaggatagagtacttctgagaattgctgaagaagggtgggtcttggcaatgatcaaacccagtgggataagattgtgttaaattgtgaatgttatatgcatagccaggagattggaggagttcaacagtactaatcattgagcaacaacaagtgttcataagtaactgaaagaatgtaattgaaagagaagtgcaaaaaagaggattgtggagaaagataaaaaggaaaggacatatatttgttcaagtaaatgagaggagaatctgctgcatggacaaagcctcagtccttccttaaaatgttgactgctaccttgatttacaattcgtaccttccctactttgctgcatttttccttttcagcacctccccccacttttaaaaaactaatttgctcttctctgggctttcccctgcagccctctccacaatagatgattgtcccgcacagatgccgtcctgccacgaaggctcttagcctttctggctgctccgcccgccgctcgccaagtgaggacagagggtctttctctggggtgtgctttatttcatatgtgctcagccggcctaccctggctcttctaatacatattaatgcttttctctccctgacttatgaggacaggatcgtttgatcatttcttgttttgaatgttctttttgtgctgacagagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaa

SEQ ID NO: 2849 - DNA, 1032 bp, Homo sapiens
atgttgctgatacacaaaacactaatactcttcagcttccttaactctactatatcccctacttctacgctaacatcctgcatgaactgaaatgcccctaagatctctctgaaaccacactctctgactagggcctttgctcttctttcctccctatcaaagttaaatctactccatgtcttcattttcacctctagttcttcagcattctttctttttatctctcattttatctgttgtgtccaggctggtcttcttttcttcccatttaaacataaattttaccatctcaaattgaactcacacattcactctcccaaatctgctgccccttctgtattctcttactggatggcacttttactcactaacatgctctgatcagaaaactggatttcaccctgtccttcacccctaacttttaaccagtcactaagtacagatctgagtttctaacgttttcttgaattctttccctcattaacacttttcttatggaagctaagtaatctctggatttatctattacacttcttcctagcttgcctccctccttcgttccactccctacactgcagccagaagcgatctttcttaaagacacatttgatcatgtgactctgatttaaaattcttcggtgaattttcactgccttcaagacagtctccacattctttcccatgcccgtggtctgtcctaatgtggctcccttttgccctccaaggctgctgcttttttcctcctctcgcgccctgtctcccagtacactcagctatcgtcaaaggcaggagggcttagggggtgaacatgggcttactagagttagccagacttagattcaacttctggccccaccattcactggctgtgtgaccttggacgagttactttaacttctctgtgccccagtttttcctcatctgtaaaatggagaaatatgtgactcctaggattgtgaatgaggactgcattttaaaatgtatattggttatcttatacaaacccaggcaggcacaaaatatttctcaata

SEQ ID NO: 2850 - DNA, 1072 bp, Homo sapiens
caaagaaaaaaaaagtttcttaaaattccttaaagaatatttgcttagagtaaggattgattaaatagccacattggaagcaattggaaaactgaaaagttccacaaaaatgttgcatattttattgggaaggctgaaaggttaagttgcacgttgattcttaggctggcgtggagttcatcatgttgtaaaaggtgtagacagtgggacttgaggctaagcaaatccaaacctcaggacgtcttcaagtcactagccctaaagtctcctgcagaaatgcttcttcagagtgaaccaggcccagggctttgcacattgagatccttgtgtttggtagcatgatacttgacccatgtcatctgggttgtatcttctcctttgtctctgtgctatttgtgtcttccacctatgtcacattataggccaagaggttttagaaggcagactgtgtcatttcctctttattttctcttgtatctaggattgtttagggagacaatatggtgtagtagaaagattataggacttgaaatcagactaactccgttttgaatctcagctctgccactgtataatcttatgtaagttacttaacatctgtgagcttcagttttctcatctgtaaaacaggaataggatacttatttttatatggttgtcatgaacacagaatggaattttaaaatataaaatgctaagacagtgcttggtacatggtaagcactcaaaagtgatagctggtatcagtgttactattaagtccacagtgaaagcatgaagtcagcgttatgtgcaatcaacaatggtaaccgtgaacaggatttctagaatggtatcagcaaccttctgcatctgctacagtgaagaggataatcatttttggctgtttctaaaatgagtttctacttataatatccttttgttcacataggctggttccccaagtgtctagcttggagaatgagtcttagaaataaattttgctatattctagaccagtgctatgccaaaaaattttctgtgatgatgaaaatattttatacctgcactttccaatatggtagccatggaa

SEQ ID NO: 2851 - DNA, 1035 bp, Homo sapiens
aatccaaaataaaacctcattcatgtgcatttttggatgtgctaattccttttgtcataaaatggaagctagcctaaattttctaataattttttatcaaattgaaattcatggcaaaaaataaaaatgagctaattttgaattcaagtgcatgtattttatatggatgctttttccccttctctctacctaaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccaggtactccctaatcccattatgcgccatagcaccgatttcattccactgatttttgccacaggcttccaaacagttgttagagttagtcttagtcattcaattcacacttagctttcaggcatattaagaaaagtggagatgtggtaagcaaaacacccagacatgtgaatgataagtgtggcagggaattactgatagattacaaaacctttcatctacaatgctcaaatatttaggtgattctctatcaatataagcgaaatgacatatttctcctaccaccactactacctcttctgctaattctacgtctaataaaaatcttgaactgaaggatgtgaggaattcatttaggaaaataataaaatactgtcagtggtgagagagacaaagtaaataaattgtaagatgcaaattgaaatggaactgatacaaaataaggaatctgcatcctaaggaggtgtaaaattttgagatgaaatagattggcactgctcatgttcaaatcattattataaccaggcttacaccattgaggtttcaaattacttcatttccatcatgagattttgtgatgtgatcatcattgtcatcaactttagtaaatatgtagctcggccctaaattacagtaagactctttaggttgtaagcattgtgaatttgctgcattggaaaaaaacatacacacacatacac

SEQ ID NO: 2852 - DNA, 1048 bp, Homo sapiens
agtggtagtaaagataacctcccgcataaacgctgcttaccctgtaataggcatattcacttaatccccacataaccctaccaggtagattctgccataagccccattttacagataagaaaactgaggtattcagaggttagtaccttgacccaagtcacagcactgctaagtggtggcgtaggcactgaagcctaggcagctaggctcccgactacgattttatccattacactatattgcctctgatggtggatgttgtgaaaaataacttctgtcaccagttccttttggaaagttgtattcaacaggctaaaccaggtttcttgacagtagggcttctcagcgtttttaatatgttagtgcacactgtgactctcttagaaaggaatttagttttcagtgtttccgaaatttatatgacttatggaagcttttctatcaaatctccacacatcttccaggaatcacgtttttaggaatacacttggggaaaaactgaactaaactaatttgtagtaggactgctgaaaactatcatatggggattattcgttattgtatctcatcagtgcctctgcaacaccctactccatcccaccctgccccgcaacttcactttcattagaacacacacagttcatggaaagagtagataggttggtaactttcaattttcatttagtcatttctctaaaatgggggtgtggggtggggaagcatctttgaccagacttcaagagtagctggacagttagctgtgccagagtcacgttccaagttcttccatatcttactgtcccaactttgcctttatgtgataattctatttattttaaattatgtgtttattctagaaaacaaatttgacaattacataactagattgccagtcagttcattgaagttagacaccttttaaagcatgactctgaatgagatttcatagaataagatgttattgtggatgctctcctgtataaacgttttaggcaatctcctgccaggaattattggcacaaatttgaagtatgggccactaagtcag

SEQ ID NO: 2853 - DNA, 1074 bp, Homo sapiens
gcagtgccatggaatggaaagaacactggacttggagtgagaagacagatttggattccagctttgctacttactagctgcatggctttgagaaaaatctcttaattcccgagtttgagacactttatctatcaaacaggaatatctgttccatctctctgccccacagagatgttatgaagaatagagaggtcggtgcatttgaatgtgccttttaaaatagaaagtacagacatgcaaagggtgatgcgctagtaactggagttgatagagtctgtggttttgttttaaaagtagatgggaattgtgcatatgtaatagaaacaggcaatagctagtctactgtattgtcttttgccttgaaggtaagttttcaaattattttggagatactgtaagaacatttttggagggaaaattatttttagagatgtttctgttaaatatttcctttcttttgtgtatattcccttgaaagaagttgacctcctttctgtttctgctttcttccctagaagtgactcattctctgatctgataactcatctttcaacattgtgcttgaagttctgacatactttgcaatgaagaaaatagaagtaatttactccaggaaatatgccattaagtcttttgcatacttaaggaagtagagattccagaatctcattcctgtgttttcctttctgtttcttctcagtagttccacatttgctcaaataagggaatacagcccctgttagctgtaaataagcatagaattttgggttcttctgaaacatggaagacatcatgctgtctaccaattttattattgtttttgttttgttttattttcaataataataataaattcttgcaaaaatagagattatcttatcatattctctgactgtagtcagtagacaggatgatacttacacctgtgaggatacttagtactttccgtcttttagtagttgatcattcattcattcgtttattcattcatgaaatgttcattgaccacacaactgtgtaccaggcactattccagattttcgggataaattagtgagcaaaacaaaggttcct

SEQ ID NO: 2854 - DNA, 1611 bp, Homo sapiens
caatctgggttttatataaatgtattaggtctaaaattggtttgtgaatgattagtgatcttgctctccaaggagacctaattagggaaatttattatataaaagagacaaaaaggtgcttggtatgttatttaattctcaccacaacttgaggcaggaattattatcttccagataaggaaaccaaaactgtttaaataactggtgagtgggagagctacggttctaacataggtatttctggttccaaagtatacgttctttcttatggtaattacagtattttacatctattgctaaagaaaattcaagccacagtagttatgatgagaaagtttgggaaggaaaaattcacctttaaatttccgtggagaagtaagcgtccttggcatgtaacggttaacttactctgtgcccctaggccctctttttcctcctctagatctgtcatcttagcctgtactggtctaactcagaacctctattgctcctcctgcttctcattcctccagctcctgaacagtactttgtaaattggatgtattcttttgtatctgacatagatggcatttaatgaataaatgatgaatgaatgaaacaaataggtgtggtgctattcgcacctcctgatctgacttctgatgccagtctgtcccattgttgatggctgacagtgtgcagtaaagaacacatggcaattcagaggaactaggtttgaatctcactctcccacttggagctttgtaaccttgggtacatggcctcatttccccaaacctcagcttctccttctgtaaaaacatttctaaagccacactgcaggattgttatgggaattagaattgtgtatatagatacgcatacatacacgtatcaagtgcctagcacagtgcctgacacatagtaatacacagtagctgctattattttcactggtggcatttttaagggtcttgactggtaatttgggtatcactttacatagctattgtctttgccagggaaagtctgactgtcattttccgacggacataagtctatgccacaatgaaagcctttttaaaacagccagatcaggaaaatgtggatctagttgtattttgtaactctgatgaattaaagcaggcacctactctaagtttacaatttgactcaaccaaggcctggcaagtagtaaacacttgataaattgttacttactatttttaaaactctcaagcgcccctaaaacttacgaaaagtgcattttgtgtgcctcacaagaaggtagtgaataggacaaattttgattttagggttgtttgttcttaatttcttttagttccagtttcatttctccctggcttcttactatgacattttcaataactcattcatgttaagttttacattccattttgatgttaccttctgctttgaaaccacctataaaacttgaagggcttaaactgcttcttttaaaatacaaattattaatgtagtaaactctgaagaagccctccaggagtgtgcctctgcataccccatgccaaactattgggataaataattttccctgtgctttgaggtaaggaaaatcttggagtttctaaagttttgtcattgtggaaa

SEQ ID NO: 2855 - DNA, 1071 bp, Homo sapiens
catacagactttggagtatcttaacattgagattgttttatacaagtcagatcagcacataggaggagtcacaactgtcattgatcataatttatgaccctttctagactttctgaatgttgttatagaaagaaatgtcttatattgagcttgattctttaacatcatagaaattcattcagaaaagtttgatgaataacagaagaaatctttattcactggcccaaagcttagtttatattctgtgctgttataacatctatatgtgtgtctatattagtactatcagctctctgtggcaaaaagaggctctttaaagatggaaactattataataaaacttcgtatttttacaaaatacctcaaattggtagcattcaaaatgaattcatgttggttaataatgaggtgtacattttgctgtgtaagtgaatagatcatcatattaccccaagaggtgatttttacatctatatcaacagtgtttcttgagattgaggaattgtgaaaaggattttagtagaagggtggcaatttgcagcagatgtgtatctgcacctctggtatcactggttgtaattgaacaataaaaatgttgcaaccgtctgggtagcaagatggctaaggtcggctcttgcctgtgatagtaagaatggaggagatttgtttgacgtcatagactctggattataagaaggagacatgtcaagcagtaactacgtggcatgtggctgtgatgcgtctacagccaacctcctggtgtggccttcccaaagacaaggaagcgtcccattcaagtgtgtctcagtgcttgcatgacacagtgcctctggattttacgtcagttctgccttcagtgtaaagccctgattttcatagataacctaatctgtagggaaaaagaacattaaaaaaaaaaaagtatagccacaaaagttctttccactcatgtgtggatctttccagttttttcagacagaaaccaaatgacagcctcacagtcacagaatcttccaacactgaaagttaaagctgatttcttcttcatggagaaaagcttacaaacctttt

SEQ ID NO: 2856 - DNA, 1036 bp, Homo sapiens
ggttgcataggatgggggccatgtgcacacacataattgtgtgccttagtgcagaagagttcctgggaaagttttaaagccccagcaggtaacctcgcaaggcagctagaccccaccagtgtgcctgaatcctccacagttctcatttgtaagctcttaatgagactggtattgtcggtcaggaaatctagaacactggagaaatattattaggaagaatatagtaaaaataatgacaagatcgaaaacaaatcctgtcagagcccaagaataaatttggcttccgcttgctgtgtctgtctgtttccataatggtccagaatagaaaccggatgtttaaaatctctctccttttcacatgctctcctcccctcctgtcttccttcctcttcagtattagtagacttactatttttattattttttatttatattcctagttttcaatatttgccatttgtgtggataacacattaatttttaatgaaatattttcagactcttggaactcttggaatagctgaatcataaaagaaaacttgaaattgatatagactccaaggcagcacacaaactgaaaattacgcttgtttttattcttcccactgacaaatgacaaatggttatttgaaaggatcatgtgtacttagatttaaacttcttatgtttctatatgagcctagtttgtataatttttgtggcacagaaggtaattcagacaccattttaattaataattaaaatgaaagaagcagcaaaacaatatgtgaggtagtgagctccagtaattttctttttatctagaaatacttatttttgacaagccacattgctagtaaaggaattcaagtgtgatttagattacgtcataggcttaactttattttagttctgttgcggcactaaagtttttttgtttgtttgtttgttttgtttttttttttgggatggagtctcgctctgttgcccaggctggagtgcggtggtgtgatcttggctcactgcaaccttcacctcccgggttcaagtgagtctt

SEQ ID NO: 2857 - DNA, 1033 bp, Homo sapiens
ctcccaaaatgctaggattacaggcgtgagccactgcgcctggccagatctaaagatctgaaagaaagtggcatttgtttctttgggtaatttatttccaccaatcaataattgttgttagtgaaattaaagttaatactgaatattatttaattttatactgcatggtattctcagaaatgcaactttgtaatccactttggaactgtaaattaataagaatagtttcttctaaaagtttgttttttgttatagatagcatggacatttaagatataacatcttttagatcttttcttattctcaaattataaggatatcaatttctattttatgttggcaacttaaatcttattttaatcatttatatatgtggttacttttatattttcttcttttaaattaaaattcctaaaaaagtctacttatctcaagtaaatttacttattctcacattaataacaaacatatttttccaaatattattttctaatgtatttctaaagactaataaatttttaaggagctctgcctgtcttatatgacccgagttatgtagaatggcattttatagaatcagaagaggcctgaaagattatctagtccaacttcacctcttgtcgtctactcccaccctccattcccatccccatccccagcaccacattttatagataagaaaacggaagcccaaagaatacaagtaatgactcgaatccgttttctgacatcaggtctagtgttttctactgtacccactcaataacttatatgcttccagaaatagggaggtggactagtactaatgatgaaaaggaaaatatacaatggacataaataatcagatgtttaccagaagctattttgtccagtgaccttgagaccagaagttggatggttaattggaaggtcaaaaaatacatgacaggtgatggatatgtggggctgaggcatattttttgtgtgtaaggatcacctgatttggcatgccatgtcatttgccctggataaacaacacccaaaatacatcttt

SEQ ID NO: 2858 - DNA, 1353 bp, Homo sapiens
ccatactctggtcatctttgtatctcttgcctatagttcagatcctggcccttagaaggcatttactaaatgaatttgtagtcctttttatcttctttttaaaaatcatcatattttatcatcctttttatctcctaaaattgtagaagggtaaaaatgagacaaaagcagaacttgatgtgtatgtgcaacatttaaaaaatattttataacctctcatgtatatcttcatgtttggaaaacctactcactatatgtgtgtctaattactattatgaagtaataaaaatctatagttttattgtataatgatgcacatccagtggacactcagtaagtgttaatcacactattaaatatgctttgatctcattataactggagtggctgcctggctctacttaggctatttaacaactcattgtgttattagttgatccttatttttcaaggtttgtaggtcatgcttaatggagcgacttgctaaggttgttagcagttacataaatgactctgactttacaaattttatgataaccatttggaatgaattatatattttccaagcttttggttcccccagtggctgatacattaaagaataattggtaagttgcaaaatttgtgacagttttgtttttaaaaaatcagctaaatttggctttttacatattgctagtgatttctgtatcatagatgaaggagatagcatagacttgaggctgggaaacacgtttcttctttcacatagccaggcagaacagcccttggaagacgatccttggaaacacattatcatttcttgttcaaaccaaatatacttaacttctgtatctcttccactttaaaatcattatttttgtgaccgacgtctggaagtgccccagtttttccacatggcccttaacacatagtgttagtgttgcatttcgtagttctcattttgaattatgcctctgtgttcactagcagggttacctcctgttaggcccgactggaccatggagtcctgggctccttttggccttttgcctagagtagggaggcctcagtgactgcaaatgtggcaactcgggcagtcccttggccctttccccttaggtccacactcccatcttgggattctgtcttttccacttcaataaatggctccaaggaagagcttgaaaacgtatttggatctgattgccaaatttctcaccagaactattctttcagggtgggatttttgaggttgggtaggggcagggttaaaaacatgagctttctctagaggccaacattccctgattctaggcagttagtcagaccttgttcctatggtagacgtctctgttttccagcacttagagc

SEQ ID NO: 2859 - DNA, 1033 bp, Homo sapiens
gactcctctatctctttctctgtcatacctttttgacttctccctacccttgagatgatctcatctcttttttttttttttttttttttttttgggacagtatctggctctgttacccaagctggagtgcagtggtgcagtcacagcttactgcagcctcgaactcctggcctgtagggatcctcctccctcagctttttgagtagctgagactgttaagtgtgcactatcacacctggctatatatatatgtatatattttagaaatggggtcccactgtgttgcccaggttggttttgaactcctagactcaagtgatcctcctgcctcacccttccaaagtgctgggattataggtgtgaaccaccgtgcccagcctgcaatgagattcttacactgaaatgcatagatgggctgtgaaccttcataaaatttatataaaacttaatgtttacttatttcttttctgagaagcagatccaattattctgtgagggcttctgttgtgccaggcaaggttctaggtctgatcctttagcagcctctcaaaacgttgaagaactgagtgactcttcttactctgttgttttccttctctgaactgtgagtgccacgaggcaaggacttcatccgtcttgttcatcactgatttcctgctgcctagaacagtgcctggaacatagtaggcactcaaaaagtgtagtgttctgaatgattaggcattgtgaagtagaaaatacatttatcttatgactctccttttccggagttgatgagatatcatgatgttattggagggtgcaggaggtgatcaacagtattctaggactttgggaattcagactggggatcacaaaatttggagcaggtttcgcttggcactcaggtgggcatctgtctccatcccaccggctgtactctgcagtggctggtaaattacactcttcttggtgggcttgaggccccagcccaagactgcagggtcaatgcaacataaaagtccaggtctcctgactcggagtacagactatg

SEQ ID NO: 2860 - DNA, 1032 bp, Homo sapiens
agggtgcagtggtgctatgtcagctcactgcaacctccatctcctgggttcaagcaattctcctgcctcagcctcccaagtagctgggattacaggtgtcggctaccatgcccaactaatttttgtatttttaatagagttgggtttcaccatgttggccaggctggtctcgatctcctcaccccaagtgatctgcctgccttggcctcccaaagtgcagggattacaggcgagagccaccgcacctagcctatttccatctatcttgatcacacttgatcatgttgagagactagaggctctgaaatttaataaatgacctaattcaaaatatcttactccaaatccagcttgatagaaagccaaactgttgtcagtatatctcactttaagcaaacccaacatattaaatccatatttacaaaatggattagttaagtagtcattcttcacttagcaacataattcattatagtaagttccccttgtaatgcatataaacgtgatttactttattagaaccctctgtgtgtgccacatttcaagtgcaaagtacatttgataatgttactcaacaaattattttctcatttgtccaaatatttggttgggcatcgctgtggcccctaaggaaacaaacaagtgggtcagaatggcctctggaccgaagggatgcgtgttgcaggagcaaggactgttggcgtgggctgatcgctggtctacaggctgtgggagctcagagcatggacccagtcagttcagtctccatcatcctagttttctggatcttccaactccttattcatcgaatgaaccgggagcatgcagaatttatcttggtggaaagcctttctcctcagttttctctccctgttttggtttactgaacaggaaagcctgacataattaggtctgagaagagtcatcgggttctgctctcatccttgagcctgccctggttggtagggaaattcacttattaattctgtggctggctttgggtcatgcagatgacccagggtcactgggctt

SEQ ID NO: 2861 - DNA, 1035 bp, Homo sapiens
atcaaaccagtttgaattaagtcatcagcttgagtccctgagagtagctggtcagtacctggtgggcatttttgtttgtttgtctgtttctaagtccagggctggagaaagaggtcagtacctggtctgtgctgcacaccatgggggcagagtgcccttcctcctttctcacaggcaatgaccccaaaaacggaagcaagtaagaaatgcagcatccaggttaaaaatgaattcacttatggtcagctgtgtccaggctgaaaatgagtcacctatggtcaactgtgggaaataggaagctgtcatgcctactgcagcttccctcaaaggtacttcgagcaatgaaaatacattctaatttatttgctgtggaacaatgcaaaggcttcctcaaaaaaagaaatgaaacctggagaatgtgtgactgaactccagcaggagaacaggacacaagtctagaaatctcaagtgtcttcaaactgttattatttttatggatttgtgactccagcaaacaacttttactatcttaaacaaggtcatctgaaaatcacttgaagattgttaccaaattccttcataaatattttctacaaacataaatgtccaccagaaatttcagataaagtactatttctcctgtgtcaattctttgtatttaaaatttatctcatatacctaggttttaaaacacgtttttaaattttcagaactcatttcatgctgaacatgttaagtgctaggatattcttactttgtcttccgagtttaggatctctgcgggggtgtggggggtgtgtctgtagaaagcataattttgattgttatccaccaattggaagaaatccctactttaatctcttttaccttccaagtgtacatggtcccaaatttgtcagtcttagaatttcttgaaacaatgcaattaaactgcaacatatttcctaacattcttaattaagacagtgactgaaaaatgtagattaacagaagttactgtttttatcaacatattttctctctctttcccgccac

SEQ ID NO: 2862 - DNA, 1804 bp, Homo sapiens
tctggctcccctgagggaggactcggtcttgagggagctggaccgggaggacaaagccagtgatgatgagatgatgaccccagagagcgagcgtgtccaggtggagggaggcatggagagcagtctgctcccctacgtctccaacatcctgagccccgcgggccagatcttcatgtgccccctgtgcaacaaggtcttccccagcccccacatcctgcagatccacctgagcacgcacttccgcgagcaggacggcatccgcagcaagcccgccgccgatgtcaacgtgcccacgtgctcgctgtgtgggaagactttctcttgcatgtacaccctcaagcgccacgagaggactcactcgggggagaagccctacacatgcacccagtgcggcaagagcttccagtactcgcacaacctgagccgccatgccgtggtgcacacccgcgagaagccgcacgcctgcaagtggtgcgagcgcaggttcacgcagtccggggacctgtacagacacattcgcaagttccactgtgagttggtgaactccttgtcggtcaaaagcgaagcactgagcttgcctactgtcagagactggaccttagaagatagctctcaagaactttggaaataattttatatatatataaataatatatatatatatacatatatataaatagatctctatatagttgtggtacggtctaaaagcagtcttgtttcctggaaataaaaagttgggatattaacttgtttttgcactttagaatagcatgagaatctcactaatttagcattctgataaaagaaactttagagcaagtcagaatagagaggtgtttttcctttgaggggataggggaagtaagccaataagaaccttttaaacaaatcgtcctgtcacaaaatgctttcatatggcttaattttgtcaacactgcattgtcttttgagctcttttttcccccccaacaaagtttttttgttttttgtttttttttttaagtagaaattccctccagttttattagcctctttatatgtctcaaattgcatgaattttttctggctgttggaaacctgaatgcttttagacccaaatggaaaatttctgaaatgctggattatctatttttaaacaagcagttgacttaaaactttctgtggcaacttctggttttctgacagttcccagtgagagaaatgctgaaagtacactgggatcactgggacactgtcttatgaaggtttgcttgggatgaaaaaggatattgcagcttcagcagtgttgaactgtgtgtttaaaaatgtgaattactgttattgtatactgtaattgattacatgggctgggggggtgtcaaagaacttgacaggttgtgttgatgctcttagttgagtcttgaaaagtaaatattaacgctacagaaatgcatgagtttcaatatattttttgtctttgtttgcattgtataactttaacgagtgagtttaaaattatttaatttccttagaaaaataacaccatttggaaaaaaaaactggtgttatgaagaacgtaaatgcactgtttttatttttattttatataatttaaattgactttcccactgtctttaagttgaaactgttaagctgaataaaaacttaagctgcaaattgataacttcgctacataacaaggaaaatataaatgtttacaaacagcttaaagatttgcatgtgcagtgtgcatttataacaaacttctaattgcacaaaacccatgccagctcagagtttaggtgtacacatttacccagtt

SEQ ID NO: 2863 - DNA, 1040 bp, Homo sapiens
taatgctttcaaatctttacttttaaaattgggaattgtactcctcaaactaggactcattatttaccttatagcaggctgttcacttaaacactgtagtaaaactatagatgagagtactaatgtgtttgccatgcaactcttggaaactcaaccaggcctgcatgagttgctcagacagttgcaaagcaattccactcttctcaccttggggttcactcccattcccattacctcccctgtcagcaggaagaagccagagctatcaacggccttctcccatcttcatagcctacccaaagggaaggattgaaaccatctttgcaaaattatgattgagacagtgaaagagatctaactgaacggattgcatcttgcttctaacctcaaagctgtccttgttcattcctgggcataagctgaactaactttgggagaaacttagtttatagtttacacaaagacggtaacaaccctttcccaaagcagacctccttcttgcctggagactagattgcctttgtaggactaacattaaccacaagatttgaaatcaggtttaggagtcatgcagctggaggatacaagattctgacttgccctaaaccgctcctaagatcggtgctcgagagattttacagaccctgcacttgatggatcagctggcaccacccagatcagtaaactggctcatctgatcttgtggccccacccaggaagtgactcagcacaggaagacagcttctactccctatgatttcacccctgaccaatcagcactcctggctcactggcttccgccaacccaccaagttatccttaaaaactgtgctccccaattgcttggggagactgatttgagtaataataaaactccagtctcctgcaataaataaataaattaattaaataaaaatcatttatgctgtgcctggccaggtctggtggctcacgcctgtaatcccagcactttgggaggctgaggcgggtggatcacttgaggtcaggagttggagaccagcctgggcaagatggtgaaa

SEQ ID NO: 2864 - DNA, 1098 bp, Homo sapiens
tagtaaactttattggaccatgtctaataataaaaacagggaaatggaaactttttgtgaatttcttggttcacattttgctaacagaggaaaaactttgttataatgccgaattattctttaaggagcaaagtatgttctgtatctaaaggaatgtttatcctcgggggctcaaggcatgtacagaagagtttttgtttaggtttgccaactaaaacatggtatactcttctgtcatttgggacaagttaatagatttactttacttctgtctctttttttttttttttttttttttgagacggagtcttgctctgttgcccaggctggagtacagtggtgcgatctcggctcattacaacctccgcctcccaggttcaagtaattctcctgcctcagcctcccaagtagctggaactacaggcgtccgccaccacgcccagctaattttgttttgtaatttttgtagaaacggggtttcaccatattggtcaggctggtctcgaactcctcacctcaggtgatccacccgcctctgctcccaaagtggctacaggcgtgagctactgcacccggccgatttactttacttctattcataacggtcttttttttttttaacagcctttttgagatactgttcatatactagatgaactatataaaatgtacacccatttaaaatgtacaattcagtgaattttagtatattcacagttgtgaagccatcattaccacagtcaattttaggatattttcatcaccctagagagaagcccatacccattagcaatcacttcccatatcttcccaaacttccagtcatagaaccacgaatctactttccgtctgtgtagcctattctgggcatttcatataaatggaatcatgtaatatgtggtcttttgtgattggcttctttcacctggcataatgttttcaaggttcattcctgtggtagcatgcatcaaatacctcattcctttttactgagaaatcatattgcgtttcatggataataccacattttatttatccagtaatcagttgataaacatgtagttgtttctactttttggctattacaagtaatgctgc

SEQ ID NO: 2865 - DNA, 1034 bp, Homo sapiens
tcatgttatataatccttgagtctgttttcataatagatattagtctctgtttcttgtgatgtctttgttttggtatcaggtttatctggcctcatagaatgagttgggaagtgttcccctttcttctgtattttggaagagcttctgaagaattggtattgattcttgtttaatttagtagaatttgccagtgaagtcccctggtcctgggcttttctttgtgggtagtgtttaaattactagttcattcttttctcattagaggttatttagattttctgtatcttcttgagtcagttttggtagcttgtgaatttgtccatttcatctcagttatataatttgttggcatacagttgttcttagtcttccttggaatccttttcatttccattaggttggtagagatgtctcttcatagatttttaaccagtaaatagatcgctactttaactttacaaagaaattaactcttcaacttctgggggtcctttctgaggatagaaaatataaggaaatgtgaaaaacaaagaactactgagttcatcattattattgctaacaatgaataagcaacgtcaacattaatttttgccttgcacagaatattgaaacagagccttcaaaaaaataacagtaatgagtctgggcacagtactgggcatggctcacacctgtaatcccagcacttgtggaggccaaggtgggaggattgcttgaggccaggagttcaagacaagcttgggcaacatagcgagaccctgcatccacaaaaataaaagttaaaaaattagcctggcatggtggtgcatgcctctagtcccagtttctcaggcggctgagttaggaggattgcttcagcccaggggtttgaggaggcagtgagctatgatcgtaccactgcactccagcctaggcgacagagtgagaccctgtctctaaaaaaataacagtaataatgatgatgatgttaggagtgaggggtggacttacactgtttaatactgtccaaaggaatatatctctaggttta

SEQ ID NO: 2866 - DNA, 1050 bp, Homo sapiens
tgatctcctgaccttgtgatccgcccacctcagcctcccaaagtgctgggattacaggcgtgagccaccgcgcccagccttttgccatatattactttgcaacttgcttttgtttccctaacaaatatatcctggaaattacttcctcttcctcttagttccttaagagcatcacacctgccccaacactttttgaatttttttttagagacagggtctcactttgttgccctggctggagtgcagtggtgtgatcatagctcactgcaacctcaaactcccgggctcagttctcccacctcagcctcccaagtagctaggaccacgggtacctggctaatttttttttttttttaagagattgggtctccctgtgttgcctaggggggtcttgaactcctggcctcaagctgtcctcccgcctcaacctcccaaagtactggaattacaggtgtgagccaccacactgagcccttcccctctttttatggctaaagagtattccattatatagatatatcatagtttatgtaactaggaccctataaatgaacatttaggctgttgtcaacattttactaacataaataatactgcagttaatagtcttatgcttatggttttttatatgtgcaacctattcttttactatagtataaagattcaaataaataaaaacctgttaaactaagataatagcattttactttaaaataacatttttaactataaaagtaatactctttatcaaatttagaagaacaaacaatcctgaatgtatggagctaaaactgaaagtattgcattttagtcctccactcccaccctagccacgtgtactcctctcggccaaattgttaacagttgaacacaggtgcttcagacctttcttttgttgcaattggtggtagtttgattttgtcatcccatacttaacatgtaagtatatcctcaggctaacttatttttcaaaaatgtgatcatgctacacatattatgacttgatctttttattttatgtggtttttaaatatctatcgagttacctca

SEQ ID NO: 2867 - DNA, 1050 bp, Homo sapiens
tctaaatatactctctgaagattttgtactttaaaagagttgcaaaatcataactataggtctctctttttttaaccacttgcatatgttattacagaaagtagaagaaaatctccccatattcatttatactgcgttttggaaaaatgcccaaagtagaatgtatttggggagaaagtactcaaaatacaagaatatacatttgcttcattcactttatcttttattctaaatactatgttttaaaaaatattttccttttgtgattgtcataaaatgacagtttgttttgttctcatatatattggagctcctaagaaaccttgcatttcgaaaatagcatgataaaaacaataattttggtcggaaaggttggtgctagaaagtgtcagacttgaaataccaatttcctgagggaatttcagtaataaatttggtttgtagacctatacgtcttataaaatctataagtttttgaagtctaaaaacattgctgagcaaatcctgccatgattacatctaatcatgccctttgtcattaactcagcccttttcattctccttattaaaaccctttattaggataaacatgtcaggagtcactcaaaccaagcagctgtgttttcaacagtttttttccactgtgctaattcctactcttgatgcaagataatctacccctgatcaagttgtaactaatagtaatggtctgcgtaagacagatcacattgctgatttcattcaatgtatcattttgaattataaactaaccctatagcagaaatgcctttgttcgcttcagctaggcagtctttgtgacctcttaagaatatattattgcagtttactgagggttacccctgaacactatacaccagttttaaccaatacaaagaaaagactcatttacttaaatgtgtcagtatggtggttatactcttttttatattccattttacctgcttccaggtgaagtttagcatattaaatgttggctataaaaatctgccatttaagctctattttacttgaaagtctgcatctaccaaa

SEQ ID NO: 2868 - DNA, 1034 bp, Homo sapiens
gcctgcaggattggtcctgagctggcatctgcgagcttggacttctgtaaggttctcatcattcccagaactgagaagagtggctccctttgcctaacctgtttgtacaactaatttggtttatgctgaaaacctgctttccctctgggactctgggattttggcagaggacgcctgcatgaccagcccccaatagaagtctcgggttctgagtctgtaatgatcttccctggtagacatttcatatatgttgtcacagaccattgctggggggattaagcatgcacatcctacctgactctattaggagaggatccttaaagcttgtgcctgctttcctctggactttgccccaagtatattttccttttgctgattttgttttgtacctttttgttgtaataagtcatagtcatgagtatgctatgctgattcctgagtcctagcaaatcaccaaaacggggcggttgtggagacctttgactcacagaaatataacagaaggactggcaaggcacggtggctcatgcctgtaatcccagcattttgggaggttgaggcgggcagatcacttgaggtcaggagtttgagaccagcctggccaacttggtgaaaccccgtctctaccaaaaaatgtaaaaaattagcctggtgtgtggcacacacctgtaatcccagctactcaggaggtggaagttacaatgagctgagatcgtgccactgcactccaacctgggtgacagagggagcctctgtctcaaaaaaaaaaaaaaaaaggactgagaaaagaaaggatgaaatgggtagaggtatggaaaacctttgatgtctggatggctgtggagttatccatgatatgaaatagcagctgagctgttgcctgttatgaaaggtaaaagttacctgtcgaatttcaaatgatagatccaactccaggagaactgactcactagatcacctggctacttttggccatgctggttacagtgaggagaaaaaagaagtgtagcccaggtaataccttcagtttttgt

SEQ ID NO: 2869 - DNA, 1028 bp, Homo sapiens
cagggagccgagattgtgccactgcactccagcctagcaacagagtgagactgtctcaaaaaaaaaaaaaaaaaaaaaaaaaaaaaaaaaaaaaattctgtgaaaacttttgtcccgctttaatatatcccttccagacaaaaggtctggatgagagtagaggacaattttttaaatgcgaagctatgactgctaaatgggacatactgattttgtaacaacaacaaaaaacaaaccctggcacctagggaatctcaaaggaggcaaagactgatcatctttgtttttcaatactgcctttccgctcttccctaaaaacttccatgctacctttttaagatgctgcaagcactttgaattcaaacagcctgctgagcctgtgctcaaacctatgagagcagggagtggcctcagctcctgcacttcccacacggaacacctccagatgtcatccacagtcgtgaggctgataacctgatgtcatggaccaacatggaactgactgtcttcaggtagtccctctgaaacaaaaactcaaactaagttttcaggctggagtggaaacctgttttcctctacactttaccccatgcaccttttcgcttgccaattttgtttcataccctttcgctgtggtaagtcctacctgtgaatacagctatatgctatgtcctatgagtcctctaaaatcatcaaacctcgaggtggaaaaactgggtcttgggcatccctgacacagttccctagtattctctaagtggttttttctccccacaaaatagtttttgttttgaaaatttagcatcgtgaatatctcctccccagatttaaaagtattttcgtttcggatcagtgtaatgactgtttttgtcccatctttgatgcatgggagcctcttcaagttggctcataagtcttttgatttgtccctagtaatcttctacagcgttttgttatctggtatgacaagatattccaggctcatctacatattttctacctcagaactgtttccttctaatagcaaa

SEQ ID NO: 2870 - DNA, 1030 bp, Homo sapiens
tttgtaagaagctgccctctgttttttttatccactcgtaaatctggatttatttcttctgttttatacaagctctgttaagttatgtttacagtatcttgtatcgctgtttacaaatcttgcatggactcctgccacagtgaaagaagaaaatcttcatgtcttcaaaaattaggcaggtaatctttgtatacttctgacaattgccagatctatggcataaataggcacacaaaaaggtacttaaacagttatagtcaccatcacctgcttcagaatggtcttttagatttgtgtttgttttgttaaagttgttggcaccaggatgcagagaatcagactggcctgaggtgaaggagcacacagccctgagggcttggaaccctgggtccagttcctcttcacacccccttccactctgagtagcacatctccccaggtgcccatggaacacctgctttcatcccaaatatccgtccacctaggcggggtggtatgttcttacgtctctctgactttgatgccactcattctatagtttagctggttttcgttcaagatattcttggtagtaactgacaagtatgttgcacatgtattgggggaggcgcttcatttttattttaatacacatgtatttcctccttgcacaggattttgatggtgtgggaatatcctaagtggtagccttccaagtagcagtgagttgacattcagctgcttttaactattcaggctaccttttatactaaaccttgaaaactagaatctaatgtctaccccaaaaaagtagttctttgatattttatactttttatgtaccatgtcagaaagagtatgttggcgtttgtcatgggactcatttcacataatagaatgcctagtctcattgaccaatcgttaaaaaatcatatttgtgtgtcttaagattcatatttatatgttctctcaaatgtatgtctcttacgtaacatactctaagaatgaaactgtcaccacaggtaaatccttgttagcaaggaatctgtct

SEQ ID NO: 2871 - DNA, 1051 bp, Homo sapiens
ttccgctctcccgcccctgcaggctgtgtgccgagcttggaagaaagtgtgacccgttcgacggaacaaaggacatgacagcccggccccgtgcggccactgcggagcgttaggaacattccctaaaatggcggccggcgcgtcggaacagggcgggaggcggcggcgcgtgggggcgggacggggaggggcgcggccagccgggcttctgcttccgcgaccccggcggtgcagggcgggtggagtcgcggagtagtcctcatggccgccccgccggagcccggtgagcccgaggagaggaaggtaacctgggggtcggcggggcgcgcgccgcgggtgggcggtgggtaaggacgttctccgcggagctcctaggcccggagcacgtgtcactggcttctctgccacccatgggcttgaaactattttaactgttcctagtccttatcccaagcctccaacattttaatctaagtggccgggacaaaattgaccaaaactagggggaggaggggaccagtagtactaatgacttactacaggtcattatgaaataagctaacaatactgaatctttggcgagaaaattttgctgctaagggcactgcactgtaatttgttagtaaaggctaatagtagagattaaagctccgttgaggacaggtgccttgtctttaacacgttgtattcatcacatttaacataggagtaattgctgagggatgacttgattgtactacgatgagatgaagggttaagatttcttccccatcaccagtagcctccctagctggtgtccctgtctccatactctcctgaatccaccttccactattgtccgctggccctttccagcctgtaaactggacagttttcattcctctgcctaacatccagtcgtagcagcccatcctatctctttaaggataaaacccaaattcttggtatagtaaagctaaaccaagcgctctccctggaagggctcctgtgtttcaccaaagctgacttacgtactttccccatcttcccaggcatcttgtacgtcgttaca

SEQ ID NO: 2872 - DNA, 1032 bp, Homo sapiens
tgacacatgagactctctataggccacttgactgtacatgcaacattgcatctggtatcccatagagtgagtcattcaagagacagaaagagatgacacagaagccacaatatcttttataacataatctcagaagtaaccaaacattacttttgctctattctattggtgacataaactaaccctatataatatcagtggtgactgcgcagtggtataaatagcaagaggtgagggtcatcgggaaccatctcagaggctggctaccacagtctgccttctggcctccagtgattcacgtttctcgcacatgtagaatgcactcactctctccaaaggcccactagaatgggccttccgtcccattacagccattacagcatcagctcaaagtccagaatatcatatctaaatcaagcccaggtggtaatgaggttccttggctgtagctacttatgtatgacttcttgagtggtttctcttgatctatagacctgtgaactagagagatgttacttgccccttaccactcaacatacaatgggaaaaggtaacatccacagacacttctatcaaaaaagaggatgtcttcgtgtatttgtgctgctgtaacaggataccacagactaggtaacttatgaagaacataaatttatttctcacatttctggaggctggaaagtccgagattgagggtctgcatctggtgagggccttcttgctgcatcataacatggtagaaggcatcatatggggatggggaaggaggctgaactcattcttgttaaggaacccactcctgctataacatacgtgctcctaagataacagcattaatccattcatgagggcagagccctcgtggcctaatcacctcttaagcttccacctcccaaaacttgcatgggggtttcagtttccaacacacgaactttggggatacattttttttttggtatactttttggtattcctccatagtaaggaggaaatgggaggaacacaggagtcgtggttcataaaactgagcct

SEQ ID NO: 2873 - DNA, 1033 bp, Homo sapiens
ggctgtttccaccttctgtctattgtgaataatgctactgtgaacactggtgtgtaagtatctgttcgagttcccacttacaatacttttagttatttactcagaagtggaattgctagatcatatggtaatttgatgtgtaactttatgaggaactacgatactggtttccaaagaagatactattattatcaccatgtggcaagtggggagacttgggcacagagaggttaagtaacttgcccaaggtctcacagctagtacatggtaaagccaatggtggctggctccaggtcagtgctcttaaccagcaatatatacatacttactggcctcttttgtaatctctgttataattatgttttcctatttggggaagattgacatcatttggaggttttttttgagatggggttttgctctgttgagcaggctagggtgcagtggtggaattatggcttactgcagccttgacctcctgggctcaagtgatccttccacctcagcctcccaagtggctgggactacaggcatgtgccaccatgcccagctaaatttaaattttagaattttaacttttttgtagagacaggatctcactatgttgcccaggctagtcttgaactcctggcctcaagcaatcctcccccctcagcctcccaaaatgctgggattacaggtgtgaactaccgcctgttttgttttgtttttagaggcagggtctccctatgttgtcaggctagacttgaactcctgggcccaagctattagcttgctgagtagctgggacaataggcatgtgccaccttcgagttttgagaattggactaaatcaaacaatattttactcgtagagtatttccttcttggattgatttttttgtttgtttgtttctgagatggggtcttactgtgtggccctggctagtctcaaactcctgggcttaagtgatcctcctgccttagcctctggagcagctgggactataggtgtgagccatggtacccagctttggattgattttttttttac

SEQ ID NO: 2874 - DNA, 1040 bp, Homo sapiens
cattttaacattagaatggattgttgtttattttctacaataaaactcaggtcaccttcgaattaattaagctgacaaaatgaaaatgacttaattacccaaggtttggcatgtaaagatcttaagagggggcagaacgaaccactcgaaaacgagtagcagtgtaatgaaggcttcttttttaaacaataacaaatgcttcatcaatctgagtgtggaaggtgatttatcaaaataaatattactaatttatttttttatgagtgccaattacaaatatcatttgggataataataacttagtgtaaacatttatatttgctgatccagcatgtcaccatttatggagtagctaaaggagttgagatcattggaactagagaaaagaaggttgagtggaagttgatagtgtaaggtagtggcaattctccctttgtctttagaattctcacccactccgcatatctgtcatgggagcattgtcctgaatactgagtaagaatactgagaaatgttatggtgtgcaaatgtacagctcctgaaagagcagaatgaagcacaagcagtcacaatggaaaaatatatggcatggccactgcctcctccttgcaattctctccgatcttggcatcttatatggcaactatatggcaacttacaagcaaaggggaagataaagtaaagggaagtgaacaattttccaaacttagatattctgttataacaagacacacacacacacacacacacacacacacacacgggtctctatttgaagatggcttcaccactatatgtgtgtatctacatagatgtaaacatttagagttgctgtgagccttcctcaggcatgtagtcttgcccccaaaagaggcggctgctacccaagagactgtcgctgttcattcattcatgaaacactgaaggagtaccatgagatgatgtgctgggaaccggagtccctaacgaatccaggtcacagtttagtgagggaagcctgcaaggcagtcagcagccacatttcagataggggcatgttc

SEQ ID NO: 2875 - DNA, 1027 bp, Homo sapiens
ccgcctgcctcggcctcccaaagtgctgggattacaggcatgagccaccgcgcccggctgaaatgacttctcttagagctgcctcctttctgtggcacctcttccatatgattgggttagtaaaaatattctaaataagcaattgatttgaggctttttgaagccaaacagtttggtgccttgagagcataagccattgcttatgtgaaaaaaaacaagaaactgtatctttgcatatactggggcccaaataaatcccgtttgaatgaatgaacatttcctagtgaaaacatggggctggaacccttctgtgtccgtgggaaaataggaatctattgatggatatggctctttggcttaaagtgaaaaatcatgaactggtggtcaagaaatctaggcatagtccacgcttttaaccctctgggacctgtttttctgtaaactgaggtgacgctctgttctggaacagcccctaaggggccgtttcaggtcctgctacacgctctgagttgtgattagagactctctggccctgtcatcgaggaggacgcctcgagacaggcctcatatggtttgcatcacttcctcaaccagactcgctcaacctgaacctcccattgcttcccatcattgtgtctggctgtcttgagtgtctccctcctgagccaccccttgctgctgcagtgtaaagaggcctcttgatttattaatcaattaatcagtgcgtgctgaggagctgttcggggtagttaaacagggaaaacaaacagctggagcctgcaatcaagatggatcctaattaagaaccaccccccaaatgctgatcttcctgccccgtcactgcctcacaactcccccccaccagcctacagctcagcaaaccgccttcagctctgatggggcttctaccccatgcaagctgacagtgaatttccgaagggcagattttctccctaatgtcctagaggtaaataagccttgagatgagcgttatcaattacctgcaacgactgttgagcccccaaat

SEQ ID NO: 2876 - DNA, 1670 bp, Homo sapiens
gctaattttttgtatttttagtagagatggggtttcaccacattagccaagatggtcttgatctcctgacctcgtgatccacctgcctcagcctcccaaagtgctgggattacaggcgtgagccactgctcctggcttttttttgttgttgtttttttttttttggagtctcactctgtcgcctgggctggagtgcaatggtgcgatcttggctcactgcaacctccacctccctggttccagtgattctcctgcctcagcctcccgagtagctggaattacaggcatgcgccatcatgcctggcttattttttgcatttttagtagagatggggtttcaccatgttggccaggctggtcttgaactcctgacttcaggtgatccgcctgccttggcctcccaaagtgctgggattacagacgtgagccaccgcacgcagcctcaaacactgggtcttatttcttctagcacactgtatacttgtacccactaaacaacttctcttcgtctcccatccccgctgcccatcccagcctctggtaaccacccatctactctctgtcttcaccaactccacttgtttagttcccaaatatgagtgagaacgtgtgatatttgtctttctgtgcctggttcatttcacttcccataatgacctctagttccatgcatgttgtacagctcttctctcattggaatatattttgtaaaacaaacaaaaaaaaattgggggtatgaaaggttttcactgctcatataaatgacaacttgtaaactactgtgaatagcaatattttcattgagtagagtgctaccaatatgcccattcagaatgaaaaactctgacaaacagctctgtccgtatatccttatcactcactgacaatcttttgattggcactggagcacccatctgctgggttttgtggagactgtggccatctctgccttttagactgagctgctcagacagttgacccaacaccggctgcctccttgccactgaatcggaatgaggtcatacttgtacatgcttcttggaaggttttcaggcctcagctctactgagcgaagacttggttgagtaacaagtgaggaggaaactgtagggttccattgtttacaatggggacagcctgcggcaccactagacattctgaggcgggtcctggttgggggtcagaaggtcattggataggcgggaaaaaaaatcattgcaaggttatgattgcaccagtgcattccagcctgggcgacagagccagactccatctcttacaaataaatcagaggaatgggagaaaatatttacaaatcatgcatttgatatttctccaatcatataccggtggccaataagcacacgaaaagatgcttaacatcattagtcattaggaaaatgcaaataaaaaccacaatgagatgccacttcaaaccgtctgggatgactataatcaaaaagacagatcgtgcattgggggcattttgagcattggtgaggatgtggagaagctggaacagtctatacgttgtttgtgggaatgtaaaacagggcagccgctgtggcacagtctggctgttcctcaaaagcttaaacacagagttaccaaatgatctaacaattccattcttagggatatacccaagagaactgaaaacatacatccac

SEQ ID NO: 2877 - DNA, 1044 bp, Homo sapiens
actttctctttagacattgctaatgttattcttattcttctactattcacaataatagctaacatttactgagtgcttacagtgtgcttggaactttgctgagaactttataccaattatctgagttttacagaaacattttaaggtagatattgttaatatcccaatttgacagaaggaagaaacaggagttctgggcaggtaaggaacatgcccaagcattgctcactaataaatgactgagctgtgtgtaaacatagttctttccacgtccaaagcccatacttgtaaccactgcactgctgtttgtagatttgttcgactcctcagagcagtaagtcagtttcatcttacttgcctggcctctccattgagtattgaacttggcaggaaatagtgttgggagtgatttgtgatgtctgagataggtagatccagtacagaggaatgttgaaattagacttactagtcccatattagattcttctcagactatccacgagagacttctccatggacccaataccaaccaagcttctgtagaacattttttttttttttttttttttttgagacagagtcttgctctgtcaccaggctggagtgcagtggcgcgatctcggctcactgcaacctccgcctcccgggttcaagtgattctcctgcctcagcctcttgagtacctgggactacaggcgcacaccaccacgtccagctaattttttgtatttttactagagacagggtttcaccatgttggctgggatggtctcgatctcctgacctcgtgatccacccacctcagccacccaaagtgctggaattacaggcgtgagccaccgcacctggcctgtagaacacatttttattatgcagtccatgttcatatgtctagcctgtcagtgggttacttgttaataaaaagcagccgtttcatattagtgtctcattgaaagcagtgcctgttttccattcattctaccttggatttgttttcttcctcaatactgaattcttagaaaatgatatgtatgttgaaaaata

SEQ ID NO: 2878 - DNA, 1023 bp, Homo sapiens
ccattaccataagcttaagataaataagacataattaatccattaccataagcttaagtacttcgtgtgtaataaaacatgtgaatcctaggaaataagtgaatcttatgatgacttttcactatcaatatagaaattaactgtcaactaaattttatgtgagaactttttttcttttttaaaaatttattttagtttagttttatactgcaggacatatgtgagaagtttagaggtaagaatttagggttgggctgttgaaaggagcgttctggttttttttttcttttgagacagagtctctctttgttgcccaagttggtctcaaagtcctggccttaagtgatcctcctgcctcggcctcccaaagtgctgggattacaggcatgagccaccatgccctgccactgatttgcttattcagacatttaccagccaaagttgtaattgcaggaaatgcaaaatattcataggtctgtcttgcaggtggccaatttcttattgtcgggaactcaaaggttattccattccttttatgggatctgatgtgtctgttgtaaggaggactcaacgttacttgtatgaaaatttagaggaatcaccagtaagtatatatggtttatttatcaataaagtgtgtgttacagttcctctttctattcagtgtgggatatttttgtttataaggcagaaaaaggaagagctaagtaatacatgtttcagcctctggaaatacacagaatcattagggtagaacattttgtattttataaccttgtcttttgattcagatctggctgctgaatatctttttaatgtaacacaatagcagcaaattcaatacgggaaatcctgctgtcataagcaccccagaatccctgtttagggtttcagttgctagaaactcttttgcttgtggaaatgtctggaaccctttctgtcccctctctccttgccacgcctggagttccatcctgctgcttttggcgaggaaagtaattgctttcattgccgagacttcag

SEQ ID NO: 2879 - DNA, 1079 bp, Homo sapiens
ttataaacatttttttaacttatgtttagtcgttattctttaagaaaaaattgagaggatttttttgttgtttttaagtgaagtgtgtgaatacagatagggatcggctcagtgtacaatagagaaacaaaaaacctaggatcattggcttcaatgattgtcaagaagcagtgcagtgcagtgggtggagtgtggactctggaaccagctgcctgggtgtgattttggctcagtcactacctgttagtttggacaagtcacttaacctctctctctatgggataaaagtaatattgaccttaaataattgttatgaaaattaaatgagtttaatagacctaaagcacttagtacagttcctaacacttaataaatactttcgatatgttatttttgttaagtgaccagagtatctattgaaaaaaatctgcacacctagagtaagatataaaatctaccatttgatttttgatgttgttgaatgggtacttcatgattcctttctttttccctgatcaactgttttctgcagaggctggctatgtggctacccccatagctatggttcaggcagccatgactcttctaagtgatgcttctcatctgcctaaggcgtaagtttggttttcttccaattagaagatcttttttatctatgttatattttagcttattttgatttgattttcaggctttgggtttgcatgtaagcatttatagttcagttcctttgcttcaaaaatataggtaaattaaaactgtgagaaggacagcttcttaccagcccagagttggtctcagaggaacaactgtggaggtaaatgagaggagacagaaaagttggagagccatgagttaacttcagccctttataaagatacctcaagtccagagtcagccactcaaaaaagtccctgttgttaatagtattactaggagcttccaatcagtgcctaactatacccagctggcagtagtaaccctgactgacaccagcataaatggaaccatgggatcctggctagatgattttcagacgtactgtcttactggagcatttagctgtccccctaaaacta

SEQ ID NO: 2880 - DNA, 1034 bp, Homo sapiens
cataatttaaaaccagaagggacacatttgtaaagaaaagggacagatgagccaaagatttacagcgcatgtgtcagataaaagatgacctatgattgattgtcatgtttatcacctccaacatcttactcaacagggatatcatcactagataaataataatttttttaaaaagctcaggctgggcgcaatggctcatgcctgtaatctcagcattttgggaggctgaggcaggcagattgcttgagcccaggaatttgacaccagcctgggcaacatggcaaaacaccatctctgtaaaaaatacaaaaattaggtgggtgttatggtgcatgcctgtagttccagctactcaggaggctgagcccaggaggcaggggttgcagtaaggtgggatcgctccactccactgcactccagcctgggcgacagagcgagactctgtctcaaaaacaaaaaacaaacaaaatggatttcaataaatcccttctactcagataatcaaaaatggttaattttctatgtgaggcggtgatttggttttcgttcttcaaagtctctattgccttatctttatttatttatttatttatttattttgagacagagtctcgctctgtcacccaggctggagtgatctcggctcactgcaacctctccctttggggttcaagcaattctccttccttagcctcctgagtagctgggattacaggcgtatgccactaagcctggctaatttttctacttttagtagagctggggtttcaccatgttgacaggctggtctcaaactcctgacctcaagtgatgtgccagcctcagcctcccaaagtgctgggattacaggcgtgagccaccacacctggcctgccttatctttcaatatccttttagcctaatttgtttaagcatatctggtgcttctgccatatcataatacagtccttttgtttccaactaaaacctaaaaactgttttgcttagataacatggttttactggatattctttctgataattagaatttctgc

SEQ ID NO: 2881 - DNA, 1029 bp, Homo sapiens
taataataaccttaaatgtaaatgggctaaaagccccaattaaaagacttggactggcaaattggataacgagtcaagactcatcagtgtgctgtattcaggagacctatcttatgtgcaaagacacacataggttcaatataaagggatgaaggaatatttaccaagcaaatgtaaagcaaaaaaaaggcagggattgcaatcctagtctctgacaaaacagacttgaaaccaacaaagatcaaaaaagacaaaaaagggcactgcataatggtaaagggaactattcaacaggaagagctaactattctaaatatatatgcacccaatacaggagcacccagatgcataaaacaagttcttacagacctacaaagggaattacactcctgtgtaataatagtatgagattttaacaccccactgtcagtattagatcaatgagacagaaaattagcaaggatatccaggacttgaactcagctctggatcaagtgacctagtagatgtctaaagaactctctaccacaaatcaatagaatatacattcttctcagtgccacatggcacttattctcaaatcaaccacataattggaagtaagacacttcttagcaaatgcaaatgaactgaaatcataatagtctctcggaccacagtgcaatcaaattagaactcaggattaagaaactcactccaaaccacacgatttcatggaaatcaaaaaacctgctcctgaatgactgctaggtaaataataaaattaaagcagaaatcaagaagttctttgaaaccaatgagaacaaagagacaatgtaccagaatctctgggacacagctaaaacaatgttaagaggaaaaatcatagtactaaatgcctacatcagaaagctagaagcaagagcaaactattccaaaagctagcagaagacaagaaagaactaagataagaactgaagaagacagagacacaaaaaaccctccaaaaaaatcaacaaacccaggagctggttatttgaaataattaac

SEQ ID NO: 2882 - DNA, 1090 bp, Homo sapiens
ttgctttcttcccatccctttcagggatgccaataattcatagatttggccactttacaaaataccatattgctcagaagttttgttattttttattctttttaatttttctgactgtcttatttcagagagccagtcttcatgttctgagagtctttcctccacttggtctattctgctgttaatacttgtgactgcattatgaaattcttgtagtgtgtttttctgctctgtcagaaccatcaggctcttttttatatcagttatcttgtctttcagctccagtgattcttagtttttttggattgggttttgcattttcctgaatcttgatgatcttaattcctatccatattctaaattccatttgtcattccagccagctcagcctgagtaagaacccttgttgaaaaactggtgtggtcatctggaggacatacaacactctggccatttgagttactggagttctttcattggttctttctcatgtctgcaggtgggtgttcctgtaactgcagtgtagattgagtacagtcagtacacttttttttctggatgtcttcgcagagccaaggctttgtgcagggtcttcatttgtagctgacttgtctttggtctcacagaggggaatgctagcaaggtgtttttggtgttggaacttcgggatgtgatccagtaggtggtgcttaggcatactggttagttggtaggctcttgcttggtcatgtggctcccctatattttctgacagttgcagtcatgctccctctcaatgttctgaaagtgtgggcttctctcccacttgaatgctggctataaattgtggcttggcactcttgggctgcccaccacagctctggggcactctcagggcttatgttcctcccctggcttggaggcagcagaggaagggaccttaatagtggttgtggccaaaggtcttttgcttgtctcctgggggctccacccaagaggagccggttagcaattgctaagtgcaatcagcccagaacggagggtctgtgctgtgggaccaagcccagggtttcctatctggtgacaagcagggggagtgggtggaacctgt

SEQ ID NO: 2883 - DNA, 1027 bp, Homo sapiens
gaaaggcataatctttattaaattgtccaggtatttatttggcctttgacctgaagatacacatccttcaagtctgtttctttcatttaaaaaaatcctgaaaaagacagcccagaagaaacgcttatacaagatgtgggaaaatgaagtgagagatccatgaagaattgtcttccaaaagggagcaacattcccttacatgtatgagaatattgatacagccattataaaaaaccgtaaggtggctcatcacaatattaaactagaactaccatattatccagcaagcccacttctgggattatatccaaaggaaataaaatcagtatctcagagagacttctgcaatcccaggtttattgcagcattttccacaatagccaaagacacggaaacaacctaaatgctcattaatagatgaatggatacagaaattgtgatacacacacgcaatgaaatattattcagccataaaaaagaataaagtcatttgtgaaaatatgaagctggagaatattaagtaaaataagtcagacacagaaagacaaatgttatatgatcttacttatagatggagcttaaaaacattgaactcgtagaaacagactacatagtggtttccaggggccagaaggtaggggaaatggggagacattgctgaaaaggtacaaactttcagttataagatgaataagttctggcattctaatgtacagcacgggtggcaatagatgttgtctcagtcccttcctgctgctttaacaaaatacctgactaggtagtttatacatgacataaactcaattgcttacagttatataggctgggaagtgcaaaatcaagccattggcagactgtctctggtgaagaccttggtctctgctttcaagatgacatcctgaatgttatgttcacagacagcagaggggcagaaagggcagaactcactccctcaagtccttttatgaagtcattcatctcaatgatgagggcacagcctttatgacctcaccacctcctaaaggcc

SEQ ID NO: 2884 - DNA, 1107 bp, Homo sapiens
ccagactctgttgtgtgtcctgatttcaccttatagcacaggcctcatcctggatcccacaccctgatgtgtgtcctgattctagctcagagcatagacctcatcctggatcccacaccctgttatgtgtcctgattccagctcagagcacaggcctcatcctggatcccagaccctgttgtgtgtcctgattttaccttatagcacagacctcatcctggatcccacaccctgatatgtgtcctgattccagcccagagtacagacctcatcctggatctcacaccctgatatgtgtcctgattccagctcagagcacagacttcttcctgacctcagcatctctctccagcctgctcactaaggtgcagtttaagccatgctgtccctaccctgggtattttccctctgtcagacccacatacagggcaattctatttctgcccccttgctatctgtgttgcttaagtggtgggagatgatgggttaatttttccattcataaactgttgatacacctggcccaaatggatagaacaaaatctggcacttaaatacccagcgcagagttagagatacttagcaggtgcttgctcatcacaatccttcttcctcctctattagctgcatataaacttttaaactttatagtgtatgacatttctcattttagtgtatcttaatctgcccttctgccattgaacactgtaataattaattttcggtgtcaacttgactgggctaagggatgaccagatagctggtaaaagagtaactccaggtgtgtctgtgagggtgtttcccaaagagactggcatttgaatcagactgagtaatgaagatttgccctcactgatgtgggctggcattatccaatctgttgaatgcccagagagagtgaaaaggcagatgaaggaggaattcttttttcttcttgagctagagcacccaccttctcctggtcttagacactggggctccaggttcttgcagcttcatactctgacagtggccccccagtttcttaggccttcagcctcggaccgagagttacaccaatagcttccctgcttctccagcctgcagattgcatatatgaggcttctc

SEQ ID NO: 2885 - DNA, 1025 bp, Homo sapiens
gcatccccaagaaaggcacatgctctgataattcctgctgtattctgttagaagaaggcaggactaggccgggtgtcatggctcccacctgtaatcccagcactttgggaggcatgtggatcacctgaggtcaggagttggaaaccagcctggccaacatggtgaagcaccgtctctactaaaaatacagaaaattagttgggcgtggtgtcagaggtctgtaatcccagcgacttgggaggctgagacaggagaatcctttgaacctgggagacggaggttgcagtgagccgagatcgcaccactgtactccagcctgggcaacaagagggaaactttgtatcaaaaaaaaaagaaaaaaaaaaaagcaggactgctattgacaaagattttctcgaccaaactctactcatgctccctgaactcttctcaagccctgatttttgggcttctgtgtttatctctgcacattgtctaatcctgctaagtcagtttagccagaatcctgcaccgttgatactgatcacccttgatatctgattgagttcctcatcctccatcatgcctctggtgatgtggtatctgatcaccgtgatatctgatcaggttccttgtcctccatcatcccccgggtaaagtctgatcaccatggcctgccttcagcaagagtcctgttaggtccgttcagccagaatccccatgcccatggtgtttcttcttagtaattttctgctgacccccaccctgctccttggctataaatttccacctttacttgtgttcagagttgagcccaatctctcttccccactgtaaaacactgctgtggtggtccctatacttatctccattggccacctgaataaagtctgcctaactgttctttaatcagtagtatcatcattttttcatcaacactgtcacatgttataatgggtctttcaagcaacaaagtgggccaggcatggtggctcatgcctgtaatcccagcactttgggaggctaaggtgggcagatcatttgag

SEQ ID NO: 2886 - DNA, 1020 bp, Homo sapiens
accagcatctgagggactgtcgtggtggtgtagcagaggtccaggaaggacaggtgactgaggaagatgtacatggggctgtggagttgaggatccacccgggatgccaggatgatggcgacgttccccaacatggccagcacataggacagcaggaggaccacaaagagagggagttccagccacggcctgtcagacacacccagaaggatgaaggctttaggggagtcccctaagaagctatggttgtcacttttcatgttgcggcattttctggcacttgtggcaaattgagaaaattggaatgaataatacctgagaagaggaattgatcactttcctccctcttgcatccactcttcctttcccaggtgatagcctgtttgattctccttacctctgtggagacgctgggatgcggaagggtcagaaccaggagccccagtagcagcctctgtgtctttgctctccttcctactcagtggccgcaactaaaccatttaatattcctgaacttctgcatctgtaaaatggggagaaatacctccttcaattgccaagacttggggacgatagagacattaagtatgtgagaagaatacctcacgaatgacaattatgttccaggtagagcgaagcgtgctgcagctcccatcaccgtcagagtgtttgatttctctctacatccacatcgacaaggaattgtccaccttcttaggctttcccattttgggaggtagtggtaggagggaggcaggcggtgacataaagcaagcagaagggctttgtgagcagctgggggctgtattgataggaccaccccccgtcactggctcacgcttgcatccagctcccggattcatgctgatctccgctgtcatgaccacacacgcacaggcagccctgtcactcacactggcagtaaaagcagcacaattctaggtcctgtgagtctctggagtggaagagccaaggtatacgttacttcagcccctgaataggtcatggtagttaatgaga

SEQ ID NO: 2887 - DNA, 1030 bp, Homo sapiens
ggaataatttacctctcgtactcagcttaaagttagttttcgatatacttatcttgagagaagaaaatctagaaactaagcctgggacgaagtatgttccttaggtctattcagaaactgaagacgtgagattcaggtagaaattgggattaattctctgacgtgaactctgaaatcagtggcctgagcatcacttagttctttcttggctttgtagagaatgttaggcttatggttgtgttcactattaccatattatgaaacagcattcatattttctcatctctcagccttttcttattcaaacaaacatttcttcatcattcagttgtttctagtggttctagcgactgatctagtagtaaatagtaacttctgctgtgtgactgctctatgctaatcactgttcttgtagtttaatagatatttagctgtaatccacatactcctctttttccccacattttttaagagatggagtcttgctctgttacccaggctgaagtgcagtggtgcaatcacagcttactgcagcctcgagctcttagacaagtgatcctcccacctcagccttgtgggtagctgggactacagggcttaccaccatgcctggtcggttcattttaatttttttagagatggggtcgcattttgctttgttacccaggctggtcttgaactcctgacctcaagcactcctcttgcctcgacctccccaaaacctcacattttgtatatggtactgaaacttcagtataaaagtgccttgcccccaagcctgtggcaaaatgggaactccagtccaacagtattttttaaacttaatttgaaaactctcctgggctacttcttatatgaatggactccagtctgtgcatgttgttaggatgcaaccagtgagtccacagagttacggagcccggggaagtctggacattaccttctccagcactgtcctgtacatggctgctggaggccaagcactgacgatgtgatccacggtgtcacctcaggagaaagtggaaatgca

SEQ ID NO: 2888 - DNA, 1051 bp, Homo sapiens
ttcctcttcattttcttttaccagtgttttgtacaaatcattctagtgttctcttccatgtctacagttaacagtaaagtattacggtaaaaattatttcaatgcttttgaaatgtcatttctatttctaagcctgtggatatttgttttacaatgtcgtagcagttaaaacatacattttgaacttgttttatgaatcagagtaagtctttgttgtgctttgttgcaatgagcagcgtatatttttatttggtgatgatttactaacaaagtttactgcctaaacttcttgccatttcctgtcctgaactcagtcagatacgtcatattccatgaatacaacagagatgggctctggagcagagggaaaataggcctcccatcagcagtcacttgctactgccagggagagcacctcctctcttccccgttagggacaattgtacccaactgccacctgtgccactgcttctatcattactaccaatctgagcccagtcataccccagccactgcttggggtcctgtggtactgtgaaatattgcaagatatgtgtgtgtgtgtgtgtgtgtgtgtgtgtgtgtgtgtgtgtgtttgtgtgcataagaacgccaggccagttgtctcatgtgggtgttgcctgagcccacttgtgtagtcactgctactgaaccaaaactgcatgcattctgccaacctctccagttcctctgtcacaagcatgcttaaagatgaaatgattgaaacttccaatgataacagcagagcatgaaaccatgcatggagccctttgagtgtgggaccctgtgcataggtccatgaaaccaatcccgagaaggatgggaagagtgaacatgaagtgaatgagatcatgcagcctaggatagtggtgggaatgcgtgatggtctgagtgtttgtatactccccaaatccatatgcttaaatcttaaccctcaatgtgataatattaggagttggggccttttgggaaatgactaggtcatgagggtagcaccctcttgagtaagatttgtgcctttctaaagaag

SEQ ID NO: 2889 - DNA, 1047 bp, Homo sapiens
aggtagtctagacagggtggatctcctggaaaagcaggtagtatagacagggtggatctgctcgacagagggaggtgtcacaccccaggtggggctgagtgggacggcatgagacttcatcaagctactcagaatgaaacatgatttaacacgtgtgtattgtttatttctggaatttttcatttaatgtttttggaccatgactgactgagagtaactgaaaccttagaaggcaaaacagtggataagagtgacttgccgacctgaacagtttgctcttagaaactttgtgtggttggttgtctgatctgtgacttcctttaattcacttctctgagttccttaaaggtaggaatcatgttttattcctctcacagccatatttccttaaaaactagttggtgaaccgtggaaaatctagattgctcaggccgccttctgccaacagaaataacgttgcctttcagcggtggtttgcttttctgaaattttcggtcatcacaccctttagaaggaacaactttagagaataagactggccggtatgcaactcccagaattttctcaggaatgtttcaaaaatctattgttattctggatactggtgaacagatgcgcgaacggctcaggctctgccactggccttctccatgactgtgtttgtagggacaaagcatggtagcaaacaacttcaaaaaacctctgtggcttgaaaacacaaagtttaatcacttgtccatgcttctcttccactgcaggctgggggtagctcctgtatcctcaggcccaggtgagataattttcccatcctgagcactgccaggctcatggcagaggggagggtgcaggaacgttgtgcggcttttaaagtttctgccaataaggggcagagtcacttccattccgttccattggctgggcctgaccacgggacaagtagcagaacctttccatccaggagaaacagagagtgtctggaggaagaatacacactgtccccaactcccagagttaatgctgtgaattcatcaacaggatgatacactt

SEQ ID NO: 2890 - DNA, 1012 bp, Homo sapiens
ggttaacagataagccaatatggatagaataatggctgctaagcaaagagaaactggacgctttagagaaattagttactgaacaattagaaaatgggcacatagctccaacattttccccttggaattctccagttttcataattaagaaaaaatcaggtaaatggagaatgttaactgacttaagagccatcaattcagttatacaacctatggaaatataacagccaggattgccttctcctactataattccaaaaaattggcctttaatagtcacagatttaaaagactgtttctttactacccttttagctgagcaagactgtgaacgatttgcatttacaattcctgcagtaaacaacctgcagcctgctaagcgttttcattgtttcacagatgggtccagtaatggtaaagcttcttattctggatcaaaaggtaaagttttccagacgccctatatttcagctcaaaaagtggagcttgtagctgtaattgaggtattgactgcttttgatatgcctattaatgtgatttctgattcttcatacatggttcattccacacagttaattgaaaatgctcagttacgatttcatacagatgaacaactgataataaaaacaaaaaaggggggaaacagggattacgggacagcccagacacaattgaatcttgcattattaactttccatttttcgagccttcccaaaggccagatgttaccagcagctgaacagcatctacagaaaccagctgcaaagacacaagcagaacaactggtttggtggacagatccaataacaaaaagttgggaaataggtaaaataataacttggcgtagaggttatgcttgtgtttctccaggaccgaatcaacaactgatttagataccatcaagacacctgaaactttatcatgagccagatgccgagaaagagattaaaagcacaatcatcattgaaattacagagcttctggctgggcgcgtggctcacgcctgtaatcc

SEQ ID NO: 2891 - DNA, 1050 bp, Homo sapiens
ggccctccgccccaggcctcccatcctccactctgagtgcagcaggaacctcgtgagatgagcatgtggagggagctccccgggatgctgggctgggcacagggtctgcaggggccgacggcccctaggctgaccttccagagctccctctccagccacccgggctcggcctgctgggaacagagctgccccaaccttgtgcccgctgggcctctgtgcagggttcccaggactgccttctggacaccttccctgctggggttctgacagcggggtggacagccttgcccagcctcagggccgtgcagcgccaggggtaaatgtggctctccttgcaccgctgcgcctagggctgccctaaggaaacacagtcggtctccaaggctggggctgcctccatggatgcagacggctcactgggggacttgaacatctgtggattttggtatctgtggggatcctggaatcagtgccccacagatactgagagatgactgtaccacagactgggtaggttaaacagaaattaattttctcacagttctaggggctggaagtccagggtcaaggtgtgagctgggcctttcctggcgagggctcttacctggcttgcagatggccgcctgttctgtccccacacgtcggagacagggagtgggtgctctggtgcctcttttataaggacacgaattctatcagatcagggccccacccttagggcctcatttgacgttaattactttcttagagggcccgttgaacacttgttcaatgaaccagttgacgaaaaagatcacagtcacacaagctaaaccgcagcacacaccacgcagtggtggggaggtggtgcgaagtcagagtgtgtgtccccccgccccaaattcctgtgctgaggccctaacccccaggacctcagaatatggttgtttggagatggggtctttaacgaggcgattaaggtgaaatggggtcatggggcgggccctgatacaatgtataagaagaggagatgaggatttagggagaagacggtgtccacaagccaaggag

SEQ ID NO: 2892 - DNA, 1047 bp, Homo sapiens
gagaggaccagcgtcaggctcactgcgaggtgctgcacagaaaacccacagccagagcccctgggcccagcccaggcaagaccagaaaaggagggggcaggtgggagaccagcctggggctcccgggaagcccacgggatggaggcgggagagccaggaggcctggggcaaccctgggacggttcctggatcgaggagagcaggggggtgatgagggttccctcagggctggggagccttctcctggtctcagacccaccccccttcagctcccaagccctgggtgcccctggctctgaggacagttgggaatcttccctgaggcaggttcaaggacagagctctgaccctggcccagggctgctttgggtgcctatgaactcggcttctggctcagagcagttccctgcaccccttcctgagccctctgtcctctggaacccgtgggcagggtgagggacgggtgttccttctgggtgggggcctgggcgcccagccagcacgacgctggcttgctgagcttagggcagaccccgacttcagaatttatacaaataaatgcaatgaaaagtgctggcaacctgatctgattacagagtcattcattctctggtcgttaataatttgtgcaataaaggactgcagccgctcagtgcgggggaggctgtggcccaaccttccctcggcgccggccccgggagctggaagcataaattattagtttcttatcgctgggcctgccatcgctcatgctgccagggcctggcgggagctggtggctgttctgctgcccgccctggccggctcagggccggctctcagccgtcgcctggggccctttgtcacccccaccctggccccccaggtgtgggagccccagagcctgctcaggcctggaggctgctgctggagccggcaactctggaagccagaaaggtggggctttagtgcctgtcctcagaccctcaggtaaccaaagccaaattactccctgttggaaacacaacctcacataccgggccacagcacggacacccacgacagcag

SEQ ID NO: 2893 - DNA, 1044 bp, Homo sapiens
ccctagcaggtcgggcttgtgctggctgcacattggctggtgagcttggcgggtctgtgggcacggagagaccagaacgtgcgtaacaggcccgatgagggtgccaggctgtggcgacccccgagcttcagaggagaggggcaccagccgggggccctgcacaggcagcctcaggtgcgaggagctggagcccaggccagctggggaggggtggggtgccgtggctggaagttgctgttctcagacctggttctgagaccctctccaactgcatgggggggtccaggctggaccccagatgtgacggtgtatgtgctgggatgggagccccctgagagcagggcttttgttaattcaccggcaatcccacatgtctggcacgagataggtgctcagtcagtgaaaaccacacacggggtcctccattgtgtccaggggagggtgggccctgctcacagccagactcctagccctgggcagccctgctgcctgcctgctccttccactcctaccacctgcccaggtgggactctgcctgccttcctgtccccagtgctctgtaggagtttgaccacaggtatcctcttcatcagagagaggaaagctcacgatctgggagaactccaggcctggcccagtgaagacgtccttatcttcagcagacattgcccagtgcaaggggaggtcagtctcaggagacagtctcctggacagtggcgtggcatctgtcctaaggccttgcctgcagcacagggtgccacagaggtcccctgtgacagagcctcatggctggggcaggcgggggtcgcacctgctcctgcatgaagaggcagataaagacccacagcatggtctctggggtcccacatcccaggtagagaatgacccaggtcgctggcgtctgtgccatctctgctccactgaccactcatgggggtcctggagatcctgacaccggtggccggggagcagcagcccaggcacaggccccagtgcacatgcagatcccaccgtgtctgcacaaggccttgccccaacgaggcc

SEQ ID NO: 2894 - DNA, 1492 bp, Homo sapiens
ccctgtgggcatctcccagagcaggtccaggggtgagtgggccacaggcctgtttgcacaggtgccttcttcgagggagggaacagcccaccaccacctcctgccagaccagcttccttgagcataaacctgaccctgggtgaccacgctgggctccttcaccttatctcaccagaggcttctgctggtcccacagccaacccgcggagtgaggtctgggccaggagtgctctgctcaggcaaggaacatgcccagaagcctcccccgctatcctggccctgttctgtgggggctcgttggtctgttggggtctggggggccaggtaggagtgtgggtgtgagtgtcggtgacccttccttatgtggccacccttggccctatcaacctgtctgcatccaggacaccagcacatccctgaccccagctgtggctgccagtgagttcctgtgccttcctctcctgaagtctgtgtcttctcccaggtctgataccatgtggaaagtctgctcctggggccagctggaggccatgtggactggccctgagtgcccactgtctggatgcagccctgaccctactgcccgtgtgtgggctactaggttcacctgcacctgaccctccttctaggttcgcctgcacctgactccctgatgttcacacagtgatttggagagggaggctggggaggcgcaggtctgcatggcagtgcctctcagggtctgaggcccttgggccaggcctctcctctgacctgggccagcagaggggcctcctttcccttccaagagccctcccctgttcaccagcatctcatcatgctcaggcccacagtgtggttaaggaggggcatggggctggccctgggtttctggctgggtgtgggggcctacccggggcccatggtgtcttccagaaaagaccctgactgggtccaaagctggaggcacccctctatcctcactgtccactccctgatgttctggaggtccctccaggggctgggtgaggaggccttccccaccacctccttgtcttcctgggaagcaggcacccgttcagaggccacgttcccacaggaccaggctcctcacccccagcatcacccttttccacggggttgtgccccttccttggtcctgtccactcacacacacccgtgtccgtgtccatgttcacacctgttctgtgtccactcccacacacctgtgtccactcccacacctgtgtctcgtgtccactcgctcacacctgtactgtccgtgcccactcacacgtgtcccgtgtccactcgctcacacccgtgtctcatgcccgctggcttacaccagtcccgtgttcactggcgcacctgtgtcccatgtcttgtgtctgctcgcacatctgtgtgatgtgttcacttgctcacacgtgtcctccactaccacacctgtgtcccatgtccactcacacacctgtcttggtctgggacacctgggccccactctcccctg

SEQ ID NO: 2895 - DNA, 1034 bp, Homo sapiens
tatggggctctgtgcctccccccaacctctgccctatgtctgagggtgagggtgagggtgcctttctctggggctgccgtttccactctgccaagtgcagtctcagctcccctgacgcccctggtactcttgctccttcagcaacgcctcactccaaagctgttccatgaagtggtacaggcgttccgagcagctgtggccaccacccgaggggaccaggaaagtgctgaggccaacaaattccaggtcacggacagtgctggtgagcttggggggagcctggcatccaggctgtctgttgcgttctctgtcccgtgagtacatccaggccttttcgttgcagcattcaatgctctggttaccttctgcatcagagacctcattggctgtctccagaagctgctgtttggaaaggtggcaaaggatagcagcaggtaagaggggagggggtgaaggggggtagggtggaaggtgggtcgggaccacacacaggagaagccagaggccttgtggctaggacagagacatggcaacagagccagcgtcttcttggggaccctgagaaggcagcggggcacgagggaccgttgggagaggctgggcacttggggccagttggagcggccccaccttctttccttcctgaaaagggaagttgtctgctcagagtctcagaaggtgtggcgtgtgcagctgcctttgctctcagattttcccaggttagggttcttgctctatttccctttgtaagaacttgtaagtcctgtccatactccttgatctctgcactatgactggcctgtttcctggagctgtgtgtgtctgtagacaggggcctcatcaatgctgagaacctgagggcctcaacttcccctttagagaaagattgggcagagaaggccgtggaaggttttcagagaagagagacgcacggccaagcatttggtagagcatggagcacgttggggttccggggctgtgcagccatgtgaccttgaggcagtggaggcctagagttggaactgccccaggac

SEQ ID NO: 2896 - DNA, 1030 bp, Homo sapiens
tccgagggccgatttggcctcccggtgggtgtctgtatccaagggggcttttcttgctcctctcagcggggctggggcgagctgggcgtgcgggcagctgtgactcctgcgtgacccgcaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccaggttagtggggacatgcgtgagcagaacctcttgctcgtcctgtcccaccccggttgggttgctgacctcgcctggggtctcagggccaaggcctaaggatcgccgacctctgccccccagtcctttcagcttaacttactctttcatccgatgtttactgagctcctgttccgtgccaaactctgtcctaggcagggagcgtatgttggtgagttgtgcaaaaatctcttcccgatctaggagaactctcacgttcttgggtgaaatcaccgcctgcagttcggtagaagagagataagtgctggggagggaaaggaaggacagaggggctgaagagagagttgcaggggagccgagttgctctgttagaaggagcggaggctgtgctcggtggctcacgcctgtaatgccagcactttgggaggccgaggcgggcagattacctgaggtcaggaattcgagaccagcctgaccaacacggaaaaatcatgtctctactaaaaatataaaaattagccgggcgtggtgggcacctgtaatcccaactactcgggaggctgaggcaggagaatcgcttgaacttgggaggcggaggttgcagtgagccgagatggcaccattgcattccagcctgggtgagagagtgagactccatctcaaaaagaaaaagaaagaaatcaaaagatacaaaaattagcctggcgtggtgacacacacctgtcgtcccagctactcgggaggctgaggcaggagaat

SEQ ID NO: 2897 - DNA, 1806 bp, Homo sapiens
ggttcacacaccccgcggcggcgaggccttaaatagggaaacggcctgaggcgcgcgcgggcctggagccgggatccgccctaggggctcggatcgccgcgcgctcgccgctcgcccgccagcccgcccgtggtccgtggcggcgcgctccacccggcacggggaggcgcggggcgcaccatggccgcagacacgccggggaaaccgagcgcctcgccgatggcaggagcgccggccagcgccagccggaccccagacaagccccggagcgcggccgagcaccgcaaggtggggtcccggccgggcgtgaggggggcgaccggggggcgggagggacgcgggactcagccggtgcccgacccgcagtcctccaagccggtcatggagaagcggcgccgagcgcgtattaacgagagcctcgctcagctcaaaaccctcatcctggacgccctcagaaaagaggtaagtcgggggcgaaggcccgagacccggagtctgggtcgcagctgacctggacctcccgcctatccccgcccccagagctcccgccactcgaagctggagaaggcggacatcctggagatgaccgtgagacacctgcggagcctgcgtcgcgtgcaggtgacgggtgaggcgcgggcggcggcggcttggaggcggggggagggcgcgggacccccgggacccggcaccgacctctcctcctgtgtcgctcccgcagccgcgctcagcgccgaccccgccgttctgggcaagtaccgcgccggcttccacgagtgtctggcggaggtgaaccgcttcctggccggctgcgagggcgtcccggccgacgtgcgctcccgcctgctgggccacctggcagcctgcctgcgccagctgggaccctcccgccgcccggcctcgctgtccccggctgcccccgcagaggccccagcgcccgaggtctacgcgggccgcccgctgctgccatcgctcggcggccccttccctctgctcgcgccgccgctgctgccgggtctgacccgggcgctgcccgccgcccccagggcggggccgcagggcccgggtgggccctggaggccgtggctgcgctgaggctgtggccctgagactgcatcggaggcggcgccccgttctagggccgtggcctttgccgagactgtagcagagaaaacgtatttattattccagagtctgcgtcacgagttttctttctttgtcttggtgaagagttgactttgggagcgccccgcagccacgccgcgccggggtcccgccctcctcccagggccgcggtctgcaggtggctgggggcgtcgggcgggcccgggggggcgggctgggggcgggaccgaggactgagggcgacccctccgctccgcgccctccgctccgcgccctcccctccgcatccctgcagccccgcatgcgcacccgccctctgcccccgcgttgggtttgcctcgctctgcggtggcggttgtgaggggtccccccggaggctcaggtgggaagctcaacgtccctgagtgcccagaatcttcccggtgctggaaggcggtcgcgcagcatcgccgggcaagttacttttcggaggcccctttcccgactcccagtccccggaccgcggaaggcggaggctgcggtcctgagcggcgctgggatgagggcggccgcccttggccctgaagacccccgctgggttctcctgttaagtgcagagctgcccgtgcccaccgcagacccctcctccaggcgtctgtgcggggggcgcccggcgggagcgcgcgggtccgagctgggctg

SEQ ID NO: 2898 - DNA, 1248 bp, Homo sapiens
gaaatcaaccacaaataaaataggaaaaactcaaatgtttggaaattaacccactattgaataaaccatgggtcaaagaagaactcaaatgggaaattagaaaatatttccaggctggggccaggcgcagtggctcacacatgtaatccctgcactttgggaggtcgaggtgggtggatcagaaggacaggagttcaagactatcctggccagcatggtgaaaccccatctctactaaaagtttaaaaaattagctgggcgtggtggtgcacacctgtaatcccagctactcgggcggctggggcagagaattgcttaaaaaccctagaggtggagctggcagtgagccaagatcgcaccactgcactccagcctgggtgacagagcgagactgtttcaaaaaaaaaaaatttgtaactcaggtggggaaaaaataacagaagaagaaaaaatatttccaactgaataataatgaaaatataacatcaaaattgttggtgtagctaaagcaatacttagaactctgtaactaagtgcgtgtaaaggcatgaaagcagagacctaagattcactcccagaagccagggaaaaaagaacaaagccaaaaaagggaaataaagacaaatacagaaatcagtggcatagaaagcatgagaaaaatggagaaacttaacaatatcaaaagctgattttttccctaaaagattggaaagattgacaaacctctactaagaatggtcaattttaagaaagaagaaagagccaggtgaggtgggtggttcacgcctgtaatcccagcactttgggaggcataggtgggaggactgcttgaacccaggagtttaagaccagcctgggaatcagaaggagaccccatctctacaaaaaaaaaaaaaaaaaaatttaatgagctgggtgtggtggctcgagcctgtagtcctggctagtcagaaggctgaggtgggaggatcgcttgagcccaggaggttgaggctgcagtgaactgtgatcacaccactgcactccagcccaggcgacagagagagacctgtttgaaaagcaaacaaacaaatagaaagataggccaagcacggtggctcacacttgtaatcccagcactttgggatgccaaggtgggcggatcacttgaggtcagaagtgagaccaggctggccaacatggtgaaaccctgtctctactaaaaatacaaaaattagccaggcatggtggtgggtgcctgtaatccca

SEQ ID NO: 2899 - DNA, 1044 bp, Homo sapiens
caaataataaacggtaaaaacggtagacctgaaatccaacgatagtgtcattatacacttgccaaagctcagcaccaagaacgtgcagcaccaagagtgcgccctcgtgtcaaccatggactttgagtggtggtgatgtgtcactgtcggtgtgtcagctgcaacaagtgggatgctgagggtaaggctgtgcctgggtgggcacagcggggaggcacaactccttgtacttaactgctcaattttgctatgaacctaaaatcactgaaaaataaagggcagcgtgtgtatacaaagggacaatcagaaaacgattaacatacctacatctacccataacagtaattatattaaatattaacatacctacatctacccataatgataattatattaaatattaatgaattaaaccctccagttaaaaggcagagattgctaaaatggacaaattagcaagatttactacatgctgtctacaaaagatgcactgtggtgtgtgtgtctgtctgtccgtctatgtatttgttttttaagagatggggtcttgcctttttgcccaaggtaaagtctagtactgctcaaactcctgggctcaagtgatcctcctgcctcagtctccagaatagctgggattaggggcatgtgccatcacactgaactaaaagatgcactttaaatataaaaaacacaagtaggcagaaagtgactgcaaaaaccatacatatatagacaacccacaatcatagttggagattttaacctctctctctccaattcttagaacaatagaccaaaaacatcaatagacaacccagaatcatagtaggagattttaacctctctctccgattcttagaacaatagaccaaaaacagcaatagacaatccacaatcatagtcggagattttaacctctctctctctccaattcttagaacaatagaccaaaaacatcagcagacaatccacaatcatagtcagagattttaacctctctctctccaattcttagaacaatagaccaaaaacatcaatagacaa

SEQ ID NO: 2900 - DNA, 1035 bp, Homo sapiens
caatagaccgtgagccgacagactgtgagctgattgatagaccatgagccgacggaccctgagccaatagactgagctgattgatagatgtgagccaatggaccctgagccgatagaccatgagctgacagaccctgagctgatagaccatgagctgatagactgagtctgtgagatttaaaaaaaaatttttttttatacagtcttgctctgttaccaaggctggagtgcagtggtacagtctcagcttactgcaacctctgcctcctgggttcaagcgattcttgtgtctcagcctcccaagtagctgggactacaagcgtgtgctaccatgctgagctaatttttgtatttttagtagagatggggttttgctatgttggccagggtggcatcaaactcctggcctcaagtgacccacccacttggcctcccaaagtgctgggattacaggcgtgagctgccacgcccgaccaagtttgtgagtaattatggagaccagaagaaagtggaactgctgaaagaaaaaaaaagcatagaattctgtattctctaagaataaacattacatgaaaatattttcagaaaaaggaaaactgataaaatttgtcaccatcaaattgtgctaccggaaatgctgaagatagtatatactacagtgaaactcagatctttaagaatgaatgatgaacatcaaaattagtaaatatctggggaaaaattaaaacatctcttgggtttataatgtatgcagatatgacagccacaacgtgaagagtagtagaggggatccgtggactgtacagttgcaaggtgtctacatgtctacattttgcataaagtggtataatgctagttctaagtagactagaaaaagcaaggttgaaattgcaattcctagagcaacaactatgagaataatggaaagaagcacaactaaagggccaaaagataacttggaaaggaatttttaaaacttcaaatcacgcaaaagagggccagaaagagaatagaggaacaaaaaacacagggaca

SEQ ID NO: 2901 - DNA, 1007 bp, Homo sapiens
atttatttatttgtttgtttttgagacagagtctcgctctgtagcccaggctggagtgcagtggtgctatctcggctcaccgcaagctccaccttcccaggttcatgctattctcctgcctcagcctcccgagtagctgggactacaggcgcccgcccagctaatttttttgtgttttaagtagagacagggtttcaccatgttagccaggatggtctcactctcctgacctcgtgatccacccacctcggcctcccaaagtgctaggattacaggtgtgagccaccatgcgtggtccacacttattatttttactttagttaatagtctaatatttaagggtatattgttttttaaatccaatgcctttactttttatttatttttttttgagatggggtcttactctgtcatccaggctagggtgtggtggcgcgatctcggctcactgcagcctcaacctcctggactcaagcgatcctcccacctccctcccaagtagctgggatcacaggcatgtgccatcacgcctggctgatttctgtaaggggtttcggtgtattgcccaggccggtcttaaaactcctgccctcaagcgatcctccagcctcagccttccaaagtgctgggattacaggtgtgagccactgctcctggcctttacttcttaaattgaaaatttctataaacttttacggtagttggccagacatactgaacatatttgttgagtgttgcagttgaaaaccatcagactccagtttattctggagccagagggcctggcctgggcctaaccctgccgcctactcacagtgtggtcttatgcaagtcttttcctcatatttaaagtggggcgataaggggcattgttgaaattagtgaaatcagtttgtgtgtataaatcccttcgcgtggtgtctggcatgtggcaagtgctctggaagtgttgattgctgctgttgttggacagtgaacaggtttacatcccttggagacccaggatc

SEQ ID NO: 2902 - DNA, 1658 bp, Homo sapiens
attcctccctgccccccagcccctggcaaccaccgttgtcttttctgtctctatgaattcgacaaccctgggaacctcatgagtagaatcatacagtatttgtcctgttgtgatgagctgctttcacttagcatagtgttttcaaggttcattcctgttgtagcatgcgtccaaaatttcttttcaggactgtagaatattccacggtctgtatagaccaccttttgtttatccattcatctgtgggtggacacttgctcccaccttttggctgtggtgaacaatgctgctgcagacatggtggctgtggtgaacggtgccgagacatggtggctgtggtgaacggtgctgccgagacatggtggctgtggtggacggtgctgctgagacatggtggccgtggtggatggtgctgagacatggtggctgtggtgaacggtgctgccgagacatggtggctgtggtggacggtgctgccgagacatggtggctgtggtggacggtgctgctgagacatggtggccgtggtggatggtgccgagacatggtggctgtggtgaacaatgctgctgcagacatggtggctgtggtgaacggtgccgagacatggtggctgtggtgaacggtgctgccgagacatggtggctgtggtggacggtgctgctgagacatggtggccgtggtggatggtgctgagacatggtggctgtggtgaacggtgctgccgagacatggtggctgtggtggacggtgctgctgagacatggtggctgtggtgaacggtgccgagacatggtggctgtggtggacggtgccgagacatggtggctgtggtgaatggtgccgagacatggtggctgtggtggacggtgctgccgagacatggtggctgtggtggacggtgctgctgagacatggtggctgtggtgaacggtgtcgagacatggtggctgtggtggacggtgctgctgagacatggtggctgtggtgaacggtgccgagacatggtggctgtggtgaacagtgccaagacatggtggctgtggtggacggtgctgctgagacatggtggctgtggtgaacggtgccgagacatggtggctgtggtggacggtgctgctgagacatggtggctgtggtgaacggtgctgctgagacatggtggctgtggtgaacggtgctgctgagacatggtggctgtggtgaacggtgctgagacatggtggctgtggtggacggtgctgctgagacatggtggctgtggtgaacagtgctgagacatggggctgtggtgaatggtgctgccgagacatggtggctgtggtgaatggtgctgctaatgtgtctagaattggtggattcttggtctcactgacttcaagaatgaagccgcagaccctcgcagtgagtgttacagttcttaaagatggtgtgtccggagtttgttccttctgatgttcagatgtgtttggagtttcttccttctggtgggttcgtggtctcactggcttcaggagtgaagctgcagacctttgcagtgagtgttacagctcataaaggcagtgcagacccaaagagtgagcagcagcaagatttattgcaaagagcgaaagaacaaagcttccatagtgtggaaggggacccgagtgggttgctgc

SEQ ID NO: 2903 - DNA, 1099 bp, Homo sapiens
ccagcaggtgcaggtgggcggggcggcctgtgccacatggctggaatttaccaccttcctctgaagcgttttcactggtatcatgtgtaggcttgtttttctcccactgctgagtgagtcatcttgtttttatgtagaatcctgtgattcctggcgacagccagtgggcccggcccaggttagggatccttcagaactggggtccaggcctgtgtagcccctgtgccccgttacccctgctggccccgggcaggccttccggggcccccggcttctccctgccctgtgttttcatttgtgccgcctcccttcgggaaccttccagaacgtgcccacactcccgctgcagccaataggcaccttaaatagccacttcgtgcggctggccgcggagctcggagggggaaaggcgacgctgacctgtgccccgctcgcccgcagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttc

SEQ ID NO: 2904 - DNA, 1032 bp, Homo sapiens
tcacgtgcagggggctgagtgtgggcctcaacactggacttggccactgactgcagtgagccccaagatggggcaggaggtggtgtttctgtcctggagacccagggtggcttgggtccttgggatgtgtggggacctcggggtgagggcccgttggggccgggtgggcacggcaggagagcgggggccacacacccagaggcagtgccgtgtcccggctgggagggttcctgggaagctctgctcagccccagtctcagtcatttctagaaactgtgttttcctccctgtgacgtcacacgtgaaggaaacggaaaagggcagtgagtccttcgccccgcggcgccgtgcgcacgtcagccttcagggtgattccgctcctccagaggggcaggcgcgggtgtggggggtggggcccaggcccatcctgaggggtcccaggcatgaggggctctgagctgtgtcctggggtggtctgggccatggggaggttctggatcatgtcttgagaggtctgggctgtgtggggggtccaggccatgtcctgggggtctgggctgtgtctgtggggagtcagggccatccatgtattgggggtctggggcaggggggggtccaggctgtcttggggagtccgggctgtgtggaggggtccaagctatgcctttggggatcaggcctgtgggaggctctgggttatgtcttggcgggggtccaggctgtgtcttaggggctgggccatgttctggggacgtgtgaatcctggagggtggggccccggtctcgcgggtggctgtgtccctcgagttcaggcagcacctctcggaactttctggatttgcgtgctggcgtctgtcggcctcgatacccacaggctgcgcccctctcagcacaggaagtcctggagaacctgaaggaccgctggtaccaggcggacagcccccctgcagacctgctgctgacggaggaggagttcctgtcgttcctccaccccgagcacagccggggaatgctcaggttcatggtgaagga

SEQ ID NO: 2905 - DNA, 1093 bp, Homo sapiens
tgacggggacggtactgtggctgggccggggtgggtggggcggtgggcggggcgggcagggccatgggccttgcctggtgcctggagggcagacaggccctgtctgagggacgggcggtggggaagtgtcagccggagaccccgaggtgtggtggggtgcacggaagctgggttcatgatgccagaatcctggtgacagaggtgtgtgtgccaagcactgggcgtggcccatggagggcgcctcttatgtcttcggggccttcatctggtggtgtctatgcctcttggtggccccgaggcacagacgttgccggctggcctcacaggtgaggaaacgggtgtggggtgctggccggggccctggggctccagacgctggcatcctgccgcttccagcctgggcagcagagcaagaccccatctcagttgagaaggaagttcagctcagtatcagaggccctgacaggtgtgatctgctcttccaggtcacgtgtcttgggacgagtataaggtgaagtttttggcgagtaaaggccatagcgagaaggaggttgccgacgccatcaggctcaacgaggaactcaaagtggatgaggaaagtgagtgctcagccaggctcccgccaccggtctcaggcatcctgtgtgtgcgcgcgtgtgttgtgtgtacatgagtgtgccgtgtgtgtcgtgtatgagtgtgccgtgcgtgtgctcgtgagtacgtgtgtgcgtgccgtgtgtacgagtgtgctgtgcgcgtgctcgtgagtacgtgtgtgcatgttgtgtgtacgtgtgctgtgtgtgtgctcgtgagtacatgtgtatgcgtgtcgtgtgtacgagtgcactgtgcatgtgcttgtacgtgtgtgcgtgtcgtgtgtacgagtgcgctgtgcgtgtgcttgtgagtacatccaggtagctgttcatgtaggctcgtgagtacatgcaggtgagtgcgccctcacacccgctgtgtgcacacgtgttcgtcttaacagcatggcccaacctggttggtggtggctgtcaggagggaagtgggtgaagccgttgctgacctaggcgccgcccaggagtccggt

SEQ ID NO: 2906 - DNA, 2143 bp, Homo sapiens
tgcctttcttctcagtaggcggggctgggtggagttcccaccttgtcccaggcactgtcgtggagactgctttgctctgtggcctcgtgttccccgctgcctctcggtcttgcttttatccacatccagcctcatccacacccgccaggggctcctccttgggatcttggggtgggccaaggcggtaccagttgcacagacggcccgggccttgtcagcggggagcccggtgctttggtggcttgtttttccctgtctttaataggaatcaagtgtgatatcatgaattgatggggggaagattaagaaggctttgtaagactataagttagtttgctgtgaagagtgtgcttattaaatgctttctgcaacacgaagactgcagcccttgactttgaaatcatctgtttttagaatcttgaaagaattgaaattagttttctggctgattcccttcccttccttcctagaaaagacaactggcagtgcagagtttagcatttaatttgaaagataaagtcttttgtgaattatttcctgaagtcgtggaggtaagaaagacggaagtgggtttcgccttcccctgcgttaaaacacttgagtttcacctctttccaaagagtaaaatctgtgtcctgaagctgcagacctccccaggggatggctcctctcccccaggagccccgaggcaggggaggcagaaagcctgggctctggggggtggcctgcggacagctgtgctggtgggccgggggctgggcctgtcccacaggggcgtggagctcgtggttctgagcagccagctgggtggtgtctggggatagctgggaggcacagcggctgccatgtgggactgggactggagtgctccctggtcttggcctctgtggctcagccttgctctggtctgcctgagtgcaggggccaaggggcacagggccagtgaggccggccacgctcgggccctcacctgtgagatggggtcggaatttgacacagcctagggcttggttcttggtggtggaccgtggactcctgagaacgggagtgctggtcctgaaaggcgctggttggagaccagctgcttttctcgctgtttttctcttaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcattttattagatgtggtcacttagaaatgcaaacttgctgccgaccgcgggctgctcctgcgttcttggagctcctggcgcgtttctcggagctcccggctcctcagcgggtgggaacctcggggcccaggggtggagctggcgtccgcgggtgctggtctggcctggccgtgtggtgatgaggcttagcggggccagtgacggccgtggctcaggatccataagtcggggtttggtctcagcatttacaaatgtgtttacagtcagaatgaaacacattccttctagaaagtgcttgggggtttttgctgccctggaagccaggagcctgctcactccaaccacaagtcgcccttgactgcggcggccgcgagcggggcgggggctgccggtgccctccgcaggccgggcctcctgggcgcccctcggtgctgcaggctggggggccttgggt

SEQ ID NO: 2907 - DNA, 1030 bp, Homo sapiens
agctgtcccttcccatcccatgtggcctggggagcaggtggccgcccctcccctctgcttccctggcctgccagatggcgggacacacagggccctcagtgactcccaggcctcctgaatggggctctgtccgcccagctggccacatgaatggggcactcaggatgcggagggtgggggcgcagcttccttcctgatcgcagcctgctggtccctgcagggctggggtggggccggcactctcgggcccccagctgtgaacgtgaggggtctgccccacgggttgcagggctgggggccttgctcaggtcaagaagtggctgtggtgaacagagggtctctcgtctgagcgtgtggtccgtgggccgtgtggcagcctcagacaaggacctcacccccacctgtgctccgggaaagcacggagggtagcagggcccctggggtgggcactgagggggcgggttccatccccccaggacttctcctacgatgagtccaaagtggagtttgacgtggacgcgcccagtggggtggtgatggagggctacctcttcaagagggccagcaacgctttcaagacatggaaccggtgagaggccttcctcaggtgggggcggggtccttaggcgggggtggggtcctcaggcgggggtggggtcctcaggtgggggcaggggtcacagcagccctgggatgggccccgcctgactccccacatccccccacccacctaggcgctggttctccattcagaacagccagctggtctaccagaagaagctcaaggtgtgccctgggcctggggctggggccctgatggctggacgccccacctgggccacagggcagactggtcagttggggttagcacagggccggggcactagtggacgccggagccggaacagtcagggagcagagagctggacacggggcttggggctcaggcagtcggcctccgggtctccaaggtgaagcaggaagtgggtggtcggggccgggtggtggctgagggcaggggccacagcgg

SEQ ID NO: 2908 - DNA, 1035 bp, Homo sapiens
tgtgtatgtgtgggtgtgcacgcgcgcgctgggtctcttgggatctgctggcaagtcagcatgtgtgtggaggcacggggagcctctgtatccctggagccctcaccaggaggctcaggagccttggagtgggaggctcagggccagccaggagagtggccgccagccctgggcagaggaactggggccatcctctgctctcccatcttctgttgctgacctgggaaaaggggttgaataacttgagcaccctaggatcctgcattgaggacccgggctgtggggaggtgtgggcatggcctccctgctgggggctggaccctggctgaagcacccaccttctccctggcccctccgtcagaagcctaatggacctcctcctccacgcagacggccctgtactgccctcttccagtcgtgtgggggtgctggaacccactcacctctgggccttctctctggtaaccggctctcatgggagcctgttacaggagccagttatgggggctgtggggctgcagtaggtgccgtagagtgactgccctgggaaagtgcctcacccctgtggggcatggactggagtggggagatgagaatggcctggcccagtgggttttggggttaggctgtgatttaactggggttcgaggggctccctgaggctgtcctgggggcaggccctaagggcgtaacttgagtttcctggcctaccgccaggttggggggccaggcagggtgggcgggaagatgtggtctgtaacgtggagcctggtcgccccagcccgggagagggggaccctgcccgcaccctcctggtctggggagggcctagtggcagcccaggtgcagtgggccggaggccaggggagcccgtgtaggggaaccgcctggcctctgttcagtgtgcccctcccctgggtggggcttcaggcgctgagtcatggctttggttggggggcagcctcaccctcctccccgtcctccaagctgctgaggaaatcctgggctgagcacagcagaggaggcctaggtccc

SEQ ID NO: 2909 - DNA, 1040 bp, Homo sapiens
gcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctc

SEQ ID NO: 2910 - DNA, 1928 bp, Homo sapiens
gctagtgcagacttggtctgtttctccactgacattgcatcccatgggagaggggcagagaaggttctggggccgattttagcaatgcatgtgctagaaaggaaccctaaagtgcaatgtagtatttgggggattctggggattctggtgaattttttcccatggagttaagtctgtaagggtcatatttttgctgactgaattgtctggtgctatgacatgtttaatagagaacctattttgacttttcttttctgtactctttcaatcaaagggtagcctctgagggtaagtgactaagacttctcctctgctgtccaagcgctttggtgcagggacagcggcatcttcagccaatccagtgcaggctctccaccgaaggctggctctagactggtggtacgcacatagcatagccatggccgactcctgctgtggttctctgacgattgtgcttcttgttaatcctctgtcgtgctttggtaatcgtattgattagagttggtaactgtcttgacttgaattttgtccctttaaaactgctgtacctgtatgataaagatgcagtacctttctcttaaaaaaaaatgctatggaaagctgtgagaattgaagagacaaattggctgtgtcagtgtggggttatgtcatgatttctagaagccctgaagttgctcttttgagcagctttgcatgacacgctctggtaaaaggtgtgcatctttaaattatttcatggatactttgaaaaatattgtatcacttcaaatacagcaataagtttatatgttctcaagatttcatttgtttttaagaattttaagttcgtggattaatatcactacttgaatactgacagttgttgattagacaccgaaaggttactgattgttgaatgtatctgtgttagagctgtgcactggcacgcttgcatcaggggctggggccacacggccgccacacagattcccccgtgatgcctggagctgcttccagagccgggtgtctccaagaggcacctgtaggacttcccatttagaaatctcttgagtgggtttgtatgttaccttctccaaggtttatttaggacagagatattgctggaaggtcatgggtcagattccctcacaacccacctcgtctgcgggtgcagccccactccaaggctccccgttattggggtatgtgaggagcagtaaatataaaaccagttcaactgtcctcatggaatcaccctttctgtttttgcagtattcataaagctagtgtaaggtctggttttagtctattaaatcttagagatctaaaggaaatgctcaaaatgtagccaggttttaaatgctttaacttttaaaaaatgtaaatttttgtatgtttatagcttctaaatatgaaagttaaagaatgtactgtgatgaaatgttcagtattatgttgcttctcagtatcatgttgcttctcagtattgtgttgcttctgattctatgaatgttcattttaagaccccttgttgaaatgggacagttggcagcggctctgatgagcccgagaagaggcctgcccttgggtgcggagtctccctccgcacgatgctcccacgcgtccaacttgcacccaaggggcttttccctcttccaagtggactccttcaaggaagctgcagctcggtcagcagagaaggggcctgccgccagcgccctggaggaagaggaagaggaacccaagaggatggcttgtctcccagcagccacaccggctttgtgctcagccagttcatttgagtttgcatgtttctctgcactatggattttgagcatttagatttctttaatcaaaagcgttttagtgactccagtagacattttctttctgaggcatcgtgctttgcatgagagcaggccaaggttgaggggaaaagtaaagttaaa

SEQ ID NO: 2911 - DNA, 1960 bp, Homo sapiens
caggagaattgcttgaatttgggaggcggaggctgcagtgagccgagatcatgccactgcactccagcctgggcaacagagcaagactccatctctaaaagtaaataaatcaaaccctcccatcagacctggcgcagcctgttagcagtccatgtggcagaggcgaggagtgccactccagctgcaccgtagctgcactctgtcttggtgtggggttctggcaggtctgggagcttaccgcactggttggcagcagagcagaattggaaacagggcacgtctttctgggatgtaagtcctgatgtttccccattaagaaaaaaggccaggcatcccaacactttggaaggctgaggcggacagatcatgaggtcaggatattgagaccatcctggctaacaggtgaaacccggtctctactaaaaatacgaaaaattagctgggcatggtggccggcacctgtagtcccagctactcaggaggctgaggctggagaatcgcttgaacttgggaggcagaggctgcagtgagccgagttcacgccactgcactgcagcctgggcaacagagtgagactctgtctcaaaaaaaaaaaaaagtgtagaaaaacttgactttaacttcaaagtttaatttgaaagtttaaacaggccaggcgcggtggctcacacctgtaatcccagcactttgggaggctgaggcaggtggatcacaaggtcaggagatcgagaccatcctggctaacatggtgaaaccccgactctactaaaaatacaaaaaaattagccaggcgtggtggcgggcatctgtagtcccagctactcgggaggctgaggcaggagaatggcgtgaacccgggagacggagattgcagtgagctgagatcgcgccactgcactccaggctggtcgacagagcgagactccatctcaaaaaaaaaaaaaagttaaaacaatgaggctgggtgcggtggcttacacttgtaatcccagtatgttgagaggcagaggcagaggcgggctgatcacctgacatcaggagttcgacagcagcctgggcaatgtggtaaaactctgtctctattcaaaatacaaaatgagccaggcgtggtgctggcatgcgcctgtatgctactcgggaggctgaggcaggagattggcttgaatccagaaggcagaagttgcagtgggctgagatcacaccagtgtactccagcgtgggcgacagtgtgtgactgtgtctcaacaacaacaaaaagttttaataatgagtgatttctgatgacatagcaggtgaaataggaacttacagaaaggaaggggaatgttttggagcgaacggatggtttatgcaagtgtagcaaaatcttggtgattactgaatctggtcattatgctagtccctctgcttgtgtacattaagtttttcctaaaaggttgagggggtgggtattttgcagaaggcactctttggtgctttacaaagatcttcagggtaggcttaggaggtttgactttcccattttactcagggaactgtagttaagaaaggagacatacttggccgggcacggtggctcacgcctgtaatcccagcactttgtgaggctgaggcgggtggatcacgaggtcaggagatcgagaccatcctggctaacatggtgaaacaccatctctactaaaaatacaaaaagtagccaggtgcggtggcgggcacctgtagtcccagctacttgtgaggctgaggcaggagaatggcatgaacctgggaggtggagcttgcaatgagctgagatcgcaccactgcactccagcttgggcgacacagtgagactctgtttcaaaaaaaagaaagaaagaaaggagacagactttgcacaaagcatacaggtcacaggtagtacagttaggtcacaggtagtaggccactttgtcctcggtagccgaattttgtgtttttg

SEQ ID NO: 2912 - DNA, 1050 bp, Homo sapiens
aaaaccctgtctctactaaaagtacaaaacgctaggcatggtggcacatgcctgtaatcccagcactttgggaggccgaggtgggcggatcacccaaggtcgagagtttgggagcagcctgaccaaaatggagaaacccccgtctctactaaaaataaaaaattagccggccatcgtggtgcatgcctgatcctagctactcatgaggctgaggcaggagaatcacttgaacctgggagatggaggttgccgtgagccgaagttgcaccattgcactccagcctgggcaaccagaatgaaactgtctccaaaaataaaatacaaaaagtagctgggtgtggtggcgtgtgcctgtaatcccagctgctcaggtggctgaggcgggagggtcacttgaacccaggaggcagaggctgcagcgagctgagattgtgctgttggactccagccagggtagtaataatagtagtagtgtatatacctggaccagggacggggatctaagctcccctgacctttgtagacaaatgggaactctactgtgtaggttctttccttgggtggactgaccgttttatcaagaattgtttttattgagataaaatgtacaaatcatgcacttccctgagtcgcgtgtccagttctgtgggtttcaggacattcatggagttgcagccgtcaccacaattggttttgagacgcttttcgtctcccaaggccgtttgctgctgcccattctcctcccagtgcctgtagcagcttcccgtgctacaggtccgcccgttccacaccgtccagtttagctgcttcccgtgctacaggtctgctcattccacactgtccagttcatatgcagccttttgttctttcgctgagcatgcgtggaactatttctaagtcccaggtttctttgccatgacttttcctcgctcagcctcagtggcacgtggagtagagcagctttgcgctgggtgtcctgccgaggggcttgagcctggctcccagggtcacgtgcagaggcttctctattttttttcattttacactgaa

SEQ ID NO: 2913 - DNA, 1066 bp, Homo sapiens
cagagtctcactgtgtcaccccggctggagtgcagtggcgagatcttggctcactgcagactcactgcaacatccacctcccgggttccagtgattctcctgcttcagcctcctgggtagctgggattacaggcacgcgccaccacacctggctaatttttgtatttttagtagtcacagggtttcaccatgttggccaggctggtcttaaactcctgacttcaggtgatccaccctcctcgtcctcccaaagtgctgggattacaggcgtgagccaccatgctcagccctactcttgtatttttttttttttttttttttgagatggagtcagagtctcaccctgttgcccaaggtggagtgtagcggcttgatctcagctcactgcaacctccccctcccaagttcaagcgattctctgcctcagcctcccgaatagctgggattacaggcatccgctgtcatgcctggctaatttttgtatttttagtagagacgggggtttcaccatcttgaccaaactggtcttgaactcttgacctcgtgatccagctgcctcggcctctcagagtgttgggattacaggcgtgagccaccatgcctggcctcttggaatatttaataagctaaaaaattcttatacacaggtagattaattaggtagccaggagtggcccctgaaagtatgtctggcaaaacctagaactgcatcctagccatcactgtaccttctgccctccctgctgtctcctctgccagttacagttaaaaggttgtgggtgaggacgctgggcagagtcccaggcgtctgctgtcagctccccagcccggcctgcctgccgagccatctgggcgtcccacggtggagagtgtggtgcttgtgacgcggtggtgctgggagccatcctggtggcagatgtgggctctcactgcaagtcagtgtaagtccccagggactgtcagcagcacgtcctgctgcccctctctctgcagaagccctggtaacctgcgtttggaaaaatctctaaggatttctgaggagctgtcaggccatgtccttgtccac

SEQ ID NO: 2914 - DNA, 1068 bp, Homo sapiens
atcctcccacctcagcctcccatgtggctggaaccacaggcacgtgccaccatgcctggctatttttttgttgagctgggctctcgctttgttgcccaggctggtcttgaactcctcggctcaagcaatccttcctactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccccggatttccatttctttttttctgctttcctcaaaaactaatagaagactgggtgtggtggctcacgcctctaatcgcagcactttgggaggcagcagctggcggatcacaaggccaggagttcgagaccagcctggccaacatgatgaaaccctgtctctaccaaaaatacaaaaattagctgggtgcgatggtgggtgcctgtaatcccagatactcaggaggctgaggcaggagaattgtttgaaccccggagatggaggttgcagtgagccaagatcgtgccattgcactccagcctgggcaacagggcaagattccgtctcaaaaacaaacactattagaaaatgccctggaggtggcggggagttgttgatttgtgaggacagattgaaagcaactcccagggtggtaatgtggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaatagggtaatttcctgtgtaacgctgctctggggcctcttcctcatcctggcagaaggagcctggagcccatgaggcagccagcactgtgcccttgctcagtcgtgctgtcccctccctctccctcagtctcctctccatgcccaagtcggtttccagccgctggtcttcatggcattcc

SEQ ID NO: 2915 - DNA, 1034 bp, Homo sapiens
gacagcaagcgatcctccctcctcggccttccaaagtactggggttctaggtgtgggccaccgccgctggccaaacatgaaggtttgacttacaactttgtggtctctggtctgaacaggcacctgcacctggaggactctgagaccctgtttccaaccatgatgttttgcacttgtgctctgatatgaaatgtgtttggtctttgttcctggttcctggcacagaagctcctcgaagccttggaatttcctgagtgacaggagtggttcagatcaccccggagcttatgctgatcacacctgagcttatgctgatgaggcagggggtggggccctggagagcgggggtaggggggactggtcgccagaacaccaggtgaccccaggattggaggctgggagctttgagccccacccgccaacctcagggacgcagcgagcgaaggtggagattaaacgctgtaaaaacccgtgaatgagagatgaaagagtgggatggtcttcggattgtggtgctgggggcagggggtggcgcccagagagggcctgaaacccagcacctgcccaggccttgcctgcgcgtctctgcggccggctgctcctctgttttcttttaacgtaagtgctttctgcagttctgtagggcagtcctgtcaaactcattgatcctcaggagggtgtcgtgggaaccccgatgtatagctgccggtcagaagcacggcccacaggctgaccagcatctgaggagggggcagtcttgtgggatccagccctcgccgcaggggacctggcactctccccagggggacggcttcgggagggaattgaaccagaggacacacagctagtgtctgtggagaattgctcaacgtggaaataacctgcatctcctgtgggaagtgttgtgtgggagtgcagagaaactgtgcattcctcacaggactttatttatttgcttgtttatttatttgtttgtttttggagacagagtctcgctctgtcccccaggctggagtgcaatgtctcgatgtcgg

SEQ ID NO: 2916 - DNA, 1023 bp, Homo sapiens
cagcctcccaaagtgctgggattaccggtgcaagccactgtgcctggcctggaaacatttgctctacagaagtcactggggtgtgaggggacatccctcttggctctgcttgttttgagaggcgaaggctggggggttctgcactgtgagcagggctggtggaggcagagttatgagcgtggccttgggcgggcccagccctctcacatgttgggcaagtggctccctcctgtgccaagagtgcccacagcgctcacccttgcacaatgctgcttgggcaacagcgccccgggctttgcatgacggtggccgcacaagcacagctgtgatggtgcctggggatggtgctctcggttctggtgatggtaaatgtggtgagttttaggtggaagcttgccagagccggcgctgcctaacaaggatcacgactatcaaatgcaaggggggctttttggtgaaaagtagtcttagaaagcatgttgtcttacccagtgagatgggagagcctgtagcgcctctgacgtggtggcagccgtggagaaacaggctactcccacgttttctgtctacagagtcgctgcctgagccaggaggctacgagcgctggtggctgccttcatcccgcaggcaccacgtcaccactcagcctttctcagatgcctcgttgcctcgttgtcagtgggggtcgttgtcctgtacctccaggccaccccagcgcagtgactgcgtgaacagaattgctttggggttttatttttttttcctgtgggttctttggcataatgcaccatttctgttgcattctgaacctgatgacagcagccctgggtcagaggtcgcctccatagtgagtgacaggcgccttcagggtgaggtgggggaggaggtagccaaatacgcccaagcatagcctgtccttgggaaggaaacattaaatcccaacacccacttcgagaaacattgttttccgcaataatcttttcagttcgtaagtaagtaaaattcttttgtaatgtacttcgt

SEQ ID NO: 2917 - DNA, 1049 bp, Homo sapiens
atctcttcctggttttattgtattgtggtcagaagatgaggttctaggctgggcgtggtggcttacgcctgtaatcccagcacttcgggatgctgaggcgggcagatcatttgaggtcaagagttggagaccagcctggccaacatggtgaaaccccatctctactaaaaattcaaaaaaattagctgagcgtggtggcgcacgcctgtagtcccagctgctagggaggctgaagcaggaaaatcacttgaacccgggaagcagacgttgcagtgagctgcgatcacaccactgcactccagcgtgggcgacagagtgagactctgtctcaaaaaaaaaaagatgaggttctaggccaggcatggtggctcatgcctataatcctagcactgtgttgggaggctgagttgggaggatcacttgaggccaggaattgaagaccagcctgggcaacagagcaagacaccctgtctctaccaaaggaaaaaaaattagctggacgtggtgctgtactcctgtagtcccagctacttggaaggctgaggtgggatcctgtctcaaaaaaaaaaaaagaaaaagaaaaaggggaaaaaagggtgaggttttctatcctcaccagttttctttgaggcttaatattggtcagtttggtaaatatttcattggcgctgaattcacgatgcaaggcatggagttcacaacatatctgctggttcaattttatttgacagcttttctggactagggtatttgaaattgcacactttctctctcattaatgtgttgtattgtttacgagaaaagagcctgtcttttttttttttttttttttttttttttttttttttttttgagacggagtttctttcgttcttgttgcccaggctggagtgcagtggcacaatctcagctcaccacaacctccgcttcccgggttcaagcgattctcctgcctcaacctcccaagtagctgggattacagacatgcgcaaccacgcccagctaattttgtaattttaatagagatgggggtttctccatgttggtca

SEQ ID NO: 2918 - DNA, 1030 bp, Homo sapiens
ggaattacaggcttgagccaccactcccagcctatattgtattttaattatcattcaatgtgaaatttttaatatccttgtgagtgcttatttgacttataggttatttagatgtataatttttacatatctgaagttttcttagttattgttgatttctaattagatgtcattgtgcttaaagacacacttggtatcatttcagtcctttgacatttgaggcttgtttttaatggagctgatggtctgtcatggtggccgcgctgtgtgcacatgggaatgatatgtgtttttgttgtatctcggcctgattttctacatacatgttaattagagcaagatttttggcatgttcaaatattctgtgtctttctatgaaatgctcatgcagggctgttaaaatgattatggattttctaactttcctgttaattctgtcaatctgtgcttcagatatcttgagctcttttagtagatgcctttacatttgttgtctctttgtgattaattgaccctgtgaccctgctctcatgatgaactgttctttctcactcataatgctctttgttgggaaccgctgctttttctgatactaatgtagtcagtcctgccttcatgggggtcctttcagcttaactgtgtctttgaaaatagtctgttacagacctcgcatcattgttgggtcttggttttttctgcccgcctttggaatatgcttttgcacatttatatttcttattgtaactctgctactttgccacctttttgtcccttcatttttgttttttggttgttcccttcctaccttcctttgagttacttgattacaggcatgagccaccacgcctggcctgggttacttgattttttaaagaaatctattttactttgtctgtgggctttgtaggtaaaccattttgcctgatgtcttagtggtgtctttagggattatagtgtacattcccaatgtctcgcggtcctctagttaacttggtcctagttgataggaaacgtaaggaactcacagcca

SEQ ID NO: 2919 - DNA, 1059 bp, Homo sapiens
tgccccagtcactcaagtagctgaaactacaggcatgcgccatcacgcccagctaattttggtatatttagtagagacatggggtttcaccatgttggctaagctggtcttgaactcctgacctcaggtgatctgcccgacttagcctcccaaagtgctgggattacaggcgtgagtgaccgcacccggcctaatgtggttttgatgagtgggcagcactactgttaagactccacctaatcataagttgtgacttcagtaaaactggactgtgtggattgaatttgaatcccatgtgcagcactggacttctcattaagtatgcttcacctgagtggccacatatgggaatcgctctctagataattttggctcttattttgttctgttacctcctttgcagtgaaagttggagatgagaaaatcctggtgtcagtgttgtttttgaacataaagttgtttgcatcatctgtctttctgtcattaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggtacctgtccttgttcataagcttcaagtgacacaagctgtttacctggggtacattatatgctttggatactcactttttatcaatcattttttaattaattaattaattattttttttgaggcggagtctcgctctgtcacccaggctggagtgcggtggcgtgatctcggctcactgcacgctccgcctcctgggtgttcacgccattcccctgcctcagcctcctgagtagctgggactacaggcgcccaccaccacgcccagctaatttcttttttgtatttttagtagagacagggtttcaccgtgttagccaggatggtctcgatctcctaacctcgtgatccacccacctcagcctcccaaagtgctgggattacaggtgtgagccaccacacccagcctt

SEQ ID NO: 2920 - DNA, 1214 bp, Homo sapiens
tggtcgtgcagaagcaggtgtcatgcaggcccacacatagcctgacataggaaccagctattaaattgtggtgtgggacatctgtgtggtgtcataagaagagttgcgagatctcaaagaactcagagacctaggaggagatggtcctggatggacagggagaggaggaaggaagcaggaagggaacagcaagtgcttcaaggctggccatgttcgtgtgcgtgcattggagggcagggcacacaggttcctgatgaccagccagactgagacttggtaagaggtacggaaggggttcagtgcagaatgccacagtggaagccactggagaactgtgggaagggctgggaagaggtaggcacagtgggcgagccaacagccttgacaaggatgggtgatgaggagaatcgtttaatcacagatgttgatttacagaaatgtttttattttcaagatcacaaacaacatcgacccagtgggaagaatccaaatgcgcacgaggaggacactgcgggggcacctggccaagatctacgccatgcactggggcacagactccaggtaggcgtgggcatgagcaggatgctgcttgttacattcaggggctgctctgttgtcctaggggaaaagtacctgaacccatttgctgtgctgtgcagtgaagaaattaggaagttgaatcagaactctgggcacgcaaggtgcagcgttcacaggtgcatattccctgtccagttttccacttacctgggctgaaagaacactgccatttcttcactgtctgaatcacattaatacaagttctgatttttctttctcccttctcctgtctctttcagtttctagacctctgtcttcccagttctactgcatcctacttatgtgaacttggggaagttacctctctgtgcctgtttctcagggctggttggccctcgccctcttgtgatgtcagtgccctggctcaggaaatcacagaacctgccccgaggatcctgagggattaagtgtattgagccttagaacagcattgtgctgtgtgtgctttgctgcggcagacacacgggaatgcgctgtgagctgctctcaccattctctcatctggcctgtctgccctgccttcctttggtttaccatcccaagagataattcccttcatgggctcctatttgttcttttcttttctctttttttttttttttttaaagacggag

SEQ ID NO: 2921 - DNA, 1032 bp, Homo sapiens
tgttcttcagagtgtcgctgtacaggaagctgatgacattcagtacatacctaaataacagtttataagctgggtatggtggtgcgcgcctgtagtctgagctacccaggaggatcacttgagcccaggaggttgaggctgtatagtaagctgtgattgcaccactgcactgcagcctaggtgacaaagtgacaccttctcaaaatacagtaaaataaaataaaaaacaacagtttatttttctgactccagtgcaaggatgaagtcaagtatttccttttaaacggccaattacatgtttagaaagcccaccaggatttggagagagaaacaccaacataattttaggcaacttgttcctgaacttgagaaaaaataatggaattctctgagatttacagccaaagagaaaacaaagtatcctctactgtaagaattttaaatcttaacatttaaaagatcttacataggtgaatagggaagacttagatttttttaatagtttgctctgatcagacttgtttaacatgtcccctccaccaaaattaatcaaatgtgttctgaaatatttagtttgatataaaattattctctgaaatatctatttaaataaaaccaaaaggtattcaaattttgcctgacttaatacttaagcttctgctgttcattttaagtcagcatggtttttggcaagtaaaaaagaaaagcaaagtgttgttatttaataataatctaactgggtttttgggggggttcagaacactctcagctctttaccacctgcttttgagactatatttcatcttatagaaatcagatttttttttttttttttttttttttctggagacagtctcgccctgttccccaggctggagtgcagtggcgcgatctcagctcactgcaagctcctcctcctgggttcacaccattctcctgcctcggcctcctgaggagctgggactataggcgcccgccaccacacccggctaattttttgtacttttagtagagatggggtttcaccgtgtt

SEQ ID NO: 2922 - DNA, 1023 bp, Homo sapiens
cccctgctccccttattcctcacagtattgttaggagcggtgcgtaagggaagcagggcctgaggactttttccgttgccctttgaattcccacagtcttagttttggagattgacctggacttgggaatgaaagaaaaatggaaaagtgagtgaaattggtttaaattcctcatgcaaactcctctctttcaaaatgctgcttcgtcttggaggtgagctgtgatccttgtgtgtttggtcaagttagcaaatttcctgccccggtgtaagacactggggccggtttggacttcggaagttgtccaaaccatccagagatgcagccatccagtgctgcacaggaggctcaggggtgtgcggctagctggtgaccaggtgactcaggactgccctgttgctgcttggtggtgggaccacatgtgtgcactttggtgagcatggtgcctgttgtccttgagattgttagtcaaaggtacacgtcatagtttaatcactgtgagactgacagagcactttcagattggttgtctgatttaattttcattttagctctgtgatatagataacaccattcccattttgaattaagcagattagagtaaaaaacaatttagtgaaagcattattctttgtatgttgcagaaccagaacttgaaattatttttcaatatctgtaccctattttgtcattggcaaacttgcagcctgaatgttgttattggtgactgtgtaatatggggtcctgagggcaccgctgaggtgcccctcctagactctcaggggtctggatgagaggcctgggctgctgcattgccatgaagggtagaggcactacacggagcacattgcattgcaaatatgaaatattctgactttaaaaatcttgctaacacttgactcacaaagatgttgttctaaagtaggggcagatcccttcacctgcttgcttttaagttattcaaatctctctcaaaaggatttccaaaactcagattctgaataaaagccaatggcagatatg

SEQ ID NO: 2923 - DNA, 1030 bp, Homo sapiens
agactacagcccacgcccccattagaatggctgtgacacccacccagcgttgttgggcgtgaggagccgggactctccacattgcttataggatgttgggaatgtgacccagcataaccattttgaaaagagttggttttttttgttttttgagtttgttttttgtttttttgaaatagggtctcactctgtctcttagactggagtacaatggtgtgatcatagctgactgcatccatgacctcctgggctcaagtgatcctctggcctcagcttcctaagtagttgggactataggcacgcactaccatgtctggctttttttttttttttttttttctttttttaattcttgtaagacggggtctcagtatgttgcccaggctggtcttcaattcctgggctcaagtgatcctcctgccttgcctcggaaagtgctcagattatagtcatgagtcactgcacctggcctggcattttcttggaatgttcaacacacacctgtagtatgatccagccattccaccgctaggaatctgcccaagagaagtgaaagcagatgttctcataaagacttgtacatgtaacaacatgcacagatttcaaagtatcacatctatctgattaactccactgttacactggttgccactgctacatatatttttgatttctgcaaaagggcctactgcactgactggatggaaagtgtggcaggtgaggcaggaggtagttttctggacattacttaaaactttcagggcaacagttttacacctgctttcatagcaagtcatatttagtaagcatttactgtgtcagtcatggttctaaggggcttgcatggattctaatggaattgtcatagcatgagctgtggggactattactgtccccactttcagacaaaaaaatgtaggcagagagaagttaggaaacctactggaggccacctggtgagaagagatagagtctgggttagaacctggggcttccaactttcctgccatgaagcgtcactctgcttcca

SEQ ID NO: 2924 - DNA, 1811 bp, Homo sapiens
tttgttttttgagatggagtctcactctgtcacccaggctggagttctgtggcgtgatctctgctcactgccacctctgcctcccgggttcatgccattctcctgcctcagcctcccgagttgctgggacttcaggtgcccgccaccacgcctggctaattttttgtatttttagtagagatgaggtttcaccatgttagccaggatggtctcgatctcctgaccttgtgatctgcccgcctcagcctcccaaagtgctgggattacaggcatgagccaccacgcctggcctggcctggtagtttttataacagatgttagatagcaatactcttcataactctgtacaaggcaatcaggcaaaaccaaaggccaagtaaaatgtaattggttaagctaattgtagctgatgaaacctttacgttttgtgaaagaggagatgtgcatcagcagctgtaagtgagcactctaagatgcagtgagtaaaaggtgttgggagatgagcaactaaaatataacctcttagttataaattgcagaacgaagaattttactcagagtacaaactagtggaaaaagtctttcgtatactgggtttttcagagttcttaggcaagattatatagtttgatttaaagacccaaaaatgtacttcctggggtgcaggaatgtcaggtttctgttaggtggaacatgctcctcatggcacagaattggctacatgaagttaacctacaggccaggtggtaatcggcaggatgggtcggccggagggaataacttgtgatgatagtgggagaaaccagtatcattgcggccgttttaactacctactgtgtactaggccctatgctatgagccagaagttgccacgctacagccatctctttctgtggcccagaagctaagaatagttttttcgtggggttttcttcttttttttttttttttttttttgagagagtcttgctcttgtcacccaggctggagtgcagtggcacgatcttggcacactgcaacctccgcctcccaagcaactctctgcctcagcctcctgaatagctgggattacaggtgcctgccaccacgcctggctaatttttttgtatatttagtagagacagggtttcatcatcttggccaggctgatcttgaactcctgacctcgtgatccacctgcctcagcctcccaaagtgctgggattacaggtgtgagccaccactcctggcaaattttttaaattttgtttttttgttttgtagagacagggtccaactatgttgcccaaactggatccacccgccttggccttccaaaattttaggattacaggcgtgagccagtgtgcctggcccagaccctcttgttttcagtcactgtgcaacaccacctcccacagaaacattgttctgtcctattctttaaaaaaatgttatcaattatgtgctgccatatactacactgagagtggggattcagtgcttaagcataggtaggttttctgaatttttccaacttaaatctcctttgaaatcttactgtgtgtgatatctgaaatttgggtgtttgctcactaaaagaaccttggaaggagaagatctcaaaatgagctatttgtggatgaagagtgagtcctgtgggtttttgttttttgtgttcttttatagttaacagagtagcagcatgtagaaggtggtggagcctgaacactaggtttagccatagaaaggcagttaggtctcctaagtagacgtttcagtaaagggctttgttgacgctttgcaatgtctggggtgtgtttgccccactc

SEQ ID NO: 2925 - DNA, 1017 bp, Homo sapiens
ggttacactgagttatgatatgccactgtactccagtctgggtgccagagtgagaccttgtctcaaaaaagcaaaaacaaaaccccacaaacaaaaacataagattgtctttgggcctggtgcggtggctcacgcctgtaatcctagcactttgggaggccatggcgggcagatcacttgaggtcaagagatcgagaccagcctggccaatatggtgaaaccccgtctctactaaaaacaaaaattagctgagcatggtggcgggtgcctataatcccagctactcaggaggctaaggcaggagaatctcttgaacccaggaggtggaggttgcagtgagcctagattgtaccactacactccagcctgggtgatggagtgagatgttgtctcaagaaaaaaaaagaaaagattgtttttgaatctgaagacataacaaagcagcattacaagttgtgttgtacaagtgtgttagcgtaggttgtccttgataaatggaatataaatagctctgaagtttttgtatatattgacctattacaaaatcagagactttctttcggggttgggagggcagtttgagggtagttgggtcatctggaagaagaggcagaaaagaggaaccagctacgtgatgaataactgtgataagacaaataggctcctctactgccacctccttgttttttcctgcttactatttctgtggctgtgattgttgggattcacgggaggaggaagcagggacagtaggaaaagctccagttcctgatggacctgtgttgctggtgctgcactgccttttctctgacttcatcccacccacctgagagacactaaggtgggggctgaggtccaccctgtaattaagctcttgggcatgaatggttagctgaaacaagactgtcaccttctagtgaaattctgttttttggattcttatagaagtcagtagtaagtgtctgagataatgaatggtcagataacaacataaaggagcagtggactgactagagc

SEQ ID NO: 2926 - DNA, 1043 bp, Homo sapiens
caaaagtttagtggggtgtggtggcgtgcacctgtagacccagctacttgggagactgaggcatgagaatcacttgaactggagaggttgaggttgcagtgagctgagatcacaccactacactccagactggtaggcagagcaagactttgtctccaaaaaaaaaaaaccagaaaaagataaaatgtcttctaagcatgggcccccaactcctgggctgtggtctcttaggagccgggctgcacagcaggtgagaggtgggcaagcgagcattcccacctgagctccacctcctgtcagatcagcggcagtgttagattctcataggagcgtgaaccccgtcatgaactgcacacgcgagggatgtaggctgtgcactccttatgagaatctaatgcctgatgatctgaggtggaacagtttcatcccaaaaccatcccctctgtctgtggaaaaattgtccttcacaaaaccggtccctggcatcaaaaaggttggtgaccgctgctgtaaggattctggatgcttcacagaacgaagctcaggaggcactttttttttgtcttttttttttgagacagggtgtcactctttgtcacccaggctggactgcagtggcaccatctcagctcactgcaactccgcctcacaggctcaagcaattctcctgtctcagtctcccaagtaggtgggactacaggcgtgtgccagcatgcccagctaatttttgtactttttttttttttttttttttttttttagatggagtcttgctctgcttcccaggctggagtgcagtggtgcagtctcgtctcactgcaacctctgcctccaaggttcaagcagttctcctgcctcagcctcccgagtagctgggactacaggtgcacaccgccacgcccggctttctctgtactttggtagagacggggtttcaccgtgttgcccaggctggtctccaactcctgagcttaggcagtccgcccgcctcagcctcccaaagtgctaggattacagacacgcgtgagccaccacgcccggcc

SEQ ID NO: 2927 - DNA, 1197 bp, Homo sapiens
gagtctcacttattgcccaggctggagtgcagaggcgcgatctcggctcattgaaacctccacctccccagctcaggcgattctcctgcctcagcctcctgagtagctgggattacaggcatacaccaccatgcctggctaattttgtatttttagtagagacggggtttcaccatgttggtcaggctggtctcgaactcctgacctcaagtgatccgcccaccttggcctcccaaagtgctgagattacaggcatgagccaccacgcctggcctgtatatatagatttttaaaattgtgatttttctactttgtaattgtttccaaatgtcattcatcttggaaaacatgagtagtaattatgtagatatcagtggtatttcttgtacctgaatccacgtgctggacatcctggttctgccaactcagatttgaggtctggagcaagttactgaacgtctctaccttagttttcttgtcttccaggattgttgtgaggactgaatgacatgctacaaataaaattcttagcttcaagccaagcaagacctcaaagtgttagcttccagtaccgctactactgatggtgtttgactctgccttcattcctgaaatgcttctccattgactgggtgtggtggcttatgcctatgacacttatcactttgggaggctgaggtgggaagattgagaccagcctaggcaacatagtgagaccccatttttgcatgtgtgtgcgcttgctcactggctcgtgcacgtggccatgcacgctcgctctctctctctctctctctctcgtgtgcacatgcatgtcctctctcttgctctctctttttcttagctgggcctgatggtgtacacctgtagtcccagctatccaggaggctaaggtgggaggattgcttgaacccaggagttcgaggctgcagtgacctgattgtacgactgcactccagccctgtctctattaaaaaaaaacaagtccttctccaagctgatctgggcacttgatttctacccttgtggttctggcttagtaaaggtcttcagaaatgacacaatgttagtttcctgtggctgctgtagcaaatcatcacaagttggatggctcagaatgaattgattccctcagttctggaggacagaagtctgaaatcaaggtgttggcagggccccagtgcttctgaaggctcc

SEQ ID NO: 2928 - DNA, 1073 bp, Homo sapiens
ggtaatcatgtctccatgcatgtctgtgtgcagtcctgtagcacttagaaaatatattccctatgttgattacagacactcaacttctgccgagtgttgtagttaataaagcttaaaaaattctgggctgggtgtggtggctcatgcctgtaaacccaacactttgggaggccaaggtgagcggatcacctgaggttgggagttcaagaccagcctgaccaacatggagaaaccctgtctctactgaaaatacaaaattagcccagacgcggtggctcacgcctgtaattccagcactttgggaggccgaggagggtggatcagcctggccaacatggagaaaccccatctctactaaaaatacaaaaaattacccaggcatggtgatgcatgcctgtaattccagctactcgggaggctgaggttgcagtgagccgagatcgtgccattgcactccagcctgggcaacaagaaggaaactccatctcaaaaaaaaaaaaaaaattagtcgggcatggtggcacatgcctgtaatctcagctactcgggaggcagaggcaagagaatcgcttgaacctgggaggcggaggttgcggtgagccgagattgtgccattgtactgcagcctgggcaacaagagtgaaactcggtcaaaaaaaaaaaaaaaaagtccggacactttataattagatgagcatgtcaaaagagtctacaataggtttcagaaaatttctcataggaattttaaaataattcctaaaatctagggagtgagagaaattcagtagttttcaaaaggattggcactgtctgagttagagcccagctcagctctgttgcctcactggctgatttgcagtgttaggacttttattcgcactgaaaatcaagatcagttcaacttctacccttccactccacaggagctttctgtcctccctgagcctgccttaatttaggccacctgcagtgttaggacttctgtgtctgtccttatctgtgaaacaggctcctagagcctccttcatggggtcattgtgaggattaaatgagtcctgatgtgggcactgata

SEQ ID NO: 2929 - DNA, 1027 bp, Homo sapiens
ccgggaggcaggggttgcggtgagccgagattgtgccactgggcgacagagtgagactgtgtctcaaaagagtaaaaacctctgtaaatccttttgatgcccaatgactttgatttcaaagctagtatcatctaggtagatttatgttgatcacttgagaaacagaatttgaaaagttaatttatttctcaaaggagatgttgtactatcctgcaaaagtaccagagctttgttctcttccctttgctttgctaaaaatttctgggtcttttggtttattttatgtgtgtgttggtccactggaaaagttgtagctttgtagctaaaaacagctttgataaaaggatgaaaaaggtcttcagggcatctctagacttcatctaccatcagttgactttttgtagctaatactttaatgaataacattggtattattttagaagtgcagtgttggcatttattatagttttgtcgttgtttttctctgcccgaaagatttggctcatgttggtctctaaattggattacattcttactgtctgtgactttggctttagcattagtggattggtaatagatattctcaatttttaaatctggcttgaccatatggcaggccatgttattttgaaacccctatttagtgtaagtctcacaagacatggaacaaaaatttttataaaattttaaactggtttgaccgggcgtggtggctcacacctgtaatcccagcactttgggaggccgagtcaggcggatcatgaggtcaggagatcgagaccaccctggctaacacggtgaaaccccttctctactaaaattacttctctacaaaaaattagctgggcgtggtgctgggcacctgtaatcccagctactcaggaggctgaggcaggagaatggcaggaacccgggagggggagcttgcagtgagccaagatcggccactgcactccagcctgggcgacacagcgagactccgtctcaaaaaataaaaataaaaaaaattttaaactggtttacattc

SEQ ID NO: 2930 - DNA, 1050 bp, Homo sapiens
caggatccccagccacccatgcgaggccacccccttccttgggggggtccttgttcagaggggcaccgacaactaactggctgaacaagccgtctcatgacgtcttggaaccctgaccataaaggtgtaggacctggccacagcaccctgcctgcgctggcactgcacagacccgtctgtcaggagcctcctgccggcccatttctgcctatccaggcatcgacttcagaatctcaggtgctgcttggcaggaaaatgcccagcaggcgggcctgggactcggtgatgcgcctgtgccggggagggcagaacgctggtgcctggcacaggtgccacaacacatacgggtgaggacactgaaaacccctcagttcccccgactcatggccacttgtcccagtgacacagccatgctctcccactcacccacaatagggtctgaatgtgccccccagattcacagtgagaaactcattccccagagcaacagtgtagagaggtggaacctgatgggagccccgccctcacagacaaactcctgtagctgtcaagacagcttgggcatggattcctctctgccttctgccatgtggacacgtggccttcctcccctctctcctccggggaatgcagtgtttgggcgccatcttggaagcagagatcaggcctcaccagacaccaagcctgctggcaccatgaccctggactcccaacctccacagctgggaaagaactctgctccctagaaattacccaggctcgctcaggtattctgttacagcagcaccaagagacattcactcgcttactccctcactctctaacccactcccattcaccctctcactccctctctaacccactcccattcaccctctcactccctcgctaacccactcccattcactcattcactcactcactctctagcccactttttttttgagatggagtcttgctctgttgcccaggctggagtgcagtggcgcgatctcggctcactgcaacctctgactccgattcaagctattctcctgcctcagtctcctg

SEQ ID NO: 2931 - DNA, 1033 bp, Homo sapiens
aaaacaggagtgtattcatatgtgtgccttgtgtatactcaggaggtacgcggagaggcagggaagctcacaggcggctctcacttttgacttaaatcccatcttcagccaaaccaaaggaagaagggtgctgggggccagtcacggggataagactggtggcgcagctgaggcggggccttctccaccgatgggagcctctgcgcctcggcgatctggggcctttctcttcctggtacggagaggagatgcccttaccgtggaacttcctttacggatgcaaattttttcttacaaaagggagcttctcctgtgtctgcagtttctcaaaataatctgctcaaaatagtgctgatgccaaagaggcagatttgggggtggtacattctggtctgtgacaggccctacaaggcagggactaggattgttctcgggcgaatggggcagcggccccgtgagtgcagagagcaaatttcaggatgtttggaggagaggacaccagacttgttgacaggttggatgtgcgggcaaaggcaagagaagagtcaaggttggtgcctgagctttcggtctgagcattggatggacagtggggcctggttcaggacacagtcaggaggcagaagcaacaccgatcactccaatggggaaaaatgtaatgaaaaaatcactaacaaggacgactcaggagacagaaaccacacccatcactccaatgggaaaaacgtaatgaaagagtcaccaacaaggacgaggcagctagctaccaaaaagggcaggagaaggaagagcaacgtctcagtgtcaggagggggcccggagacagaccctctgcggtggagtctgggagtggtgtggttgctgcttgggctgggctgcaggcctgagctcctggctggtgggaaggggaggctgctggtccacagtgtgggggtgcttcacggttaaccaagccatcccccatgctgggcgtgaggcactagcggaattgagagcctcagaaacccaggtgctgctgtgtgaggctgtcgca

SEQ ID NO: 2932 - DNA, 1199 bp, Homo sapiens
gtttgcggaggcaccgggtgttgtgtggggccaacagcagcacgtgtgctttggccacggcagggggaagtgcaggcgctgtttctgaggcacgaaggctacctgggagccatcggagcgttcctgaaaggagctgagcaggacagtgagtcgcggtgctggcgcccctgagcagcgtggggcctcagctgtggcctgggcctgtgctccaggccagggcggcccagggtggaggtggggtggggagcgtgagtcctcagaaagtgacagcagcaggcatgtctaacattttaacaatttagttaataagcgattttataccctttcctcctccactctcctgcttttgaatcaagggcaaggttaacacaagtgacctggcttcttgctttccagatcctaaccagtacagctggggagagaactatgcaggcagctccgggctgatgagtgcatcacccgagctcggcccggcgcagcgggcgcggagtggcactgtgagtagtgggctctggccgccccgggccccaggggagcagcctatgccgcactcacctcgcctgtccctgagcgaagcctcttgtggctgtcccggctgaaaggcgcctctgcccatggcgaatcctcccatggacctggggtataactaggggcaagagaaggacactgtggcttgctttcccatctccctcattgggtgctttcgtattttggaaacattcagcaggaattacggagtctgtgtgatccggccttcttgtttgcagagagattgctaaagttcaggggtgacggggacctctccccacgccagaaggcccgtccactttggagttgaaacccgaaaccgcaggagccacccagggccctgcctaggactgcgcgctctgccgcacactgccgcgcactgtggctgatggtctgtcggttacagtctgctctcctcggggtgtcccggctcattccttggatccccagtgggtttgccctggcctgagctgggtggcactggcgggctaggagacgcaccccatgtctgccgagttggagctgctccggaagggtcccccgccaggacctgcgtcagccacgggatgcccccagcacagccccacatggcaggaaccgccccgtgtcacaggctgtcagggtcctcgaccgtgcccccccgcggggctcattccttctgtagctgtgag

SEQ ID NO: 2933 - DNA, 1043 bp, Homo sapiens
ggccaggagaacagggctcaccgtggatgttctgtgtggccccgagaggccagtgaagccgcagagctggggctgtccaggaagggctgtcgcagccctagagggccctggagtaccagcctgttctccaggctgagcccagggggtttcttggtagaaggatactctaagaggtctgtttagtgctggtatttatttcccctcttcaaagtttctccctgcgtctgggtcctgtgtctctggttcttaagaggacctgttgactgatactgagagaccttttgtttgttactcctgaccgagctgctgggaggccacgctcagggtggggtgtcttcaacccaggaaccctcaaagccaaagtgcttgtcaacagtgttgtttaaaagcaggcttctcccatttcctcttcccttgcctgtgtctggatctaggaaagctcacctgccctgtgttctggcaagctgttttcctctcgatgggacgctgatgtctgctgagcagattcacctctttgaaagcagcagggacgttgtatttctcaaaacatactgcagcttcgatctgattttaggtttctgcgggctgtggggagggttcctcagaggcaggtgagacaggaaggggccacggggcggtggtgtctgcttggctgtcctgccctccattggtgcccaaagaggaaacacaggaccagagagaatggcagaggggatggggcctgtgggacagggagaactagaaggccatggctcagatgtgaagagcacaggtgaccaaacctctgggaagcccccttcccccaccagctgttggcctcagggccgagcgcgggcagcccggagagccgccaggaggcactcctgtcactgccttgccaggcgcggtttgctgtgattccgaggggtccctgagctcagcccggaagggtccccgcccgcaggcggttccctctgctctaacagatctccctgctgtgcgtgcccctcgcgcctcaggtcccgttttgtccccccgggtgtggggagtaggcagacggaaca

SEQ ID NO: 2934 - DNA, 1025 bp, Homo sapiens
cggcctgcacttctgccctggcctctccagggtccgctgcagaccctcctgcctgatggctgtgctctcagtaatgacggcgggccaggctctgttctagacctttttcccacgctcctgactcccggacacctcccagccacctctaggggaggaacgcgaattactcccttttcgcagatgaggataccaagccccagaaaggtgaactaatttgcccagggtcatcgggctagaaagtggcagaaccaggatttgaaccagccactccctgctctcctactctgcccatgtttcaggcatgagggcttcctgggggcagcttcacctggagaaaccccccttgaatagccgctgcggcttcacatacctctccctcttagcactcatctcggtcgtaggctgagtctgcttgtgtgtgaatcccacaagagcagcggtgtgtcttgtagccccagcccccgaaaaggatgcccaacctgtctttgccgcccagtaaatactgggatgaatgggcctgccgctgactgcttcccacctccctggaaaagctgggactcagagagacccaggccattccctctgagctgtgtgctcctggtgcatctgacatgtttgctgctgtggtgtcctcggggttgttggtgtcatcatctctctgagatgtccagccagggaagggtgtcctctagggaagtggggggcgatgagaatggaagtagctataggtcctggctcccacctttcagtgagcttatgggaggcaatgcttcttagggggtgtggcctggtgccaggtatgagaacgtgtgagtagcatctttagggaccgctgataggacttgggactgactggttattgggctgcaggtgctgagcttgcagccctagcctaggggattgtctaccgcaggcctcaccagaggctccccagccatgcttcccagccttctgagaccttgaggcccggtagagcgtgtgctctgcaaggttctgctgcccttacactgggggattctgttact

SEQ ID NO: 2935 - DNA, 1050 bp, Homo sapiens
tgcaaatatgtgctcaagtccctgttttcagtcctttgggatctatacccagaagcggagtggctggatcacatggtcattgtagttttaattgttagaggaactgccctaatggtttccacaacatctgcaccatgtcccattcccgccagcagtgcacgggaattctaatttctccccttcctcagcaacaattattcctctccaggccgggcacggtggctcatgcctgtaatctcagcactttgggaggccaaagtgcgtggatcacctgaggtcaggagttcaagaccagcctggccaacatggtgaaaccccgtctctactaaaaatacaaaattagcggggcatggtggcaggtgcctgtagtcccagctactcgggaggctgaggcaagagaatgccttgaacccgggaggcagaggttgcaatgagccaagatctcgccactgcactccagcctgggcgacagagcaggactctgtctcaaaaaaaaaaaaaaaaaaaaaaaatcttattctctgtattgggggctttaaaagaagccgtccatcccgctgggcctgaggtggtctccccgttgttctgatttgcgtttcccatttcccaaatgcttggtggcaccgagccttgtttcaggggcatggtggccatttgtgtgtcttctctattctagtccttttccattttttcacccagtggtttgtttttgatgttgttggggtgtgagggttctttacaaattctagacggaatgccttatctgatacatttcctcccagtccatgtgttgcctttcattctattcattcttgtttgtaaagccccatgtatctattttacacgtttctgcctgtccttttcctgtcatacccaagaaatcaagaaatcactaccaagtctaacatcaagaggcttgtgttttcctttgagggttttagagtgttttgtttgtttgtttgtttgttttgagacggagtctggctctgtcgcccaggctggagtgcagtgttagccaggatggtctctatctcctgacctcgtgatcca

SEQ ID NO: 2936 - DNA, 1041 bp, Homo sapiens
gaagggaggggaggaagactcagaggagggcacgggaaggggaggaagactcagaggagggtacgggaaggggaggaagactcagaggagggcgtggcacctgtacttgttggggaacatccgctcgcagtccttgcactcgtgggcttggccgctgccaccgccaaggccctcgggcttgagctcctcagccaggccctcgtagagcgcagcccccactgagccacacgtgtacttcttatggcgccgcaggtccagcttggactggaagagttcgtcacactcgtcacagcggaacgtgggctcctctgcaagagagagaacgaggtggtggtgagtgagctggagacccagcccagggctatcaggggactctggagacctggccccctcaccacggtgcctcagggcctgcacccaggctggccagtcctgcactgcttccttccagccttcaacttggggcccaccagcctgccctggaaacaggcatgtggagtccccagggcccagccctgggcaggaccaaaggaccccccaatctgtgcctcagagggagccccgggcgacacccggccctgcctgtgcctcaggcagccactgtgggctggagaaggccccgctcgggagtggaggaggaagccgggccaagtgctttgtttatgaatcaggagaaaaacgatgacagagctccagtgcatataataaattattgtcgtcaaggtcaaacaaattaaaaggggggcagctattattaagtttacgaggcagcatcctgactgccttgccaagccaaacaatcagcctggagctgtcatcccggtggggggctctgggcccgtccctgcctcccctgcctgtagcagctgggcagcagccttccacctaagacgggagacccccccaacaagatgcctcatccccccggctctggaaagaacgctggcactgagctctttcccaaatgaattgaacaatggtgtgtgcaccagtgtgtgagtgcacgggggcgtcttgggcatgagcaggcagctgtgtatg

SEQ ID NO: 2937 - DNA, 1012 bp, Homo sapiens
tgggggagggaggaaggggctgttaggactgaggaccgtgcctttcacctgtgcccctctccaggcagggatggggagtgaggctgggctggcaggtcatcctaggggcagccccctgcaaggtgcctgaccccaaagtccaacatggggctggaaagccagacagaccctgtggggccagctggctgggggatgcaggttgctccctcttccctggccccagcctgccctgccggcctgtacggcgacaactgtcggcattcctgcctctgccagaacggagggacctgtgaccctgtctcaggccactgtgcgtgcccagagggctgggccggcctggcctgtgagaagggtgagcgctgggcggcagaggagggacataccccagcatgcttggtgcagccccgcctgcaggcctaggagggctcccaggtcagggggcagcgccctggggtgtaggcttcagctctgcgtgcaggaagcatgggtcagggtctcctgggcccaggaggcaggaccctcaccctcgtgcctgcctctgctcctgtagagtgcctcccccgggacgtcagagctggctgccggcacagcggcggttgcctcaacgggggcctgtgtgacccgcacacgggccgctgcctctgcccagccggctggactggggacaagtgtcagagccgtgagtggggcggggcagcaggggggtctgcaggccctgctgggaaggggtggcatcagccttactgcagggctgaggactgtgcccggtttggggcctcaccaggggacctgttgtcctgtgaatgcaagagctgccgtcggagcactaagaccctgttgggagggtctcagcctaggaagctggcctgtggggacagagtgctgctgctttgccttggcaggggtagccccagccagccctgtggtgggtggaacggaggatgctttggggctcagggggccgttcctgtttcctgcatgcagagaggggccccttcaccccttgtcctgg

SEQ ID NO: 2938 - DNA, 1031 bp, Homo sapiens
gccggctccttccagtgctcctgcgaggccggctaccggctgcacgaggaccgtaggggctgcagccgtgagtctcccgccctccgcggagcaccggcctctgccttctcgagtttgccccagctgaccctgcgtcccgcaggcctggcccaccccacccccacctgcctggggtcctttgccccctggcctctctgggccaacacacctcagaggctcttgggcccttggggacccactgaggtcctgcctcttctgagggccgtgtgggggttggggacagtggggtgggggaagctggtgagacaggcatcctcccggagcccagcacctgtcctgaccacgtgagagaagggaccaagacctaaggtgatgttgtccctgggactgatggcagctgctcccacccctacccctctaggccccagagtccctagagttgggatgaggctgggggcagaggggccgggttcaggtcctcagggcccagagccttctctttcctgagaaggagggtcgggtgcagctgggatgacccctgggaccaggctgaggaggtgggggtagtggaggcagtaggagggtggtggggttccctggggtggggcttaggcccagccctacccgccggggggtcgctggagcaggcaggtgggtggcaggggctaaggcgcctctgtgcccctggcagccctggaggagccgatggtggacctggacggcgagctgcctttcgtgcggcccctgccccacattgccgtgctccaggacgagctgccgcaactcttccaggatgacgacgtcggggccgatgaggaagaggcagagttgcggggcgaacacacgctcacagagaagtttggtgagcgcgggcccagcccccgggggctcctgctcgcagggccagcagccagcgacccctcgggctaggctgccatccaatcagaggctggggacgtgaggaaggacccctgcaatgccatgttagaccaaggcccagagagggtgagccactggctcagtttgcgcag

SEQ ID NO: 2939 - DNA, 1035 bp, Homo sapiens
gaggccaacaacggcggctgctcccatggctgcagccacaccagtgctgggcccctgtgcacatgtccccgcggctacgagctggacacagatcagaggacctgcatcggtgcgcactggctcctcccagatgcctgcaccccactccagggacccgctgctgccctgggtctgggatcagttccatgccatgacttggaggtcctcgtcagtctccctgagtcctggtctggctgcctgggccctggcggggtggtagggcaggtctgacagaggcagcatcctggccgggaaagaccttggtgcccacatcggcccgccaggcccatacccatgttcacggcacccccttagccccatcagcacctcctcagtaccaccccttcacctgggaaggacccagtgtcctggaagtcacaccccagaccctgactcccagatggagtccccaccctctagccccagtcccaacaccttgtccacagcagacaggcgggtggccctggggctgtgacatgtgtcctgtgtgtgcacatatgcgggaccaggaacgtgcatgtgcgtgggcgtgattgtgtggtgggtgcgattgtctgcaggtgccatgaatgtcggtgtgcacacgtgaggctgtgggcagctgcaggtgcagtcgggcgcgtgggttgtgtgtggtcgtatgcagttgtgtgtgggtgggggcgtgtgcacgtgcaggtgcctggtaccagggggcccgtggcgtgtgctccacagatgtcgacgactgtgcagacagcccgtgctgccagcaggtgtgcaccaacaaccctggcgggtacgagtgcggctgctacgccggctaccggctcagtgccgatggctgcggctgtgagggtgagcactgccctgccactgcacagctggggtggcctgggagcagggctgccctaaggaaggacacggggctggctctggtacccccatggtgggcatggggtcggcctgctctgtgctttgctttggggctgtgggtgttggttgagcgcctgctgt

SEQ ID NO: 2940 - DNA, 1034 bp, Homo sapiens
tgctgcagtgagccccgacaaaccaggtggcttcaaaacagcagggctttattctctcccagcttcagaggccggaagtccgagatcaaggtgtgggcaggctgggcccctgcaggggctctgagggggcgtctgtcacagcccccagcttctgctgccggctgtctgggagtgccttggcttgtggccgccacttccgtctctgccttcctgttcacacagccatcccctgtgcctgcgtccaaatttccctcttcttataagggcgcccgtcactggattagggtcccccatccactgtgaatgacctcatgttaacttgactgcaggtgaagcagagaccctatttccaagaagtaaggtcacagccgggtggacctgagtttgtggggacattagtcactgcagaacaagcagcgggagacagggcgtcagggtgggcaggtggcacaggtggccgtctgtcttgctagtagtccttgctagagtgagggtggaggctgtttgggcagtggaggggtgaggacccaggcgtcagggcggcttcccgaggaaggacggcagggtgggcaggcggatcctggggctcatgtgacccatgctctggggaagcaggaaaggagcttcctcgagaggcagcgaaccttccagaaggcagaggagtaggcatccgtgtggccaaggcctcattcccctgatgaccccagccctgcgtgaaccagctccctggtggcagtggagctgtgtgagctgctggtggctgcagggcaatgagtgggcggtcctcacaggggctgcggggtccgcgggccgaccagccctctccaagggtctttcactttagggggcatggagcgggtggttggcggcctgttgggggcagctcgagttggaagaggcccagacaaggaggaactgagacttacgagccccgggatggggctgtgatggtgggaggcttgctggggctgtgggctggggtgcccccacctcccaccttccctctgctctaggtttgtagctgtcccactcag

SEQ ID NO: 2941 - DNA, 1033 bp, Homo sapiens
cgcacaccacggggcaacccgcccgtcccgctgcgccgcgcacaccacggggcaacccgcccgtcccgctgcgccacgcacaccacggggcaacccgcccatcccgctgcgccgctcacaccacactgcagccctcccgtcccgctgcgccgcgcacaccacgtagatgatggcacctgggaggatttctcccagcgtgtggctgcagatgctctgtagggtttcattcggcttttttcaagctggcatcggctgggataaagttttatccagccatgagggttgctgaatcaactgcttcagatggctggatggctttacatatttttcagtttcgattttaaaaaatactccaaatctaatgtctgctattatgggctgtcagagaataagacaggaaacaaaggcccaccaatgtctccgcactatgtattgacattggaaggcactttcggcctgagtgtttcagagaggataatttgagcttttcacgcagccgtgtctaacagtcttcaggcctgtaatgctttgggcccaaatctgcccttgagaagggctcatgtcatggggtcagccttgttgtattatcttattaaatggcccagaaggaaaactaccatctatagagtttagaaaccttaaaagatggataaaagcctggttttgttgagcatcccatgtcacacacaccaatattgaaaacacctttgctacagaacaaactgatttttcatagagtacatttagatgacattgttcaacctaagactaaggtcatgaccactttgctggtggccttagaggaaacgttaagaccaggtggtggatgaggaccggtaacctcaaggcatggggcatcttgaccaagatgtcaaaatgtgtctccagctttgcatgcgaactttaatggttgcaagtgaggaaacaaaaccggaattccagacgtgctggccaggaagtgagctgcgggcaccgtccatcagtctcattcacaagagcaaggaccagacccgttcgaggattagcggggcca

SEQ ID NO: 2942 - DNA, 1015 bp, Homo sapiens
ttgttttgagatggagtcttgccctgtcacccaggctggagtgcaatggtgcgatctcggctcactgcaacctccgtctcccaggttcaagcgattcttctgcctcagccttctgagtagctgggattacacgcgtgtgccaccacgctcggctaatttttgtatttttagtagagatgggatttcaccatgttggccaggctggtctcgaactactgacctcgtgatccacctgccatggcctcccaaagtgctgggattacaggcgtgagccaccatgctcggcctaaaaaacaattttcttgaagaatccgattttgtgcatagtaatgacacagcaccattcctgagaaataggaaatatatgtgtgtggtatgaaaagcccatattctgttcttgtcacctgaatctaggcttcctctttggatgtgaacgcgggaatgaacagtggctgttttccacccaaaggggcgtggagaccttttggaaacgggctttctcctttccattttgcagccgggggcgggtggaaaccttccttcgaagggtagtgccttggggagcagcagacctgctctgagtccagcttagctttccaaaattctgtgtggaacttactggagatgtttttatatatttgaaaataatggcctgtatttctcacgctatacttaaaaaaaataactaaccttttaaacaaagatattcaaactcacccttgtgctgaaagcactcacatttctgtgttcattcctgaaagggcgttttagagtccccgtttctacgttctatgtggcaccctcttgccgagggaacatccagaatccctccacttcctgtctagtttgaggcctcaacaccttcatgatccagagtcctgcggctatgagggggtgggcccaccaccgcccagccctccttggtggacgtggggacaggtaggagcctagggaaaggggtgggcgggctctggtgtgacggcgtgagcgctagccaggaagatggggccagggc

SEQ ID NO: 2943 - DNA, 1037 bp, Homo sapiens
aagtgctgggattacaggcgtaagccaccgcacccggcctgaacattttctttagagtaggatccgatgctgttcttgcaaagacatgaaataatgaaacagaccgcgtttgcggttactcgaagcggtgcacagctgtgagaggactcggcggatgagcagtcgttgggaaaatggtttccttcactcgctcactaccttttaatcagaaattttggtctctgtcccgatagtaaaaccgtttgcgtggggttggcagtagggtgagttgctgtgtcgtgctgtcctgggctgttgaatctgtggagtgcacgaggtcccggctgctcagcctttctctcctcttttggccttctgaggatggcagacctctggaaacagttgtgcatgagctggctttaaggttaagccctgcctcagtaggatcggtgtgtttgggcgtcaggtctccccgggacgctgcagtggcagcccacatgcagcttcttgctgcgtggtcccgtgggatgctccctgcctgctgtagagatgaatgagggcgggagtcgggagggctcattgaggcttaaggccgtaatcgacacgatgggcgagttctgtggctgtgaccctagtggagtttgtgggtttctgcccgatagattgtccccttggggcggaaagaagccaaggccaaggagctggtgcggcagctgcagctggaggccgaggagcagaggaagcagaagaagcggcagagtgtgtcgggcctgcacaggtgggcagcgtgcctggtggggtggggccgggcccgggggagtgccgcatgctggcctcagctgagttagtctgtgctcctcaggaaccgcctaatgctaccagaacccagaagcttcttaacagggtacaaagaaagcattctctttccaaaggagacgttgtggaaccagtctgtcatctagatggccctgacgtgagggaagtggaaggtgttaggagcggaggtattggccattccacagggggcgggtggccctcaggatgggacaggacaggat

SEQ ID NO: 2944 - DNA, 1099 bp, Homo sapiens
cctttctccttccatctccagtcctctgttaagtgaattcattttcaatctggtactttccaattctagtatttgtgtttggctgggatttctttacaggtttcatttctctgctgagattcacctctgttcactcattaagatcacctgtttttaacagcttcatggagatctagtctgcacagcctctccccgtggacagatagtgggttttcatgtattcagggttctgcaaccatctgcacacgtgtggaacttttccatcacccaaaagacaacactgcctacatgccgccccttttctccccagccccctctccagcccctggcgaccatatgtctagttttggtctccatggatttgcctactgtggacatttcctgtaaatggaatcagacactatgcggcctttgtgtctttgacttaacgtgttttcaaggttcgcccgggttctaatagatcagtagcacttcattgcacgttcaagtccttgaacatactaggtatctgctttaaagtccttttgtgctaattctaacatctggaatttttctgaatgtgaagggggataaacagtgaagtttgacaccctccacactgctcagaagaaagctccgagtggatctgagattcaaatgtgaaaggcccaattatgaatctctcaggagatgctagagataagagaatagccttcagaataggaagggatttctcaaacaggacacagaaagcttaagccttgatggaagaggcagatcaattcaattagattaaaatgaagaaccttggggcagagtttgggttttgtaaaatgaaaagagttctggagttaagcatcgtgaacatgcttaacactactgaactgtacactcattttataataaaactattaaattgtaaaaggtgagaacctcctcttcatcaaagaacataaatagactgaaagacaatgctggggatgaaaaatcattgaccattattcttcaaagtgagtggaaggcaatgtccctgcagggtttgagcggaagagtgggcatggcctggcgggccctatgccagccagttttgctgctctgttgagagcagcctgtgggacag

SEQ ID NO: 2945 - DNA, 1044 bp, Homo sapiens
agacccgggccctgatcctagcacccgcccacccgtgtgtgtgtctagacccgggccctgatcctagcacccgcccacccgtgtgtgtgtctagacccgggccctgatcctagcacccgcccacccgtgtgtgtgtctagacccgggccctgatcctagcacccgcccacccgtgtgtgtgtctagacccgggccctgatcctagcacccgcccacccgtgtgtgtgtctagacccgggccctgatcctagcacccgcccacccgtgtgtgtgtctagacccgggccctgatcctagcacccgcccacccgtgtgtgtgtctagacccgggccctgatcctagcacccgcccacccgtgtgtgtgtctagacccgggccctgatcctagcacccgcccacccgtgtgtgtgtctagacccgggctctgatcctagcacccgcccacccgtgtgtgtgtctagacccgggccctgatcctagcaccctcccacccgtgtgtgtgtctagacccgggctctgatcctagcacctgcccacccgtgtgtgtgtctaaaccaggctctgaggccacttgtgctcatcgctctgctcttagcgtgctatggagtcatgctggcccattgccgtgcagcctcaccgccagaggcttgaagagaaaggcagagtgggtggggaaaggaatctcatgccgtctgccgttcaccctagcccagccatcgattccgaggagcgagttcctgaacttaccggtgaagtagagccgcttcacggagcctacagttgaggggttaggacttggccatatgccagcgtgtagcacagagctttgctcatgatgaggtgcttggtaaaattttgtcgaagtcaatttcacaaatatttcttgagcacctactgtgtgccaggcactaattggtgaataaagcaaagacccctgccttcacagagcttatgccctagcagaaatgaatgaaagctggattcttttactgtaattgtataatatataaatatatgcttcagaattcacctgaggagctgta

SEQ ID NO: 2946 - DNA, 1051 bp, Homo sapiens
cgcaggtccagctgggcagagccgggatgcccacgtggaagctgggccctgcagcgcttgcctatggggacggggtacctgggactcccccgatgagggcaccacgctgagctgctgctctctccgtgcaaagccgcatgcctttcaaaggggccgttatcattcccatcacgggcatttctcagctgtgatttcatttctcccgcctgctcctccctcctcctgcccctgttgaaagctacttttcactaaatggagtcaaatgcaagccagatgagctgctttgtatttctcatgtttgataatgatttaatgctatgtttgtctgtatttagaaataagacactttttaaaattgttgcctcaggttctaagagggtggggaaacagccattattgcttccctgatgaccgctttttctcctgtggacggaggcgctgccgctctcaccccagcaacctcgggtagcacttaccgggaggtgcgctgaggccttgacagagaaagagacagagggctcaggagcagctggtggcgtgcccacgggaggtattcaggtgggtcgctgtctcgcacggcccaagcacagtgggtctctctggccctgtgcaggatgccaccctacagacgggaaatgaagaatgtagacccttcctgcctggaggacgctggcgctccacctgccgcactccgctggtgatgccacgtgggccccactggctctcctgaccccaagccaaaaccacgcctgagcgggtccacaggaggctgtgcagcgcccgggagcttctctgcaggttgggcagatccacctcgggccaggcccctgggtttcaacactacccctcacctctccgagggggtcctgggaaaccccttgctggtgggagaatggatgactgaggaacagtcaccccaacttcaggggttgaatactgtccctgcaaaactcacatacactcagaacctcagaatccggctgtttgggaagagggtctttgcagatgaaacgagggcttgagatgaagtcatgttgattggggtgaccct

SEQ ID NO: 2947 - DNA, 1065 bp, Homo sapiens
acaggtgggttgggtggctcaggagggtcccacctgggacgttccaggggcttcgactgaggcctatgctgggataggggctgctgatggggtgtcaagggacacaaggctgggtgcctgcctgtgcgcacctcagggcagaggaccgacatgggaccctgtagggccagtgacaagctcactgaacctcccgagggtcctctggaacgtttgggatttttcagggcagaattgaaaacacaataaaactaagccgtgtgatgtttctgaagctgtgtctgtctgcatgagattcagacttgtctgctattttattagggaattttccactccttagaacccagcctgattgtaaaccccagagccccatgggccacatccacccgacgctggcagcgcagaggttggtggggggcctggcggaggggctcaagtgcacagctcgttaagtcgacttggaggctctgcctgcctgtttacgaatgtacatccgaggcggcctggtaaatagacaatatggacacagcaaaactcaattaggttctggagaaataaatgagccacatgtgaggagcaggcattattcaaaggctcatgcaactaagggagttgcaagaagcgttctgctctgagaccgagttggttgtttttatatttaattctccagccaccaaatgtgcagtgactccaggttttaaaatcttatcttcagaagaaagattgcctccattatatgttatctccaattgtcattttcatactttgcctgcaagagagagataagctcataggaaggggaggctgagatagccagcctgggagactccggcgctgacgggagagggagaggttttcacaaaggtcgaatccacccgcagcactctgcgcatcagtgcagcgagcctggctctcctccgtcagttctgcgttttttggaaaaaaaggtgttatggcttttctttcttcataaaactggctattctgtggtacagtaggcgtctctctgctagcagcgtgggtgctggccatggaagcctgcagggttaccgcacgggacagaacctg

SEQ ID NO: 2948 - DNA, 1046 bp, Homo sapiens
ttctctggcttccctgggccctccaggatctggaagtttctactcactgcagatgtagctcctcagtctggctgtcctggtgggaacccatctttcctcccttgatgacttcctgtgcgtgggacttgcatcttcagctctctgtgcagaccagggtcacaactattggaatggcttttgctcctgggggtgcgtgtgcaccctggtcatgaggtggccacacagaacctctttccttcccagcctgggccacttccaggagcactgacttctgccccctcccagatgcctggtgaccctgatccctccactgagttgctgcctcttgagatggggcacccatggcacacaagtgatctttcctaaaggaagtcggtctgggaaatggcctttgtcctccgttattttagtttatgtcatccctccctgcaccccccccccccagctttttgaaacattctgttaaaatgtttcttggcttactgtaattgtatatatttatggggaacagtgtgatgtttcagtacacgtatgtgttgtagagtagatcaaatgagagtactagcgtgactgtaatctcccacactcatcatttctgtgtggtcaggacattcagaagccgctcttctagctgctcttctagctcttttgtattttacgggaacttactggtaaccgtcattaccctgctgtgcaggaacagcagaatttagactgtaacttgtaccatgaccccttgacaacctctccctcccctcctcagtctctgataaccactgttctgtgctccgcttctatggtaccaactcttctttttgagatcccacatatgagtaagatcatgtggtatttgtctttctgtgcttggcttattccacttaaccttgatgtctgctaggtccattcatgttgtgttgtcgcaagcgacaggacttcattctttgatcgtggttgcgtaagtactccattgtgtagatacactacttttctttatgcattcatccattgatgaacacctaggttgattctgtgtctccactgttgtg

SEQ ID NO: 2949 - DNA, 1063 bp, Homo sapiens
ttgggtcgaccccagcagccatgggagtgttgggggtgtgctctgctgtaggaatcttctgggtggtcctcatggcctgggctgcatgcttcttccaggcacttctggagacttttgtgtggctttcttgaggactccaggagaagggacacaccagcctccttctacctgtcatgtgatggagatgtcctggcaccaccagaacctcgggtgtcttgggtgactgactccctgctgggttccaggaagagcaggatttgaccttgtgtgtgaggggcggggaccgagagcagtgctgtgctgagagtttggctcattctggaccctgaagaaaaggatgcagctcggctccggcgcaggtccctggttgttggcaatgacagccctgtgcatcgtacaggcattctggttggtgctggggtgtagatgttattatctgagttaattaatttcttggataggtctatggtggacatcatcattgtgaagtcactgtttttccagcattccagggaggagagggtgagaaatgagaagggaggaatgaactctgaacaagagcaagcgtggggtcgcagtctgggtctgtcctgctcactgagctataagtgctctccacgcccacttcggggtgtcttaccctgtaatctgcctgcaatcctctgaaaggaagaaggagacagagggaaggcctcattgtcactgctgttgagttgagcaaagagaacatgaaaacctgtgtctggctctgagacctggtccgtggcttgtccttctggcccctgttctgctggccagggagggccctgtaggcgccgctgtgagatgtcgcctgcttgatactgatcatcaggactaactgtgagttgccgcctggttgatattgatcttggaactagctgtgtgctgctgcctagttgatactgatcttcagaactagctttcagatgtcacccggttgatactaatcttgggactagctgtgagatgttgcctgttagatactgatcttcaggactagctgtgagatgtcacctggtggatactgatcttgggactagct

SEQ ID NO: 2950 - DNA, 1031 bp, Homo sapiens
acagtcaacatggaaaagccagggggttgctctggggagagatgaggcaggctcagagggcaggtctggatgcgggaggagctgaggaggaagagagactgaggggaagagggaggaggacagggaggtagcgtggtaatgggagctgggggccaggccccggtgcgtggtgatgggagctgggcttggagtcttcagacctgctctgcccaccttccctgtcctcatggataacaccacctccctccacgttgcttcacttgagatgcgagattcagtactgggcctgggagggctgggccgacctaggcagctggcccttcccacttttctcccttcatgaccacgcagccactcctgcaaagcagcagagcccagcggtgcctgcttcctgtcaccctccctgcccctccctgtctcgcctcctcctaattggcccctgcttccactcccgcccccacatggcagctgcgggaattttcttaaatcccgaaccagattgtgtcatttctgcttagaatctctccctggcctccctgcatgattggagtgagaacccagcttctcctcgcgccgtgaggcctgcctgaacgctcttgcgcctggcgctcattccttctctcctccctggcccagcctgctgcagtccggtgggctttctgcttagaatgtacctgggactggtttccatttaggggtggtgaggccagcggatcaggagacaactcagctgagaccctgtctgttactcagggctcccaagacgaggggtaggccatgtcccacaggccacctggggaagcgcagggttggtcaggaggcaggagggtggaagggaggcatgggcagagacttgattatggttttgtgggaggactgggccagggagggtgggcagctggacgggcttgcgttggccaaggagagtcatgtcgtggtctctgaggtgcagggatggcccgaggtgtctggtcactgaccctgagagaccatggcagagggtgggactcctggggtgtgtgagccagaca

SEQ ID NO: 2951 - DNA, 1034 bp, Homo sapiens
ccatcatccatccatccattgtccatccgttatccattcatttgtccatccattatccattcattggttcatccatccatctaccactctgtccatccatcatccatttgtccatccatcatccatttgtccacccatccatccatttgttcattcatctatccatccttttgtccatctatccatccatttgtccatctatgcatccatccttccatttgtccatccattactcatccatttgcccatccatccatccatccatccatccatccatttgtccatccatccatcatccattcatttgcccatccattcatccatccatttggtttatccatatatccatccattcttttgtccattcatccatctatacatccatctatccatccacttgtccatccatccatccatccatcatccgtccatttgtccattcatcatccatccatccttccatccacctatccatccatccatttgtccatccatccatccatccatcagtccacccatttccatttgtccatccatttgtccattcatcatccatccatccatccatttgtccatccattcatctatccatccatttgtctatccatccatcatccatttatccattcatctttctacccatccacccactctcctacccttccttccttccttctttccttttatccatcttctatctcctcacccttttaccacctcaaccatcagtctattcacccacccacctttccatccaccctctattagacatctactctgtgcctgtctggcctggggcgatgcagttggttgtgtgctgggagtgtggatgaggacttccatgactgcctctcccctaccctagttgatgatggtgacggctatgagacagaccaccaggattactgtgaggtgtgccagcagggtggggagatcatcctgtgcgacacctgcccgagggcctaccatctcgtatgcctggacccagagctggagaaggctcccgagggcaagtggagctgcccccactgtgt

SEQ ID NO: 2952 - DNA, 1049 bp, Homo sapiens
actccatctcaaaaaaaaaaaaaaaaaattgtaaagtcagctggggccaggtgggatggctcatgcccgtaatcctagcactttgagaggctgaggtgggaggatcacttgagtctgggaggtcgagacttgagcttgggaggttgagactgcagtgagctgtgattgcgctggtgagactctgtctccaaaaccaaaacaaaaaatgatattagttcagtgttgggagacagataaaatattctgttgagacagatgaacttgtcacttcattggtcaatttaatgatttctacaggagcagtttttgcaagaaaggatcaaagtgaacggaaaagctgggaaccttggtggaggggtggtgaccatcgaaaggagcaagagcaagatcaccgtgacatccgaggtgcctttctccaaaaggtacaggagggaagtgtgtgtgtggcctgcgtgcacccagtgcccagcccgccttttccctgcatgggagtgggggcacccgcagagtgattggtttgcatctgttaatttctggaactatgctcagtgcaggaggcagtggatgaatgctattatggttgttaacaatagtcaacttttggtggttttaaaattttgtctttcacaggctaaagtgttttatttttttttgagctggagtctcactccatcgcccaggctgttgtgcaatggcgcgatctcggctcactgcagcctccgcctcctgggttcaagcagttgtcctgcctcagcctcctgagtagctgagactacaggcacctgccaccatgcccggataatttttgtatttttagtagaaacgggggtttcaccatgttggccaggctgctctcaaattcctcccctcaagtgatccacccgccttggcttcccaaagtgctgggattataggcctgagccaccatgcccggccaggctaaagtattttaaacagtaaggtactcagacttgctttcaagactgttttctcaaaaatattcttggctgggcacagtggcttatgcttgtaatcccagcactttggga

SEQ ID NO: 2953 - DNA, 1033 bp, Homo sapiens
caccacaatctccgtttccctggttcaagccattctggtgtctcagcctcccgagtagctgggattataggcgcctgccaccacgcctggctaatttttgtattattagtagagatggggttcctccatgttggtcaggctggtctcgaacccctgactttaggtgatccacccacctcggcctcccaaagtgctgggattacaggcatgagccactgcgcctggccattttattttatttttatttatttatttttgaggtggaatctcactctgtcacccaggctggagtgcaatggtgtgatcttggctcactgcaacctccaccttccaggtttaagtgattctctttctcagcctcccgagtagctgagattacaggcgtgtgccaccatgcccacctaatttgtgtatttttgtggtagagacggcgcttcaccatgttggccaggttggtcttgaactcctgacctcaggtgatttgccagcctcggcctcccaaagtatcgggattacaagcatgaaccgctgtgcccagccaaattttttttttttttttttgagacggagtcttgctctttgtcacccaggctggagtgcagtggtgtgatctcggctcactgcaagctccgcctcccatgttcatgccattctcctgcctcagcctcccgaatagctgggactacaggtgtctgtcactatgcccggctaattttttgtatttttagtagagacagagtttcaccgtgttagccaggatggtctcaatctcctgcctttgtgatccgcctgcctcgggctcccaaagtgttgggattacaggcgtgagccaccgcgcctggccccaaatttttatttatttatttattttgagacggagtcttgctctgttgcccaggctggaatgcagtggcacgatcttggctcactgtaagctccgcctaccgtgttcatgccattctcctgcctcagcctcccaagtagctgggaaacaggcgcccgccaccacgcctggctaattttctgtattttt

SEQ ID NO: 2954 - DNA, 1063 bp, Homo sapiens
ttcggaatagatcttaaagtacccctcttagattattactgcgaagagacgttgtaaaaaataaatcagtgatttttgtagtggccaaatgtttgaaaagttgatccagttaacacaagttttagatgaagttcttttaaacatgaagggaggtaagatgtgtttttggaaaagtctatttagttctgcagagcttttaaacgtgaaagtacaggttggtacgatgcacaagtgcattaatggtgtcaagtttgtagagagataagattaacacaagcttcttcgtaagagtgaagaaactggaaccttgtaggatgtgctttgccgggtggtttggaagtactaatgcatagatgaagcgaatcaaaatgtcagaagttcttgacggtagtgttgtaataagattctaggttttagccttaaccttgtccaagctggagtggacaggcacctagaatactttgcaactcccttcatgagaaggtggatgagacaggattaagggagatgagctaagacggatcaggaccctactctgaacatgtaggacaaggattgatttcatatgaaaattgtgggtatgcaaggcattttgtatgcctgcactctaattttggaaaaatagtatttttttgaaattgggaatgttagggcaaacaaaaggaagtgttcattttattgtggttcataaactaagagaccttcatgcctgtagagattggggagactggaaagtttgagtgagtcaagagtgctagaatgatttccccatcaaaagggcatgaccccaggccccaagcttgtacagcagcatctgccccattatacctctggcactcaggcagtgatgcctcttggccctctggcaaagggagcacacttccgttagttttgtatttgtatggacttttatacctatgacgtttctggttctgttaatcttgtttttccgactgactgaaacttcatctctgttatcatttgtgtattttcttagaaaaagcttgtggtgaaggggggcaaaaaaaagaagcaagttctgaagttcactcttgattgcacc

SEQ ID NO: 2955 - DNA, 1452 bp, Homo sapiens
tgtgatttacagatctctctcatgtaagaggagcaacaggaaagcacgtgagaaaggcctgcagcactgagtgctcagggctaaggtgacagtactgctcccagagaccctgacggtctcagcagggcatgggcacagaaatcctctgggtattagagacagacgcctaccaaagcacagggcgtcatcccacggtcaccctgatgagcctggtgtctccctctgttaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaat

SEQ ID NO: 2956 - DNA, 1077 bp, Homo sapiens
tgcctgctgcccagcatcctatgtccctgactcacatggaaaggccatcggcacttcctctgacttcagagtcaagctctggtctggtctactggccgtctccaggcccttgctgcccaagccaaccagagcatgagactggccactaccccagagcacccagtgtgtgccagacctgggcccagggctatagagatgtggctcctgtccacctcagcctccccgcggaagaagcatggcagtctcttagaggagaaggtgcagggaccttgccccagccacaccgctgctgtgtgggggctttaacctcagcgcggggtcctggctctggaagaccagctgggggctgacatagcagactgcctgccccctctcagggtggtcaggaaggtggtgaccatctccgttccccaacaggtcacttggggaacaggagagggaaatggaggttcagggggtgtggtcttccgggacatgtccttacgtggcctgatgaagtaaaataaattaaggcaagtacgtcagagatgtccactgtggggggctctggcatgggctgtgtgaggattctggaacatttgatggcaagaggacttgttctgggatggtgccaggtcatgcacggggcaagagtgcccatctgggcccaccttggatggttccctgaggatgcaggtaacctggaagggagcccagatattgagctttgaccaggagtggacggaagtgagggaatacgcacttattgggcaccccgtatacagcccctgggtgtcagggacatgggcaggagggtcctcccggggcgtggagaggagagtgcagcctgatgtaagccagggccagataggtcatggtgcgccagggccttccccgccttagggcatttgtgctgttgtaacacagtacttaagacgcagtaactcatgaagaacagatttatgtctcgccgggtgtgggagcacttgccctgtaatcccagctactcaggaggtttagatgggaggatcacttgagctcaggagttcgagaccagcccaggcaacatagtgagactctgtctctaaaatataaaaa

SEQ ID NO: 2957 - DNA, 1071 bp, Homo sapiens
tcccagagaatttcactagcaaaagagtgggcggaagcactgtgtggtggccgcgcgcagcctctgcactcgccctgggatgggcaccgctgcgcccgtgtgcgggctcttacactggcttcctttgtttgtttggccaagattggacttttggaataattttttaattgttgactaatttaggaaattcagctgttactggagtgcagaaggttgacggtgtgttcctggaagggcttggtgaaccgcctgccgcgtttggccattagtgagggaagccctgcccccctcctgcccccaccttgctgccagcccacaggcgtgagtcatggactggaatattcatgaggctcagaatccagtgtcgtgctctctgttccttttgcctgcatttagcgggagtcagtcttgtgatgggaaaatacctgcatcctgaagctgcccctgtcgcctcattggttagcgcttaggaacatccggtggccagtgagtcccatgtgcctagaacccgagcatgggtgctgagaaggaggttggcgcagatgagagcatgtagccctcccctccagcctggctctcgccttccctctgcctgagcccagactctttctccagccacctttcatgtttctgctctgcatatatctctgaaagatccactgtgtccagacagccacacactggcccttctgagcggcactggtaggtagctcttctgatgccactgtggcctaaccggctgcggggggttaaaaacccacctgggcacagtgagctgctcatgttctccccctggaggtttacagaaggctctgctcagagccaggcctggggggcatacaacagagtgtgggatggagccttggggcctctctgtccccactgctgtcagatttgtgacacggacagagtgagcactgccaggaggggggctgtaccaggagaggcccgtgggtgggatttccagaggattcagtgaaccgagggagcatcccggctagacccagggtgctgcggaaggtgagcgagagatctgtcagggaggcctggaaaggttgttgggcccatgtg

SEQ ID NO: 2958 - DNA, 1040 bp, Homo sapiens
acggggggacttaattttcagaagccacaatttctggcaggacattcacttggattggcttccttcacgcagtgagggcaggttgggtgggctcgcctgattcccgctgtcccaagccacacccagggcctgacagtgggccgcccaggcccccacctcgtctcggctgtggccggggcctcctgggtaaaacactgggccccttaccagaaacagaaagactgttgttttcttagatgacatcttgttttgtgtatagaggaatttggaccaaactgaaatagcagccatggagtctggcctgtttctatgccagtatcctccagggcccactagactctgtcacatccaggggccgttgaatgctgtcacactcgtgtgttgttttccagaggattgtcacacctgccaggtcctttgcagggaggcgagggctgtgctggccgagtggggccagggttgtcagagcagggtcatcatgcttgctcctaggatactgcaccttagatcagctcgctgcctcccacgcttgccccttggtagggaaacagagcgaggctgtgcggggaggcacggcccctgctggctctgggttctgggtgacactgggtgggtgtgtgagaaaccgcggggggctggcctcacagttccagcgtgactttctcatggactctgctggggccgctgtacaccctcgagccccacacctgcctctcacttcgaccataccatgaaggaggtctcgagggccagaccctgctgccctgccgggtgggggcacacattattgtggactatcccagtcggtgtcaagagcccagggagctactggcaggcacagaaacctcacctcgggttgcacgtggtgcctggcagagctttgtactgtagagaatgggcattgctttctggtgggctcagaacaacagacatctgttcgcccccagttctagaggccagaattctgaaatcaaggcgtcagcagggccaaggtccctctgaagtcaggggaggatccgtccctgccccttccagcttct

SEQ ID NO: 2959 - DNA, 1052 bp, Homo sapiens
ggtttcactctgttggccacgctggcctcgaactcctgaccttgtgatccacctgcctcggcctcctaaagtgctgggattacaggcgtgagccactgcgcccggccctacttttttctttagtatgttaagctgggagagaaccaagctcaagggtcatcagtggccttctgccctatgaaggacaggcttgaagccatcaccaggtgtccccgtggcactgtggggaaggctactggatggttctgtgtgaggggtgtcccgagggacagcacagagaggtgcgctctgccttcctcctgcctcaagtcactctttgagtgaacctgcttttgtgcctcctctgagcgacccttggacctgcccctcacatcctggcctgcaaggcctggcagcctgcctctttggacctttgtccatgtctcccactgcgtccctgtgttctggtggctccccaccacctccccactcctgctgctctttcctctccctgtggtaccaacgctccccctacctcctcctgcctaacacctggtcttttaggcctcagctcagatgcctctcatctgaagtcacaccctgccttaacatcgttgggctgtccccatcgtggcgtggccccatttacttctcgtccgtccccccagctagaacccaggcttctctgacccacacccctctgtacacccagcactgagaggccccacagatgctgccagaaaccagctgcagagcagggaggtggaaggcctctgccccggaaaagcatgcgcccataggtctgtttgatctgtgtcagcatagcataccgtaatgtacttaatcaccctcaaacaacacacacttggcttcattccacttttaggtcttgcagacagtgcttggctccttccaagatgggcattgccctgcccagaggcggtgcctaattcttgcctggctctgtgcagccctgccctaacagcctttggccaatgggtggcgccatagccacatacattgacttgggggtgaaagagacagttccaggcatcgctttactgtgacctgtt

SEQ ID NO: 2960 - DNA, 1029 bp, Homo sapiens
aggatttcactatgttggccaggctggtctcgaactcctgacctcaaatgatctgcctgtctcagcctcccaaaatgctgagattacaggcgtgagcccctatgccctgcctaggttttcagtgtgggtgaaacagctttctgttgaaagaagataacatctaggactttcatagctagggaggaaaagtcaatgcctggcttccaaggacaggctaggtctggtgactcacgctgtaatcccagcactttgggaggctgaggcgggtggatcacttgaggtcaggagtttgagaccagcctggccaacatggcaaaaccctgtctctactaaaaatacaaaaattagctgagtgtggtggcacttgcctgtagtcccagctactcaggaggctgaggcaggagaatcgcttgagcccaggaagtagaggttgcagtgagccaagattgcacctgccacagcactccagcctgggtgacagagtgagattctgtctcaaaaaaaaaaaaaaggacaggctgactctcttgttaggggcttatacagctggtgactttaagttgaagccaatgctcatttactattctgaaaatcctagggcccttatgaattatgctaaatttactctgcctgtgttctataaatggaacaacaaatcctggatgtcagcacatctgtttatagcatagttttctgaatatttttaagcctgccgttgagacctactgctcagaaaaaagatttctttcaaaataatactgatcaggccgggtgcggtggctcacgcctgtaatcccagcactttgggaggctgaggcaagtggatcacgaggtcaggagttcaagaccagcctggccaagatggcgaaaccctgtctctactaaaaatataaaaattagccaggcgcagtggcaggcgcctataatcccagctactcaggaggctgaggtaggagaatcacttgaactcaggtggcagaggttgcagtgagccgagatcgcaccactgcactccagcctgggcaatag

SEQ ID NO: 2961 - DNA, 1047 bp, Homo sapiens
ttcttctaagagttttatagttttaggttttacttttcggcttatgatccattttgagtttttttttttttttgtatatgctattaggtaaaggtgcaactcattcttttgtgtgtaaatatccagttccttagcaccatttgttgaaaagattgtctttccccattgagaggtcgtcttcttgttttttttttttttttgagacggtcttgctctgttgcccaggctggagtgcagtggcgtgatctcagctcattacaaccttcgcctcctgggttcaagcctcagcctcctgagtagctgggattacaggcacatgccaccatgcctggctaatttttgtatttttagtagagacggggggtttcaccatgtcggtcaggctggtcttgaactcctgacctcgtgatcctcccacctcagcctcccaacatgctgggattacaggggcgagccaccacacccggccgaaaggtgtttatacccttgtcacatagatcatttgaccatatatatcatttgagtttatttctgggctctctgttctattgattcttatatctgtctttatgctaatgccatactgttttgattattgtagctttgtggtaagttttgaaatcagaaagtgtgaatcttccagctttgttctttttcatgattgtttggctatttccgatgtgatttgcaaatatttttttccactcactgggttgtctttttactttttctttgctgtgatgcccaggctagagtgcagtggcatgatctcagttcactgcaacctccgcctcctgggttcaagtgattcccctgcctcaacttcccaaggagctaggactacaggtgtgcaccaccacacctggctaatttttgtattttttttccagcagagacagagtttcaacacgttggccaggctagtcttgaactcctgacctcaagtgatatgcccacctcagtctctcaaattgctgggattataggccaccacacctggcctattttctttaaagagttttataggatagatgctgtggctcacat

SEQ ID NO: 2962 - DNA, 1023 bp, Homo sapiens
ccttgtgtgtccccaagacaccttcttggcctgggagaaccaccataattctgaatgtgcccgctgccaggcctgtgatgagcagggtgaggggcttctcagtgcttggcagggagttcctaaggacaggcctttctgaaggaagtggctggctcgggcccaaacttggggtgtgagggtcctgcacccacccttgccagaaccctccaccctgatcctccttcagggtgcccttgccccttctctcttcctggtgaccttcccatctctccatgtgccttggcctctggtcggccttaatctctgagcttctctcttttttagggtagccctgtacctgtctgtctttcgcctatttctgtctccattatcttgggataatgcctctgcctctccatgggagcctttggccctgactaactctccactccccatctccctgcacccccaccagcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgtgagtacccccacccagggctctctactcccagacccccttctccctgcctgacccactcctgtcccatggtgacgcatgcctctcctggattgcaggttcccgcagagatactgactgtgggacctgcctgcctggcttctatgaacatggcgatggctgcgtgtcctgccccacgtaattcctagctgtcgtgggatggagggaagggcggctgggagcagagcaggggcctggggtggggcaggtgctgctggttcaggaataggaagaggggatagggaggagggagccttggccctgtgatgggtgggccccacttcaggcaaacttagatggcaaaagagcaatctggatccgccttagccagatacataagggtatttgccttcactttcagc

SEQ ID NO: 2963 - DNA, 1051 bp, Homo sapiens
agcaggggtgctactgggcctcagagagtgaacgtgtggattcagggagcgttcacagtggaacctggcacccagagaacactcttaaagtacttcacattagccgggcgtggtggctcacacctgtaatcccagcactttgggaggccaaggcgggcagatcacgaggtcaggagatcgagaccatcctggctaacacagtgaaaccccctctctattaaaaatacaaaaaattagccaggcatggtggcacgtgcctatagtcccagctactcaggaggctgaggcaggagaatcgcttgaacccaggaggcggaggttgcagtgatctgagatcatgacactgcactccagcctgggtgacagagcgagatgccgacttaaaagaaaaaaaaaagaagtacttcacattactgtcatcaaaagtagattccaccaccagagtatttgcaacttggaatccaggctgctaataattgttttgggaggaaagcatgatagtgttaggattcgggatgatgaaaaaacaaaactagcggcaggtagcacttctgaaatgcttactctgtgcagtactctgttctaagcctgtgtaactccactacttaccgtggtcctgttattatccccattttacagatggtaaaagcaaggccagggactgggagtcagcttgcccaaaatggtgtagtcaaagttgaggctaggactgaagccgcaggacgcccgactctgagcccaggtctgtgctctgccgcacagcatgtccggttttgagcgcttgctctgtgccaggcactctgcgaagcatggaggggctcagtgacttcatggccaccctgtgagagaaaggctaagacgtgcttcatttacagctttgagcattgggcattgtcaggtggaagcatttgccttaggtcacataggctgaagcggcagacctgggcagcaaggatatgtttcttgggcccgatggtggtgtgggctccaggcctctgagttatctcccctggagagtctaagtcactttgctaatggggttttagtttat

SEQ ID NO: 2964 - DNA, 1018 bp, Homo sapiens
ttttttttttttgagatggagtcttgctttgtcgcccaggctggagtgcagacggggtttcaccgtgttagccaggatggtctcaatctcctgacctcatgatccacctgcctcggcctctccaaagtgctgggattacaggtgtgagccaccgcacccagcccagtttttactcttaagtttaggtttttgatccattttgaattaatattttcatatagtgtaaggaattggtccagcttctttcttttgaatatagatattgagattttccaccaccatttgttgaaaagactatcttgaagattgtttgatcttatatgtatgggcttatttcctggttccgtttctgtttcatcagtgtacatgtctgtccttgacccagtatcatattgttttaattactatagcttttcggtaagttttgaagtcagtacaagtgccttacccatttttcagttgggttatttgttttcttgctgttgagtttcttgtgttccttacatattttggatattaactctttatcagatggatgatttacagatgttttctcccattctgagggttgtctctttggaattttttcctttgttatgcagaagctttttagtttgatgccatctcatttgtctgttgttaacctttgttttcggggtcatatccaaaaaattgttacctagaccagtgtcatgaagcttttcctctagtaggtttacagtttcaggtcttaatacttaagtctttattccattttgagttgatttttgtatatggtgtttgataaggatatctagtatccttcttctccccgtggataaccagatttcccggccttatttattgaagactgtccttcccccttgttttgttattagcacctttgtcagaagtcaattggctgtaaatgcagtgtttatttccaggctttctatgctgttccattgggtgatatgtctttttttatgccattaccgtgcttggtttttgagagagacagtgtctcactctgtcaccc

SEQ ID NO: 2965 - DNA, 1002 bp, Homo sapiens
ttgggaggctgaggcaggagaatcgcttgaacccgggagggagaggttgcggtgagccgagatctcaccactgcactccagtctgggcagcaagagcaaaactctgtctcaaaaaaaagagtaactcccttaactccctcttgtcctcctcttgtcctctttcctagcccctagagacttcacctctgttctactttttgtccctatgaatttggctattctcatgtaagtggagtcacacaatacttatcctttgtctggcttatttcactcagcatagtattgtcaaaatccatccatgttgtagcatgtatcaaaatttaattcctggccaggtgccatggctcacacctgtaatcccagcactttgggaggccaaggccggcagattgcttgagcctgggagtttgagaccagggtagcatggtgaaacccagtccctattaaaaaaaatacaaaagttagctgggcttggtggtccatgcctatagtcccagatatttgggagtctgaggcaggaggatcacttgaacctgggaggtagaggctgcagtgagctgaaattgcaccattacactccagcctgggtgacaaacagtgagattctgcctcaataaataataataataataattctttttgatggctggatgttattcaattgtatgtgtatatcacatttagtttatccattcagctgttaagggacacttggcttctttccacattttggctttcgtgaataatcctgctatgaacatgggtattcaaatatctcctccatatcctgctttcagttctttcaggtgtataccgaggagtggaattgctgggtcttatggtagttctgtgtttaatgttttgagaactgccaaactgtttttcacagtagctgcattttacattcccagcagcaatgcacaagagttctgatttctccgtatcctcaccaatgcttattttgattatagctgtctgagtttgtgtgaagtaatgtctcat

SEQ ID NO: 2966 - DNA, 1051 bp, Homo sapiens
tctctggctcacaactgtgtgaggcttgattaatttagtactgaagaaaaaaatatgcattttttcaccttaaagtttaaattgttgatttcagagtccaactccccagattaaacctgaatatttagccttgaggtctgttggcatcagaagagagaaaaaaaggaaaggccttcagttaactgagagtaccctttcagccctggaagagttagtcaatgtttcctgtggtgagtaatacacattgatcaccctgaatgtctgtccaccagacccccagaggaagattagtcataattcgagtccaaggaagacggctaattctagcgatcaatgtttgtttcccattcagaagaagtagatggctgccctgtcattctagtttgtggatcccaggatgttggaaagtcaacatttaatagatacctgattaaccatttgttaaataggtaagagtgcttttcttatggctttgacacattgctaggtttttgtcatgaagtgggatttttgatttggagggaatgcttcttggcttctagctagagattacatacaggtctaaagctgcccagctgaagcatctggtcctcactgccgtctgctttgcagtatgtgacaatgctctagcgtaggctgactttgccttacctgcaggcagacttccaagaggagacacttggtctcagagtctgtatttataagttctggggtggggggcggggggggggtgcgtgtgtgcgtgcgtgtgtgtgtgtgtgttttcagacagggtttccctcaggctggagtgcagtggcacagtcatacctcatagtcttgaactcctgggctcaagtgatcctcctgcctcagcctcctgagcagctgagactacagccatgggccaccatgcctggctaatttttttatttttgtagagatgaggtcttgctatgttgcccagtctggtctcaaactcctgggaattttcgcttaatttttttttttttgagaccgggtctgactgtgttgcccagcaaaaagtgtagtggcacaaacagggcttgct

SEQ ID NO: 2967 - DNA, 1035 bp, Homo sapiens
tttaaacgagagttaactgaacagcggtggcgaaagctgctggtggtcaggtgagacctgagaaagcgctggctgtagaggccgggaagtagcctgattggaatggggtcaagagcctgggcggagagggactcacaggcttagtagtaaagtattttgctttggtagaagttagctgtaaagggaagaaaagaaatgaagcactagttgcagggataagtatgatcaggagagttttgtaattttgttaagatggatgaaaaaaacatgctggaacatggcagatgggaatgatccagaggaagggggaggtaaccatgcagcagagagaggagaggctgctggaactatgtaagttggctaccagggatgggtccggttctggcatcatgtggccttaggagcatagccaggtcattcatagtggctagaggaagtcccttggagagggccagaggaagtagaagttgtcctctgattatttcctgctgcactgggaaatgaaatcaaggtcgtcactgtgtgggaagcagatagatacgaggtgggtgtggggaatttgaagtgaaaggagagaagaaatgagagtgggacagcgaacggactgttgtgattgccttttagtcttttgcagagtccagtagctggaccaggactgcagaggaggagatggaattgcctgttctcaagccttggttactgaaagtgaatgttccagatgctatggggcagccacattcttttttcatttattttcagctttatctgtttttctgggacttcaccaccactgttcatatttcttatgctctttcttggatacttccctccctatcccaccctctggatgtgtcagtagattctggagttgttttttcacataagggagatagtaaacttgattatctaattttgttagatattcttgatttgccctcagtgattgataattgcacacagtgtagaatggttggttcaacagacttttttctcaaattgttgaaggccttgttctgttgttttctaagatccagc

SEQ ID NO: 2968 - DNA, 1047 bp, Homo sapiens
gtgatccacccacctcggcttcccaaagtgctgggattacaggcgtgagccaccgcgcccggcctactagcccagtttcttaatatatagtggccaggttagttatggatgtctgctaaccacggtcctctaatccttggatcaagttgcagatgttccttgatttacgatggagttacggccgaataagccatcttaaatcaaaaatatcgacctgttggctgggcacagtggctcgtgcctataatcccagcactttgggaggctgaggcaggtggatcacctgggggcaggaattcgagaccagtctggccaacatggtgaaaccccatctctactaaaaatacaaaatattaaccggacatggtggtgggcgcctgtagtcccagctacccaggaagctgaggcaggagaatcacttgaatccaggaggcggaggttgcagtgagctgagaagatcacgctactgcactccagcctggacgagcgaaactccgtcaaaaaaaaaaaaaaaaaaaaaagacctgtccaggctcaagtgctccttcctcctcagtcgctgagactacagggcgtgccgctacacctggctaattttgtgtcttttttgtagagatgggggttttgtcatgttgtccaggctgtccttgaactcctggggtgaagcaatttgcctcctcagcctcccaaagtgctggggttacaggtgtgagccaatgagcctgcctactgttattttaatggcataaacatcacctccagagcttagaaaggagagaaagaaacttaggcaattgatgtggagctctttattaaagaaaccagctgttagtttacccttcagcaccttgaatgaagtgtgaatttctgttagtaaaatgaaatacctcttttcaaccagaagatggggctggactcccttggaaagaaactgcagaggctcttttcgggaaccggtttcctgtgctcgctttgcctgtagtttctgtcactagtacccagctgtggtcactagtacatcagaaatcacacagcagctccaaaaat

SEQ ID NO: 2969 - DNA, 1031 bp, Homo sapiens
gcatgcgggggtggggggcacaccggaccgcagtcggtgctctgcaggtggcggggggctgcgccgggaggggtagggggagccagctggtctcctgacctcagcctgggaggcaaggaacagaggggagcagttttttctttggagggacaccaatgaaacatgtgcctttgaagcctgggtctcctttggatctgtggcagcagacagctccatttggcaaaggttaagatgagacattaacaatcttccacccccttcttttagagccctggcaagaccagtgaattgaatgaaggaattatacctagaggtacatacctgagcctgggttgctgctatgagataaaacaccattaatgccttctctttttccttttcaaacagttggaatttggagctggagacctacaggggcctttgttcggtctcaagctgttccgtaatctcacaccaagatggtaaatatgagagacagcagctcctctttggtggtctttgttggcttaggagactagaactgtgtgttctttttatcacagtggttggcactatcttgtctgtcctacaaggtcactgcgtacatcaagggcaggtatagcactggcgtgaagcccaggcagtgtgcaggtgggaagaggcaggattgagggggccggacccttgtcccagccctggccaggctgcaccatccaggtctcgcacctcccttacctatgccacaaggccacggagaaagagtgccttcagggagagttggtcagtggaccgaaacacttacagacttatggatcgttccattgtcccagagaatgacagactgcctcatcatcgggttgattgacatatgccagagatgtagtccccagccagcctctgcttcctgtcgtctctgctgctgccatgtcacactcctagaactgtatatccctgtcccttctagaacgacagcagtgtcttcatttcctatatggtgggtgcagtgatgtctgtgtgagctcagataaaagaattggtggagggtaaataat

SEQ ID NO: 2970 - DNA, 1074 bp, Homo sapiens
ccatttgagataaagtgattctgtgggaagcgtcatgagtgccatgctgggttcaccagttataaaacaggtgaatttcacattgcctcgtatcacctcttttggtggaattttcagttagtaaagagttccttttgagattgcagttgacagaaatttcttatgttaccctcatggccagataaatataaacatgaaaatcattccacctgggtggtggtgaatgtgttaacgtgattgtgaccatcactacacagtgtctgcgtggatcaaatcagcacactgtacacctggcacgtgtgcagtctctatttgtcagttaaatgttttacatgtttttaagaagatttgaaaccaaaaaataaagaatttagaatggtacattcctggctgaataaacaactgattctactcaacgagtacaaatacatcatttcctacctggtaagaagtttctcattgtgggagaaaggctgtaactcaggctcagaatttctgagtgatgtcagtgaagacgtgtttatcacattcacagttgacccaaggcagaaggttctaaaagagcccagtgaacaagaatgaagggattaaactgcaaaataacatttaacagggagaaatgtgctagctacgaaaggggggaatcagggaaaatggtcatctttcgttgacttggtttaatattagcaattttgtgggttggaggtgggtaaaaatggttgatttattcgcaaagtaatttaatttgggtgcctgtaatgtgccagacactttaggaatgtgaacattccgcagagaataaaacagacaacctaatcctgccatgaagctgaataatctagttgagggacagagaagctgcagtaaatgcaatatataaattatatattaagactgggcgtggtggctcatgcctgtaatcccagcacttgggcaggccgaggcaggcagatcatctaggtcaggagttcaagaccagcctggccaacatggcaaaaccgcgtctctactaaaaatacaaaaattagccgggcttggtgacgtgctcctgtagtcacagctatttgggaggct

SEQ ID NO: 2971 - DNA, 1053 bp, Homo sapiens
cttctcatctgcatgtcctcctggctccagtgggcagttggtatttggcctctggcttgatgggaatagcagtgcttcctgtcacattggttcattgcagctaggtattaagccaaataacttagcattttctcatccaaaaaggaaagtagaattctgttgtatttattcaatttccccgtcactctttatacactccttaaagcttctttgtttttttaagatgtgggttggctacaatttttcaagtcagcaattggagtcactgaaaagctgtaggaccccattacatattccctcttcaaagactaggtttttagtccccagcagcattatcccaatcagtggagcactggggtctgctggtagaatattgtatggcttcctctcatcagaccagattatcttcccattagaaacaaagcaaatccacacgcaaaatggtggttatacaaatatatagggctgggtgcagtggctcacacctgtaattccagcagtttcaaaggctgacacaggagaatcacttgagctcaggagttcgagaccagctggagcaacacagtgagatcgcatctctacaagcgataaaaaatgaaaaaattaaccaggcatggtggtgagtgcctgtaatcctacttcttgggaggctgaggtgggaggatcgcttgagcctaaggaggtcgaggtttcagtgagccatgatcacaccactgcactccagcctgagtgacagtgagactgtgtctcaaaaaataaaaaatgaaataaataaatgaaaataaaaataagtgcacagtcgtgggtggcaagtggttaaacattattttcgtatttttttagtaaactaaggaagtcaggttctcatagatcagaattggcttttttttttttttcatgtggatactaagcttttgctgcaagataaaaatgctttcaaagaaaactaaatgaagacacctccccagatatttactcggatatgtattagtgcttaacatccaataggaaaattgagcccattattcataatacacagaaagtctcattgaa

SEQ ID NO: 2972 - DNA, 1071 bp, Homo sapiens
tagctatttgggaggctgaggcgagaggattgcttgaacccaggaggttgaggctgcagtaagccatgatcacaccactgcattccagcctgggcaacagagcaagaccctgtctcaaaaagggggagaaaaaaagcagatacagggagttgatatatcagccctaaccctgctgagggtctcaggatgaacccagggggtggatcctgttgcagaggaggaagaagggaatttcagtctgttggatgcctgttatctgcctgctgttgtgccaggcactcacgctgctgctaagtctcctgcaagcaggatattccatagagggtaagacgaaagcttcaaaaagtcagataacttgctcaaagccacacagctggaaagcagtggatctgggtttcacttcagagcctgtgttcattctgccctattccaagcacctaaaaactcttaccattaagtagatatcatttgtttaacagaacagtctggaaatttctacaaaggatttttttgttttttgagacaggatctcactctgttgcccaggctggagagtaatgccatgatcttggctcgatgcagccttgatctctacaaaggaattttaccacagtgattaaagttcgagatgcacaacagaaagtccacatcaactgatttcattacacctgttacatttcaatacactccagggaaatggtagtcattaatattatataccaaatatctctggttgctatccctgggggtgctttgcactggcctgtaccctttgaagttagatgtgaccatgtgactttcttgagccaatgaaacatgaataaatctgatgtgtattattacagatagaagctttaagagccagtgacctgcccaacacattctttcccccggccctggcaattgtgcaagcttgtttataggaaaaggtagcctctgccagccggggcccctgtgtgaccatgatgagtagggccctccctagcaattgtagttggacttgtagcatgaatgagaaatccagtcctgagattgaattggttgttactgcagtataatctaacctctcct

SEQ ID NO: 2973 - DNA, 1029 bp, Homo sapiens
atggaaaagtattctaggtgccagtgttaggatgtcagttttacaaaataatgaagcaattagctatgtgattgagagttattgtttggggatgtgtgttgtggttttgctttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatgataccattagtaatgtttcttgcctaaagtcttataaagtgtatgaagcaatttgacagcattatttttaagcacaagcgaagattctttgaagtttaatgtattcttgaaactcttattctttagaatgaaacataatttgtgcaatctttttcacatattatgaaagtatacagtggaaatgagctgtttgtttttacctttaacaactgaaagagaactggattctggggttactatcagaaacaacgttgggggtgggagtccacatcaaggagaacgtgacagaagaaaccagttctgatgtgtagacttggtttgactcattctgatttttaggacgaggtcccggttactctgggccctttggcagg

SEQ ID NO: 2974 - DNA, 1032 bp, Homo sapiens
gctgctttacttgacagcttcatctctttgggtcacttcctgtcctgtcagattaaatccacaagtgtttgatttcatttggtttggttgggagaatggacggttatgaggaataaacagaaagggtgtagggtgctttaaagatggccccaggcgactttctgccgctcagaaagtgtggttcatttccagcacacgttgttcaggacagtcccttgggatgagtgctttaggtttgagaaccgccctctggcgtgagcccactgatttccccacctcttccctgagctccacaccgaccttcatgcagccagggacaggcagggcggcctgttgtttgccaaggtctgggatttgctgagaggctgatagggtgtgccttcaggcttctgcctgtgggttgggctcaggtgggtccacatggggactgggaatctggtgtcaccagtcttcggtttgggtgggcagatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaaggtcaggtgctggggggatagtagggcctactctgtccctccctcacattaaaactggtttgctggtattcgtgatcagctccctcagacacgaggatgcagctcattcatggagcctgtctggacaccagcattgtcctggcctaggggctgcagaccgaaggctgggggcctagagaagggggctcgagcaccaactcttgggggccacctctgcctcaagcttcccaagttctcagaaagtgtggggagtggttagaacggctccctccagagccaagtacagtcctcccttggtatccattagagattggctccagagcctccaccgcccaggataccaaaatccacaggtgctcaaatctcatatacatcgacacatggtttgcatgtgaccagtcac

SEQ ID NO: 2975 - DNA, 1071 bp, Homo sapiens
ctgcctgctttcatgcagcatggtgttgctgcatgtgtcggtggtctgtgccttttaattgccaagttgtagtccagtgaatgtggggataccattatttgtttatccattctcctgcttgtgggcatttaggttgtttccagtttggactgttaagaatagtttctggctgggcacggtggctcacacctgtaatcccagcactttgggaggccgaggcaggcaaataacgaggtcaggagatcgagaccatcctggcaaacacagtgaaaccccgtctctactaaaaatacaaaaaaaattagccgggctggtggcgggctcctgtagtcccagctactcgggaggccgaggcaggagaatggcgtgaacccgggaggcggagcttgcagtgagccgagatcgtgccactgcactccagcctgggagacagagcaagactccgtctcaaaaaaatatatatatatagaatagtttctatgaatgtatccgtgaaagtctgtgtgtgagaattttttttttcttttgggtaaataagagaagaattgctgggttgtttggtagatatcgtggtttgagcattctgtatttccaccagcagtggatgacagttctggtcaccctgtcaccttcctgaattgtaagtttaccgttcttaccacctgtgacttcactgctgtggaggacagtccttcctgcctggtcattttcttttcttctttttttttttttttttttttttttttttagtaaaaggcgaaagatttattcgatttgaagagaaaccagttgcctggtcattttcatccttggcactcagatggtgaaatctgttctggactacttcttctttaagtgtcaacaaaaagttgatgttgatttcaatgttagatttctttcttttgggtcttgatttttttcacttgttggcagagatcagtgaagccaggagcaaaggtttgaaagttaagccttttttctgtctggcatggggcagtttcttacctcactgaactctggcttcttgtttttaagtgttcttttattttttttaaagagatggcctctcgc

SEQ ID NO: 2976 - DNA, 1063 bp, Homo sapiens
gaggaagcattttcagtggctgctgagcgaggaagcattttcagtggctgctgagtgaggaagcattttcagtggcttcctaagccaccattccatgatactcaccttcagagcagccacttccaaacatcggcatgtggattgcgttttcactggcccataagaaataaatgtagccatttttcctaacagtaaatgtaatcaaagaactttttctgtttacttttttggagataaaatgtcatttcttttacaaaataatgatgagatcaggaggcagttacttctaatgaccttacatggcaaaataagaaagtggcaattcggtatccatttctcaaaagttttatccttttaatttcaggtgaattttaattctccagaaataatcatttcatcagatgtttactgaatacttattcaagatgttgtcttagacctgtggggtactcacagatgagatagcacgtactttggcaagttgggtgggcccatgtatggttacagcacagggaagcctgtctgtgccagcacagaggcgggaatgaaaagatgtaggagtgaaacctgtatgatgccatccagtggtgggggagtgaagtgaagggaaggcttcatggagaagaaggcagcaaatgtgatgaattgagtcctgagtgatgaggaggactacagggcctggacagaggaggaggtgggggtggtatggggctcaggggctcacccagcaggcaggagagtgctgaggaacagaaaactggccattgtgtttgacataagccaaaggccgtgaggcgggggaatatggtagaaaggaatatggtagaaaagtcttccggtaacacagagaaagtctcagaagaagtagtcaagcagctgggcctttgttccttaggccctgaggaacctttgaccgtttggagaagaagtggcaaggtactagcggggctttgggaagactcacctggtctgtgtgcagcatgggagggccggcccagggaagagctgtggcaggacctcaggtccagacgtctgagtggaggtgtggggccagggtgggatt

SEQ ID NO: 2977 - DNA, 1050 bp, Homo sapiens
aaatagaacctccctcagagtcgtagtgaaagtcgaataaggcagcagtgattgagctcttattatgcactaggcactgttctaagcacttgaacttacttaaccttcatagcatctccatgaggcaagtggtggtgttgccatcacaatacgtgtgaagagaaaggaggcagagagattatgatgacttgcccaaagaacacagagttcacactgaattggaactggaacttgggcagtgtggttgcagagcacccagtcttagctgctgtgctgtttctgactcagtatctgtcacatagtaaacattccattagaatcagctcctgtttctcctcccagggaagacacacagtacattttgcctgagataactgtctcaccagatgtgtatacagtcacgtggtagactggaaagcacatttgtgagtgttagttctcatggtcctttgagttttcccttacctttaaaatgcaaagatgctgttgaaagtgaataaactgatactgtggagaaagcatgatatatcacaaagaatgccattgtggaaaaagttcactttgactgcttaatgagggggaggggtctcctttgggggatgatgaaagcgttttggaattagatctgagggctgcacgcattgtagatgtattaactgcctctgaattgtaaactttaaaatgattaattttatgttatgtgaattttacctcaataacaatttttttaagttaattcgagttgggttttacctttggaagtataattacaaagcgggcaatacttcatgctgttaaaattaaacttgatttattagacggctgactgcttccgttgttatccacagctgaaaaggagatgaagatcctgcttgtagctgagcagtctttagaagtctgctgcattcttcccaaattccatcactctagtcaagagtaagaggatttgataataggggactggtttcctctcggctctgtgataactggggactggttccaggagggcaggtactttgtatgtgagttttcatgtacttcacattatgt

SEQ ID NO: 2978 - DNA, 1050 bp, Homo sapiens
acatcgtgagaccctgtctctacaaaaaaataaaaataaaaaaattagccaggtgtagtgccacacacctgtagtcatttgaacccaggaggttgaggccgtagtgatccgggatcacaccactgcgctccagcctgggaaacagagtgagaccctgtctcgatttaaaaaaatattaatctggtggattgactcactcagaatcctactgctgcagttaaaaatcatagtacatttaagtttggctttgtagttgttagggggaaagggaaggggtctgtttttagtaatttttttcccccttgaaaacacagaaaaatttacagtagaaaattaaaatcaggccggctgcggtggctcacacctgtaatcccagcactttgggaggctgaggcgggtagatcatgaggtcaggagatcaagaccatcctggccaacatggtgaaactctctctactaaaaatacaaaaattagctgggcgtggtggcgtgtgcatgtagtcccagctactcaggaaaatgaggcaggagaatcgcttgaaccaggaagttggaggttgcagtgagccgagatcgcaccactgcactccagcctggcaacagagtgagactccgtctcgaaaataaaaagaaaaatcagtaattccatcactaagagatggccactaattaacgttttggcccatattcttccgactgtttctaggcatatatcaataaatattttaaacagaaatggcctcattcagttctataacctaatttttaattttatttttattttatgactatttaaaacttatctgtattgatcttttgcttaacgcatgtatctatggagtcatttttgatggttgcatttttaaaagatatcatgttattaaccaacttctagttttgatcatttattttcagtttctggggtatttttcgggggtggttactgctgcaaaaaaatttcttaatgagtgactttgtcttatctgggggcagttatttccttaagattcattcctagaaatatttatttcaagtagtgtgtgcattttt

SEQ ID NO: 2979 - DNA, 1028 bp, Homo sapiens
gctgtcttttgcattgcactggaggagtttggtagtagggtaaatctgtaagtattataatgagctgggagaggcactcatcttgtgttttcttattttctctagttatcaacatagccaagctaatcattcacagcccacagggaggggagggcagaggtcattttttactttttgctgcagaagatgagatttgcatgtaccagtgttgttgattcagaacttgctgggtagaattcttatagtcatgccccttttgatagcaaatccctctaatatagatacttttcacattctctctctctttctctctctctcttttttaatgagacaagatctaactctgttgccctggctggtctcaaactcctgggctcaagtgatcctcccctgaatagctgggattacaggtgcacgctaccatgcctggcttacattttcttctgtctaccagaattattaactcatttctttgttattcgcaagtgacttggaacttgagaagggtgtcagcatccaaaagaacatgcctgattgggcattggtgcaagggtcagcagacctgtgttctattcttggccttactggtaactatagtacttgatgatctctttttaattgtgcagtctgccttgagctgttcattggaaagctcaggtcaaatcttgacaacactgggaagttattttctgtaaaatggtgtttctctgcatgagaattgtgtaggtgctgtggtcgttataaaatgcctgtacgtcgttacttgctgcagtgcctgagaacgaagtgatgattcttgccttctctgctacttacttgctctggaaccttaggcagattattcatcccctctgtcctttaatttctgcgtttgtaaaatggggtgataattcctacccttttgattattttgagaatttaaatgagataatgtttgtaaagagtgcatagaaatacttggaaatgattgttcttcctgtctaccttaaatactacataaggtggtagctaaatgctttgaaaagtac

SEQ ID NO: 2980 - DNA, 1025 bp, Homo sapiens
ctggtggaagagggggacagattgcttcttagcctcagacgcaggacgtccttctcttaaacgcgctgccctgcgtggtgggtgggattggggttctgatgaaggtagctggggcctgccctggccagtgggtcccagctgagctgctgacatactctccgagcctcggcagtattccctagccgagactttttttgtggttgttattctgctgattgtagatatctttgctttgctgacatcctgttttgtttttggtttttacatcccatttgtttctttttatcacagaaacgcttcgttaagggactcaggcagtacgggaagaacttcttcagaattagaaaggagctgcttcccaataaggaaacagtgagtacaattggactttatgtaacttgattttttcctctttgctcctgctgcctctccacatttgatcttatgaaatggtttcctttaaccctgcgctgtgctcagactcgggctggcctccagaattctctccgttttactcccttgacttttaatttgagttcataatttttagatagtaaagtgacagattatgcttatccgcctggagaacatagacttctgttgtaactctgagaacagaaaggtctttgggaacagagggttagttgtgggggaaggattgttggagagttaacatcaaattttaaacatagtggctggaataggaaatagcattttatcactagtttgaatttggtaattggcagaaatcatcaaccaaaccagaggtttgtggcttattatactttgagttctgggggattttttccatttttcaatgttgctctgttttgaagaggagttttaactctttaatattctatccctgagagtttgcactttccactggacagatgtacaaggggatcttataaattgcttaaatggagctttacaaaaaactacttagtatttcacaaagctgggggtcagagctgacaaatgtgcccgataaacgtgaggtagaaggatttgctgaggaaaat

SEQ ID NO: 2981 - DNA, 1740 bp, Homo sapiens
caatttggtggaagatctatagaccttttaatggcagaagtgcttattaattctagtcataaacaggaattgttgtttttcagagaagggagagagagcagagcggactctgtgtagggatagagttgaaactggaacatgcttcgcacagtgcctcgtgctgtgctccttgttcactcagtgcctcgtgctgtgctccttgttcactcagtgcctcgtgctgtgctctttgcacagtgtgttcactagaatgagggctcaatgaatgttagttgagttgatgtgtttgaataagcagaagtgaagaggggacattctagattgggtaagagagaaaggcattggtaaaaacccagggaaaggaatcaggatggggtactgcagtaactaacttcactacatggtggtgtaggtgattgggaacccaattgtggaggctgttaactaactagcagaccgatagtttggacgtactaggaattgtcacaggtcttcaaataagagaacacattaatatacagaatgcccagaactggaatgttggggggaggggtgtggagacacactgaggccagggaggagaccagtgcagtcactggcatgacgtggccctgtagttggcagagcccttgcaaaaaccgaggagcatgccgaacaggaaactccatgaagtgaagaatgaatctagagggcatggtgactgatggaaggagtgggaatggacagagagcacgccaggcacttcttctagaactctgctgcagctgacagaaatagggccacagggagctaagagagggcaagctggcttggggagagagaagcgggggagatttgaggtgctaggcccatgaggttaattttaaactttataaagtgaaaaaagttacagtaagctaaggttaatttattattgaagaaaggaaacattttaaatgtttaggttaattaagtaaacagtgtttataagactacagtggtatacagcagaggtccccaacctttttggaaccagggaccagctttgtggaagacagcttttccatgggctgaggggaaggatggtttcaggatgattcaagcgcattacatttattgtgcactttatttctattattattacattgtaatatgtaatgaattaattatacaactccctataatgtagaatcagtaggagccctgagcttgttttcctgcaactggacagtcccacctgagggtgatggaaaacagtgacagatcatcagacattagattctcaaaagaagcacgcaacccagatccctcacatgcgcagttcacaataggattcgtggtcctatgaaaatctaatgccgctgctgatgtgacaggaggtagagctcaggcggtaatgcaagccagggggagcatctgtaaatacagatgaagctttgctcacttgcctgccgctcacttcctgctttgtggcccagttcctaacaggctggtagtggtttgtaccctggggactggagacccccgtcttaaggtatatgcaggaagaagttttacttgtgccagtagtaacgtaagggtaataagcctgcacctcagttggtatttggaagacaaaggaatgcctggaggggcctacccagtgtggctctgggtcaccctatggcatctacggactttaatggcatgagttaatacacagaagtacttagcagctcacacgcactctgttaccattggcatggcttttgttgttagaac

SEQ ID NO: 2982 - DNA, 1030 bp, Homo sapiens
ggcagcaacctttgctgttctgcagcctctgctggtgatacccaggcaaacaggttctgaagtggacctccagaaaactccagcagacctgcagcagaggggcctgactgttagaaggaaaactaataaacagaaaggaataccatcaacatcaacacaaaggatgtccacacagaaaccccatctgaaggtcaccaacatcaaagaccaaaggtagacacatccacgaagatgaggaaaaaacaaggcaaaaagtctgaaaattccaaaaaccagaacgcctcttctccttcaaaggagtacagctccttgccagcaagggaacaaaactggatggagaatgagtttgacaaattgacagaagtaggcttcagaaagtgggtaataacaaactcctccgagctaaaggagcatgttctaacccaatgcgaggaagctaagaaccttgaaaaaaggttagaggaactgctaactagaataaccagtttagagaagaacataaatgatctgatggagctgaaaaaaaaaacagcaggagaactttgtgaagcatacacaagtatcaatagccgaattgatcaagcagaagaaagggtatcagagattgaagatcagcttaatgaagtaaagcgtgaagacaagattagagaaaaaagaacgaaaagaaatgaacaggcccggcacagtggctcacgcctataatcccagcactttgggaggccgaggcgggcggatcacgaggtcaggagattgagaccatcctgcctaacatggtgaaaccccgtctctactaaaaatacaaaaaaaaaaaattagcccggtgtggcagtgggcgcctgtagtcccagctactcgggaggctgaggcaggagaatggcgtgaacccggaggcggagcttgcagtgagccgagatggcgccacagcactccagcctgggtgacagagcgagactctaaaaaaaagaaaagaaaagaaatgaacaaagcctccaagaaatatgggactatgaaaagaccaaacctacgtttg

SEQ ID NO: 2983 - DNA, 1027 bp, Homo sapiens
tgcctgagtgtgttccaggaagagcaaagatgccccggagtggatggagaagatgaagtcggaaggccaccaggatcttagaccagagatgttcactcctattttgtacctcacagttaaattacattatcaaattaatgaggaattcttgagggctgttctgttttctcctaacattgtatctctcataacagtgtttttacggcttcagttatgtaggactctgagtcatgcattcctctgacttctgcagctgctcattgtgtcaagattgaagcgtttttgttttgtaactggtttagacaatatttactacataagtttactataaattcagcatttgtgagaggagctgtttttcctgagtaggagcaagaaaatacctggaaagaaaagtgtacctgctctacctctatcttggagcagtcattactcttgttatcagcctgtcctgacaaattttaattcaggaagtgaacactgtggaaaacttaaaactgtagatgtcatgctctgaattataacacctaatgaaaagagtcatctcaaaaatcttcctttcttgagtcaaataccctggctttgagactcagctcaggggagagtccctctaatactgctgtttgacagaagaggccagcttcccttgtcggccggcatttgcttgctctaggcctgtggtgattattcttaatgtctggaggatggatgctacgtgcactgactaactagaatgctgggccaagcttaatgttccctagtagtgttctgatattcttctttccccaacactcgttcttctgagaggttagggtgctcacgaggcactttagaatgaggagtggcccatgactgatgaaggccgggacgtcactgcattttgcaggccctgctgcaccaggttggtttgacaagttcatttaggtgcctccacacaaaactaggaagtcttgagggcagggttgtagtttaattctttttgtattcacagaacctggcccagcacctggagcaggattgataataa

SEQ ID NO: 2984 - DNA, 1041 bp, Homo sapiens
aggctgaggcaggagaatcacttgaacccgggaggcggaggttacagtcagccgaaaccgtgccattgcattctagcctgggcaacaagagtgaaactctgtctcaaaaaaataataataataaaaaataaaaagtctgatggaattttaattgggattctattgaatttatggatcagtttgggaaatactgacatcctaacaatattggatcttctaatccataaatacgatatttctctatttttaaagaagttgtctttgattttttttttttttttgattaaaaaaaatttaaagaggtcttgctatgttgttcagtctgggcttgaagtccttggctcacgtgatctcctgcttcagcctcctgagtagctgggactacaagtgcatgccaccatgccccgctttcttttacttcttacaataagattttttgggaatacagatcttacaacattttgttaaatttactcctaagtatttcctgtttgaggattctgttgtaactaaaattttaatttctaaatggtcttcgatagcatagaaacacaatcagtttttatatgttggctttttttggtcctgctaaacatgtcgtgtgcaaatatagttttacctcttcctttatgatctatgtgttttatttcttttttgtgctttattgcacttccttgaacctctgctataatactgaatagaagtgatgagagtggacattatctttctaatcttagaaagttttcagtcatttactattaagtacaatgcagtttttgttgtatttgtttgttttgagaaagggtctattgcccaggctggagtgcagtgtagcaatcttgaatcactgcagccttgacctcccagactcaagtaatcctcctgtctgagcctcccaagtagctaagactacagggtacaccatcatgcccagctaattgtaaaattttttgtagtgacggggtctcactatgttgcccagcctggtctcgaactcctgggcccaagtgatcctcctcagcttccccaaatgctgagatt

SEQ ID NO: 2985 - DNA, 1035 bp, Homo sapiens
tgagtctttggagtttgcgcatgcctggggatacgggaagaccttcccagttattggtaattttaagagagtgaatttctaggccacagttttcatttgtattgtctccttacttaagaggggctctcttgtctcttcttcatccttttcatatagccacctcctcttggtagccagaagacccttcggatgatgccccaggtgtaaaactctctggggcccgccccactcggaaggattactgaaatgagtcatttccgggacgccttttttactgttgaatgaaaggatgctaacacatggggcttccctgtctttagtcatatttctgttaacagtgaagcattgctttagatacagagtatacaagactttaggaggctctggaactggttatttcagcaaggtggatgtgatggcaattttctcttaacggtccctcctcatctattctgtaaacaatgtcaaataatgtcctacttttgacagagatcatggtgagaagagtgctctgataaaaaacactgaatacttaaaatcatacccatacttctgcacacatatacacacatttttaaaggtaaacactgttcatcacgagttgatttgtaaaatacttcaaatgggtgccacccagtcagagccaatcctggtggccttacctggttatggaaaccctttcttcagctctgctcaatactcagtgtttgagggctggctaactggcaagattatgaatcattaccatatggctacagctatatggtaatgattctcattgttttactttcctctagtagttttttaatatacagtacaatgtagattttaagtgtacattttcagaaatgtgtttgaccctaaacaagacctggcatattcccctcatctcaggaagttccctcaagatccttccctctaaaaacttcccacccaaaatcaccaactgttcaggtttctctcactataaattattttttcctcttctaaagctcatataagtggaatcatgcagtgtatactgtttttgtgtct

SEQ ID NO: 2986 - DNA, 1025 bp, Homo sapiens
cgtgaggtgggtctgtccctctctagttccagatgaggaaactgaggttgagagatgctaaggacgttgctggggccatgcattgtctaagtggcagtgctggcgctggcatcaaactttgcctggccctgatcctgctccacttttctcacagtcaacaaaccaatgaaaaacagcttggaagaatgatgttctttttttatctttctgttttttttttttccttctttgaaactataaaaaaacctctgttaaagcgtgtaaattatagttccttgttaaaaatattcttatcaatggaaactgtgtaagttcactccattttgtaatatttagcaagaaaaataagacaggatcactaagtattttggtagttgaaggaggtgctaggataagatagttgtttttcttctttttccatttgtgcttaatccattttggcaaaatatagggtcttactaaggggtataaaacatagccaagaagatactttgttgacaaaaactgtacattctgttattgttattcttgcaatttatgattcctcttctctattttgcatacttaacgatgctaaccaggcccggttatttagtgggtggtaaacgtgaaagaaaagttttacaaattttttttacttgttttgggaaactcagttttaatgtcgtcttaattaattttttgacagactctggaagagaacttgtcattacagacccagttatcaagaaccgagagctcttcatttctgattacgttgacacttaccatgctgctgcccttaggtaagtactggagacgtgctcttccatgtgaaggaggagtcactgagtgcaggaggtggagagtaatttctcctgatcttttagtagtcactgtattaatcagactcctcttttggcctcagtgaacatgccagtgtccgctctggattgttgagattgcagaggttctccgtgtcttcactaatctagctttacttctctctctcttttttttttttgataatttactttttaatgctg

SEQ ID NO: 2987 - DNA, 1047 bp, Homo sapiens
atgagaggggatttattaagggaataataaatctcactccatcatagaagctaagtcccatgatagccatgtcttagtctttttttctgaatacctgagactgggtaatttataaagaaaataaatttattatagttctggaggctgtgaagtcccaggtcaaggggctgcatctggttggcctctggggagggctttgtgctgtgccataatgtggtagaaggcatccaggacagtagggctcacaagagagagccaacctggtttttataagagactcactcttgtgataagtcgttaacccatgaatgcatcaatgaattaatgagttatcaggctccttgtgatctaatcacctcttaaaggcctcacttgttaatactgttacattggggattaagtttcagaatgagtttctgagggtgacaaacatttagaccatcgcaggccatctgcaagctggagatgcggggaagctgatagtatggctcagttcaagttcaaaagcctcagaaccaaaggaacctatagtacaactctgtctgaggctgaaggccagagagcctggggggccgctggtgtgagtcctcagtccaaaggctggaggacctagagttctgatgtccaaaggtaggagaagaaaggtgtcttagctcttggagagagagcaaagtctccttttccctgcttttttttgttctgttctggaccccagccgattagatgctgtcccacctacattgagggcagatcttcccacacaggctaccatctgacacaccagtctcctctaggaacacctgtacagacacacccagaaataatgctttaccaactatctagatgtcccttaatccagttcagacacctgatattaaccccacagtcaggttgaagtacattgtgggatacttttggggagctacagaagtgctctttagtttgctatgtctgtccctatctgctaagtccccttgacgtacagtttatctctgtgtgtgtgtgatattaaggacaacagaggtcatctagttacccagccttgta

SEQ ID NO: 2988 - DNA, 1035 bp, Homo sapiens
caacatggtgaaaccccatctctataaaaagtacaaaaattagctgggcgtggtggcatttgcttggagtcccagctactcaggaggctgaggtaggaggagagcttgagcccaggaggtcaaggctgcagtgacctgtgattgggccactgcactgcagcctgggtgagagtgagactgtctccagaaataaaaggcaacacatcacagttaatggctttatctaaaaccatgcttagacataaacttttttagcctttaatatatatttaaattacttagtaagacactgtgaacaacattttaccaataccaaaatttgaacacttagctgtgataccaaacattcagagtaatcgaaataatttgaatagaaaagttttatgtgtgaaaacatatataggaatacttattacaaccaaggttgtaatggtggaaaactggaaatgacccaaatgtctactatcaggaaaatgtatgaacacattgtgatgtgctgtatatgaaggtaatacatgtcacttaaaataagtgaactagggcgtggatggatcatgtaagtgtaatgctgaaagaacaaagcatattatagaagaactcaaagagtctagtgtcatttatgtacagtataaaaacatgcaaaataataccttatgtatttttagttatatatatatattaagtaaaagcatgaagtactggatgggaatgatcagtgaattcaaggtggtggttacctctgggctgtaggcaggttccacaggcagcttctttaggttcgataatgtttttgttgctttaggtatgtttggtacagatggttctgttatttttatacctttctgcctgtcaaatatttcataataaaactttaaaaagaaaaataagaaagataaagcaagaaagtagagccacctttgggagttttcatgaacacgctcaggatagcaagcaagcaagacatttaggtttcctcctaggtcctgtaggtagagaaactggtgtatggaatcattagggttatttaaacctgtc

SEQ ID NO: 2989 - DNA, 1023 bp, Homo sapiens
tcttgctctctctctcccaggctggatcccagacgcgatctcagttcactgcaacctccacctcccagggtcaagcagttctcctgtctcagcctcccatgtagctgggattacaggcatgcgccaccacgcccaactaatttttgtatttttagtagagacggggttttaccatgttggccaggccggtctcgaactcctgacctccggtgagccacctgccttggcctcccagagtgttgggattacaggcgtgagccactgtgccccgccttaggcagtagtttgcatggcatgcagatttcagatggggtagttgtagcaaaagttaagaaccattgttctagagcctgatttgagttatagttaccagataatgatttctttattaatgcagaggcagtagtctctataaattccctaggcctggttccactatcttttcttctgtgtggtcagattgaattttcttgggcgttgtttcattttatgttccaataattatttactgccatttagaactctaacagtttttcttgttagcctatctgacataacattgatggtagagctagaaaatgatttcctacaattccctctatagctaatttttaccctccaattatagaatacggtaatattgttaataggttagtggtggctctattatgtgttaattaccaagagtcagctattaaagttttcttttgacagtaaaagcttttctgaacacagaggattaggaacgttttcttgattcttgttttaaagatcatcatgtgatggtagtaggcagagagctggaatgtgcatttctacgtagccatgaaatttaacttgtgctaatcgtggtggttctgcgtgagtaacagacatggacacagacagcggaacacagtggggcatagctttgtgcttgatggctgctttaactttggggctccaagcaaggatttcaagaaacatttctttggtcttaaaaactgggaaattaatagatcttctggacaggagggctcccta

SEQ ID NO: 2990 - DNA, 1031 bp, Homo sapiens
gtacatttttctggaaagaggatctttactttttgactatggatgctaatcagtagattgcttaggtgttgaaaataatttaaaagttaagattaaaaacagcgaaggttctgctgtttgtcatttaaaacctcaaatcagcccgggcatgatggctcacgcctgtaatccccagcagtttgggaggctggggcggttcggtcacttgagctcaggagttcaagactggcctggacaacatggtgaaatcccatctctgcgaaaaaatgaaaaattatctgggtgtggtggcatgtgtctgcagttgcagctactcaggaggctgaggtgggaggctcgattgaactcagtcaaaccggtgttaatagagttatttttgctgaagtaaggcacttaccattagtaagtatcacttctaacattagtgctttccatgcttgataccatagtaccatttaagaattaaaaaagaaaatttattataaaatgctcttttggaaatgctgattgtattacgtttgttacctacttgttgcttagaaagaactccaatctggttgcttttttagtggtgcagaagtttagagaggctatattgctttttcattatttactgtggcttccctgctttggcatactccccattaagtatgccaaaaataaccatcgataaagatcatgagagattgctttttatatttgattttagtgaaagatattaagatggctggattttcagaagaattgctaatacaaatgttgggattaatccagctaccctaaatgaaagatgattactagctgtcgacttataatgtaacaaattaagaaagttctgaaagcacccagctgacctataatgccaaggctgactgctactggcatcagagaacccggctgggcctgctttcagctctgttcctttcacctggagcagttgtccccataaaagctaattgtcagttaatttattcctttttttttttttttgggagacagggtcttgctcttttgcccaggctggagagcag

SEQ ID NO: 2991 - DNA, 1013 bp, Homo sapiens
aattgttgcaacagcataacacgtttacatatttgctgatgtaattactcaagggtcataccaaaaaaagggatgggggtttcacattatggaaaccttggaattctctgtcttacagtggaagacagaacccagtgtagtatagataaaagtctaattttaattcccagagaaagactgacatcttacgggacaaattagtagattcccaatgtgactacctacttctaaagcttcagcctttagcaattaccaatatgtcttatttaccgatatgtcttatttccacatatatctaaaaagtaggttttactttcaggctgatattttcttaatcaatgtggatgctattattaatacttttatttactgtaatactcaacaggaattgctgaatggattttaagtcttccccataataacattaatttttttgtaaactttttatattagaattaatgattagtatttattttttagcaataaaaatatttgtgtctactgatgatttaaataagttcatgactggtggagcacttgggtacattatatgtaggtgtaagagattctgtagtgaaaggataaatcttctttcagtcaagatgatgctacataaagctaactgtattgattgttctttaatgatgctttgtgctgccaaagtcatttgagctggatctgaatcagatccagttggcaaagcttccccatatgtggagttctcataaatcctgcaaggcacacagatctaatacagtgtaatgagagagctgctgggagaaaaaattgattacagggttgcagacaatatcattaacatttcttgccatgatacaccagatgtcttccctaatagactatttttgttaatttagtttttataggatagcattgattgcatcataatttaactttctttgcatattcaggtatatgtgatctgtgtttctacactaatgatggaataaacatcagatttaattttgtaagttttaacttatctgttcattttt

SEQ ID NO: 2992 - DNA, 1041 bp, Homo sapiens
ctgatccctgtctgttgtcctgccagactattaaacagcctcccctttcactctcaaaaatgtcttgagtgtggatgataggttgtgtggttatcttgcctatggggataagatccatggcttctgctttattaatattcaaccatcaaaacacatagggacaccaccgtcctacactggtaggtgtatttcgagcccacacttccacagggtaggtggaggctatgatagtatcaagcaattaagttcctaactgagctgaggttttaaaggtaggaattatgtattctattaggaagctttcattctcttaggaagtattcatttgattgggcttatttacaaatggagaggtctgattttgtttgaatgcgctgaccaaagtatttatggaagaagtagtcaaaagcaggagctcaggcaagcagaagaggcagggtagaattagggacagcacgtacttagaagcaggagaaagaagtattgttgattaaaaaggtcgcttcgcactgtagatttctgaactaaatagtaaaatagctggcaaagtctttatttagctttttgaaggactagtaatacggaatgacagtctgtgatccttgtggcctggcatgaaaagattaattgagccaaatttcatttttagaatttagagttgagaaactgagagactgaggcagttagtagaggggaaaggtgaatagataattcaagaattacccctaatatatctgtaaaaattaaaaataaaagaattacctgaatgacaagagcaaggttagggctggcataggcaagctcacttgctagggtaggaaactgggaaaagcagaggacaggcaagctgtgggaagagcagcagactgccaagggaagtgtgtgcacagccgtctcttccttgactctcctgggtcccactgcactgatgttcttcccacaggattcttagattatcctgttcgctctgagtaaagagctctcacctggctagcttgagtggctcttcatgaattgcaatggaaagagcctagattaata

SEQ ID NO: 2993 - DNA, 1036 bp, Homo sapiens
ctggctgattttggtcaggagcactgtctattacagaccaagagtattacttaaggatttagggcaggagagcttatcacaggcttggaatgtttctgtgtggaggagaagtttattgtggggttggaatgttttggggctgacatctctccagccagaggggacgttatctctgggctggcatgtctgtggtcagagaggggtttatcttaggattggaatgtttgtggttggagatgtcatttgtggtttatggtcatgatgtcattagccattaggctgatgccctttgggttggatttaggcagtttttgatcaaggggaacttgaaaatggtggtgcttgtccaagatggtgatgctcctgctctgtcagtagctaggctatgatggtgttaatgtcatgaaatgtggtatgtaggaagcaacagaaaggagagggcatgttgagttgagtaaggtgagtaaataattgataactagagatctgaaatgctggcagtgggtataacagggactgaaacacaggaaactaagaactttgggttgttccaaaattgtgtaatttggagctacagtttttatctagggaattgagtttcttctgtttttacttgaataccaaggtaggagtatgaaagaatgatctactgtggtgggaagaattctcttgcttgtcccttaagatgattagcatgttaagttgatgttgcctgaatgctgaagcacagttatttagcatctgggaccttggaacaagatagggaaagcttagtcaacagttcattcctgagctactgttttacgtggattcagggattaaatctctgttgagtccatctttgagtagagaaatcagttggggaattctgaatgcctaaatagttggcattgagatttcttctttttctagagtgccttttgggtaggtacaaagatcctgatgttctgcagaaagtttcttggaatgtactcatttgtgaggactttcttcctgatcatcttagttggtctgttggggtttgtgatgactccca

SEQ ID NO: 2994 - DNA, 1047 bp, Homo sapiens
tgagagtcactaatcactcattagtgcttcccagtctttttcaagctaacgcagatataaaatgagtccattgcatgaggtgagaggattagtacccagcatgcttgtcacttacctgtggcagactacaaattaggcagatcaaaaattagagaaaaaatatgtgatttcatggcttgagattttgacgttaaaatatgatgcatgcagttcaagaagaacagaggtggctgcagaattacattctggccaaattattgggaataatttgcatcttctaaagtgcctgattgcaaagggcactgtgaacttggctgtaaatagtaagggagctacaacatgggtgacaaccagttttaaagcaccttctatctactggatttgctttgagtgtgtaatttctagtccttagaaaattcctatacaacctagacattgtttccctgctgtacagatgaggaaacaaagacatggaggccaaagtcacacagctggtttgtaaaatggtatgggcctgtgagaactggttaaagccaagaatgaacggacatttgcataaaaccctgaagagaatacaaaaaacaaataacctgtgtggaagaaaaaagaagagatagactgatttcttcgaaaatgcaagtgatataattactttgctctttttctcttttctccttttactcctaaaattatttatagctctcctgttgccaaaaattgtatgtctagtcaggcacagtggtgagcatctgtagtcccagctcctcaggagactgagttggcaggatcacttgagcccagaagtttgaggctagcctgggcaacatagtccataaggaaactatgggaagtaagctgagaaggtgagtagtaaattgttcaagaatacataggctaatggtgattactggattttgaaccctaagtaactgaaagagaaatacacatttttctatgatctaataaaaagcaagcatgttgtatgcatgaaaagttttttgatgcaaggtggtgtacattgatcacataacacaaagggcaatgtgt

SEQ ID NO: 2995 - DNA, 1033 bp, Homo sapiens
cctggaattggagagcagaaacactggagactctgagggtcagtagaaggtacacagacaaaggggcggggaacagtattcccagcagttgggttctagggactgaaggagtgtcttgaggcagcaggaggagcatgcaggaggggtggaggtggaagcagtaggggagaggtgaggctggagaggtgaaggggcagccccataatctttgaaaaggaatagtgggcattgtatgctttaaatgaattgtatgctttaaatggtgattcatatggaacgtgaattatatctgaattgagctattatgaaaaaaagtggtgggacgtcagatatgctggctggctggctgcactggaggacagatgggaggaaggctaaggcaaacaatgttttgtagtcacaaagatctgttagaaagcagttgtattcatctgcatgagggatgatgatggcttgaagtaggtaagctaagattcagttggagcagtgggtccattacagaggtgttcaggatgtgtctggtagactaagtgctaagcaaaaatgcctagagtatggtcaggcatttgaaaaatataagtatgtcttactgtggttgagtgaggaagaattaactggaggacttcgctcactgtatttagtcaaaagtcaaacatcctaacaaatagcctggcttgagcaatggagatgagtagagcttgaggattgggaactcaggagggaggggcagatttccatggataagtgaattttacatgacccaagaggaaatatttttaatttttttcttcatttgtagttaattctccatgatttgtttcttaatcatggaactggatagattttacccccgcccaaatagttaagtttcttgaggataggggtgttttggctacctttatatcttccatagcttattatctaccatagtagatgtaaatcatgactgaaataaatacatattattgatattttacatttgtaaagcactttgcaatctataagtacaatttacatatagtatacttgtgta

SEQ ID NO: 2996 - DNA, 1052 bp, Homo sapiens
tttaaaagcctaggaaatttgtttcccgggacctcgatggttttacatgctttctgactcccattctccggctctccactcaggtggttgagccattggaaattttgacctgtatttagcattcgtagagggcacttggtaatttttatttttgcaagtattcctgcgagattgacccatattagtggtaagcagttgtctcagtcctttgtatgtttacctgtctctttctcccgggctatagtgtttttcaatttccgactcccagtctgagctgaatgtgaactgtgaaagggtgtgtagcttctaaattggtaaggtttattatactctgaaacggagttgaggaggtacaattcttttcctttaatcctagctgagtgctttcttttctctaaaggacccatttaaacatagatgttacttttcagtctctctttcctttttaccctgaagcccacagttctgattctcatgcttaagaactaagattttctcagactcctcctctgtcttccttcttttcctttctttcccccatccatatggcattacgtccttgttcttgaattgcttctttctgttgtcagagtccttctggaaacattttctatggaatcctctccattcaagctagaattccgggcgagaatttgctttatacaccacactacgtttgcttgctttctcagattcagaagtgctttggttagaaaggaatagttgcccacattttggcctcttctcatggcagatggctgacctttcccctcagagatcattggtacctggactcagagggcagaaggaagtactccagagaaatgcaacttatgcatatactcagatgtatttttttttcttttagtgaagtaataaccaaaaaatcagaatgataatcactgaacaggtttttctggctttctccattttccaccaggtgtataggaaaaggacattggtgtcacgtgactgcctttcttatgtgtacagaatctcttgcacccctacccgctaccaccttccccatacatcactaagaaaacagctat

SEQ ID NO: 2997 - DNA, 1056 bp, Homo sapiens
ggggttcccaaggctgctgttgaccgtattaaactgctttctttatgaggacatagagataaacttttcttagctcttagtaccaaaaaaaaccagaccttctgagcatgtggtttgttttctaacttacagatttagaatcctgtaactcatcaagtttcctttgagccatttgcttgtaaaattttggccggccgggcacggtggctcatgcctgtaatcccagcactttgggaggtggaggcgggcagatcacaaggtcaagagatcgagaccatcctggccaacatggtaaaaccccgtctgtactaaaaatacaaagattagctgggcgtggtggtgcgcgcctatagtcccagctactcaggaggctgaggcaggagaactgcttgaacctgggaggcagaggttgcaataagccgagattgcaccactgcattccagcctggtgacagagcgagacaccgtctcaaaaataaataaataaataaataaaaataaaaaataaactaaaattttggccacatctaacaaaaggtacaaaatgaacatgaatacatacttttatgtagcagctcattcatggtttcatcttttagattctcctcctcttctattttttcctttgttccaaggaaaagagaagcaaatattgtataattaaaagtaaaggctttgtagcctgtgtgacccgtgaaactaggtgtgtgacctaaggaaactatccacaaaggtaaatacttaatacttcttagctattattctccaccaaataccctcatctgttcttaaattttattttacattgtctaaatctcagtaagctaccttcagccccctttaaagccatcctttcaaactatctttctctctcgatacaaagatttaatttctgcctagagacaatcagtaaagaaattgtgtaggcgagtgccgtggactgaattgtattgcctcaaaattcctatgttcaagccttagctttccgttccccaagtgctatagtatttggaggtggagcctttggaaggcagttaggtttagatgagatcctga

SEQ ID NO: 2998 - DNA, 1247 bp, Homo sapiens
cagttcatttattcattcaacagatttgtgtacctgacataaatctacatgatgagcaaacatatagaaccttctctatagaactctatggaactgtttagaaggggctatgagtgttaaaaaaaatcacacccatgacttacaaacggagatcaatgctgtgaaggaggaacacagttctatgagaacttataacaaaggaacttgacctagaatgggatctcaggggaagcttctctgaaaaagtgatgtttgacctgagatctgaaggaggctttaaacggtctgtgagtggctgtttggggctgcaaggagattattcctgctctggtgggaagaagcctgctggcctgtggtagaaatccctatacctgggggaagtggaaaaactggtgtaactgcaaagtggggggctgggtgcaggttggattagcagcaggtgcaagatgagcacaaaagaatttgagtggcataaaatgctgtcaaagcatttagaatccctgagagactaggtacagtatgaattcagaatagagcggtttgcttcttctcaccagccttttccaactcactataaactggcacttttaaaatggtctgtagaaaagaaaaaagaaattcttttcagcctgtgccatgtgtctggatatagctggttagaaaattggaagtgtgtccaagtacaggagtagctttgtagcaaggctttaggatcaatttcatctctgacatatatggagtaatctcatagccacttggatatgaagcagattttcaagtcacaggtccccctcaggatggtttcactgaggaatggtgtttagtggagcttatagcagagctagatttgcactacagaccatctctgatttgtattgatcacagccacctttcaggggggcaaagacattatgcctcatcagctcttgctctcagtacatgtgctgtgttaggagtttgagacagatatttctatgtcctgtagaataacttgatttgtctttaaagagagaccagcagagttatctttaaatagcaaacatgcatgtgcatgtctgtttggctgtctgtggcaacaaagcaggacccctgggttctattcagcctggccccacccccatcttgttgagagactataggcaaatcactttaatctgtctaaatttctctgtttattggaaagagagtacctgataatgcagccactttatagggccttggaaagtctaattaacatttatgaagct

SEQ ID NO: 2999 - DNA, 1021 bp, Homo sapiens
tggaatgccattatggtggaacccatagggcatttgcatatgtgggcctcttgctaagaagcaagctcagctggaaaaatcaaattttggaatcacaaacacagaaacagcttgagagtggatcttttcactgatgtgagatggccgaatgtgataaaaggaggcttgacagggactacttgtatttaggaggagtcatggaaagaaagagagaatcgccagaaaggtaggagatccaagagagtgcctaatccaaaaccaaaccaacaaaaaccagaataagagtatgggaacaggaccaggacccactgctggtaagagtataagttgtacagcttttggatggctgtttgactctctctgaaagagtgtatattcattgaactagggattccttcagtgtagaaatacatgtatgcacaaagaagtttgttgtagcactgtttataagagtaaaaaatgtgaaaaagactcaataaggggcttgttatataataattatgggactcccacactgttcagttctttgcagtaataaacaagaatgggatgttaatggtcttctgtaaagtgagagaagtgacttgctgtataacataaatagtgggatttcatctttgtgacaaaaaatcaacaagtgaaccctcagacaaatgaatacatatgtttttatgtatatgtgcatgcttttgtacctatgttctagagaagagcctggtaaaccttcagcctgttaagtggaattgcttggattttccgtaggaccatatactctaaaaaaaatctacaagggagctgggtgccgtggctcacccgtaatcttagcactttgggaggccgaggtgggtggattgcttgagctcaggagttcatgaccaacgtgggcaacatactgagaccctgtctcaatataagaaaaaaaaaaattaaaaaatctaaaagagcttcaagaattttatatttttcttttttcttttaaaaactctagagttgccgggcacggtggctcacgcctgtaatc

SEQ ID NO: 3000 - DNA, 1034 bp, Homo sapiens
ccaggaggcggaggttgcagtgagccaggatcgctccactgcattccggcttggcgacagagtgagactccgtcttaaaaaaaaaaattgtggtatgattgaattacatttcttgtacaacttctttcctggaattaataattgtctctcttttgattctttgttttgttttgtatgccccgtctctaaatcacccttaaattttccaacagaactattggaaaatcagtgtaatggaaaatattaatctatagatcagccttggtgctatcctcctggaacccattgcctcattttggtgtctagatctgccactgagttgttggaagaagacttccctttcatatgactctcagatcatttttcatggcttcttggttggggttccctctgttgtttgtgaagtattttcctgagaagggtacatgggaagtaaatgttttgaggctgtgtgtgtctgaaaatgtctttattttatgctcatccttgattatctcacagtttggccgggtatagaactgtaggttggagactattttcctcaaaaatttgaaggcgttactctattgtcttccaattttcaggaaagacgccagagcataatacagaatacactcaactgaaagccagtatgggccttttaggatgagttgttacttgaatgatgccccttggaaagataaagttattagagtgatgtcttctgaaccataagggaaaagataaagttgagagaatttcattttactcccatctgttaaatggcagtagttcaatcctctctagagatattgtagaaataaatatttaaaaatttaaagatagctataactatcaaatagaaaattacttcttggggtgaatggcaaactttgtggtattagccatttatgtttgtattttaaagcactttatcatgataggatttttccaatcactaccctttaaaagccaaatgaattttaaattcatgtgctatgtgtattttaatattaatatttggatatttttggcttaaagttttcataatataa

SEQ ID NO: 3001 - DNA, 1027 bp, Homo sapiens
ctcgagatggggccttactttgttgcccaggaaggagtgcagtggcttgatcactgttcactgcagcttcgccctccatggctgaagggatcctcccgcctcagtctcccaagtagctgagaccacaggtgtgagccactgtgcctgacctgtttttattttctattttagacatcacttgctgagtttacccaatgagtaatttaaatttagccatttaaatctcttccccgcccgtcccgccccagacagggtcttgctctgtcatccaggctggaatccagtggcatgatcatggctcactgcaacttctactttctgggctcaacaatcctcctgccttagtctcctgagtagctgggattataggcacgcaccactacacctggctaatttttgtattttttgtagagacaaggttttgtcatgttttccagactggtcctgaactcttgagctcaagcaatctgcctgctgtggcctcccaaagtgctaggattacagatgtgagcctccttgccagcccgtcaccttttatatatcttctactttctcctcttcctcttccttctcattgtggtaatatcaccatttgtggttaaatcagtattgaatgtttatattattattattattaagacggagtttcgctcttgttgcccaggctggaatgcaatggtgcaatctcggcttaccaaaacctccgcctcctgggttcaagcgattctcctgcctcagcctccccagtagcacggattacaggcgcctgccaccacgcctggctaattttgtgtttttagtagagacggggtttcaccatgttggtcaggctggtctcgaactcctgacctcaggtgatctgcccgcctcggcctcccaaagtgctgggattacaggtgtgagccaccgcacccagccgaatgtttatattattataggcatgtatatattgttatagcttaaaacaaatattgtgggctgggcgtggtggctcacgactgtaatcccggcactttgggaggccagg

SEQ ID NO: 3002 - DNA, 1090 bp, Homo sapiens
attcccatggacattaaatacacacagtatagacagcacaatggcatcttctatgtgaattattggactcttttgatcacttttaatgctgaaaatgggatctatcctggttaccttccagtcctctgatgaaatttagggaatgtatgtctatctcctttcgaagtttatcctgatagctattggtggtcattgtaaaattatctgtctgaaacttaacagattgcaaatgaaataggaatcttagtatttattttgctactgcctaatgatgcctctgtttgagtcattgaatactttcaaagcataacctttaaggtatgtttctacatcttaatttgccacttggtgcatttagttctaacaaaccagaactaaagcaaattttgtttcatgagaaactgcttgccaagctttaatttaggtcttcttagaggattattaatgaactcgtgaagtgtacataagcactttttattgacaaaacaatggcattaaaattcagtattctcaatcgatgacaaggcgttattgtgtttgagaaatactgaaaactaccactgttgacctaatgattaacttgcaatttagaacatgcttgattttcctttcccttatccatcttattcttactctctttttcaaaaaccattagctgactatggaacataattgtgaataaacaaatgggtaaaatgctaaaaatgattttaaaaattcattaagttttttgaagctggatgatctatttgtactttcacctactgcttcttttaaaagctgttactttagttagtgatgtatttctcatttatacatactaaaattatagtgattgagttgttatatcatttattttttaaaattgtgattgtgtctttttcctttctttttggtataagattattattatcgaggggccaaatttcaggagtcttactagcaggttgcaaaatgtagtacagcctgccctctgaagaaaaataaatttcagtccgatgcctacgtcttaaaaagattgattgcttctttggctaggtttttttttattccttttctttttttccattctgaaattttattactttct

SEQ ID NO: 3003 - DNA, 1024 bp, Homo sapiens
cttggtttgctcacttataaaagaggaggtaataatagtgcctatcctgtaggaatattgtcatatatgtataatacttacagcagtacctggtgtacagttagcactcaataaatattagtatcgctgtcattatagtttggatgaaaaagctaatgggagttttaagtagaaaagggatgttaccagaattgagtttcagaaacattggtttgatagccaaggggaaggtagatgggtgctaggttagcaaaggttgaggcaggaagacctgtgcgtggattgagttgtgtttctgtcagaagacacaattacaacaaatatcgtttaaagatttcagttggctttatttgtggttctagaattgggcaataccttatgaagtagaataaatgtaagcattccaatgagtgcagtagaggaggttggcttcatagacagaaaaagggctgaagaaagcagaaacaaagaacaaaaagcaccagtagacttccctgatgtagggttgccaaagccttcagtttgctaggtgagaaaaagtagtatctgcaaagcgcagcaaagcaaatgcaatgaaatgagatatgctggtagctgactgttcagctccgtgttactgctgtcaagacagagataagggtttatgttattaagatgatttagttttgagttttgaggttagctagcactgagggacccatcttacatatttaagcagtcagaaaggagaacatatttttgccagatagtaattaaaatttctaatagaggccagcaacccttccaacagagagaaagcaggtgtgagaccaagtcaccaaatcccattggtcctggtcaggtgcctcacttctcaccagaagaggttttaagaatctcttgccaggcacggtggctcacatctgtaatcccggcattttgggaggctgaggcaggcagatcccctgaggtcaggagtttgagaatggcctggccaacatggtgaaaccctctctctattaaaaatagaaaaaaattagctggg

SEQ ID NO: 3004 - DNA, 1035 bp, Homo sapiens
acctgaggtcaggagtttgagaccagcctggccaacatggtgaaaacccgtctctactaagagtacaaaaatgagctgggtgtggtggtgcatggctgtgatcccagctactctggaggctgaggtaggggaattgcttgaactcaggaggtggaggttgcagtgagctgaggtcgtgccactgcactccagcctaggcaatagagggagacttcttctcaataaataaataaataaacgtcagtttacaatattagaatactgaaagcttgagtaattagaagagtcttatgattagaattaattatttcaggctaaaaaatattagaaggagactctagagggcagtataagtcaacatgttcatgcttctcctggcaatggaaagttaaattttgctttggaaaaatataccaggtgttctgaactctttccccaccacacggtgtcccggtttggtagaaatgtgagttttggaaagaagtgctctgatttggcttacaaagattagctaatgtatcagaattatatggccctagggaatatctctgcttggtttacaatactgtcttagaaaaactggaattgcctggccgggcgcgttggctcacgcctgtaaccccagcactttgggaggccgaggcgggtggatcacgaggtcaggagttcgagaccagcctgaccaacatggtgatgaaaccccatctctactaaaaatataaaaattaaccgagcgtggtggcgtgtgcttgtaatcccagctactcaggaggctgaggcagaactgcttgaactcgggaggtggagcttgcagtgagccgaaattacgctgctgcactccagcctgggcgatagagcaagactccgtctcaaaaaaaaaaaaaaaaaaaaaaaaagaaaagaaaaaaggaaaactggaattcccttattgactcaactaaattgagttgagtttgcttttcagacatttgtggagcattaagtgaaaggaatatatctttatagctaatatgtcttttgttttcaaatcttgtt

SEQ ID NO: 3005 - DNA, 1113 bp, Homo sapiens
gggataccccatcacgcctggctaatttttaaccatcatgcctggctaattttagccttcatgcctggctaatttttgtaagttttgtagagacagggttttgccatgttgcctaggctggtcttgaactcctgggcttgagtgatctgcctgcctcggcctcccaaagcgctgggatcgcaggtgtgagccagcactgctggtggttgtactttgtgtattttagtgctttggcttgtgtgagttctagtcctgaatatatttcccttggccattgagtggatgagattgctactcactattacggatttggctaaatttcctcccagagtgtcagagtaactttatataccgattcagctctacaatctttgctccatatatccctgagcaaattcctggagttagccagagagatattccctttgggagtgtcagagaggacctagtttttatttcatatgggtcagagtgctttagaagactgtttgcattgcataatgactctagaactgtggttgggtaaacaagttactgaaaacaaataggatgtattgattttctaccatagaagcatggtgtgcaatggaatgtcatgttgtaatatttgattttcattattgggtgtaaataaacagaatcctttgatatatacatactacactgggatggcactgttcaccttgaaaactaacagtctttttcctcatctgcatacaatatactgaaatcatataaattcatattgccagctggttgaattagttctttttcttttgaggaatagactttatattttactgtatcttaattgttaggcatgagacaaaggcattgtctccttatccttagagttatatatgtgtaataattttattgcatgtacactgatcaacatatcagatataatctcaaagccaaaattttctccttttaagttgttatttgcttcataaaatgcttccccttatattagtctgttcttgctgctataaagaactgtctaagactgggtaatttataaaggaaataggtttaattgactcacagttccacaatgctggggaggccccaggaaacttacaatcatggtggaaggtgaagggaaagcaa

SEQ ID NO: 3006 - DNA, 1035 bp, Homo sapiens
ccccttataaatccctcagatctcctgagcactcaccatctctagaacatcatgggggaaactgccctgtgatccaatcacctcctgccaggcctctccctagacacgtggggattatgaggattacaattcaagatgagatttgggtgaggatacagccaaaccaaatcaccatggaagtcactagaatgccctggggtgaagtggtagaggagtggtttatacctgagagtttctattcatggacccacttgactggaggtaggataaactgcatctacagcgccacgtatgtcatgggaaaatcaaattgtcctaatatgtgatttttgttttcttgggtctaggtgattttgaagttttccattttagactatgggcatttgtctccattatcctgtacatactatttattccatcttaatagatttaagaagtctttttgtatggggaacatatattttatttgtctcttaccacaaaatgcagtgtagaactttgtacgttttagcttactgacttctgttaactgattaacacctctatttctgtgttttcttattttatcgctaaagtttgaaggtcatctcttttagaccatattatgagctatttagatcagttctgtctttcctattgttttaatggccaaatggcacactggttggtatactttttctatcaaaattacctgattgagaatgtacccatcagttacattgctgtgtatgttttagatagtaggcgtgtttaagaatgcagctaatacagtgtttgtgaagagttgtattattagagggcatgtatgtggaaaaacaaaggtgaaacggaattctccctgtggttagtgtgaccctcataatgttataagtggtgtggtgtaaatcgttactacccacatatggaacttaagcagtttacattttctacatcagggttttccattgctttagcaggacatagaattccttgctttttgttaaaacgtacgtgagcacccaggggcagccttaatgatttttgggtgtagttgga

SEQ ID NO: 3007 - DNA, 1048 bp, Homo sapiens
gtgatacccaactacttacagtttctggtgtagaaaatgaatagtcaatttattgttaaaaagtttaaagtccaattttccttgagccttgagttcagtttataaatcatattagtctattcattaattcagtacattttatataaaggtaaaagaaaaataatgcagtttttgatacatgttgattaattcaagttgaattctgtttaaatatccagttctacttataaacataactaacattaaattgcattttaaaattagataaatgcccaagaaagcttccaacaaaaccttaaaacaaaaccttcttaaaaccttctctaagtccttatataacttttgtaaatataattaaatttcacaatattgtgaattttcctgctcccaaacatgtctttctgtgttttcctgttttgataaatgctactcaattttctaagtaagtaaccctgggctgtgttgattccttctcttctccccactatatagaatcaagtattgtttctttttcctgtatctcttatctcttcctaatccattacgctagttcaggccactgtctctctctctctcttttttttcttttctttttttttttttttttgcaatggagtcttgctgtgttgcctaggctggagggcagtggtgtaatcttggctcttggctgactgcaacctccacctcctgggttcaagtgattctcccacgtcagcctcctgagtagctgggattataggtgcgtgccactacatccagctaattttttgatttttagtagagatggggtttcaccatgttggccaggctggtcttgaactcccgacctcaagtggtctgccagccttggcctcccaagtgcggggattataggcgtgagccactgcacctggccactgtctcttgcttgaattactttatagattccaaaccagttggcatgttcaaatcctctaatttctaacaaaattagaaattttgttcttcactgctgtagtccttttgatcttttgtttgttttttctttttgttgttgttgttttgagat

SEQ ID NO: 3008 - DNA, 1490 bp, Homo sapiens
tgcactccagcctgggcaacagagcgagacttcatctcaaaaaataaaaaataaaaaaaaatcgtgtggcctgggtgtggtgactcatgtctgtaatcccagcatttcgggaggctgaggcaggagtatcgcttgagtccaggagttcgagaccagcctgggcagagaccccatctctacaaaaataaaataataaagttagctgggcatgatagcatgagcctgtagtcccaggtacttgggaggctgacatgggaggatcgcttgagccttggaggttgaagctggagtgagccatgactgtgccactgcacctcaccctgggtgagcgattgagaccctgtctccaaacaaaccaaaatgatgtgttttacatcctttatagtggtttggagttttacaactttaaaaatggttcggaattcagtgtcttaaggttgtcattctgaattaggcatctgcctatcactttgtacttggacagtcatttattgggtcagtgattttttgatggaatactgtggattgggattggaagtgcagtattttaaatcttctatatatgattgtttttgttttttgttttttccttgaaattgcttttttcctaataataaaatacagcagcagtttacccctcaaaacaaagtcttttactccttttactcaaatcattgggtaaaaaacatttactcaaatcaatgatttactatgtgaggtagtaaacattttaggctgcgtgggccagatggtcacaactactcacctctacccttatagccccaaagcatggatacatgcttttacagcaaatgagtatgtctgtgttcctataaaatttatttgtaaaaacaggttgcagtccagatgtggcctgtgggccaccgtttgccgacctctggcctctagaagttgtctgatgaacatttttcccctaaggatgatgaactccttctctaagtacacggtttctcttggaacttggggtgtgaaatggatttcctttgtcctcctagtccacacccacatttttgagactttagagctcttgtattatgagaatagaaccaaaggctcttcagggacaagcgtcggtgttgttacatgtattcataagtgagtgaattcacatcttttgtgttgtaaacaggactcttggacacctaactggcctgtaaatttcttcattttctttaacagaaaagtttactgtgctgttctttatggtaggcactaccctcatatgactatttaaattaacttaaataaaatttaaagttaagttcttcagtcacactagctgcatttcaagtgttcagtggctacatgtgaccagtgggtgctgtgttggccagcacagatacagtatatttccatcattcccaacagttctgttggacaatactcgtctagaattctgacttaaggattagagaaaaaggacatagaaatgatattaaagtataatgaatgaatgatactttcattat

SEQ ID NO: 3009 - DNA, 1045 bp, Homo sapiens
aggccgaggcgggtcgatcagctgaggttgggagttcaagaccagcctgacacaacatggagaaaccctgcctctactaaaaatacaaaattagccgggcgtggtggcacatgcctgtaatcccagctactagggaggctgaggcaggagaatcgcttgaacccaggaggcggaggttggggtgagccgagatcgcgccattgcactccagcctgggcaacaagagcgaaactctgtagcaaaaaaaaaaaaaaaaaaaaaaatagtttgccaaaatgaaggagataatattaaattcctacaagcagtgagtataaaccagagaaagtagaagtgaaatctgaaagatgctgaaatgaagaaaactgaggaccaaagaaagacaggtacagttgaggctggagaacaaatgcatctcgaatattcaggattgctagtgattatggctagagaatgggatgcctcgaatgaatggctttagaggtagagcaagtttggctgcgtgtgtggattcgtggagagaggacacctaggaacaaggtacctggttagatgagtacatttttgttgccatcaccctggattatgataggatcctgttgagaaggaaggctatgagctgatgtcaaagacttgagtaaatgagtgggaaagatcattagagatcattctgttaaaattctatggcagttcttttgtgacatttccccttctcattgtctttgactgtcattgatgtcaaatgtatgtacagcattgtaacttactttagatgtaacttttttctgagatggagtctcgctctgtcgcccaggctggagtgcagtggcgcgatctcagctccctgcagtctctgcctcccaggttcaagcgattctcctgcctcagcctcccaagtagctggtattatagatgcgcaccaccacgcccggctaatttttgtgtttttagtagagacagggtttcaccgtgttggtcaggctggtctcgaactcctcaccttgtgattcgcccaccctggcctcccaaagtgctgggattacag

SEQ ID NO: 3010 - DNA, 1047 bp, Homo sapiens
aaattagctgggcgtggtggttggcacctgtaatctcagctactcaggaggctgaggcaggagaattgcttgaacccgggaggcggaggttgcagtgagccaagactgcgccatcacactccagcctggggacaagagtgagacttcgtctcaaaaaaaagcagctcaaggcaaattatgagttaattagagtttaaaatgcctttgtcttcaaagtatgtcatagattctgtatccttgaaattcctctgttggagaatggaaccaggaaaggtaaggactaggacttggttgcattgtgaatccacttgctgatggaacaagaaagatggaacagcagatgtgcatattttcctctgtaatggtcattgatttaatataaaagatatgtctgaagaatgtatgcttggataagtaatatgctgaattctggtgtttggtgtgattgtattagcctagacctgtttagtagtaactttgaaatatgttgcagcaataataaggaatgtagtgggtgcctttctgctgttatcaaaatccattaacaggttttcctatgcttgactgcctttcattgttacgctttatggttcatactgagggggcatgtaaatgacatctcttctatggtttctcaaggtctttaaaacagtgttgtattttgagtaaatatctgtttattccatagtaaggatagatgctagacaggttatgatttgctttggttctactcccctactttggataggattttacctaggtggagcattggatcatgttcttgagctgtgtggaactttgatttgcttatgtgaatgcttcacactgctggccaccctttgttgcttaagcagtagagacataagctcatcctgggtacaccttttagtgtgcaaggttctgtgaaaagtgggtgaaggtgcttctcaagccattaaattgtagtggactgtctttttttctttagcaaaatttggttttgggagtatgaaatttaaacttgtgtctgccatttgtaagatacgaagtcatagtatgagtgttttt

SEQ ID NO: 3011 - DNA, 1092 bp, Homo sapiens
ttgcaagaatacaacatttagagatttctagaacaaaagcggaatttaaccaagtacttactgtttagcataacaaatttagttcagtttcaggttagagattggtgtggattaaataagttgaccaaagatccattgaaaagctgagtgggccatcgaagaatgggtgctgtttgaatagcagactgggagagcaggttaggacagtccaggcaggggtcggcctgaggcaggaatgcatatggtatgcgcagcgttcagtaaagagaacctggttgaagtacagaatttgtggggaggaatagtgccagataagttaggtagaccaaagaagacaggcttggaatgctaggcacggagtgtctgttggcacctgaagggaattggggcgaggtaataaggtagcacgtcagccagagactggagagtacatctctgtctgagtaattttggccccaaatttgtaatgtggggatgggaagtgtattggtcagtcctgataaagagttatgtgtgcatctgtgtgacgtgttaaaattgcttcctgccactgctcgtgtttggtcagatagtaggttaggctgaaggaaagagaggtagtagccacaggacagataagctttgagaagccagagtggttggtaaagtatttggctttcatttagtatctctcatatatatatatatatatatatattttttttttttttttttttggtagagaggaggtcttgctgtgttgcccaggctggtttcgaactcctgggatcaagcaaccctcccccatcggcttccccaaatgctgggattacaggtgtgagccactgtgcccagcctagtatcatattttatacaagataaattttaccaaaaattctaccatcaaatatagaagttactttagttttttaaaaaataatagttcacatattctgtttcatgtcttctcttgcctctcaccctgagcacccactgattcatacctgtttatctccccctcctttgcttcttagctcctgtttattcttcaggtctgagttttgggatcatttcatttggaaagcctcagggctgtgcccagggtgctctgcc

SEQ ID NO: 3012 - DNA, 1031 bp, Homo sapiens
atatatacttaaacattcagtttcctgttcttcatagtaaaatattcctaaaattgtggttctctgtattttaacccttcgtatttcattatttttctatagttttatgcctcttctgtttggaaagtcatatttttcattggcttgcttttagtcatttaaattacagtatcaggctgaagttagtgatttaatcttaattgatggttacagatcaaactccttattctactctttccctcttctcactgctgtatttgactattctaaaaaaaaaatcgcagtatctcctctttttccctcttgacatccctttttgtaattcctaattttttcatgtcttaagtttttttcctaccttaaagttcctttgccttttagttgcagttttgattaaagtggattttttcttgggcttttaattagattttcttttccttcagcttttcatagggagattgaagatgatgctgactgacacttgggtcagtggcctgattacttagaataagactgtgaacattgagtggcttgaatatagcatttaacttagcctgtggatgtttccacttctacttgaaggctatttcctggcttagaggcactgtcctgaaaaataacaaaatgaatataaattaaacaccccatgtattcttgtgtagtgcccatttgaatcaagatgagatctgagatctgggtggcctatggcagaatactatttataactctagaaacaatattttactaagggatatgttgattacattggagagaactactaggttatatgatagtagtttaaaacataatttatatatgctacataattcctgttttgttttgttttttttttttttttgagacggagtttcgttcttgttgcccaggctggagtgtaatggtgcaatcgcggctcaccacaacctctgtctcctaggttcaagcgattctcctgcctcagcctcctgagtagttgggattacaggcatgtgccaccacgcccagctaattttgtatttttggtagagacg

SEQ ID NO: 3013 - DNA, 1050 bp, Homo sapiens
tgtgcccatgatgattttctcattaatgggaaagatgagacatgtacacaactgagtactaggtagaagaaagtgcctcaaaaggtgttgatactgtggtttaagaaagagaatcagctctggatgggggcattagggaagatttggtgtaggagttggtgtgtcacctgtgttttgaaggattggcaggatttggacatgtgataagtagctaagaggatttgaggcaggaaattgcatgaagcaaaggcacagagcctggaaaacttgggaaatggtgagtacttttgctgcttctatgatggggattattaaattgtgtttcaattttctttttaaaaaagatctcttttaaaatgttttatagcagatgcaggcaggcgtagttttttcaactcaggtaatttgtatttgaagctgtagcgggtagctgttcagaccacatagtaagagcattttggagagggagtccttgggactggtttctcaaagaaggaacagactggtttggccagaaccatagagcactggaaagataggttgggatcatagcataggctgatttaacaccagggttaaatgactttatttgatagcttcatgtgttcaaatgaaatacaaattataattataaaattaatatatactcattgtaatcactttcacacaattcagtattcctccagacattttctctgcatatataagcatactatagatagtatcttgaatttaaaaaaattccaaacatatttttcaattcaatacttataactcaggtttgtttttgaaaacaactgcataatcggacgctgtatggatgtaaacttcacttttcccattgatggacagttaaattgtctcagactctttggttcgcatcctcatatctgtactgttgtactattgtacaagtatgtgtataggataagctcttaagtagagttgctgaatcagtgggttatgtttactttttattttgaaagctgtaaataaattgcccccaaagatatgcctgtgtatgcacagaatattttagggttttcattt

SEQ ID NO: 3014 - DNA, 1031 bp, Homo sapiens
tcactgtcttactactctttggttgatggctttgcagaagaccccaacaattagtcttttagagtgtgtaagagtgaaatgaccaagaacaagaacacaaactcttacatgtatgtgacttttttttctatcttgcacttgaatcaagatttgtgtaacttttaatcttcattgatcttcatagttgtacacagggttcaatcagtactgtggactcttgacccaatccgattagtgttccatcctcttagagagattcaagaagaaaggcaattgagggaaagagcaagacctcttgttggtctggcttcaaatctctaatgaggttgatgtaatggcctgtgaggagtaactaaaaatatttggctatctgcctaagcagccctacattctgacatttttcagtatagtccctgggactgggtggggggcggcggaactgcaaagtatttttcaaatttaaggataaagctggatgtggtggctcacaactgtaatcctagtgctttgggaggtcgaggcaggaggctcccttgagaccaggagtttgagaccagcctgggcaacgtaacaagacccccgtctctgcaaaaaaaattaaaaattagccaggcgtggtagcacgtgcctgtagcccaagctactcagaaggctgaggcgggaggattgtttgagcctaggaggtcaaggctgcagtgagccaatattgtgccattgctttccagcctgggagacagagtgagaccctgtctcaacaacaacaaaatgtaaggataagagaaccccataaggtacagttagggaaagatatcttgtgataaataagatttgccatgtggaaaactgacccaccatcagtgataactgctatggcattttggtaagatgctgatgctaattttggtaacaggagtgtcatctttgaggaatatgattatgtgtgattatattagcagagcaaagctgaagtctagtcacattgtactctcatattgtagcctgaagcaagaatatgatgacagcaggggagt

SEQ ID NO: 3015 - DNA, 1036 bp, Homo sapiens
cgggatttctttttttactaccaggaattcctcttgaatgatatttaagtgattgttgaatcatatttgtgtgattggtatcctgataattattctgaagttgaagctctccttgtcctatttaagtgtgattttgccgagccttttggcttatgtttggtttcttgtctaacagagttatagtttgtgtgtgtgtgtgttttttttttaaataatggaggagaaatgagcattttaaatatgtgttagaacattgttaagattgcataggccaatttaatgaacatttgaacacaactcaagttcaaatactaaatatatttactagcttcaagtttgggttggaattgtgatttgtatagctaacttgttggtgtgccaagtaatataagatgtactgtgtgtctgtacattaggtaactaggtcagagagtacagttaatataagatgctttttttggtaaagtggtctgtgccagtgtaaaattattattattattatttttcgagatggagtcttgctctgtcacccaggctggagtgcgatggcacgatctcggctcactgcaactttgcttcccaggttcaagcgattttcctgcctcagtctcccgagtagctgggattacagacatgtgccaccacacctggctaatttttgtatttttagaagagacagggttttaccatgttggccaggctggtcttgaactcctaacctcaagtgatccacctgccttggcttcctaaagggccgggattacaggcgtgagccactgcacacggcatatttttaactggtaaaatttgccagtatgtcagcaagtgtgagcaatatatttaactgtgaaaattttccttatatggttagttataaaatgatgtggcctctaattcataaaccactcggtatttgaggaatcctcataccctatttgtcttgggtatttgcatcagaagtcgaagccatgggttttatcttaattttaaagtagttatatacatgacttttaaggactttggttaggctgttttt

SEQ ID NO: 3016 - DNA, 1268 bp, Homo sapiens
cttccccgagctgctaatacagatgtcctttgacaggcacggttgcattgaggcattattatgttactggttgtgcttcgacattaatttgttctgttaccagaagtatttacactttgtgacttcccaggactcctttgaatgataccttctcatcttttatgagataatttctcttgaaatattaaaccagagggtttatttctgttcccagtattggaaactatatacaccagcagtcttttaaaaaagtttttagtatcattaataaaaaatcaaataaacctactctatggaaagtaaaattgtagcactggacagaggtttttcttgggatttaaaccaggtagaggggtagaggaggagttgaaggagggaaatctcactaaaatcggcaattttgcaaatgtagtggccttgcattgcagtagtgttgttttcagtagtcttataaagtctgatagggtgacttattgtatggattagataaagaatttaaaattggaagccagagaaaatgtgaaatgagtgtgtacacaaattatcatagaagagggtcaaattgttgcccaaaggcttgtaaactaaggtgcagtttcagagataatctgcttaataaatgtctcaaaggatttttattttcacaaatcctggcccatctcagttgttctaatgtaatgaactattagagaggtttgcagtggtaaaggggactgggtgtgtaggataaacatctgttccagactgactgcttctaggaatgtgacttctgattcactttactttcaaaacttcaagagtaatctctaaagttgtgtatcttttacaatgaaatgtgaacagttcaaatgtattattttctcagtgggaatggattcaggggatttcagttcaatatattctccatcagtgttttgtcacaaggaaactagaactgagaaccaattcacaacaaaaaggtaatccaaatcaagaaataaaatgtaccagttaccttttcaactttgatttactggtcagtcgaaaaagcttttaaaaaataggacagtaaggcctagtgcggtggctcacgcctgtaatcccagcactttgggaggccaaggcgagtggaccacttgaggtcaggagttcgagaccagcctggccaacatggtgaaacctcgtctctactaaaaatacaaaaattagcctggcactttggcgcgtggctgtaatcccagctacttggggggctgaggcacgataattgcttgaactcagaggcagag

SEQ ID NO: 3017 - DNA, 1046 bp, Homo sapiens
tgggattacaggtgcccaccaccatgcctggctaattgttttgtatttttaatagagacggggtttcaccatattggtcaagctgacctcgggtgatcctcccactgtgcctggccccaaaatgtgttggcctttttttttttttttttttttaacatcaagatccaaacagctcacacattttgtcttttaataaggtcactctccttttctccccatgccatttatttgttgtcccttcaatattttttaaaaaacaaaagcattagaatttttatattccaagaaatggcaatgctgacattttactttgctcctctgcaacactgacggggagaggagaggaagagaaggggcggtgggtggagggcacctagcatggtgagttgggatgaggagaactaaatacttttctatatctggcttctcagagaagcacaagtttagagggtttaaagaaggtggacaaactggagagttctgtgttctcaacttcccaggagtggggctgtgtctttgaccacatctaggatgggaaaacttaaaacttgaggtctgacttttcttttttcctccccatctctttacctttctccttcccaagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtggccacaggctagatccccggtggttttgtgctcaaaataaaaagcctcagtgacccatgagaatactccgtgtgcct

SEQ ID NO: 3018 - DNA, 1117 bp, Homo sapiens
gaggctgaaacggcatcacttgagcccaggagtttgagatcagcctagggaacatagcaagactccattgctacaaaaaaataaaataaaataagtagctgggtaggttggcatacccctatagtcccagcgactcaggaagctgaggtgggaggatcatttgatcccaggatttcacagctgcacttagctatgattgcacccctgcactcaagcctgggtgacagagtgagattttttttgttttagatctatagatacccaggattgtgggtgacttttgtcccctgctgcaggagtaggctggggcacattgtttcaaggatcagttggggagctgtccccatcctatgcttttgggcattgtgaggccaggcgagcagcaagtcaagggggaagcaaggctgggcattgcggtggagcacactgggaggatcacactgatgaagcgtgtccctcctttccttagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtaagtgtcttcccaggcgagcagctttcccgcagctacggcttgtgaatcagaaaagggcccttttgttctggtgatggggaatcctgctggccagaatgtaggactcgctggaattttaacaggttttgtgtttgaactcaggagccttttaaattaaacaattggggcctgtaatcccaacattttgggaggccaaggcaggaggatcacttgagctcgggagctcaagaccagcctgggcaacatagcaagtagttgtattctgtgaagagctctgtcagagaacactaatctttctcccatcaagggaggctgaacccagtgtttcaactatgacaggagggctaagaaggtcctgggggtggaagagttcaggggagggtgagggttctcctctgtgctcttgacaaagcccaggcatggagggctttagccattaacag

SEQ ID NO: 3019 - DNA, 1018 bp, Homo sapiens
ggggaggaaatgacagcagtactttccttgctaggctgtgagcattacctgacatagtcacaagtgtttctcctggtgatgatgaatttgcagttatcaaaatagacctggcgtgaactggttgcagtagcgcacacctgtagtcccagctaatcaagaggctgaggcaggaggatcacttaaacccaagagtttgagaccagcctctaggcaagaccagtatagtgaaaccctgtctctaaaaacatgagtcagagacctggtgagcatttcacagcaccctggcccctctggtgctcctcaagaagcaagtcttgggctcatctgtgagctagattgggatggtaggaccagaggggcttactgccctgtggggctctctggacccagtgccatgcttctctgctctgctctccccaggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggtaaaggcgctagggaaccgcccccccacccagccctgcagcgccagctccctctgttggggggtcgtccacacctgccactgtggaaatctattctttccacctgtagtttgtaaagatcaagacccttcaaacggttttaaggaggaaaaggggagcttcattttattttacttatttttttctttttttttttttttttgagatggagtctctgtcgcccaggctggagtgcagtggcgcaatctcggctcactacaacttccgcctcctgggctcaagtgatacctactagtttggggagccaagtgtctgtccgtctgtcctgctggcagggcagcttagccatggacagcagaccctgagcctgagctc

SEQ ID NO: 3020 - DNA, 1022 bp, Homo sapiens
ctgggggatagagcgagattctgtctcaaaagaaaaaaaaagtaccagaacgtcttcaatgccctgtgtggctcgcattggatttctcttgggcagtgctgctggagtaatccacagggcaccaatgcgagcttgtgagggatgcatatttgcctgggtcagaatctacattttaacaagacctccaggtggcatgtaggctctgctgtagaacactttctttctgctagaggaattagtcatctttgcagtaagttctgcagtacaggatcataaacatgtgaaaggcatgaagaacagcccagagcgtttaattcacacagctggtaggaggaagaaacagctccctaatgacaaatgcatctgtgggcgggaggggacttgggattgtgctggaactggatttctgaattgctactacatcttttttcctctcatccaggtctcttcagagctgctgtgcccagtggtgcttcaactggtatctatgaggccctagagctccgggacaatgataagactcgctatatggggaagggtaagccttagaacccacagcccatggcctccctgcttccagccccattcctggccttgcccagtcctgtcctctctgggtggcacttgcacttgcaggtttatggcaggtaaacctgctgtgacccatgatgttgatggaagcagtgcaccaccttgtggacaggaaagttggtgtgtggattccggggttcccgagcctgcatgctctgggtcgagagttccaatgcttgcttctattgcagtttgttcccaatctgcgaaatactccttcacggttaggacaggaacccaagcatgagaacagggcctgttaactaaagaaaagtttccccatctcccaggagggttctgtgggccctccagagatcatcagcctcttcacgggctagaaaggatccagggaaggtctaaccaatgacctgccctgaatggtgagctgcaggtgtgtcatttagtgtgattttcctgttgactgactcata

SEQ ID NO: 3021 - DNA, 1028 bp, Homo sapiens
ttggctgacagcttgctgtgaccaaatgcaggatacagtgtgataggatggtatctcttgataaggggagggatagcaggtgtgaatatagcacctttatctctgtgactagaaatcagtcttcagcaaggatcaaggacagtttttacctgtaggctttggaatagtctggaggctctcatttttacctggctgtcaatccctataggaggagttttcttatgaaaaattagagaattgtgaaactccttcctttaagaagaaaatccagtgcctttgtagctctgtgttacctccagcacatggcgcgatggacagagtgggtgaggttggcaaaggagcttcaggcagaatcactcagcggtgctaaactcacagagaactgccagtcggagctgagtcaccatctgtgagtcacaggcctagcagtggaaccccagcccttcccttccccttgcacctcccctccccctcaggaagaaaggatccttgaggcctgacttcgttgggcaaaagaatgcctgagttggctgcttgctgtgtgggctctcaagcactgtggggtttctcactggctttatggggaaccctgagggttctcacaggatgccaagaattcccttcatccagtaagagtggtttgcttagtcaatgggtggaactttctacttggatattaatgaactttaagcaacaaaagaccccagatgctagaagattgttgggagttggacattttgaaattgaaatgaatggaactttctcttgtgtgtcttaatccttttcaaaaaacatgaaatgatggacttgctcagaacctttcatctctctctctccctgtctcatcaacttttttagagcagttttaggttcacagcagaagcaggcggaaggtgcagaggtacataaacccatgagtacccactgcctctgcacatgcgcagcccccccattgtcagcatccccactagagtggtcaacatgcgtgaacacgttatcatcaccaaaagtctgtagactccaagcct

SEQ ID NO: 3022 - DNA, 1045 bp, Homo sapiens
ccacgaggctgcggccccctcccccaccggtagcccccgcctctcgcccgcgctcgcggcccgcgcttctgcctagtaagcggtgactcatttaactccgagaaggcacctcttgaggaacctacagcagagccgttagatcattggcaagtcctccaggcgacctcgcccaagttgggcaagagcggctccccggctggccaccaaaaatcgggcctgatctgatttggtttttttttttttttgagttttgctattgttgcccaggctggagtgcaattgcgcgatctcggatctcggttcaccgcaacctcggcctcctgggttcaagcgattctcctacctcagcctcccgagtagctgggattacaggcatgcgccaccacgcccggctaattttgttttttttttgttgttgttgttgttttagtagaggcggtgtttcaccatgttggccaggctggtcttgagctcccgacctcaggtgatccgcccgcctcggcctcccaaagtgctgggattacaggcgtgagccaccgcgctaggccaagaaggatgtattttaagaaagcttcctgttcaatgttcccctgctctgtgcgcttctctgggcggtagggtccattgcttcacttgcctttcaggcccacccgggccctgactgctccattcatttaccgtgtccctaattcggggttccatccaggcagctaaaaaagctgtgaatggtccgggcgcggtggctcacgcctgtaatccgagcactttgggatgccgaggtgggcctcctcaggatcacctgaggtcgggagttagagaccagcctgaccaacgtggtgaaaccccgtctctactgaaaatacaaaaatcgaccaggcgcggtggctcacgcctgtaatcctagcactttgggaggccgaggtgggtggctcacgaggtcaggagatcgagaccatcctactctactaaaccccatctctactaaaaatacaaaaaattagccgggtgtggtggtgggcgcctgtagtcccagctactctggagg

SEQ ID NO: 3023 - DNA, 1496 bp, Homo sapiens
tgagacagagtcttcctctgttacccagtctggagtgcagtgacaccatctcggctcactgtaacctccgccttatgggttcaaacaatcctcccgcctcagcctcccaagtagttgggattacaggcacctgccaccatgcccggctagtttttgtgtttttagtagagacaggagtttcaccatgttgcccaggttggtctcaaactcctgacctgaagtggtccacccacctcagcttcccaaagcagtgggatataccggtgtgagccaccgcacccggccagaatcaacgttttcttttgtgctgaaggagctcacagcccctctggagttctatttcctgctaaagatggcttctgattttctcgaattcctcctggtttgctggaccagcagggctggctgggcagcaagacacatcaggcctggggccttatacatcttatgtttaatgcagcagaagctgggcctgatacttagagtgaaggcctttctgtagaaaggaacatcatttaaatctctgtcctcaggttgtgactccagggaagtctgacatggttaaagattgctgacttggtacgttttgtattttgtggaacacaatcaattttcatgtattgattaattattccccattgcctaaaatcctggcctcctctctcttgatggagaaggctgtccccaaagtccaggcctagaatctttgactggaaagactgtcctgagagtccaggcctcctctctctgactggaaagactgtcctgagagtccaggcctcctctctctgactggaaagcctgtcctcagagtccagacctcctctctctgactggaaagactgtcctgagagtccaggcctcctctctctgactggaaagcctgtcctcagagtccagacctcctctctctgactggaaagattgtcctgagagtccaggcctcctctctctgactggaaagactgtcctcagagtccaggcctcctctctctgactggaaagactgtcctcagagtccaggcctcttccctctgactggaaagattgccctcagagtccaggcctcttctctctgactggaaagattgtcctcagagtccaggcctcctctctctgactggaaagactgtcctcagagtccaggcctcttctctctgactggaaagactgccctcagagtccaggcctcttctctctgactgaaaagattgtcctcagagtccaggactcctccctctgactggaaagattgccctcagagtccaggcctcttctctctgactgaaaagactgtcctcagagtccaggcctcttctttctgactggaaagactgtcctgagagtccaggcctcctctctctgactggaaagcctgtcctcagagtccagacctcctctctctgactggaaagattgtcctgagagtccaggcctcctctctctgactggaaagactgtcctcagggtccaggcctcctctctgtgactggaaa

SEQ ID NO: 3024 - DNA, 1092 bp, Homo sapiens
tggagattgtttggagttttgaaatcacctctcctggtaagaagactcggtctcctgtgttcttgccccctctgtatcttggccagtgatggttcccttagacaaattgatgggggatttctggcctgaggacaggaagaaaaggagcccaggtctgtttcagtgaagaacaagcccaggacaccccacctgaaactaggactagttttgcccagtttggcatcgttgaaaacgcatttgccctcttccttgaaccaggctgtgccttcttctatctgtttccctgccatggaacatcacccaaacattttactgggaaggggaggggtaagagcagatacaatgcttgtctgaaacccccgttgcatggcattctttgcagggacaggacaggggagcagtttttgctgttaccgaaccctttgtgacagagatgctgtttgttaagtgatttgcttttttacaaaaaaaattccaaggtaattgatgatgacacagttgcttagactatggaatataccagttaggattccttcagctgcaagtaagagaaaaccttacttaaaatgacttaatcagaacagtaaacattttttaaggctaggtgcagtggatcacgcccataatcctaacactttgggaggctgaagcaggaggatcccttgagcccaggagttcgagaccagcctgggcaaacaggcagatgtggggtatctctacaaacaaaccaaaccaaaccaaaacaaaaaaactagccaggtgtggtggcatgcacctgtggtcccagctactcaggaggctgaggtgggagaatcgcttgaccccaggaggtggaggctgcagtgagctgggattgtgccactgcactccaacctaggcaaaagagcaatgcactgtctcaaaaataaaaaaagtaataaaccaagtagtccagaggtagggcagcttcaggacaggtgacatccaggcgctcagtaatgtcaaggactttggttccctccgtatctctgctctgctgccctcaccccactggcttcattgcctgccagttcctctcccattgggctcctcccggggtctcctcatgagtga

SEQ ID NO: 3025 - DNA, 1471 bp, Homo sapiens
atttggaaacaaagcattgctttgattcatcactttcctttagcttagctttagttgtgctatttacttgatattgaatttcagctgtgaagttgggagtggagtgagtgtttatccaaggagagtattgattaacagaatatgagatattaacaaaacaccatgttgagggtaacagtatgttctgaggagggacaggaacttgagcgcaggagtttgagctgctcagagactttcttttttttaagacagtgtcttgctttgttgctcaggctggagtgcagtggggtgatcatggcttactgtagccttgacttcccagactcaagccgtcctcccactttagcctcccaagtagctgggactataggcatgtgccaccatgcctggctaatttttttttttttttgtagagatgggtttcgccatgttgcccaggctggtcttgaactcctgggctcaagcgatccactcacctcagcctctcaacgtgctgtgattacaggcatgagccaccaaagtgctgtgattacaggcataagccaccgtgcccagcccagaggctgctttcctaccctgtctctctgtaacaaccccattgcagttgtgaatgagcttattcgtgactccaggagtataataatttcctgtggctgctggatggcttaaattattctctcacagttctggaggccagaaatctgaaatccagcagggccatactcccactggaggctctagggaagaagcctcccttgtctctctttagctttggtgactgtcccagcattcctgggctggtggctgcatcactccagtctctgcctctttcagtggccttctctgtgtgtctgtgtcttctcctcttctgactgtcttaaatttccttctgcctctgtttctaaggacacctgtcttcgggctcacccagatcatccaagatggtctcatctcataatcttaatcagctccgcaaagacccacatgctctggttgcagggatttgatgtggctatctctccagggtgtttttcagtccactgcaatgagtgacgcagtaaaagaatgaagaacagtgcctgacgcgtagtggggccgctgttgatattgctattgctgctgtttttggattacttctcatcctttcattcattcactggttatccaggtattggccctggctccccatcatgctaggtgccaagggggaataagtgaagtgaggcaccctgacccacgaggggatgatgccccatgttgctggatatctgaggtcccacagtacaatggactgtcctggctgagcctacaaacctgccacacttatggtattgtgactttggggcgtggcattcctagttgcaagcagccaacttgccaaataaccttgtgaaaagtccaaatcattgtcaacttatgaattaggtgtacttggccgggcacggtagctcacgcctgtaatctcagcact

SEQ ID NO: 3026 - DNA, 1877 bp, Homo sapiens
aagtcagtggagaaatagaaaaaacattgggagtgacagtgttcctgatggtttcttgtcgtgtcaacaacttacaagaacatttaggatgccagcagcgtgtctgacatgttttttattccctcctggattccatggacctgccctctggggagttaatacagtcagggttgcttctatggttaaatcatccccaggagtttacagaagaggaactgagccacgggatcttgagacagagcaacaagggaagagagagcccagtgttgaatttaggcatttggtaaaaactttaaaattcatccacttatttattgattcctcagttcatctgtgcatgtgttcatatatccagcacgttccagtgacttccttctgtatggtgtgttcagtactgtgctggtgttgacacaaacgtggctgtgtccctaccgtgtccagggcagagttaacagataggagaggtgggacacctctgcctgggacactgtgggtggcttcattccctttgggcgtggggaccatcctggagtccactgcaggcacaagcaggcaaagggaacagcaggtaggagtgcagaggttctgagggcaggtgtggggcaaccccatggggctcagtcatgcctcagggcaggtagggggccagaagcagtggccactgcaccctgcctcctcacttcactaggaaaatgggagggagcgggatgtcaccccttgaggtggtttgtctttggggcacaagatacctctgaacaggagcctcaacaccaggcagacaggttcctgggaaaccttgagtgttttatttttattttattttattttattttgagacagagtctcattgcgactcccaggctggagtgcaatggcatgatctcagctcactgcaacctccgcttcccaggttcaagcgattctcctgcctcagccttgcaagtggctgggattacaggtgcatgccaccacgcctggctaatttttgtatttttagtagaaacgaggtttgaccatgttggccaggctggtcttgaactcgtgacctcaagtgacccacctgccttagtctcccaaaatgttgggattacaggcgtgagccaccgcacccagcaagtgttttagacagctaaagattcatcctggctgggtgcggtgcctcatgcctgtaatcccagcactttgggaggctgaggagggaggattgcttgagcccaggagttcgagaccagcctgggcaacacggcgaaacactgtctctacaaaaaaatcaaaaaagatgaagcaggaggattatttgagccctggaggttgaggctgcagtgagccatgactgtgccactgcactccctcctgggtgacagagcgggaccctgcctcaaaaaaaaaaaaaaaaaaaaaattcctccctgtaccggcacttttcaattgtttcgtttttggttggaagtctttccagaatataattcatgcttccctcttcttaaaacagaataaacacaattttacctggcctcaggtggcagggcttttttaagtgtcacgaatgtggtttatagaatttccatttcttctcttgttctctttctctcacttgtctttccttgttcttgccggtgaatctgatttcagcaaacctttccctcccttccaagttgctgcttctaaattactgtggggtcaggaaccctcattcctatttaggttaagattttgaaataagaccatcttggatgatctgggtgagccctaagacaggtgtccttagaaacagaggcagaaggaaatttaagacagtcagaagaggagaaaacacagacacacagagaaggccactgaaagacagaggcagagactggagtgatgcagccagccca

SEQ ID NO: 3027 - DNA, 1035 bp, Homo sapiens
aacagcaaacacttccctgcctctcattctctccccttcataaagaatcacaccttctccaaatgctgccagattcgcacgctttgatggcacacacagcacacattatgttcatttaagtgaattatttccagttaagcccaattaccatacgaaaggctcacacttgtgcttgtccttaaatgtgtgtcaaattaactttgttagaggttgtttttaaggcagtggagaaatataaagaacagtttctgggagttagttggcacttgtttttttttttttttttttttttttttttgagacagggtctccctctgttgcccaggctggagtgccgtggtgcgatctcggctcactgcagccttgacctccccaggctcaagtgatcctcccacctcagccttccaagtagctgggactttacatgtgcaccacacccaactaattttttaaatttttcgtaggggcagtgtctcattatgttgcccaggctggtcttcattttaccccttcattatctcagtagtgcatgaccagaatataacacctctcaatccattttcttttgttttttaataagaaaaaaaataataattttaggccgggcgctgtggcttacatctgtaatcccagaactttgggaggccaaggcgggtggatcacttgaggtcaggaattccagaccagcctgggcaacatggtgaaaccctgtctctattaaaaatataaaaattagccaggcacggtggtgtgcatctgtgatcccagctactcagtgggctgaggtaggagaatcacttgaacccaggaggcagaggttgcagtgaaccgagaccacaccattgcactccagcctgggtgaaagagtgagacttcatctcaaaaaaaaaaaaaaaaaattttaaaggtggtatctcactctgtcacccaggctagtctcaaattcctggcctcaagcagtcctcccgcctcagctcaacctgttttcttatcctaaaataaatcattcctgtcctgcctacctcccagagtctc

SEQ ID NO: 3028 - DNA, 1047 bp, Homo sapiens
tatatcgggagcagcattgcagcccaggctcagcctctgtggagtgtcctacttcatagcacggattggggaggggaacgaattccatgtgtgtgctttcattcatcttattttgaatctaacatatgttttggcaaggaggatgtgggaaggtggaacaaaagaagcctggggttgggggtggtaaagtcacttctgggaaaaggtgattaaatacaagcttgcgtccagatgggtacatcccagagcgggatcacgagggaattttctcttcatgttttatagttggttgcttcaaacctggttttcaaggtccggtttgaagaccctaacctctcagtccttttctattgtctttgtcttgcttttccacagagttttcaggagttgaaaatgacaatgaaactgagcctgtgactgtggcctctgcaggttgctggattttttccctacattcactattgtgtttcatttaaagatgagactgattcattccacgtgtcgcatgaaacgccccagttgcattttggtcctggacaccatctgagctgcttccctgcattgcgcttccccattgcttcatggagttcccttattctgcccattctgaccccagctggagtgaggacaaatgacatctcaggcagtgcatgcatgggacttccccccccatccagtttgaccctgaccccactgcatgaggctccctgctttttcagtcttacaggcagggtttgggaggccgcctcgtgactgtcatgtggatgaaccacgagacaggaaaagacttgtttctagatattctgtcctgattgacagtaaattttaaatagacgtctctcttttttttttgttttgagatggagtcccgctctgttgtctgggctggagtgcagtggcgcggtcttggctcactgcaacctccacctcctgggtgcaagcaattctcctgcttcagcctcccaagtagctgggactacaggcatgcaccaccatgcccagctaatatttatatttttagtagagacggggtttcgccatgttcgc

SEQ ID NO: 3029 - DNA, 1065 bp, Homo sapiens
gccttaccctcgtgtcctggatcttttccttccatttcctgtgtacagcctttttggggacactgccgttaccccactctagctagcatagctctgtctgtaggtgctccataaaggtgataggactgaccacaccgtcacctttcccggaaacccaagagggagcgttccacagagggagcgtgtagtggggggaactgttttataaattaatccgtttattgaaaggttcacaaggacaaagaggcaacagcaagagtcaggcacagaaataaaggacgcagaagtagaagtgcgccttggacctggaggactcttccagagtgtttatcacttggtgacctggtaggagggctgcgagggctctgttcaccctcagcaagggccacgtgtggggaggattccatggaagtctctgctgagaggggatatgataaccaccagagcaccagtgcttcttacctgtacttaccaagtggcaggctgtgtgccaactcctttatacacgttgtctcacctaaaccttagaatcccttttttatagctgaagaaactcaggcccacagaagcagcaagccaggtgtcacccagctgatgaatcaggagccagggttttgaatttttttactttgagaagcctgtgggccaggcgcggtgtctcacacctataatcccagcactttgggaggctgaggcgggcagatcacttgaggtcaggagttcgagaccagcctggccaacgtggtgaaaccccatctctactaaatatacaaaaattagccatgcatgttggcatgtgcctgtgatcccagctactcgagaggctcaggcaggagaatcggttgaacccaggaggcagaggctgcatgagccaagaatgccctattggccgggcgcggtggctcacgcctgtaatcccagcactttgggaggctgaggtgggtggatcatgaggtcaggagatcaagaccatcctggctaacacagtgaaatcccatctctactaaaaatacaaaaaattagccaggcatggtggcgggtgcctgtggtcccagctactcggga

SEQ ID NO: 3030 - DNA, 1048 bp, Homo sapiens
ttgtggagtttcacatcgacatcaaaacatttatactgttctcccatggacaagaatggaaacatagatttttaactcctaattaagttgtgagccaatttagatgtagagaagttcccaggctggtgtctttttcaggtttgataggataaagtccgaaacaaaggcaagtctagccagtccctcccataatagaaactgtgtctgaatcgtagatgataaaatagctgttgaaatggatgcctgacgagtcggtatttctacctttctcattgagtagtttgttttgattccctaattttagccaggctcattgcacaggaagacttgtttcctttgatttttttttttgacagaatttctgtaattacggtgctgatcctatatctcacgcttcctcctctctcaacacataactgcgttttagcttctctctggtccaaatcaaactggctgccagccctcccaggagctggggcagcgctggtgttctcaggcctggctgtgtgctaatgagactccttttaccctcgagctatctaagtgctcctgtggaatgcctgtctatattttcttctctctctcttttgtattcctgcatgaatggatgcaaagtaaacaagttgcttggaaagccagaatctgcttcatcttactaaagcccgagaacttccccatgtttaaaacacagtgcccctgctttgtccacggaccctccaaacccctggctgccaaattgttgtcatttattttctttgggggtggagatggggggaggagggcaaggtgcagaagatctatgtggtaggaattcttacctgttctgctttgactccctaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataagtaagtaagctg

SEQ ID NO: 3031 - DNA, 1022 bp, Homo sapiens
tgtctggcccagagtgtccagctgttgagaaaccctgatctaaataatgtctaagctatgtatttggtgtttcaatcagccctttaaaatttagtttgtttgggattctgatgaagaaatccttaaacctgtgcatacagagattctttggcagtgttcagtctttggaaaaaaaaaaataagagtaattaaaaaatctgttttacagctgggtgcagtgggtcacgcctgtaatcccagcactttgggagactgaggcaggcggatcacttgaggccaggagtttgagaccagactggccaacatggtgaaaccctgtctccgctaaaaatacaaaaattagccaggcacggtggatcacctgaggtcaagagttcaagaccaccctggccaacatggtgaaaacccctctcctctaaaaataacaaaaattagctgggagtggtggcacacattgtagttttatttcacttcagcctgggtgacagagcaagactctcaaaaaaaaaaaaaaaaagaatttatgactagggacaatacttagagacccagagataatgcctttttatattttgattttaaaactgtgaatattttacctgttccaaatgcttttttgaggaaaaaaagaatcagctggagattttaaacttagagtttaagatacttttctacccatgtcatctttaacaagggcctactagctcgcctttggaaattaactagcaggattttaaaatcaaagcctgagaacttggagcatgcaagggcacctgtcaccacctgctggcagtgttccttaattgcaggttcttatgatagaccaaggtttaaaagttgaatctgcaaatgaaacctgtaacatcatctaggatttataggtgagacgccaacagtctcttgcaatatttagctgttgttttttaagggcagacatgaccaacctacgtgtcatgataagaggcacacatcacactcttgtttgaaacagtgggtttcttttttctttagagatagtcttg

SEQ ID NO: 3032 - DNA, 1050 bp, Homo sapiens
cgtgcattaaaaaacaaccaaggcctggcgcggtggctcatgcctgtaatcccagcactttgggaggccaaggtgggtggatcatgaggtcaagagatggagaccatcctggccaacatgatgaaaccctgtctctactaaaaatacaaaaattagctgggcatggtggcatgcatctgtagtcccagctacttgggaggctgaggcaagagaattgcttgaactcgggaggcggaggttgtagtgagccgagatcacaccgccgcactccagcctggcgacagagtgagactcagtctcaggaaaaaacaaaaacaaaaacaaaaaaaaacccaaacggccaggcatggtagctgacacctgtaatcccagtgctttgggaggccaagatgggtgaactgcttgagtccaggagttcgagaccagcctgtgcaacatggtgaaaccccatctctactaaaaatacaaaacaattagctgggcatggtggcatatgcctgtagtcccagctactcaggaggctgaggctggagaactgattgagcctggcaggttgaggctgcagtgagccaaggtcacaccacttgcattccagcctgagcgacagagcaagactctgtctctaaaaaaaaaaaaaaaaaaaagccaaactaacagaccctcaaaagtgacattttgaggctatgcaaaggccatatataggaacccttaaatggcgacagcctccccactgtgtcagcctgacatacaatacccgtcttttccctaagagctgccaccacccgggaactagaatgctgctttcagttgtccctgatttgataggttctttctctcctatgttttaggtatatttttgctcattttttgatttagctttaggatattattattagattaaaaattttcacaagatctgttactaaagtttttatttttaaagattcttggcagagattcacgtacttcaaagtagcagagtttaaagcagcttaaatgcctataaaacatctgaaagttggctgggtgcagtggctcacaactgtaatc

SEQ ID NO: 3033 - DNA, 1093 bp, Homo sapiens
ccagactggtctcgaactcctgacctcaggtgatcccccatctcggcctctcaaaatgctggaattacaggcgtgagccactgcacccagcctattactgagttttaagagttctttatggactaggcatggtagctcatgcctttaatcccaacactttgggaggctgaggcaggtggatcacccaaggtcaggagtttgagacccgcctggccaacatggtgaaaccccgtctctactaaaaatacaaaaattagccgggcatggtggctggcgactgtaatcccaggtactctggaggctgaggcaggagaatcgcttgaatgcgggaggcggagattgtggtgagattgagatcacgccactgcactccagcctgggcaacagagcgagactccctctcaaaaaaaaaaaaaaaaagaattttttacgtattttgcgtaatagtcccttaccagatatatgatttgtcaacattttctttcattctgtgtgttgtcttttcacattctcgatggtgtcttttgaaacagaaaagtttttaatcttgataaagttctctttatttatttatttttttctgttgcttgtgctttagatatcataactaagaaaccatttcctgccaggcgtggaggctcattcctgtaatcccagtactttacatggcagaggcaagaggatggcttgagcccaggagttcaagaccagcctgggcaacataggaagataccccatctgtcaaaacaatttttcttttatttatttatttcttattttttttttgagacagagtctcactctgtcgcccagactagaatgcagtggtgcgatctcagctcactgcaacctccagctcctgggttcaaacaattctcgtgcctcagcttcccgagtagctgggactacaggcatgtgccaccacgcccagctaactttttgatatttttagtagagatggggtttcaccatgttgatcaggctggtctcaaactcctgacttcaagtgatctgcccaccttggccaaaaaaaaattaattagccgagtgtagcagtgtgggcctgtggtcccagctcctcaggaggctgagg

SEQ ID NO: 3034 - DNA, 1050 bp, Homo sapiens
ttagctgttgaccttgccctgaaactgctgagcagtaggagcaagctggcagctgtgaccaactgtgtgggccgtggagtccaggcccttctgggtgggtggtgtctgtccacagctacttctttctccggggaggggtcttctggagctgaagctggagccagggaagaccccagggaatcgttgcggaataggtggtgggagtcactccctgctgctggggcgccctgtggactgcccctacctccataaagatacctctaacctggctgccggggcctgagccacacagacctgagctgcaggaggttctgagaattctgtggactgggagtggagaggggaggggtcagccatgtctggaagagtttcataagcatatttattttctttgcgagcctaacgacaccacaaacaaacacaacaacaataacagcagaactgcaatcagcccagtcccatactgggcttacccatgtgagggcaggaccctgcatctgcctgtgccatgtgggcaaatggatctctgttaaaatctcacctgcccaccttctccatcgcagagccaatctcagctgatgctgcaggatcctgctgtcagaggctcagacactgcttaggtggaagaagccctggattgttgtctccagggactggggcaggatgcgggggccagagcagggtgcagagactgccataatgaaccccaaaggcctggagcctgtgggtaatggcctggcgtgcacctcctgcccactaggtggcgctgtctctcagcaaatgctccaggctgctttaggtgttccctgagccagaggaggctccatctaccccgggactcctctagcagggggtctgaggcagaccctccaacggacagcacccgaccttggtcctgagggtctggccgccacctttagccctgcacatgcttcccctccagggctggatgggtctggtacctggggcactgctcccttacttgaggcccagggagggggccgtgggcacccctttaccccctacccttcgattccttcctcggtcaca

SEQ ID NO: 3035 - DNA, 1114 bp, Homo sapiens
tcagtgtggttcagagtgaagggaccttatgtaccttgtggagaaacgtgagtgccccccacccccgccaaaaatagcactgtgtcagttttccccctttcttcttgaagtacttttaaatttcctaatgtaattaaaattttaagctgtgaccctgcaaagagctggcatagcttttgacagcgggattgatggagcttccataggtcaaaatttccagtctgatcgcactctctggaggtgacccgcactctctggaggtgacccatgctctccagaacctctgggccaggctccatccctggaattactaggtctggaagtggtcccttcctgacagaaatgcaaattaatttgccttttggggacttagtcagcttgctggggatctctctggtgtcccaggagagaaaaagcgttcctctacctccagttgacacagaggatcttttgatgcctttgctcaggaagcttcctgccaggtgcacagcccatggggaaggtcggtcaggcctgggaggcctcatacccaggagtgagggggcgcttgtacccatgcaagagctaggattccagcccttccattggcttataaatagaagaaggctctggattctgcattagtaacccctctggaacctgccagaggctgaaggtaatgagtcagactgaattaaaggaagatccgtggctggattttgtaggcgtgctggttcctgacttcaggtctcaggctctgacttggccaggttccagggctccagctgttctctgggaagaaaaaagaacctcttttaaaattaagccgaaagatgcctttcttttcttctgtccttgtccccccactgtgcagagagaaaacctccaccagcacgtccccttggttagaacagtagagcctgaagacatagcccaggatcttcagtgttctggggcagccaaggaaacttcctcaggctccacatgccttcctgtttgcattgttttcagctgaatttcaagaggctgtcagagcaggcctgccaggtactcttgcctctgtaaaaaggtgggtttcactcaattcaggactggagagacaacgagatctgggccagaatcacaaggataaata

SEQ ID NO: 3036 - DNA, 1877 bp, Homo sapiens
catacatgtatatcactgtttctttgttgagagtataccaagattgactggacagctttcctacccccaccctatccctacttctctgccagtccctgccatcaccaggcccctctatagagggttgggccacactggcaactctgaccatctcctgtttgattacttgatcaggaacacagtggtatctagaaagcattggttgtctttcatctgggctgagcggagttgggtaactcagcagagcgctgagagaaatggcatttcaaacccaggggctccactcaccaggaatccagagtgggactctttagactgggtgccattggccagcttttcagatccctttttggtcctcccatcagttgtccacgatgccacttgctctgctaacctggagagaccaacacaagttagtgggaatcaaataggacgcttgtgttgcaggtcactttcagagtcctggggcattttattggcagaatctgaaatgcctgctagtcatatgtcatctgtagatttgtaaaaactaaacgcagagtgggtgcaagctttttctcatgtagctggttttcttactatgagaatgatacgtgctcatttagaaaatgagaaagtgaatgatagtggcattttacatacactgtctcatttcatcctcacggtttctgagatacgtaccattattaccattttgtatgttaagaagctgaggcctagaaaagttaagtaaagtgtttgaggtcgagctagttgggaacagaatcagattcaaaccaggcagtatgactcccaggcagagctctgagcaccatgtcatatactgattctcagcagaaaccatagagaagaaagaaaagcctcccttaagcccaatgtaggtgatactcttagggtagtcagagttaacttgctggctgctccaaagggtttgaatcctaggccctttccctgtcttgtctgaccctgggcaagctaagtagcctccctttgctttactttccctgactgtaaatggggataatgatacttgtaccttcgtagttcccaggggcatggtggtgtttgagccaaagtgcttttgaacttcttttatgaaagggaactgagcaccaactactgttatactcagttattaaagacctattatgctctggtcttccatgaagccttgttaaaaagggaaagacaacagtccccagagggaagggtgtccttctgtgggggaatagctggacaaaaacattgttctccccttttgaagtttcttaaggattgagggtcatacctgtggctccatttttcatggttgtgttgtagtgtagaaacttctgtaaacaggtatgtgttctgtgcatcataacatgattgaggacccccaatggcagggccaagagggagttaaagggcttggtttctaatcttggttctgatgttttttataagccaggatcacagagacaccaagaagtggtggttgtcttccattactcctccctccctcccctccttccttctaatgactcattgattcaattaacaaatatttattaaggctttattacaatctggacaccatcataggtactaggaatatcgtggcaagcaggacaaaaatagttattccccagccgggcgtggtggctcacgcctgtaatcccagcactttgggaggccaaggcaggcggatcacgaggtcaggagattgagaccatcttggctaacatggtgaaaccccgtctttactaaaaatacaaaaaattagcctggcgtggtggtacgcacctgtagtcccagctactcgggaggctgaggcaggagaattgcttgaacgctggaggcggaggttgcagtgagctgagattgcaccattgcac

SEQ ID NO: 3037 - DNA, 1094 bp, Homo sapiens
gcggagagcgcccccgaccccgctcggacccctgactgccccagcggcgcggcgccctggtctgggcctggccgcctctcgccgcagaccacctcccgcctccctgactcttcgcccgggggtcgcctccacaggtgtccgcgccgcccaccttgttgctcacctcaccgcgtccgggtgcctgtcatcgcccgtccgccctcccgacctctgggcccctgcctcttccctcacctgcgcccactctgagactcttactctccatatttccccaaactaaacgctgggccgcccttcctccctctgtagtttgattgaactgtcgtctcccgattccacccctccccggtgagccttcctggaaggtacctggtgggggcacatatctcacctggatggcgggcgtgtatgcacgaacctgcaaaattaaccacctggagccccaaactgcacctctcacctccttttcatcaccccaccccaaccaccttcctttttttggaacctggtaaccgagacactcaggtctggacacccagcctctgctaggccctccatccctccctctgccttgtgagctgaacttgtctgagcagtgcctgttgtcaggttagcccctgggaaggcggcgggggccgtgttggccgcaaatcaagagttttatgaataatgagacgtgtggcttgcaccacctcctgtctgaggatctcagtatgctccagctgtgaattattttgtctcctgtcactcacagaactgagaggaacatgtctggccaactgctgggtaaattgaggtacagggtgtgtgggtaagggacctggaggcaagtcatggtttgtcttgaagttctgttcgcaggagccttggctcttagctccctgctacaaccactgggctccagttcctggagtgtgtccccaagtgataactgatctcttgtgccattaaaatgtccagagataccagcagcttcctcagatttaaagtaggactttggatcataaataaaggtgcgggctgttaaatgccaatgtgtcattcacggtttgctgggggagttcgtggtcctcccttgtaaatacaaatcacct

SEQ ID NO: 3038 - DNA, 1048 bp, Homo sapiens
tttaaaaaaaataattaacactatttgtgcaagtcagtgtttttgaaaattcagtgtcccaataaaaagtggactgcacactaagggaccatcccccagcctgtaagctgtctgtattaatggggcccgttgtatctcggaattttgaggttggaacaatgggagccctgttgagcgtttcctaaagtgacttagccgcctgcgttgtttgaccagggaagcaacaggaaatggcagctagaggccctccctgtgcgtgacctcttgtcacactcagaggggggtaactgtcagctgttatctactcttcaggttttggagaaacacaaaataagttatgaggaaaagcaaatttctctcctgagtatttacatgtctctgtatgctcaaatatgcagatgtgtccctatgcgtgtatattagcttattttttaggctctagccattttatattctttcatgtgcttctcaatattctttttctttgcactttatacaaattaaaagcatttttaaagcttcttctgtactgtaaactactaggtgctttgccaaccagacagattagaggacctccgctacactgatgccttatttggaacttaaaagaggtgaaattcatatatcataaaattcaccattttaaagtgtaccattcgttggcagaacatttacagtggtgtgcaaccatcactactctctagttgcagaacattcttatcacccccaaaggaggccctatacctattaagcagttagtccccattcccttctcctccgactgctaacaatagccactaatctgcaccctgtctctgtggatttacctattctggatatttcatataaatggaatcatatgatatgtgacctttttatgtatctggcttctttcacttagcataatattttcttttctttttttttttttttttgagacagagttttactcttattgcccaggctggagtgcaatggcgcaatctcaacctccgcctcccaggttcaagagattctcctgcctcagcttcccaagtagctgggatta

SEQ ID NO: 3039 - DNA, 1049 bp, Homo sapiens
gctaggcacgatagcttacacctgtaatcccagcattttgggaggctgaggcaggcggatcacctgaggtcaggagtttgagaccagcctggccaacatggtgaaacctcatctctactaaaagtacaaaaatcagctgagcgtggtggcgggcacctacattcccagctactcgggagaccgaggcaggagagtcacttgaacccaggaggcagaggttgcagtgaaccaagatcatgccactgcactccacctgggtgaccgtgagacgccatcaaaaaaaaaagaaagaggaaagaaagaacgaacgaacgaaagaaagaaaaggtaaaatccctacttaaataattcacaacctagtgattgggaggaaatcaaggaagaccttgtagagaaggtgacacttgaactagactttgaagaatgaactgggcttcataggtagaaaaaaaaatgcaggctcaaaaaagtgcatgacatttttggaacagcaagtcatccagtgtggttagactgtaggaaactaactctgaaaagacattgtcagttacatcttgggtttgccttgacttttactggaaaattccacagacttaagagaaaaattaaaatggacaatttccaggaaaaatccactaaactattatacataagatgtagctacaataaattacacttctgggtataatacttgtttatgtttgcatatcattaatgatcatagatgacttatgccaattttaatagattaggtagtaattttttgtcattatatttaattttgaatatactgtaagaatcctctccaatgaagtacacatgtcaaatcatctggtaatgatttcattatgtgtaggaaaataaaacatgctttaatgctgtgtgcggtggctcacgcctgtaaccccagcactttgggaggccgaggcgggcggatcacgaggtcaggagattgagaccatcctggctaacatggtgaaaccctgtctctactaaaaaaaatatacaaaaactaggccgggtgcagtggctcacgcctgtaatcccag

SEQ ID NO: 3040 - DNA, 1050 bp, Homo sapiens
agaatattttatttctgttagacacacagagcgttcgttgactcgtctgggcgttagtgttaatattctgtacttgaagcaagcccaccaagcggctgaactgggtggataatggaaaatgtcctgtggatttgggagtgagacaaaccggcttgagtctaacctctcagttagtctaaggctccaagcttgaaagggttaaatgaagtactatatttgttttgtttcgttttcgttttgtttgaggctttgctctgttgcccaggctggagtgtagtggcacaatctctgctcactgcaacctccatctcccaggttcaggcgattctcttgcctcagcctccagagtagctgggattacaggtgcccgccaccacacccggctaagttttttttggtatttttagtagacacagggtttcaccatgttggctagactggtctcaaactcctgacctcaagtgatccacctgccttggcctcccaaagtgctgggagtataggtggtgagccaccacgcctggcctaaatgaagtaccacatgaccgacagaccgacctggggaacatagcaagaccccatctctacaaaaatgtaaaaaataaaaattagccgggtgtagtggtacatgcctgtaatcctagatactcgggaggctaaggcagaaggatcacttgagcccaggagttcgaggctacaatgagctgtgatcgtgccactgcactccatcctgggtggcagagtgaggccctgtctcaaaataaataatccagtcccccccaagaaaggaatgaagtgctataatgagaaaaatcctagtacctaacatatagtagacagtggagagtggttctctttcgtttctcaggggcagacagatggggtgctggagtcctctatcaaagagtcagagctctatcccagatgtgtaatgaacgtggtcacagacatattgtcccattaccatttaccttccctataaccactgtgcctccagccttgtagaatagacacataggagcgcagcaatacgtctaaaaataggagtga

SEQ ID NO: 3041 - DNA, 1031 bp, Homo sapiens
agccagccccaggcatgtagtcacagtgtgtgtcagagggcacagttgcttcctctcagtcaccaacagaaatcatatggaaattttcagagacccatgaacagccaaagcattataaatgctttggtaacatggattttgcatataagcatttatgtattttttttcctgacattagattactttacttctaattccccttcagtgccgtggctggatgtgcgtggcacagaggctggtgttctctgcagtccagcgcatacatgccttgctgttctattgggtggtagacaacaccgctgaaggatatttgtagtctcttggctatttctgatcactccagtcccgttagtatttgaagcattgctatcactaaatggaatagtacagacctgtcctggagaaagcctctccgccaatgataatgatatgaaaagctactgatagaagcttccacttcttttatactttcccataggttagaaaagaagctgctaaggaagatactgtaaagaacaaaaagcattttctttttttttttttttttttgagacggagtgtcactctgtcacccaggctggagtgcagtggcgctatctcggctcactgcaagctccgcctcccgggttcactccattctcctgcttcagcctcccgagtagctgggactacaggcgcccaccaccacgcccatctaattttttgtattttttagcagagacggtttttcaccatgttagccaggatggtctcgattgcctgctttgtgatccacccgcctcggcctcccaaagtgctgggattacagacgtgagccaccgtgcctggcctttttggtgtattttttgacatttttacacataggagaatttaagaggacacctgagggccgggtccggtggctcacacctgtaatcccagcactttgggaggccgaggtgggcggatcacgaggtcaggagatcgagaccatcctggctaacacggtgaaaccccgtctctactaaaaatacaaaaaaattagccgggcg

SEQ ID NO: 3042 - DNA, 1049 bp, Homo sapiens
ggagggagcgggaaggggggaggggagatgggaggaagctttcagacacaggtacatccatcctgcagttgggaagctcccagggttaggtcccaccaggctgattcccaggccctgaacacagctagaagccagggtgaaaatggcggtgaagcacgggtggagctctgagcaggcgttcgcccttgactcgtggggatctgatgatagttgccccttctcttcttgagacaaaggggtggggctgtccaaggcgcggaggagccaagataggctctacaaggtcaagggccaaagaggcaagagggcaactttaaagggatggccacggactgcagggggtgccggtgagggacagtgctgcccatgtgtcgctgtggctgcagccttgtcgtcgaggcgggtcaatgggaggaagcccggccggtttctttctccttctggggctccaggccaggacccccttgcattgccagcagatcccccatcgcagacagcccaggcctcaactgtggggaggccaggaagcgtgggatcagaagctgggccaggctggctcattttcctgattctcagtagccccatgctttgagagcatactgtcttgaggtaggccgcagacttcttctagacggtgtctaagctgagagagcaaagagcttggcatccccaacccagccccagtgtgtgctgctcaggcccctgccctgagtgtcaaccaccttcagatcagaccttccatgagctgccaggtcaaggccagagccttgccaagtgtggaggcttctaggaacctcactagctctggttacaccttcgacctgccaggcaccggggactgagaaggttcctgtgctgtactggaggaagagattccacgccgggtttagggcagagcagattgctctcaatttccttcctccagcctttacttggccagatacacccactcaaccagtctaagctggggccagcccctgtagccaggttgggcaccggttttgccagtctgctgcagggggtaggtgctctggggccatcttggcaga

SEQ ID NO: 3043 - DNA, 1026 bp, Homo sapiens
ggtgaggccaggccagggactggggagagaatggactcaggcctggctggaatctctgcctgttcactttacacagcctggaccagctacacaccaagccccgcgtccgagccgagaattcactgtctctttaaaaccatttagaggaaaaacaaaataactttagtgcattaattctagatgaagatgggtctccagatgacagcctgatccacattattccctgcaagacaacttcccctctcctccgccccctcccgccttcctgcccctctgcccagctctttgtcctcctccgtggttcttgctttctgaaaagcggacaccggggtggcatgaagcctaatcgtgtgcttgatgtttgagaagtcaatgcttctgtctgtttgggacatcacgttcatgtcatgggtgaggtattgacttgcagccgtggaccctgtggttgcaaagtgctgggagccagtgtgtctcggaaccaccgagcagccgtggtggggttgcggctgggggcacgtgagaagcggtgaggggtccgtgtctcggcgcttgctgggttaggcacattaggtctcagaatagcaccaaaatgttctagatctctcctggctttgggggaaaaaacacacagatacgcacaaactgcccagtaagcaaaaaataattcagatgagattcgaatcaggtttgttaatatataactatatatatatataaatatgtataaaagtcgtttgtaaagactcctacacatgttataaaagctgcaaaatgtctggcattccagggcctagtaggaataattagatatttatatccaataaaactggtttgatggggaaattgtttccctccttgtggattctcagttgagggtgagtttcggtggttgggtttgtttttctcccggataataaaaccaggggtttggcaccaacaaatgtatttcccgtaaatatctaaatctcttttttccaccgtgagctctgctagaccagcctcatcacgccagccctgcccatgctc

SEQ ID NO: 3044 - DNA, 1161 bp, Homo sapiens
attcggggctgtctgggccacacctggctgaagggggaaatggggctgtcttgaagtttgcagcataaaaggaaagataggccgggcgtggtggctcacacctgtaatcccagcactttgggaggccgaggtgggtggatcacaagatcaggagatcgagaccatcctggccaacatggtgaaaccccatctctactaaaaacacaaaaaattagctgtgcatggtggcacacgcctgtagtcctagctactcaggaggctgaggcaggagaattgcttgaaccagggaagtggaggctgcagtgagctgaggttgcaccactgcactccagcctgggcgacagagtgagactctgtctcaaaaaaaaaaaataggggggaaagatggagggagggtggaatgtgaagccgccatgtggttgcaagatggggacagggtggagggcatgtcgtggagaccatctggctgtgtctatgagcactcagggaagacggagagctcattaattagcagggctcctgctgtctgtgcagggccccggactgcttctcccaacccattcccaagctgggaaggaagctgggacgcagcagccgcagggctcctcatcaaagaggaatcccacgtctcatcctgatgcctgcaacctgacccccaaagacagaagcgagttgggggacctggcagggaggcctcaccagactgacgtggcgatgttagggctgcctcaggaggtctgattcgcatctgctgcttctgccgagaagacctccatgcttgctctggccacgtgggccttggccatcatggcagggcatggtgggtggctgggaattggagacactgtggagtttatgactgtcacctacattacagttcaggtgactctacaggcataaaaccagtggtcagagaccccagacgaggagcaagcagtggtgaaggggcaaccaggcctgcccctgcctggaactagtggtcaggtcggggagctgactgcgagaaagaggtaccatggagagagatgggctctggaaccaggctgacctgagttgcagttcagacccactgttttatagacatggccgtcactctgcaagcttagcctcattgtactcctctgtaaaatgggcacaatagcatcgtctttgcagggatgc

SEQ ID NO: 3045 - DNA, 1050 bp, Homo sapiens
ctgttgtgctagatgctggagacgcgcagatcattaggacccgctctctgcccttgaggagttaaaagtccaatggtggagacagacttgtgaacaaattactttagtccagtatggatgtaaatgctgtggtggaggatataggaggagcagagtcaggggtgtgtggggccacccggggtagatttcagaaggctaccttgaagaggcttggaagaagagggtggtggtgattctgggcatttctagagtgcttgttaacaccctttcacgcctcttgtccatcctccgcgcagcctgcaaggtaggagggaagtcttaggcatcgtctccgtctggctggtgaggggacggaacctagggagattagcaggcttgtctaagggcccatggaggtttcggggacagaagtgggactcggacccacgtctcctggttctcagcccgttgtgatttctgtaagcacgctcactcagcttctcacttcttcaccatggagccgctggtcacagagacccggcctctgcgctctgcactttctgaccgggatccatggcccccggggcctgggctgtgggaaagcctcagtttatggaaggccccgcggcctgtgccctggtttggtaagtgggtcaggccacttggttggggacaatcctggagcaaggccacgccctggcaggcttggaggatggcaggaatggggaagaccgtgggggaaaaggaggaggaggcctggccacaccctttattcagttgttcttgctgccaaagctgaaaagcatcctctgccctgggcaggccccactttccgctggaagaagcccaacgagcgtcccaccagggcctggagccccctttccttccatagctggaacctcctctgagccaaggacatgaaacaccgagagtgttcaccgttggcctgtggtcagcccctggtcttgccagcgccttgcctggagttggggaggtagatgtgtttcccttaaccttttttctggggaatgtacatgtctgttttacaaagctggaagaggggcatgtcag

SEQ ID NO: 3046 - DNA, 2078 bp, Homo sapiens
ctgagcatttaggttcacagaagaggagcaggcagggctggggaggatcagctcacgtgtagctgaaggtgggcagagcacctgagcctgagctctgaggcagcctgtcctgcagagatgggggaccggggacctgagagggaggaggaatcagccgtgacaacccctgtggctaggccaagtcggagggggatggagatggaggggagggtggttgctggattcaccaactccagagacaagttctctcccttgcagctgcccgggaacaggcaaaggaggcgtgcaaagctgcagcagaacaggccatctccgtccgacagcaggtcgtggtatgtgccagcttttctcctttttcctttgaaaaacgatgcccctgcttgtggtcaggatcttccttggatatcttagggggcttgccctgtgctttatattaagtcctgacttctttccggttcaccttagcttggctattagtgtctacctcatttccgaaacctccacaagattgatattgtaattcctcttaaccttcttccactgtgtttatggtaaatatgccagaccactcaactgtagtagtagaaaaggtattgaggttacagtgctgaagcttgttgtgtgtcctgctgtgtcctacaaaaatgttgcattctagagaatgaaaccccagagcactctggaactcttttttttttttttttttttttgaagtagtgtctacctctgttgcacaggctggagtgcagtggcacagttgcagctcactacagcctcaaactcttgggctcaaacgatcctccctcctcaaccacccaagtagctagaccacaggcacacaccaccattcccagctattttttgttattgtttttggtggagacggggtctcactatattgcccaggctatcactcgaattcttaacccctgccccctgcctttccttttttttttttttttttttaatttccttttaaaaaaaaaatagtgacatggtcttactcttaccctgatgcccaggctggagtacagtggtgcaattatagctcattgcagccttgtactcctgggttcaagtgatcctcccacctcagcctcccaagtagctaggactacaagcacgcaccaccatgcccagctacatttgtttctttttttttgtagagataggggtcttgctatgttgcccaggctggtctcagactgcctaaagcagtcctcccacctaggccgcccaaagcactggaattataggcatgagccactgcacctggcctgcttgcctttcttaaatgacctcatgtcattgtccagtgaggaatttgtttcagctgaccctgagtgttggtcccgaagttccagccacagctcctctccccaccactgactgttcttcttaccacttaggcagctgggtcccagctattgctgaggccggtggagttccctgttcccatgtgcctccctgttcctcccccacatctgttcctgatctacagctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggtgaggaagtaatggggccccatacagggacatctgtgcgcgtcagaggggaggaagccataaagagaccacaatataggggccaagtgagtcctgcacaaggcatggtgctagccaggaattgttggagtagtccagagaggccgtggcaatgtggacagtcgcctgcagcctcattaccacctcctccatgggagctcaactcatggtggcctccatggtgggttagcaagatcacctgtcacttccactgtgaccagggcgccatccttcctcactataacttgtgcccataaaccctctctctctctctcacacacacacacacacagaattttgtttgttgaaaaatctcaaagcctatgacatgaacccctatggctgcttgggctgtgagagtccgtc

SEQ ID NO: 3047 - DNA, 1025 bp, Homo sapiens
tggtaccaaaacagagatatagatcaatagaacagaacagagccctcagaaataacgccatatatctacaactatctgatctttgacaaacctgacaaaaaacaagcaatggggaaaggattccctatttaataaatggtgctgggaaaactggctagccatatgtagaaagctgaaactggatcccttccttacaccttatacaaaaatcaattcaagatggattaaagacttaacaacgttagacctaaaaccataaaaaccctagaaggaaacctaggcaataccattcaggacataggcatgggcaaggacttcatgtctaagacaccaaaagcaatggcaacaaaagccagaattgaccaatgggatctaattaaactaaagagcttctgcacagcaaaagaaactaccatcagagtgaacaggcaacccacaaaatgggagaaaatcttcgcaacctactcatctgacaaagggctaatttgcagaatctacaatgaactcaaacaaatttacaagaaaaaaataaccccatcaaaaagtgggtgaaggacatgaacagacacttctcaaaagaagacatttatgcagccaaaaaacacatgaagaaatgctcaccatcactggccatcagagaaatgcaaatcgaaaccacagtgagatatcatctcacaccagttagaatggcaatcattaaaaagtcaggaaacaacaggtgctggagaagatgtggagaaataggaacacttttacactgttggtgggactgtaaactagttcaaccattgtggaagtcagtgtggcaattcctcagggatctagaactagaaataccatttgacccagctatcccattacttggtatatacccaaagggctataaatcatgctgctataaagacacatgcacacatatgtttattgcggcactattcacaatagtaaagacttggaaccaacccaaatgtccaacaatgatagactggattaagaaaatgtgtcacatatacaccatggaatac

SEQ ID NO: 3048 - DNA, 1049 bp, Homo sapiens
acatccggtaaacactattaactggaagcttattaatcagagttgtattctaaccagagttactttcattcattaagcttttaggaagtaagcaaatcacaagaaaaaagttggtttcaggaactttagttttagtttttaaaagcttttcctaatgtgggtcccttttgttttatgatgtattctaccatcaacgtcatggccctgtatgcatgccaggactgtttgtcttgttcaccttgaccccaggtcattgccaggcacatagcagatacacaagagatattcagtgaataaatgaaggtatgggaaaactgaaacctgggtcattgtagaattcttactcatcaagtaaaggttagttgtgatcaatctattctccttagttgagaaaacggatacacctgtgttcaaggtttttggcaaggcatacaaacgaatttcccaattattcagaaagttcagctattaatgggtcacgtagtgtcctactatcactgcaaagttaccatgcctggaagcaaactctgcctcacactcgctaaaccaagtggtggtacgctgtagagtcattgccgctcagaaccccagagagagtagtattcctttatccaaataagcaccagcggttcttccttcaagcattgagcactggttctctgtcaggccgtgggctaggtgttgggaccaggcagatgggtgagattctttctctgtcaggctcctatgctcttcatgtcttcctttgtccactatctggtgacctgtcaaaactttgctcccttgaaatattgtgatgactgctgcttgcccccacttctgcttgccatttctgctctcccctaaatgtacactttatacccagtgcagctctgctttctgggtgaaagtgccagccctgtgcctgctccaggcgtgctttgctggcctcgctctcactcctcgcctgcatgtatcccctgcacggtcacattcatgggcttgtttcccgtgaaccaatctgcacatctctggccttattcttcccccttgccaagtagtccccaccg

SEQ ID NO: 3049 - DNA, 1049 bp, Homo sapiens
atgaaaaacatgtggaagagtgcccgcaaggtctgtatcccaatgcatccagaacagaccaccttctccagaatgctcgcctaatctgcttcgctctgcctctttaaggccagaaaagaaacagtgtttaaaccacctactcacaatgtcagggagtctcttcctgttacaaagctatttggcctgatttcatagagtgaatcatagttgaggagatggtgtgtataccattgatcaaaccaatgaatgtgatcacagttatatgtatttgtatctagaaagtgctgggacatagaaagggcacactttctacccctaagagaagatggactgtttggtacaaaaaagagcagatttgtaaatacacagactagaactttcacaagaccaatttgggtttttcagacctctgtctcctctcctgacatcagtttggattcaaaaggaataacatgcagggtataatgctgaaaccaggagggaaagttatcttgaagccaatgtagaattcttctgactttatgtacagacaagcccttgggaaatagatgtggctcctggtttgggggtttttttctttaaacaatctgcctggatgatgctgaggactaataaacagtaggccctggaggcaaagtcatcacctgctttggcttccccttcctccttcttaaaaggaagagggagtctcactagccttctctccccattgtgacccccacagtgaagtacctgagatgagagaggaataaaacccagccactggagcctctgctgtgggaagatctcataaaatagaagttgtgtttctgcagaaggcacacttaggagatctggggactgggtctagaaattgactaattttatacatgactgaatcagagtggctgtgaataccacccagagtgggatcagccagcctgtacccaggcacctggtctttgggatttactgcagtaccaatgacctaagtttccttcttcaaatatgcagcttggagattttatttgtttttttgttgttttgttttatttttcagtctctgtgag

SEQ ID NO: 3050 - DNA, 1051 bp, Homo sapiens
atcttcagggaccatgctatcttctctgtatcgttccaattttagtatatgtgctgccaaagcaagcactttctgcgttttttgccagaacgctaggtgagaaaatcaaagtctcagagggtgcaccttttacccagtcctccctatgtgtagtgaaaggtatcagaaaaacatatcctagttgttgccccataaacaatctcatgttttttatttatttggttttgcccctcacccaaccgcccttgagaggtaggactcggtatattctgcattattttttgtaacaaatgtttgtggaagagcaatgctcttgtctgtgtactgaccaagctctgacagctgttcccacacagctgcatggtgaaggccgtgcgaagttcactgctagggcttgcccttctgagttgctgttcctacattgctccctgctttgtctcttggggtaacaatttgtgggatttcagcactgaacttgcttcctgctctagatgaaaagaaaaactacatccttggtcctgtggcacagaatcagctgatcctgaaaaaataatagagggaggctgagttaggagggacagcttgcatgaaggatgcattcatccaagttgcttgtgttcaccagctgtaaattttgaactatagggttggaaggaccatttggagatcatgcagctttctcttctacctctagtcaggatccctacaaaaatatgctgtgcagatgagctgtgcctctgctttaagccagtggttctcaaactgtgacccctggtccagcagttttggcgtcacatagaaacttgttacaaatgcacattctcagcccctatcccagcactactgagtcagaaactcagagggtggagcccagccatctgaaggagccttccaggggattctgatgcacttagtagtttgagaactactgctctaagggaacccctagcagggcccaggagtgaagatttctaagtctcggtggcagaaaaccaacacagaggtttatcctgttcccttaatggagcttcagtaaatgcatagggcatca

SEQ ID NO: 3051 - DNA, 1047 bp, Homo sapiens
tagtctctgctcttaaaggaagggccacagagcagcaagatgagtgttcccattactgacccccagaatcatgggaggagagcacaaacctctttcagatgaaacgatttaaactgagctttctggatggtaatagataattgatactctttcagcatctgcaagacattgtcctcaaagtgctggtgaaccatctgcccacaaatgacccccacatctcctaccctcagacctgttgagtgtaactaccttttccctttgttttctcagcattaataataagctacagcagccggaggcagcggccggagtgttagaatatgccatgaaacactttggagagctggtaagcacctcattctttttggaaaagcaggaggtagagacttggctagggagttattggccctgaccttcagaaagttactttccttttctgttttttctccaattcataacagtctgatgctgacttaccagtcttcaggatgaaagagataaactgtgtctgtagggactctatttctttcttttttttttttaattatactttaagttctagggtacatgtgcacaacgtgcaggtttgttacatatgtacacatgtgccatgttggtgtgctgcacccattaactcgtcatttacattaggaatatctcctaatgctatccctccccgctccccacactccacgacaggccccggtgtgtcatgttccccatcctgtgtccaggtgttctcattgttcagttcccacctatgagtgagaacatgcagtgtttggttttctgtctttgcgatagttcactgagaatgatggtttccagcttcatccatgtccctacaatggacatgaactcatccttttttatggctgcatagtattccatggtgtatatgtgccacattttcttaatccagtctatcattgatggacatttgggttggttccaagtctttgctattgtgaatagtgccgcaataaacctcatgtgtgcatgtgtctttatagcagcatgatttataatcctttgggtatatatcca

SEQ ID NO: 3052 - DNA, 1076 bp, Homo sapiens
gctgaatgggagccatcagcagcactcctggtggcctggtatctaacaagtgctgctgctaaccagccatgggatctatcagtgggaggaaacgggtatgcagccagtaaaagcaattatgaagactgaatggagtggaaaatacctgtgttagtgaaaaggcagcatacaaaattgtatctatactttcatcaccagtatgtataaaatatgcatttatgcagaatatgcgcaggtaaaagtatcttggaaaggtgattatattacaatcaacttccctcctccatttttttctttttaaaaagtggtacttccactcaccaatcttgaaaagatgagtttttttgcacacgcgcccccattcccccacgcacttcctaatctcaaaaactgttaacattctaccctctttattctaagggctcacactttctcacatacagatttagcgtgtcctctaggcattgtgacagacaaaccatttaaactgtgaccagacagaaacaaggatgaagacatagtaagaattctttttatttttaggccactctgagcctgagacatcaggaatcttttgttttgtttttggagacagagtctcactctgtcacccagtctggagtgcagtggtgcgattgtagcccactgcagcctcacactcgtgggctcaagtgttcctcccgccttagtctcccaaatagctgggactgcagacacagatcacctcacccagctaatttttaaattttttgtagattcgaagtcttgctatgttgctcaggctggtcttgaattcctgtcctcaagcagtcatcctgtctcggcctcccaaggtggtgggattacaggcatgagccaccgcgcctagccaaagaaacctattttgactgtctaaagctggccacctctcttgcaccaaacttttttttatcttggtgccttaggtccccaagagctccaagtacaccaaatgccccagctttgaaaccttgtaatggggccagccttctcttaatatataaagttctttttcctaagttccagccctgccagacccagaggtactgtcttcatca

SEQ ID NO: 3053 - DNA, 1034 bp, Homo sapiens
tctgttagcctccactcaagttgcacaatccagcgattattctggcccagtgtctggcagtctagttagacagctgaactcttggacagtgtgacatgctaggatgggagacacagaggacaaggagggccttctagagaagtgatacctaggttttaaagaaaaaggaggaaatagccaggaatgggagaggatgttgtaagcaaaggtgcagctatgtgaaagacttggactagtgggagaatgtaagtagtcgagtgtggcctaagagtcaaagggaagaagaatggcagcagaagctaaagctggagaggtggaggggggccgtgcccggggagcccaggtgaggagcgggactgatcctctgtagacatgggaaggaatcctagaggtttttccctcttgttccattgttttcctgagttccaccaggaaagtggccttggtaattgccaaacaatttttttttattttttattttttttagagacatagtctcattctgttacccaccctggagtgctgtagtgcaatcatatagcttactgaaacctggaactcgtgagctgaagcagtcctcctgcctgagcctccaaagtagctgggaatacaagcgcacaccaacacgcctgcctgtttttaaatttttttgtagagacggagtctcactatgttgaggctggtgtggaactcctagcctcaagagatcttcccatctcaacctcccgaagtgctaggattataggcctgagccaccacacacagcccaaacaagattttttcaccgcaaatgaatgatttagaacgtgagaatttcttaaaattgtaatgcattcatattaaataccctgacggggtcatttggcattaggattaaggaggtagtacatatagcacttgagttcttaggcctagaagcagacaaatctggattctaatccctccctagcacttggttgctgtgtggccatggacatattacttctctgagtttgccaacctgtgaaatggagataaaaatcaaaactatctca

SEQ ID NO: 3054 - DNA, 1051 bp, Homo sapiens
ggactcacttgtctggaaaatggcctgagaatacctttctaatcccaaactgagggcccggaagtccatgcttagaaagtgattgatacatgttggttcaggtaacagaattttcaagcttggtttcatgttaaaactttttcttaatttgagctgaggttaaccattgacttagtcagtagaagctgatcatgtctttgttcttcatgtagtttataatgggaccaatggtttttatatcagcaagaaatgacatgtctataggatatgctccttacaactaatattttcctgataatttcagaaaaccaaatttttatctctaaaccgtaaattcatgttggcccacctgagctgagctaaccagaaataaaagttattttgcaaaagaaagattaaatttatcttatttttggcctattaagtctatatttcagcattgcatttaaaaaatcctgtattcggagaaattcatttaagaccatggaaaaaaatagacgtatcacaattgaggaaccttaaggagccgcatccttcctgaacacaaagggactcttcacatggttatgtgtctctacacttaactctgagccaatgagaagagttacgtttacagagagaggacacaaaattccattaatgctcattcctggtaaatcttaggaacaccagagaactgtttctggcaaaactttgcttccagaggaacagctgttacagtttggtgcttccttggaatttcttgagatatagcctgtcagctcttggtgaggaagtagcagagctacaccaatcaggaagacttgaaccctgcttctaagacttgctgggtgactttgggcaaaccatgtagtatctcagcactccaagatggtaggctgaaacactgtgtggataaaagagacccgtgaaggtgttaggtaaacttacatagcattagaagtcaaaggaaatactgcataagcctttactaaagggaaagtgtacccacaaaagaggccccagtagtggttctgatgaccaggatatgtagaagcagtgctgtagatgg

SEQ ID NO: 3055 - DNA, 1072 bp, Homo sapiens
gaacaaaccacagggtgagcatttagacccagtggctccatctgagttgagtgtttagagactgagcctttatttctaccctgggattctcagtggtgttaattacccatcagtgtctgcatttgggagaggtggatatggggagatccagagggggtgtattttggctttactagcggtggagcagaggggtagggaagcccttcacctggatagcattagtgggacgttccaacaggtggtttcaggttaactctgaaataaattattctgctatagctgggccatgaattctagaaatgttacagtgtatgagggccacgtaacagatactcctgtcagatagattcagacttcttagacagccgccactataacaaatcagtcgtgaatatctcatagagtctggttttgttgatgtttcctggttggttgtttttgttgttgttcagagatggtggctactgccacctgagaccataattaagggagatagattttattatcacatattttccccttccatccagctagcacctcaaaacactcagaagaacctttgaggccttcctcccagaagttttgttaaaacaatgaaatgagagcatcagactggccagtttttttactctagggccatggagctgctactttatgcaggatttaagctctgtattctaaatatcaaagagcatagtggaagagacagccttttctgataggattcagagactgcggcccttactatccaagagaagcttcctgcctgctatgtctcggggtgcttttcttggtgaccactgcactgggaccttagagaggagcaccaagatggcagatgggagttgtctgaggcacataggttctcttgcagagcaccttgggaaagggaggtagagtacgtgtgccttcgccatcactattcttcatttcgtcttagtggtgaaagcaccaacttactgcttcctctaagggactacctacttatagaatataagggtaactgagcacttggtcatagagaagaaaaataaggaatgatgtcctgggcaagaagagcaagagacctggt

SEQ ID NO: 3056 - DNA, 1061 bp, Homo sapiens
gttccccaggaagaggcgatagctgttgagttcattgcccaaaacaaagtggctatactcagcgtagcgcaggttgccctcccagtcctgtcaggaggagcagagccttaaagaaagtgcagcaggctccatttcatgctgtctctataccccttctctcctgacagtcccatagccaaacatctttttataggtgtgaatctaataagactttattacttgtttacctccagtttactgtgttaacctgggaatcagaaaacaaggctcgaacttctttcctgattcaccatatggccttgattagtctctctttctatattcctcactttcctgcttataaggtgcagctatgtttttgctgaatcccacacagagctgctgtaagagaaacatgaggatatagtgagtgctttcagaccttcagcaagggtccccaaacagtatcagtaagatttgcacctaaaggacctcatgctcggccagagcagagactagtgttcggcacagctgactgttgaatttgctctactctggcctgggtctggcctcttcctgtcccacctgcagccccacttttgtcggggggttgggggggttgcagaaaggaaaaatacctatttttcctcaactccattacaacttgcaggaaaaccatcacaatgaatatacagatttgtcttgaatcagaataggaatggcacccccggagttgtacgcggtcatgtgtggtggcactggtccagtcatggggcccctggccttgtgcttacctccatctctacacgcagccgggttggctgtctggagagccggtggatgtgttcgttccccagccagaagtccccacggatgctgccaaagccctgcttgtactgcttccagtcccggtagaaggagacaaggccactttttcgtctctggatgatggtccagcctccgcctgaagtctccatgtcacagaacacctgaagcagaggggatactctggtgagggacttgcaggggcagaaggcaggagcaagagggcaggcttcccaacctgttcctgtccctgcaga

SEQ ID NO: 3057 - DNA, 1052 bp, Homo sapiens
aaatctatccattgtaggtatatcctgttttttcccatttccttccccgcacagtcaccagaacagtggggaggacagaattaatgttagatgtaagggatggcaaatgtgtccatcatgtggtactgtggtaatgtaaagtggtcatagtaatctttgaaatggaacctctggttccatgtctttgtgaggccccaactgttggcttagaaaatcttttagaacttaaggatttggatcctatttgctaatgcttctagtcctgttgtcattttttatgaccatccaactaaggattctggttatattttgaaagcaattgcagatgctgcctttgacatttctgaccttaagaatttagacattgtcccagaaacatcccaagaatcatttaatgattattattttctgcatttgttaatgccaacttctatgttagaagtccctatactgttcatttcccatttcctccagtgaagagaaataatgcaaaaactgccaagaaatattcctttggagaaaagtcactttgctctgctcttctccccgccctgccactcgccccccaagtccctgaatatcacaatgtctgtacctgcagtgtaaaattcagtagacactagccatatgtggttaattaaaaataaataaaatgtaaaattcagttccttggccacacttgccacagttcaagtgctttagtgatcactggctaccatattggacaggaaaattctcttggacagcactggtctgtatagcactggtttgtataaccaaaatcagtgatgccaaaagcgaattgataggtgtgactttgaggcagcaggcagaggcacgggaggtctctccattttccaccttctctgccttcagggatctcttcaatgctgcatttgtgtcctgctggtctgaactgaatgaagatcaacaggatgagctcatcagaagcatcgagttggccctcacctcacaagacatcgctgaagtcacacagaccctcttaaacttggctgaattcatggaacacagtgacaaggtgagacttttcc

SEQ ID NO: 3058 - DNA, 1063 bp, Homo sapiens
caagatatgctgatttgctggtgtcctaaggatgtcagctagaaccaatgtgttatctccagtcagtaaggcttcgggggatcctgccagtgtgatccccacctattgaggtttatctagatatgccccaaacagctacagagtatcagcacttctcttggcatcatagctgttctaactgttctttgattcctttgccattatttgtagtcttcagtaatttgctgtctggacaaagatttttctcccaaggggccctaccttctttcctcatttttatagaaccctactcacagctctccctgttggttttctcagtcttctctggctgtgctacatggttaaaagctctgctttagagagggccatgggacattggagtgctgtgataaaaggaaagggagcaggttttcgaatagtttttcttcctgtcacagctgtatctaaggctgttctgcctgttgcagaaaagtctgttgctcattgagtatctagcagctacttcatctgtcgtggaggtctgggtttttcccccagttccctgccactttttctgttggacacagtctctctctagaatgtcttctgccatagagaacatatgagcctttcttccctacagattttgacagagttggagcacagtgggattggaagaatcaaagagcagagtgcccgcatgctggggcacctggtctccaatgccccccgactcatccgcccctacatggagcctattctgaaggtaacacaaaccgagaggctggtgctttctctgtgcgttgtcatcagctcatatggggagatgggagtgtttcagtgttcactagtacactgaacaaagtaggtgatttctttgctctcacgcttggagaccaaagggccatatcaagcactttcagttaaagaataccaagaatcttatcagttgcaggaaagtgctgtccttacaagaggtaagagttaatgcttcaggcacatcatcgcagatgtttggaaaggagaagtaggtagatagtagcataaaatagctcgcccaaaatgaggaaaaaatgagcttgaa

SEQ ID NO: 3059 - DNA, 1025 bp, Homo sapiens
tctagcctactctgcagggccaccgcggggtcctcaagccaaagttggctgtcagagaggtctgtgtctcccaagagcaggatagccttagcatccctactgtgttctgtcattggctgggagcaatgggtgacgttggcacaaacttagtgatgggtttcagagcagcagctggggcccttggttatgcgccttgtagttggaggttgcattctcacggctgccagacgaagctattacggtagtctgggtgagtgacagtggtggctttgactaggagtggtggcacagatactgagaagtagttgattcaggatatatttgggaggtaaagctccatctgtgagactggctgtagaaaatgagctgtgaaattttaccccggggattcctgcttataatagacacagtgcttgttagataatagccatgcccagatgtgggagcagcgcatgcagcagtgtgcagaagcaggaggagtctggcttcagatccccaccgctctgatgactgtgcgactcaggcaagttacctgtttagcctcatttttctccctttggacaggggctcttacctacctcattgggctcttgtgcggtttctatatgatgttggctctctatatccatgagttctacatctggattcaactagtcatggttcacaaatacccagggctgggtgcagtggcccacacctgcaatttcagcactttgggaggctgaagtgggaagatcacttgatcccaggagttcgtgaccagcctgggcaaaagacggtgagaccgtgtctctacaaaaaaatttttttaactttttaaaaagaaaaaaaaaatcaaggaaaaaacaaacaatttaaagataatacaaatttttaaaaatacagtgcaacaaatatttacatagcatttactttgtataaggtgttataactaacatagagatgatttaaagtatgtgggaagctatacataggttatatgcaaatactatgctactttatcggagggacttgagcatctgcag

SEQ ID NO: 3060 - DNA, 1032 bp, Homo sapiens
atgccctggctgtcttgctgactgtggctgtttgcttgtgtccgtcagatgcagctttacgtggaagagcgcgctcataaaggcagctgagggggcacctgccaccccactgatgcccaaactgtcagactttgggggatccccgcctagggcagtgctgcatggctgccctgattccaagtgctcttatcgcctctgtgtgtggatcgcccgccccagcccggggccgctcaggtctgcttggaggatgcctcccccaggagggcagtgagggatgccgcaacctcgacttctcagcctcctggggttccgccggccaacactgtctgtctcaaatactgtgctgtgagttgtttcaataaaggggccccaagggctgggctgagctgagccatcattaactggagtgggagggacaggtatggccagggtaacctgggagaggggctgcttctccaccaaaatgccagggaccccctctccccactcctaaaaccaaccccaggctggttttactgaaaacatttattttttatttatttattattattattattttatgagccagagtctcgctctgtcacccaggctggagtgcagtggcgtgatctcggctcactgcaagctctgccttccgggttcacgccattcttctgcatcagcctcccgagtagctgggactacaggcgcccgccaccacgcccggctaattttttgtatttttagtagagacagggtttcaccgtgttggccaggatggtctctatctcctgacctcgtgatccacctgcctcggtctcccaaagtgctgggattacaggcgtgagccacagtgcccggcctgaaaacatttattacaacaaaacgtcagagctatgtgacagtaagttaccacaagctggtagggttgaaccggggcaggagtcgctggtacagggacctcactgcccaccccatgctcagctcctgcctggaggaacctctggctgacccagacacaggatggacagctgtcagaaaatctggacaaca

SEQ ID NO: 3061 - DNA, 1049 bp, Homo sapiens
gcctcattgagtcaaggctgtccaggcagtgggactccagttgttcttggcccaggtcttacccccaccccacatcccctcagggtgaaaacatcaccaatgcccctgaactgcagccgaatgctgtcacttggggcatcttccctgggcgagagatcatccagcccaccgtagtggatcccgtcagcttcatgttctggaaggtaaaggagccgggggcaagcttgccccgcccacctggaaaaccgtggggagggattgggaccaagtcccaagcgtgtgctgaaggccacactggacccagccttcagggcacacccagctctgactcacccatgtcactgctgatgcagggtgtttatttctgggcaggggtgggaagtgatactggcagtgggccttgttctattccgggaaatgtcctgttgagcagagcccttggagagccctgttaatcttgcctctgtgtgtgtgtgcatgtgtgcgtgtgtgcgggggtatgtgtgtgtaggacgaggcctttgccctgtggattgagcggtggggaaagctgtatgaggaggagtccccgtcccgcaccatcatccagtacatccacgacaactacttcctggtcaacctggtggacaatgacttcccactggacaactgcctctggcaggtggtggaagacacattggagcttctcaacaggcccacccagaatgcgagagaaacggaggctccatgaccctgcgtcctgacgccctgcgttggagccactcctgtcccgccttcctcctccacagtgctgcttctcttgggaactccactctccttcgtgtctctcccaccccggcctccactcccccacctgacaatggcagctagactggagtgaggcttccaggctcttcctggacctgagtcggccccacatgggaacctagtactctctgctctagccaggagtctgtgctcttttggtggggagcacttgcgtcctgcagaggaccacagtgggtggcacctcctgagaaggcgaggagagtggttgttgccaactaagc

SEQ ID NO: 3062 - DNA, 1169 bp, Homo sapiens
ttgaacccaggaggcggaggttgcagtgagctgagatcgcaccacagcactccagcctgggtgacaagagcaagactccatctcaaacaaacaaaacctttctcttgtcatgtaacccatacatacacatgctatgtacccacaaacattaaaaatcagaaatttaagacaaaacaaaagcaacagaaaacctttttttgaggagtccctaaggcttcaccagtttgtcaaaattggagcttgattgctgagactttatttgcatacccacaatgcattgtgcaccaaataattttcgtctttaaaattactagtcccctttttccttcaatctatctttcctgaaactgagattgctgttccagaattgtctgaagaaaaaggcagaagtcaatagctcttttgggcagaaagaaatttaccattagcctgttgggagtagccattacctgagaactgagtgccactcatcgaagttcttactctagtttctcttcatatcgcataaatctttcgccttttactaaagatttccgtggagaggaataattctgagttttaaaccaattttttagaggtcttgcattttttagcaaggcttatttgagcgttttaaaagtagatgcccttagccattacgacggttcgtatttactctgaaacaagaaacacactcaaaactcagagaaaacattgttccctagtatttgagtctgaaggaccagagctggcttctggaggagcagctggccttgggggaaaaggacaatttaccctcctacgtagcttgaatggggctttgagtcgcatggcggggcacggcggggcacggcggggcacggcggggcacggcggggctgggctgtgggcggctgcttcagggcctgagcccggggtagatttttttttttttttttttttttttttgagacagagtctcgctctgtcgctcaggatcgagtgcagtggcgcgatctcggttcactgcaacctccgccttccaggttcaagcgattctcctgcctcagcctcccgagtggctgtgattacaggcatgcgccctcctgcccggctaatttttgtatttttagtagagacggggtttctccatgttggccaggccagtctcgaactcctgacctcaggtgatccgcaggtgatccgcccgc

SEQ ID NO: 3063 - DNA, 1040 bp, Homo sapiens
atcacagggggagacatgcctgtctcagcaactgggaaggaggaaatcaaagaagggtagatttgtaaatcaaatcagagctggtgtttgtggggttggggcattttacatgaagacctcttgggtaaagagacacttgagcagaacctgtgagaaggtggccaggtgtggtacctcactcctgtaatcccagcactttgggagactgaggcaggaggatcacttgaagccaggagttcaagaccagcctgggcaacaatgtgatacccccgtctctacaaataataataatcataataattttttaaaaagaaaagagggtgccctacaaggagagggatacttgggaaaagagaacagagagcagccagtacaaaggccctaaggtagagggggccagtgcttctgcagggccgagacctaggagggagtagctgagacgagggatggggcagaccaggaagggcctgcgatcctagtaaacactagattccagtctgtgagatgggcagccatcagtagtcataagcagggtgatgtggtctgacacattctagaaggatctctggctgttgtgttgagaacagactgaggcaggggccctggggcaaaggtagcagccaagtgaccttttgggaccaggtgaggggtccacttgtgctccaggtgaagggcgctgaggcagggccccaaggcgccgtggaggtggcgagaagtggtgagaagcctctggatttcagaggtcaggctgacagggtgcgtggtggagtgggcatacagtgagagaaaacacttaatgtgggacagtgaagaggcttcggaggttaaaaagagcttggcatctgaaaacagggagtggtgtggaggggaagcagcctccgtcacctcccagcctcgggagcctggggctgggcctcgcttggcctcctctattgaatgaggataatggagcccatttgtgttagtttcctgtcaatggcacaacaaatgaccaccagctgtgtggcccaaaacaccaaagctgctctcacatttctggg

SEQ ID NO: 3064 - DNA, 1035 bp, Homo sapiens
acagaattccctctaccaggcctagtcagtgccctccctggtccccttctgacattgcaggtattccacacgtgggtctctgtcctcctgtcccaggcctagaggtctgctgctagcctgagtttagccaggagaagggaggcccgggcctttctgtggggacatgggggtgccgaggtacctgagctgttcaacgtccttttcatatcctctcaacagctcctctttcctccccagctggttcttgagttgggtgatcttatcaaacaccaggtcgaggtccctttgtcgaagctggttgaccttctccctctcctggcgggagaggtatttcatggacacgtggcctgacatattcttgatgttcatgagacttccgagggttttgctcatatccaggtactacaaggaaaacgttcgcgcataagaggcattacccgcggccgctggtggccgctttaaggaggccaatgtctaattctgtttcattcactttctgcaattgcagagaacacgcacatgctttgaaaggatgtgcaactggggctttcagcatgactttcctttctcccacatccatttacgctatgccttttttgagaaccgggggtgaaaaatgacaacagatataaacacttcattctaaccacccagtttttcaaggaatttggctatgtgattcctgacccatgctgggatagtaggtaggtcctgcagagttattagagtaactaaataggcatgtgaggttgatatttaaactatcctgcgttcaacactgactgcaggggccccaggctttggataggagcagggtggatgctggatgtacataccagcttttcactgagctctaaagcctcagccacatccatcttccctgacttctccatggctgagccgaaccttgcgttgcaaaggccattctgaggctgaaatcagaaagaaatgaaaggcctctcttgacattccattatgactttctatgactggaagctaaagcactgtgtgattaccgaagattaactcaagaga

SEQ ID NO: 3065 - DNA, 1028 bp, Homo sapiens
agcctcccaaatagctgggactacaggggcccaccaccacacctgactaatttttgtatttttggtagagatgcggtttcaccatgttgcccagcctgatcttgaacttctggattcaagtgatccgccctcctcggcctcccaaagtgctgggactacaggcttgagccacctcgcccagctgaaagtgacactttaatactttcaggaaattataggagatgattgttaagagctcaggataaagagaagtttctggccgggaacggtggctcacacctgtaatcccagcactttcagtggcggagcacctgtggccaagagtttgagaccagcctggccaacatggtgaaaccccatctctactaaaaatacaaaaattgaggtgccgctgttgctgctcgtgttaaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctatgatgagcatgtatcctctcgatcacatacagaagaggattgcacggaggagctctttgacttcttgcatgcaaaggaccattgcgtggcccacaaactctttaacaacttgaaataaatgtgtggacttaattcaccccagccttcatcatctgggcatcagaatatttccttatggtttcggatgtaccatttgtttcttatttgtgtaactgtaagttcacatgaacctcgtgggttttggcttaggctggtagcttctatgtaattcgcagtgattccatctaaataaaagttctgtgatctgcaaaaaaaaaaaaaaattagccgggtgtggtggtacatgcctgtaatcacagctacgtgggaggctgaggcaggagaatcccttgacgccaggaggtggaggttgcagtgagctgagattatgccactgcact

SEQ ID NO: 3066 - DNA, 1034 bp, Homo sapiens
aaaaaaaaaaaaaaaagtaaatggtgtggactaggccccttttgcccatgcctttggatttgttctttttttttttttttttaatccattgttcaaggaaagaacagcttctcaaggcaaattctggaatagaagagaatttaaaacagcaataactttttcctagtaaagataaatgaggttctttagagactttagtaatatgggaagtccttcaaaatatttttggctgcagttagcactcccacacggtgtaataattttttctcctttgaggcaaaacgttcagagagttggttataaaatgcttccctgtacttcagaagtattggagttcaaggaacaaatccttgcagcaacagtatacttagaaaaatagaaacatggccaggcacgctggcacatgcctgtaatcccggcactttgggaggccgaggcgggcagatcacgaagtcaggaaatccagaccagtctgaccaacatggtgaaaccccgtctctactaaaaaacataaaaattagtcaggcgtgctggcacgcgcctatagtcccggaggctgaggcaggagaatcgcttgaaccagggagggcggagattgcagtgaaccaagatgatgccactgcactccagcctgggcgacagagcgagacgccgtctcaaaagaagaagaaaaatagaaacacatctataaaagtaaacaaagcccctgagacatccaacatttgtttgtcctgccagagtacaaaatggtcatccccaaagcaaaattctatcctgacaagtgtgcagattatatgaaacctgtagatttatcatgttggcatcatggtatagtggcctagttagacaatatatcaaaaagactctgaaaactcaggattttaatttacttgtttaacaatttttgagcatcaaacaatgtgccagagcctgtcaccggtgtttaggtacatcactgaataaaaacaaagcaaagatccctgttctcatggagcttacccctggtggaggagaagggagacagacaataagga

SEQ ID NO: 3067 - DNA, 1029 bp, Homo sapiens
tttttttacgtttagtagaggcggggtttcaccatgctatccaggatggtttcgatctcttgacctggtgatctgcccacctcagccttccaaagtgctggtattacaggcatgaaccaccagcccagccaattttaaatacttggcctcatcgattatctccttaaatacaaactaacttacaaacgacactatttgaattcgaaaatattgtcaccaaaaccaatggcactaatatctcaggtcacctatgcataactaaattgtttctttgtagtctcagctactggagaggctaaggcagaagcatcatctgagtccaggagttccaagctgtagtgcactatgattgtgccttgaaaagccccagcactccagcctcagcaacataggagaaacccctctcttaaaaaaagaaaaaaaaaagtaaaattggctatttacatctggccatttctctgtcacaattatcacataaggaaagtcaagctaacaccctactaacgaaactcatgaactattcagtactgtgaacgtggctgcagttagtcaactgttgaactgatatgcatttttctatgaagcatgaatttgaatacaagcacccaagtttgaagcaaattttaaaatctgatgtaaaatctgatagactgaattagctgaaacctcttgggaaagaccagtgtcaccatgaagaacagtgtcacctcaattgtattaaaaggtgcaactgacaagaggattcagaaaagtgtctcgcaattagagaaataaaaggcatgtctcgccttgaatggaggcttctgttaaaatcatgattttaaaaaaaaaaaaaaaagagccgggtgcggtggctcacgcctataatcccagcactttgggaggctgagatggacggatcacctaaggccaggggatcaagaccagcctggccaacgtggtgaaacctggcctctactaaaaatacaaaaattagcctggcgtggtggtgctcacctgtaatcccagctactcgagaggctgaggcag

SEQ ID NO: 3068 - DNA, 1045 bp, Homo sapiens
cagcaattctgtgaggtagggggtcttgctcccattgtacagatgaggaaattgcggcttagagagcataacccacctgaggtcacatggagtcccggactccacctgcaggctcacaacctaatagagaggtttggcttccagacatgtgccagaaagaccaggggccagattccagctcagccacttatggatgcagcccccacccgcctcaggcctcagtttccttcaccgtagaacccggagagcacgaactggaaagcatcttcctagtgccctactctgccacctgggcctcagtttccccaggcacctgcccacactaacctgtatcttccccccacagtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccagggtgagtgacggttctgggttgcagggaag

SEQ ID NO: 3069 - DNA, 1050 bp, Homo sapiens
tgctacatgacctgagtggggttggtgtgtttcctgctggggggaatgtggcagaagcagacaccagtgtccctaaggcccacatgcacgtgaagtgctgccaaagggccttgttcaaggaagcagagggggcggtgtggtgtcacttaataccctgctcagcccagctctctgcccagctgctgttctcctgccgggctgagctccctggcctgctctgcccagctggggactaacggagggggacaggatggctggaatcctggcctgggagactggaggcccagtcctgaccccagcctgctgtgtgccttcagctgggttccatcctttttctgggcctgtttccctcatgagtcgagggatgattttcttggatatggtgaccctgtgtggtggggtccctctcgctctgtctgagagttggggttcctggagggatcctcacctttcctgccatggtctgactcctgaagacacccccaggctcaccccctctcccttctccctttcagtggtactgctggactttgctgcagctggaggggagctcggctggctcacacacccgtatggcaaaggggtatgtaagccttcggggtggggagaggtgtgagaatggggctgctggtcccctgtagagatggagaaactgaggcccagggagcgtggggcctggcttcaattcagcagctcagccaggtctcaggctcagggtccagcttctcacaccaggctcagagtcagccggcccaggccagggctggatgggcgtgggaaggtacgagggtgtgggtgtaagcctgagaggtggggggaactggggagacagagaaggccctagcggagctgggccttccatgttccagaagggctgacagtcagagggatctctggcaccacccatccacctcttgggagggaaggggttaaagatgccccctgtcttgaggtctcagcccaggaggtgaggggtgaagaagagacagggaacaggaaaacctgatcaagttccttcctgcccgcccctttcccacctctagctgttgc

SEQ ID NO: 3070 - DNA, 1097 bp, Homo sapiens
cctgacctcaggtgatccacccgccgcggcctcccaaagtgctgcgattacaggcatgagccaccacccccggcctgtttccttctttttctgcctcccaaactgggtttggaggttttgctgttctgtgttgggaggaaaagaggccggatctggagccgttgggcagtggcaggtgttgggggtggcatcctgtctcagtctctggagtgacagggcccgggttggggtctcaaccgggacttctggttgcaggagctcatggcaaggatttctgccaccctcaatatccgccccaccaacgtttggtcctcccccttcctgggggactgtggttggagagaaggggagagacagctggaatcactataggcctttctcctcggctgcccatgggggggtgggggattaggcgggtgctttgctgctgcagtccccaagctggcctggaagcctggagctgccttgtccttgtcccctgtgtccacctctccccagcctgtgtgattaaaccccacccccacaccccatgggatgcagggggaaaggcttgtgtattgcactggggtgggggtacatttttgcttcgactctgagtccccgtgaaagagtccctagagaagtgtgcctaggtgggggtgggcatgatggcctagctggcagctgctggtttcagttcctgggaatcaggctgtatgtggtgggtctgcctgggggtggcttagggggcaggcaggaggacacaggtgcctttttcacctacccccaggctgcttcagacttctttcttgccccctcacccctaggctatacttggttgcccacgtggctcctgttaggtcatcaacagccactgaatctgccctcatttttacaaatggggaaactgagggaggcccgagcccttgccaaccagggccttctggacagaggaccagacctgagcatcccgcttcttggctgccagagccaaggccctgcctgctttgtggttggtgtcatggtagattttcctgggaagcaggcatagctgggcaggggcctgggcgggtggcagggggtgctgagctggggtgctgctgatgggaagagggctg

SEQ ID NO: 3071 - DNA, 1009 bp, Homo sapiens
ctcaaccatggcctgggcataggagatgtcaaaataagtttatttcaaatggcaccatttaaatagggatttttggtgatttctcatcagtggaaagaggatttttgttttgcctttgttttgttttgaaatttaaatcctaatttcaaaacatcaccttgccaccctgacactcctctttttattattagcgtttctcaggcacaaagcctgctgcagctggccctgggtcctggctttcagccagcatctggcagcctaagtgtactgataagtgtgttttctcctgttacatcatgctgaatcctttcccttagccattagcttttatgatgtggtcttcgtaggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagggaaagctgggccagaaggctagcaattcaggtgttaccgctattgctgtaccttgtgttaggacattgtgtttgtgcatggactgtgcctccaaactcagtagttcctatctaaatataaagtatattagaaacctgaaagtacagaatctcaaccttacagtctttcccttagtcctgtggccttcctaagccagctgttaacgtgttgattccttccacttcccccaagtaggcaggcaacagatatgttgattgtcttagaaagtaatctggttcctctgaactccattgaattccagtttgacgcatactgcctggaaccagactgtttgcttacagctttttaagaaaaatctgccttgtctgcccccattatggttggtcttggtagctcctgggcactgtgggcgtgtaccatgggaaagtgattcaacacagtga

SEQ ID NO: 3072 - DNA, 1032 bp, Homo sapiens
agcctgggtgacaaagctagaccctgtctcaagattaataaataaataaagactcatttctacagtcagttcctgtggtctggattagtgttggttttatttatgaaagtattcaaaatagttgacacggacaggcacagtggcttacacctgtaatcctaacacttcgaaaggccaaggcggcaggattgcttgaacccatgagttcgagaccagtctgggcaatgcagggagtccccatcactacaaaaaatttaaaaattagtcgggcatggtggtgcttgcctgtattcctagctatttgggaggttaaagtgggaggatcccttgagcccaggaggttgaggctgcagtgagccgtaattgtgccactgcactccagcctgggcaacagcaagaccctgtctcaaaaaaaaaaaaaggaagaagaaatgaaaaatagctgatgccacatggtgttcttagatgctcaccctgtactcttcaggactgatgccttctcagtaaatcgtattgttcccctaagtgagatcacaagaaagacagtcctctgctctaccttctcaaccttgagactttgtaagtgacaccattaaagcagtctgagcagggcttttcaaacagtgttctgtaatgtgctactgaaagaggaagcaaagctctccacctagattggagcatctcgactgctgtcaggttaatgtagtgttgggatttcttctgcttaagatatcctttgaaaaatgagtcctgcagctttaaccaaaaagaaaaaaaaaagattttaaaaaaaaaagtattctcagcgaggcatggtggctcacgcctgtaatcccagcactttgggaggccaaagcgggtagatcacctgaggtcaggagtttgagaccagcctggccaacatggtgaaaccccatctcaactaaaaatgcaacaattagctgggcatgatggcagatgcctgtaatcccagctactcaggaggctaaggcaggaaaatcacttgaacccaggaggtggaggttgcagtga

SEQ ID NO: 3073 - DNA, 1075 bp, Homo sapiens
ctgggacttcaggtgctaacatagtgttttattttagaatagaacagagagagtttccatatatctgacacccagtttccctaatgttagcatcttgtattagtatagcacactgtgacaattattaggttggtgcaaaagtaattgcggtttttgccattgaataatgataaaccaatattggtacgttattattaactaaaatgcatacactattcagattttctgatttctttctttaacataacatcctttttctgttctaagatcccatccttgatacattacatttaggctttttgtctccttaggctccttttggctgtgacagtttctaagagttaacttgtttttgattatcttgacagttttgaggaatactggtcaggtatcttatagaccactcttcaacttggatgtttatcttatggttagactggagttatggcttttgggaagaagaccgtggagatataatgccattctcatcacatcagatcaagagtacatattgttggctggtgtggtggctcacgcctataatcccagcactttgggaggtcaaggcaggtggatcattcgaggccaggagttcaagaccagcctggccaacatagagaaaccctgtctttactaaaaaatacaaaaattagctaggtgtggtgacacaggcctgtaatcccagctacccaggaggctgaggcacaagaatcagttgagccagggaggcagaggttgcagtgagccaagattgcaccactgccctccagcctgggcaacaaagcaagactctgtctcaaaaaaaaaagaaaaaaaaaaccattgtcaacatgatttttcactgtttctattaaccaggatcacctggttgaaatagtatacatttgattttccactgtagagttactcttttctctgccttgtaattcttttttatagtctattgctttcttttcctgttattctcttttacccatttgtaattgcccttggttctcgatgttccattgaattttaggggaataactaagctatttgactattatgtttatcattagagtcaggaaaggataat

SEQ ID NO: 3074 - DNA, 1538 bp, Homo sapiens
acccagagttgggagtgtgcttgatatagtcaagggatactgaggaatccattgtgactggagcagagtgaacaaaggagaggaggttggacagaaaatgaaagggatgtatcacatatgtgtggctttctggctgttgtaaggacattgtcatattcactgaatagaatggctagttgtgtaggtttctgagaagagggcaagtatggaagcaaggagaccagttaaaaggtggtagcataatctaggctgaaaatgataggcacttggagtaaagtattcacaaaaggtaagaactgggtggatttgatagagccaaagggatttgctcatattttggatgtagagtaggaaagagaaagaaagcaatcaagatgactcttcaggtttttatcctgggcatttgaaagggtggaattttcattaactgagatggggaagactgggtgatcaaggttggcaaggggcaggagagatgagaaattccacttgaaacgtattgagtttgagacgcttattaggacatccaggtggagatatatgtatatggagttcaggggagacacacaggctggaggtagccatgtagggctcattagcctattagttagtaatatagtttggccctgtgtccccacccaaatctcacctcaaattgtaatcctcataatccccatgtgtcaagggcaggaccaggtggaggtaattggatcatgggggtggttcgcccatgctgttctcatgatagtgagtgagttattgatggttatataattgtctggcatttcccctgcttgcactcattccgtcctgctgccctgggaagaaggtgcctgtttctcctttggcttctgccatgattgtaattttcctgaggcctcccagcaatgcggaactgtgagtcaattaaacctctttcctttataaattactcagtcttgggtatttcttcatagcactgtgagaatagactaatccagatggatttaaagctatgagactgcatgagattaccaagggactgagtgaagacagaggatggtataaaggccaggcatggtggctcacgcctgtaaaatcagcactttgggaggctgaggcagaattgcttcagcctaagggtttgagaccagcctggccatctcctcaaaaaattaaaaaaaaaattagctgggcgtggtgtgaacctatagtcccagctgctcggaaggctgatgcaggcgggcaggggtgaggggagaggatcacctgagtccaggaggttgaggctgcagtgacccatgtttgcgctactgcactgcagtctgggtgacgaagcaagtcctatctcaaaaagaacaacaaaaacaaaaaagagaatggtgtaaggattgagtctgggagactccagcatttggaaatcaggggactcgaaaaggagcacccagtaaggaaggagaacatcggagaatgtggcatctgggaagccagcatatgaggaaagcgtttccaggaaaggaggaaataatcagctgcatcaaatgcagcgaagaggtcaa

SEQ ID NO: 3075 - DNA, 1035 bp, Homo sapiens
accgcttaagtgagaattacactaaactttctttttcttttttatttttttgagaccaagtcttgctctatcgcctaggctggagtgcagtggcgcaatctctgctcactgtaacctctacctcccgggttccagcgattctcctgcctcagcctcccgagtagctgggagtacaggcacccgccccacgcccggctaatttttgtagtttttttttagtagaggtgggatttcaccatattggccaggctggtctcgaactcctgaccatgtgatccgcccacctttgcctcccaaagtgctgggattacaggcttcagccaccgctcccgacgaattacactaaacttttatagaatctatgtggattggtgttgctagtagctttgatattgaacttctgtatcccagtacaagttatttaccttagtgctgtagttgttgtacaattaatttagcgtgttgttgcctatattgcaaaaacttcgaatttttggattgagtgaaatttttatgtggcactgtattattgaacatataccatctgtatcttaactgaaaatgagtgatctaaagttgcggctgatggaaaagtgaaggtgatgtgttcagttttctataatgtgacagcttgctacatgtacaaggatatgacttacagacaagtcatttaaaaattgtccagcattaagcttataatatagcttatgacttataggcaagtctttcttttctttttttctttttttttttttttttgagacggagtctcgggtctgtcgccaggctagatagagtgcagtggcgcgatctcggctcactgcaagctccacctcccaggttcacgccattctcctgcctcagcctcccgagtagctgagactacaggcgcccactaccacagctggctaattttttgtatttttagtaaagacagggtttcactgtgttagccaggattgtctcgatttccagacctcgtgatctgcccgcctcggcctcccaaagtgtggggattacaggcgtgagccactg

SEQ ID NO: 3076 - DNA, 1066 bp, Homo sapiens
agaaatgggaactgcggatctccttgcttgagacagcaatccatgctgtgactgtggaaggcttctcttggcgagaattgtgtgtgcaaagggaacggtggagggtgggaacgaatttgtaagcgaagagaaaacgattgtgagatcttgatggtcgctgcagagtaacttcagcgctgagttcgtttgaaaccttcggtttgttaagattcagaataaccaattgctttgtctgttaaatctcccgatttctgttaggaaaataaaagcctcatttcttaattgccagagtctggatttttctgtggtgggattctgatcgatctagatgaagattctgacacattaccagttttacttgctggcagttgctggccccgacgttgaaactatgttgttcctttttgagaacaacttttattgctgtttaaatgctaattgggagacttcgattgtgtttctgtcatgtagggaagtcggtttgaagccttgtggtctctttcttgaggaatgatggcttcactgaacttgtgctatgcagaattgttgaggcgattgcttttgcttggacacaccaaaatatcttttgtaacaaattggctttacttctgcttaagaatgatgacatcatggatttaaagaggcaaggaaaatttgggggaagtaccatcatttagaattgaatatttagaattaagtctgtatatcttatggccattagtgatgctgtgttaaattgctaactttgagtgtattcacgtgtgtaatctgattgggtgtcttttctattgtatgttgtcattttatacccagtaactgtttgcttttgacaagccagtataaatagatgattcaatctacattgatccataggcatgttgcgtatcttaaaaagcttttcattgttaaaatgacaactgtttaggttattatttgaccattttctttctttctttctttctttctttctttctttctttttttttttttttttgcagtttctcactctgtcatccaggctggagtgcagtagcacagtctcggctctctgcaatctccatcccct

SEQ ID NO: 3077 - DNA, 1052 bp, Homo sapiens
tctatccagattctctcttttccacactgattcccacctcaaacacactttgctaacctttgtgttggttatctattgctgcataaccttaccagaaacttagcgacttaacacaatacatttaccatctgttcctatgggacagtctgggcacagcttagctggtcctctgcaaggctgcagtcagtgttggtcaggcctggggtctcacctgaaggcttacctgggagtgatcagcctccaagcttgtgtggttgctggcagcatttgctttcttgcagactgctggactgagcttcagtttcttgttggctgtcagaggctacctcagttcctagccacctgaccctctcccaagggcagctcacacaacatgacagcttccttcttcaaagccagcaagagaatttctcagcaaggcagatgttgcagtcttacataaggcaaccatgaaaataacatcttgtcacctttgtggcactctactggttagcagtcacaggtctaggccatctcaaggggcagggagtacataaggctgtgaacagcaggtggggatcacagtgaccacctgggagtctatctgccacacctcccagtgcatccaaattctgttgtgcagagggcaagtgaggtctagcataccccccaagaaagcagccatcttctaccatccacccaccagtttgtaaactccagtcaggggtgtaattgaagtgatgcctggtttgggattgagttttcctggagattctggtcctgtaatgagttttttccagctgggattccagttagtgatggacagcatcaagctgtcccttgctcctggccccagaccccacaaggtgcttttcaggctagattcctgagggctgtgtcatcagctgtgccacctcctcctccctaccatgatgaactgttctgggtacttacctgactccagagaaaggtcattaaggtcaaacaatgcaatgtgcatctgctagtgcctcatccgagtgacgctcaggtgaaggaacagcctgtggccacacgtctaaccaggggatagc

SEQ ID NO: 3078 - DNA, 1052 bp, Homo sapiens
ccccaaattcatatgttgaaatcagaacattattagccactagtgatttactaattaaaacaatgagaaattgctacgtacctatcagaatggccaacataaaagtgtgaccacatcaagtgctgtcaaggattcagagaaagctggatcactcatacattgctggtggggatgtaaaagattacagcccactctggagaatatctgtataatttttacttttaaaactctatgtgcaactaccataccacctcggaattacattccctgcatttatcacagagaaatagaatcttatgttcacacaaaacccatgtacttcaagtttatagcagccttgtttttaatagccaaaactggggaaacaatgtatacacgacttttgtgagatgaatggttaaactgtggtatatatccacagcatcaaatagtcctcagtaattttttttaaaaaaacaacaaatgattgatacccacaataacctggacgaatctccacagaattatggtgagtggacgaagggtaatcccaaaggttacatgtagaattccatttaagtaacattcttgaaatgaataaattataagagtggggaatagattagtagttgccaggggttaaggagggaaggaggagcagcactgaatagaaggggtcataactataaaaaggcaacatgatgaatcccggtgttgacggaaatgttctgtaccttgcttgtataaatgtcaatctcctggtactgtggcatttgcaatatttgcaaattttatttatttattcattcattcatttttctgagacggagtcttcctctgtcgcccagactggagtgcagtggcgcgatcttggctcactgcaacctccgtctcctgggttcgcaccattctcctgcctcagcctcctgagtagctgggactagaggtgcccaccaccatacccagctaattttttatatttttagtagagacggggtttcactgtgttagccaggatggtctcgatctcctgacctcatgatccacccacttcagcttcccaaagtgctggg

SEQ ID NO: 3079 - DNA, 1050 bp, Homo sapiens
ggttctgttactcccaaagctgagtgagggccctcttttttgttgttggtttttgttttgttttgttttgtttgagacagagtcttgctctgttgcccaggctggagtgcagtggcatgatctgggctcactgcaacctccgcctccggggtttaagctgttcgcctgcctcagcgtcccaagtagcagggactacaggcgtgcaccaccatgcccggctaatttttgtatttttagtagagacagggtttcaccaccttggccaggctggtcttgaactcttgacctcaagtgatccacctgccaaagtgctgggattataggcgtgcaccaccgtgtccggccgggccctggtttttgtacacacgtgcattgcagagctagagaaggtcatgacttgcccaagcacatatagcacatcagggcagaccctgggctcgaacccaggctttctgccaggactgggttaggcccagagttggggtgctgcacgatcaacaagctgggggatgctgggagttctgctgagtctctgggtgggggccagctctcccagcagctgagctggcgggagcagaagctggaggaggcccagggggttggcccagtggcaggtggaggcgctggagccagcagcccgcggggtatccggttccacaactacgcgccgcgcccccgcgcccgtgtgcgggattcacccagctgacactctcccggtcccagaaggtgcagcagccggcgggttttgagagtcccaggtgccctgcactgtgcaggagtgtggacgctgcccctccagggctgtgaccccgcctcagggccttttccctggcgcccgccatcagggctcttggctttgacaggcgatccacccttcggctcctcccaggagccataggaccctccctgcctgcccttcactcaagtcgaggggcctgatcagcaggctctttcctctcaggccctccactcagggtgtcaacagaggtggatcagatgagaaacctggatttctacacacacctggctacaatgagatggcaccactcc

SEQ ID NO: 3080 - DNA, 1035 bp, Homo sapiens
ctgcagattcctcagctgatgattggaggtggcaatgcccaccttctaagcctgttgccaggatgacatgggaaaagcgtgtaaggccgtggcacggtgcctggctgagtcaacagtaactgctgttcatcggtcatcaggcctgttagtctgagttctctgtggttttcagatgactctcttggccccagaatccgagccccacttccctgcaccgttccccatcgaatctctgaactcagggcttctttctgctcatctaacattaactaagcacctacttgggtcatggaaattaattttcctgtccatgtacacctgagccagacagaaccaggaagggaaatgctggtgggtttccaacccgggagatggtttttagatgatggctataccatttccattccctgtagtcgtttccattaatgctgatagttaatgcttgacaggtatgttcatgtcagtcattaaaggagatgctttatgtgtagctgtgcagctgtgggaagttgctgctgatctcctctgatcctccatttcatcatctgttaaacggggatgaggataaactacataggcatgttatgaagacaaaatgaggttatgtctaaaatacttagctgggtgcttgacgcatagtaagtgctgagtcagtaatagggtttttgtttgtttgtttgtttttgtttgtttgttttgagatggagtttcactcttgttgcccaggctggagtgcaatggcgcgattttggctcacctcaacctccgcctcccaggttcaagcgattctcctgcctcagccttccaagtagctgggattacaggcacgcgccaccatgcctggctaattttgtatttttagtagagacggggtttcaccatgttggtcaagctggtctcgaactctcgacctcaggtgatctgcccacttcggcctcccaaagtgctgggattacaggcatgagccaccgcgcccagcctgtttgattttttgagacagagtctcactcttgtcgcccaggttggagtgcagtg

SEQ ID NO: 3081 - DNA, 1094 bp, Homo sapiens
gggaggggcctttgtgcatctctgctcctacagctcagggctgggagtggcttacactgggggaatatgtgatccctgagcctgggtagtggctactttgtcagggtgctttgtgccaccttcgtccccttccagagctttctgtctgtgtggatgagtagggtaggaactggcatgaaaggtggaagagcaggtggtggcagcctgtgggcagccaggtgtgtaatgggcctctgttctgcctgagtcctgctggttaccaccacctcactccctgctattcttagcagctgagctcaggacagcactgactggcattagacagtacccttttccctctaggcctgtgtgttgagaggatgagggggccacccagacagatttttcccaactcctttggctcgggtaggtgggccatgtgctctgctgaccatttatggactggcgggtacaggacagagccatccagcagctcagagggctgagcctttcatacttccaggacatggcccattcaacacagactcccctggctgggtggtggcgagactggaatctgccccaaaggaaccacaggcctaggggcaagggttggactaggtggccttggtactgaccactttgggaaccagcatttctcccagccttcttcttccagacatcatcagcccagccacctttgagagcggacaggttatgtggtatgcagacagcacttgttattccctgggctcttcacagcatctctaacataagtcattattctgtttttacagatgaaggaattaagacttagagagggctactttttttttttttttttttttttgagacggagtcttgctctgtcacccagactagagtgcagtggtgcgatcatggctcactgcaacctccgcctcccaggttcaagcaattctcctgcctccgcctcccaagtagctggtattacaggcacatgccaccacgcccagctactttttgtatttttagtagagtcgcaatttcaccatgttggccaggctggtcttgaactactgacctcatgatctgcccgcctcagcctcccaaagtgctgggattacaggcgtgag

SEQ ID NO: 3082 - DNA, 1058 bp, Homo sapiens
tgttgcccaggctggagtgcagtggcatgatcttggctcactgcaacctctgcctcccgagttctagcaattctcctgcctcagcctcccgtgtagctgggattataggcacacaccaccacgcccagttaattttggtatttttagtacagatggggtttcgctgtgttggccaggctggtctcgaactcctagcctcaggtcatcctcccacctcgacgtcccaaagtgctgagattacaggcatgagccaccacacctgatcaatttttagttttttcaggaacctccaaactgttctcgatagtgattgcactattataatttacatttccactaacagcgtacaggggttccacaacctcgccagcatttgttgttgcctgtcttttggataaaagccattttaactggggtgagatgatatctcattgtagttttgatttgcatttctctgatgaccagtgacgttgaatacctttccatatgcctgtttgctatttgtatgtcttcttttgagaaatgtctgttcgtatcttttgcccatcttttgatggaactattagtatttttcctatatagttgtttgcgttctttatatattctggttattaatcccttgtcagatgggtagtttacaaatattttctcccatttgtgggctgtctcttcactttgttgatcgtttactttgctatgcagaagctttttaacttcatgtctgtttatcttataatgtatgtagttcagattatgctgtatagaaaactttaaaaaaatttgtcaccttcagttcttttcttaaaacatttttattgagctatgattaatatacaataaactacacacacttaaagtgtacaatttgataagtgttaacatatagataaaacccgtgaaaccatcagtaccatcaaggtaatggacatgtccctcacttccagaagtttgcatcctatttttattatcaaatgttatcccgtgagtatttttccacattatcaatgtatcttactgagcatctttagggccagggggtctgctgtggcccatacaag

SEQ ID NO: 3083 - DNA, 1033 bp, Homo sapiens
gccaagacaggtgagactgcggttctgacctacgggcctccatgaatatgcgcgagggcacctgggggccggcagagccgttcccctacgcaaagtaagcgtgttatgtctacaacccaacggggacactgagagccccaaaggccctgctttcttcctggagaacagcacccatctgcgtagtttctacctggctctatgaggtgagaacacactccccgctagcacagaaatcctacaaactcctgtgggggctgcgcttggaagcagaggctgtgtaagaggtgacttggggggtagggaaaaacaggaagattttcacacagggtgagaacccaagagactggagaccacggaccaatccctgcaaaaagcagccagggtagaaagggaagagctgagcggacttcacgatagctaatttgtgttacaaagccgatacggctgatgctcgctttttctcctatggcgtgcaggcgacatgttacttcctattcgccagccctccactgtaggattaacatttaagacgccaaccaagacacaaaccaaaacaaaaaaagatatgacccttagcgtacagtctacttttagaaactccagaaagtcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagatcttcgggctctgccccgacacagcctcatacgcctcactctttacacacacggtcacttgccccgcgcactcccgagccctttccagccctgacacacagctgggattctctcttccgatccgcggtcctgaacccgctcccagggcaggggaactccttcgtggcgaagcagcaagtggcgaagcagcagcctctgcgctgcctcatctacatagaagtcgccctgtccgtgatgtcaccgacagtgccttgccc

SEQ ID NO: 3084 - DNA, 1025 bp, Homo sapiens
atcgtttgagcctaggaggtggaggttgcagtgagccgagatcgcaccactgcactccagcctgggtgacagagtaagactccgtctcagaaaacaaaaaaaaagtagtaattgtgatcagtatgatttgtgggcacacgccctgagccctgccctccacaaactgtccacacatacttcatctgctcatctcttgtgaggcagacatggcaggattgtctgactcccttgcaggaatgtgcacacagtaggtgctcaatagtcccagcctgcaggcattcagtaagggagtgccactgtttgctaggcagcctgcccaggacttcacagggccatggcgagcatgcagtgcttttctcactccaactcatggaaatatttgccccctccatgtaaatatttctctcccctccccctcctccttccccctccccttccttaccccatcccctcccctcccctcctcttttgagacagagtttcactctgttgtccaggctggagtgcagtggcacgatctcggctcactgcaacctccgcctctctggttcaagttattaccctgccttagcctcccaagtagctgggattacagatgcccaccacaacacccggctaatttttgtattttagtagagacagggtttcaccatgttggccagcctggtcccgaactcctggcctcaagtgatctgcccacctcagcctcccaaagtgttgggattacaggcgtgagccaccgcatctggccccttgtaaatatttctgttggttggagttagaaaagcactccatgcatgttataaaataattccagcagaaagagaacgactcccccaccctgccccactgcacacatgatgcccacacatgctctgtctgacccacccccccccgctggttccagggagctggctgccacctgcttccaggagtgtctccctgtgcctttatatctccgtcctctctgagcctcagtgttcctctctgtaaaatggggctgtgatttcttgttcacacctggt

SEQ ID NO: 3085 - DNA, 1035 bp, Homo sapiens
gatcacttgaggtcagttgttcgagaccagcctggccaacgtgataaaaccccatctttactgaaaatacaaaaattagctgagtgtggtggctcacacctataatcccagctactcaggaggccaaggcaggagaatctcttgaacccgggaggtggaggtttcagtgagccaaggttgtgccactgtacttcagcctgggcaacagagcaagactccgtctcaaagaaaaaaagaaaagagaaaaaggggagtcctagtaagtgtgcccagtctgtcaccatcaagatagtgagggtcagcacagtggcctgcaagtcagagtaagcctgggatgagacttcagagctgctcttctcagactgcagctctgctcctcagtttctacctcccagagtcttgtgcatcccagagtccaggctgaaccgggccctctggcccagcgagtcctttgcattcctaggcaaggctggtgcgtagctagtgaacatctccctgatgtggtattattagggattgaagagttcccctgagcatgtttggttttctagatacaagttgagtattccttatcctaaatgcttgggtttcagtgtttggggtttcatatgttttcagattttggaatatttgccttacacttactagttgagcaccccaaatccgaaatctgaaatccatgctccagtgaacatttcctttgagcagcatattggtgctcaaaaagtttcagattttggaacattttggatttcagattttcagatttgggatgcccaacctgtaatagaaatttactcatttactcatttacataccaaacatttaacattttttggcttccttaaattagtatgctgaacttaataaataattggaaaatgtggagaaatttatgtatgtatttatttttaattgggcagcccccaaaccaaaataggttcagagaggctccatcattttttaaataagctataattttcagcctggggaacatagggcgaccctgtctctacaaaaactttaaaacttagc

SEQ ID NO: 3086 - DNA, 1045 bp, Homo sapiens
acggggtttcaccatgttggctgggctggtcttgaatccctgatctcaggtgatttcccaacctcagcctcccaaagtgctgggattacaggtgagaagagtatgtggagtctcagtattattttcttctttttgttttgttttgtttctttgaaacagcgtctcactctgtcacccaggctggagtgcagtggcgcaatcttggctcactgcaatctccgtctcccagggtcaagcgattctcctgcctctgcctcccgagtagctgggattacagacatgtgccaccacaccgggctaatttttgtatctttagtagagacggagtttcaccatgttggccaggctggtcttgaactcctgacctcaagtgattcgtctgtcttggcctcccaaagtactgggatacaggtgtgagccactgcacctggcctcagtattattttctataaatgcatatgaatctataattattaaaaaataaaaaggttggccaggcacggtggctcacgcctgtaatcctagcagtttgggaggccaaggcaggcagatcacctgaggttgggagtttgagactaccctgaccaacatagacaaaccacatctctactaaaaatacaaaattagccgggcctggtagcacatgcctgtaatcccagctactcgggagactgaggcaggagaattgcttgaaccggggaggcggaggttgtggtgagccaagattgcaccattgcactccagcctgggcaacaagagcaaaactcagtctcaaagataaataaataaataaatagtttaattttttaaaaaagcatttaactatggttatatgcagtaacatatgaatctcagaagcattatgttgagtgaaagaagctagacatgagactacgtaccgtatgatgccatttatatgaattctgtaaaaggcagactcgtgatgatagctgatcagttgctaagggtaggaaaaggggacttatgtttgccatcaagggcacaaaagacctttttggatggaaatactctgttgtaattgtgg

SEQ ID NO: 3087 - DNA, 1034 bp, Homo sapiens
atttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaaaatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcttggattttgcatttctttttcggttggaacggagctctgtttttcttaactccttatatgtgtacctcctaagccctggcacccacagaaggtggtgccaggagacatgtggccccaggggagcttccaggtttaaactgcactggttgaagtgagtggatcccccaactctgccccatgaaatgctaggggagtgggacagagtcagtacctcagttgtccaattcagaagtggagttctttgcattttcactggggctttgagaggaaaaaaataagtcatgggaggcatccagcgcggtgactgcatgtgcacccactccccagacttcagcagggggctctggtcaggccccggctgtggcttcag

SEQ ID NO: 3088 - DNA, 1787 bp, Homo sapiens
ggaggcaggtccgcaggtccacagagtagaggctgcgtggctgcaggagtcagatggcggggtgaggcccctgcggctcagtcagccagcctgctggccctgtctgccaagacacagagaggggtggtgcacctcacccaggcaggattgtgagccagagaggggggggatggaagtggagctggagccatgtccccacctgtccctgctgataagaggtggcccagtgggcttccttccagctgggtctcccagggcagcctggaaggctctgattggcagagcgttggtggcagtcacatggaaactagctgtcttgggcagaggggctttttgcagttttcaagggcactctgtttttctccatgctgacccgctttagcagcccagtttccagagtctcttcaacgcattgattagtccaggcgcctcaggcacacccaacgctgatttgtccccccaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgt

SEQ ID NO: 3089 - DNA, 1014 bp, Homo sapiens
tgtgcaggatgcacagcaaggtcccctgcctttggcccctaggcctgtctaagggctttgttgttttgttgaagcgttgagtggcctgcacggaacaatcttaggattgaggagaaacctgttggccctgttattgtgtttgctacttggaatgagtacgccaagggaaaagtggcagctcacactcatgcccttgagccatagctgcgtgggtgcaggtctggggctgctggccctgcagtgacagcctgcctgtttgcaggaagagcagcatcattgtggccgccgatgagagcaccatcagctggggtccgtcaccgacctttggggaactggtaagctgtcacctgtgcgggtcaggggaagtggaagccagtcagggtggctcatggcctttgggttctctccacctgtctcccaaaacacacagaagaaaaacatttgggattccccccttattgtattaaggtttgcaacacgattgagtcccatgagttttcaaggacaattctgtgctagtcagataattctgagtcatctctgcacatttgtaaactctgaaaattgggacttttcagatccggtttcccctcacattttgtaaaccacagttgggttatggtaggaaaagggcctgtttgttccctctcccctggaggcctaagtcagtgggaaactcacagttgtgggtgatttgaggacattcttcatttttccaaattgagtttaaacctgtgtttctgttgttaataccagttacttgagtgatgaggttagaactcatgaccctcaatttcacacacgtggccttccgcaaacaaatgtctttcattcttagatcctggtgctaggtgagtcttttttttttttttttttgagatggagtttctctgtcacccaggctggagtgcagtggcgcgatcttggctcactgcaccctctgtctcccaggttcaaatgattctcagttctcctgcttcagcctcctgagtagctgggactctaggcgtttgc

SEQ ID NO: 3090 - DNA, 1050 bp, Homo sapiens
gttcttctgtctgagaatgcctaggagtctctttgttctatgctttgttgaaaaagcctgggctaggattccagagatcaagttggtcctccccactgagtggtctcagctcaccacctccttcccttggaatcttcttgccgatgaagaatgcccagggaattgggctaggactagggtaggagatttcagtttgtgcaagtccaaaaactgatttgttttgtctgatgtagtcaggggaaataaagttggctcttgtttagggccttataggccaagttttttagtaagttgtagattcccatggtttagacatgaaacatcaaagaactgaattggcatgtcagaagatgggaaaacgagactgaagaagataaatcttaaacacttgaagtgtctctgagttcatttcatcagtgaccaggtacaggttacctctgtacctgtgggtgagggaagtctaaagaaaaatccaggccgggcgcagtggttcatgtttgtaatcagaggactttgggaggccaaggtgggcagatcatttgagaccagcctgagcaacatggtgagacccccatctctacaaaaaaaccacaaaaatcagctgggcatggtggtgcacacccaagtcctagcgacttgggaggctgaggtaggagaatcgcttgagcccaggaggtggaggttgtggtgagccgtgatcgtgccattgcattccagcctaggtaacagagcacgagaccctctcgagggggggaaaagaaacgaaaaatccaggaacaggtaggccttttctgttctttctgcaattgaatctgttttttttttgttgtgtttttttttttgtttcgttttgttttttttttttgagatggagtctcattccgtcacccaggctggagtgcagtgacgctatctcggctcactgcagcctccgcctcccaggttcaagagattctcctgtctcagcctcctgagtagctgggattacaggtgcacaccactgtgcccagctaatttttttgtattttagtagagatgggtttcaccatg

SEQ ID NO: 3091 - DNA, 1335 bp, Homo sapiens
ttccaggcgtggcccaccgtgcccaaccaaactgatgatcacagtgtgggaacaggagcagtttaaaactataaactacttagcagccctgctgctgcaggtggctgcaggagcttgggtgtctggcgtgttctcaggactggagcagccgggcttctggtgtgtggtgtgctgagctgggtctttgcgaaccagtccctgggtcattcggagtgtgggaattgcaggctttagccacccgtaaccatacgtttaggttactggtaattcataaaaacagaggcctgggattgtgtatggagcttttctgtctattcttggtcttttaggggctccttgtggtccctccagtggggtagagatcttacttgatagaccattccttgatcagcagcttcaacttttttgactgcaacccattgtaagaaataagttttcttttgcaacccaatctgaacgtataataccttacctggaattgttgtaacatggtgccattattatgtgtagagtattctttgtcattctgttctattcgtttttaaaaaataactggtcttagctcacaaaattgatttcactgacccactcactgtgctgtgcctaagattggaaatgctgcctttgttgaccaacgtgtgctggtctaaggcccagaagggccagattggggtgctgccggggctcactacagagtccgtgtgagcacactgacacgtcccttgtgcttgtgctgctgctgatggccggctctgtggtctctacaggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacggtgaggctcggcttttctcacttcctgagagtcgcaccaggatggaaggggtgtttatgctcaagtttcctgacgcttggctttggctaggaactgatcccaggtagacatctgcttgcttcttcaagagggctttgcaccttggccaaagggtccttggtcccagggcagggttccctgtcactgcctcctatgttaacttctcccgtgatttaaatagacacatcttaaacacgtagatgttttgccgccctcacctgcaccttaaggtaagcactttctgcttttggcttttatctaacataacatcacagacatctttccaggtcagtagatggtgccccatactggggatgtgagtcgtttttaatcagtaggttgtcccccccgccccccccccc

SEQ ID NO: 3092 - DNA, 1020 bp, Homo sapiens
aagttgctggaggcagccaggtgaaatgacatgaaaatcactcatctcattgggcagactgtttgccaggctgtctgctgcgtggcctttatacacaagcagggtcgcagacactgagttcgtccaaaaaaacaatccgtaggcccatcagggaaggctggattccgcctgggagggcacactgagcttcagacacccacacacccactggcacccccgccctgccccgccgccccgggtggagcccgcaagcgcgggagtctctcccacgattggctgtttctggtctctgaggaagaggagcaccccttaagtgagaaggggtgctgggagttctctgttactctatttaaatgttaattccacataaggcagaggaaagaagttatagagaaataaaagaaagcagcttagagcaaacaattatgtaaataataacgaaatacactaacctccatctaatgtgtgaggaaataggatccatgacgtaaaaacttgaataacagttaatgtccttcataggaatctgaccaccgtcactggagtagactcagtttaccggggtttttcacacatacacacgtatatatgtatatgtatacacacgtatgtatatgtgtgtgtgtgtgtatatatatgtgtgtgtgagtgtatatatatatttttttctttttctttttctttttctttttttaagatggagtctcgctctttcgcccagtctggagtgcagtggcgcgatctcggctcactgcaagccccgcctcccgggttcatgcccttctcctgtctcagcctcccgagtagccgggactacaggcgtgagccaccatgcccggcccacaaatacatttttattggcgtggttgggtttgcctataaatgcttagctagcttgatggatcagtcttcatgagcccttgaccaaatgtccaggtcacccaggaaactccctccccaaggccaaggccactgcggttaagctctggctgtctgaacttgcccctgaaccatgccctc

SEQ ID NO: 3093 - DNA, 1028 bp, Homo sapiens
acctggaccggttccacaccttcccacgcctggctggaggtaaggcctgcctcacctcctcctcccgtgtggccccagggacccctcccctggccattatgaaagaggagggaggtagaggggatccagccacaagtcaggtggatgaaccatttcaggcaccagcactgcccagtagaactttttgtgatgagggatgcgtccagtaccttcactctccaatatgcagccaccagccacacatggccatggagcccttgaagggtggcctgtgcgactgaggaactgcattatctagttttctttcattttaattaagttaaatcttagtagccagtcgtggctggtggctgccgtgtcgggcattgcagctgtaagcggaggcaagtgcaaatgcagagaccagaagtgggaatgaacttgtatttgaagaaacaaagcaaggcccatgagtagggagggaggagggctggtaggagaagacgggctgagacgtaggcagggctggaccttgttggcatattaaagttttcccacaaagaaacagtttcatggtcaaggaaatttggcatgtgtggtgttaaagcaaaatggactcctcccgtgcagaacttctcagagccttgaatgctctaatacgcatggcacatcttcaaggacaaggtctgccatgtagtgtttcccacacgcattgggccatggaaccccgtttctgcaaagacccccatggaccaagtgttttgtggagcacattttgggaatgtgctgaggcctagagggagggagagttgcagccagcacgtgaccagcagagctgggaccggtggtccagcatgtttctctgtggcgtgaattggggcccactggggagtctggaccctgttcctggactggtgggagttcggatgggggtgtcagggaaggtgagcgctcctcagggtcagctgtgtggctttctgctctcagagcctccttccctgcctccctgagggagagaggccgctggttaccactttccaacctggagc

SEQ ID NO: 3094 - DNA, 1014 bp, Homo sapiens
cccggtttaagtccaagcacatcaccccccaaggtgggaaacgaggtggaagggattgcagggcccaaacagagaagccttgggaggcttggcttgcgctcagcccctccaagaagggagccaagatctcataattctatcgccatcttgctcacttcccgagagcactctgtatgcccactgcagtgtttgaagccgcacacatgtgttctctggaacatcgcaccactccagcaaggtggctgtgggtatgtccattgtacagatgagaaaactttgagtcgtgccaggtgaaatgacttgttccttgtcaaagctagagagtggcagagtgggcatgtgacctcaggtctctttggcttccaagatcaccactgggttccaccactagagtctcgtgttgcacccagctttggaaagggaattctaaaagccaagataccctggaatcagactggagcagataaacctcatggcttttgggggggacttggagctttctcttgtcaggattcagagttgggtcactgctttgagcacgtgttgcgtatttgtatctgcatgtttaggtatttgcacgtgtacgtacaagttaaagaagggatttggatactggagggtctgtatcactggcaagtgattccagggaggccttgtgggcaggtgtaaagagtcatcccaggggacacctaggaccttctgctcttctttgccaggattaccctacttgatcatttattcttccatccgtctgtccgtccgtctgtccatccatccatccatccatccatccatccatccatccatccatccgtttgtccatcagtctgtccatccatccatccttttctgggccacggtgctcagtccctatgcttgggctttggggatgatgctgcatgaactgggagcttgcagaatctggggagcttgccaaggaactgttaaatcagggctggaagagtccttagagattggttagatattttctctcccttttgtcagagaggggca

SEQ ID NO: 3095 - DNA, 1125 bp, Homo sapiens
cactgtgactgtggaagttggagctagtgagaggaggaggaggtgggcagaggaaggagggtcccttgggctcgagctccacatcagccctgagctgctggcaagcacccctggcctgcagccagggagagccagagcctttgccaggcagcgagcctccgtgccttccactcctaggtcaggttttgacagcaccactttattactttgtttaagctgttagaaaatttcagaacatcagacacaccctattcaaatgtgagaacaaaaacaccttccagcagtgcctgcttctggaacaggactcctcctgcggaacagggttttgctcaatgactacctccccggtcatgctgctgtccagtgagcagccgggccagagcttgtcggaccgcagtgtgttctctgctagatgcggcagctgtgactcagggggaatgggggctgtatgcctgctcctgacacacctctgcccgttgtgctttgcaggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaaggaaggtgttgcctgctgcttcaactcgtcctcagtggcgcaggccaaatggtttcccttgaatgcacagccatttccggcgtcagcccgggaagactcatgtcagacccgctgtctccaggcctgttgtcagcgctaagtgcaacctgtctattcttggccagcaagttggggcaccacattggatggctctgatttttcccaaaacaaagcccatgccttgctcttaattttttggccttaagagct

SEQ ID NO: 3096 - DNA, 1070 bp, Homo sapiens
ctttactaattggccttaaataattaagttgggcagggtcactcaggatttctgcttaccaaagcacaacagccacagcaaagggccaaatacggccgtggtccggggccgtgagcccggcactcatcaggcagactaggaaaggcactgtgggttagcccgatactgggaggagacccatgggggagagaccgcggctggaagggcgtgtagagatatcatcctgatgctggggcagcctcactggcggcaggctttgtcctaagtcctgtaagtcatggggtaaggggtagtagcagagacacagaaatgtagctcagcagaagctggcctcttctgcacacttgacattcagaaaaaaagttcctctgccaggaacttgcaagtacaaagcctgggacattctcaggcgtctgtcagaacttgatctgttatcttgtctgccagggtaaagagctgcagagaaatggattcttgtcctcatccacgggtccaccttccaggactttaggctgcagcatcatcacacgtatgcgggagagaaagtgggggcttgggaaggtactggggcagagggaggccacaggaagcatatttcagtagagagggaattgtccccatttaatattatttgttttttgcgagttatttattgaatgcaggtgtggatagcctgtctcatgctaggcagccccttcacttgaggcccatatagttttagcttctataatgaataccatctatgtttcttatttttatgattcttatatatacccatgcattttaatactaaacattttaatatatgtccctttagtcatgggatgtgttccagtgtgttttgaggtgtagaatactctgtgacaagggctcacctaggctttacttattacagatgtgatggctgttggcaaacaaaacctccgtagagcttgggtggtagaaactgaatcctgacactgatatttcactgtctgtgccgaggggagcctgatatttctgtgtttcatactggctctacctggtgtaatcattcctcaaacctcaaaccaagaattctgctgagaagg

SEQ ID NO: 3097 - DNA, 1024 bp, Homo sapiens
tttggaaaatataaaatttatgttgacaaataatagatttactcttctttttcaatgaattaacaaatatcttcagaatttctcagtgttttattttttattttttttttgagacagggtcccattctgtcacccaggctggagtgcagtggtatgatctcggctcactgcaaaccctgcctcctgggtgcaagcaatcctcctgcctcagcccccttagtagctgggactacaggcatatactaccgtgcccagctaatttttttgtattttgtatcgaaatggagtttcaccatattagccaggctggtctcgaactcctggactaaagcatcatctgtctgccttggcctcccaaagtgctgggattataggcgtgagtcaccgcgcccggccagttttagtttttaacatgagaaatggcaatagatacaaccatgtaaagcaaagctctctggagtccgtaataatttttgaagattgtaacagggttctgaggccaaacagcttgagacacgctggactggagtgtcatctgtggctctctctctgcaggctgcttctggttagtgacagtttgcattctggaggctgcttgtgaccctaggaaggtttttgcttaggaaactgcaaatcagccgtgggataggaattagtgtaagtgctataggattgtaggaagccagccacagcttctgctgcacaataaaaatgagtgaccttaagctcaatgtggagatgctgctgctaaattggatcaaaatggtttaacaggaacacatatttgggcataagagatacacgtgttgatcctcctgatcttcttgcctttgcacatcaccccctggggcaccagtgccatgctgttggggctatggctcaggtgtgcccttgagcgccctcaccttgctccacttgcctcctccaggatgtccccgttgaggccctcaccacggtgaagccatactgcaatgagatccatgcccaggctcaactgtggctcaagagagaccccaaggcatcc

SEQ ID NO: 3098 - DNA, 1024 bp, Homo sapiens
aataggtccagtgggattcttgtttccagagatggatcattatcacatagatgttcctctcctaatggttggtcaccgatagtaggaatttttatctgccacatttattaccttaaatagaaacttggctgggtgcagtggctcaagcctataatcccagtactttgggaggctaagatgggaggatcccctgagcccaggggttttagaccagcctgggcaagatggtgagaccccatctctacaaaatattttttaaaaaattaaatagaaacttcatcttgtggatgaagagtgggttacactgatgaatttttaaaaaggcagtacgagtcttgaactaataccatgttttgtgaactcttgtatttagtatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagtacgggctttttaggcctcgggaggggcagcaggttgtaaggctgaagctcagttgctgccttcggttcctggaatggagtaaggcagcacatccctagaggcctaatacatcctcttggcccctccattcatgaccaaaggacaaaagtgaaacaacagttctaagcatgttgacaaagattatttctaaattagcccagtggagccataggggtctgtggaagttcctcaacagcctgcctagggaggggaagctgagtgaggggacctccaggcttctcatgcccattttaactattcttacacaaaggtctagacttagataaaaccttctgtattgggaagtaattgtcatttcttggattaagacagctatgctcttgctcacagggcagaaagttatttctcaagaagcttctttagtacacacactcttcgatttccacatggtgcct

SEQ ID NO: 3099 - DNA, 1072 bp, Homo sapiens
gtcttgctcttttttcatgactctttggtggttttccataacttacaggccaaagagttctggaggacccagccacctgcttgactctagctttgtcacctataacaccctacacgcagccctgccagcctgcacatttcccaaggtgtggcgtgttgcctttgttcatgctgtcccttctggaattctttcctctccctctgctcccctttcttctcctgtctagcgaattcctagcccatcttcaagatccagcacgagctttggatccttgggaaaacttccctaacatatactccctgccatcaagtctgctcaagagagccttgtcctgggttcccggagcaccctgtgtgctccttcacctgtcttcccctctacactctcagcagaaaccatattttattcctgtttacaactccagtgcttgatacagaactgatgaataactgggagttgaatatgtgagacacgttgtgccctcaaactcttacagattctttttatgggaccacacagcttgcaggatagctgttgtttccactgtcctcacatctctcatttacctctgcctttttgtgttacatgaagccaggaatcttggctgagtttagtgatcttgcccaccttggtttatttaacaatttcttgttatcatgggaaattttggttctagggatagaatacatctcatagaagtcagagatccttactccctttttcttttttttttccaatttttttggcctttctagcactcatctttatgtaggcagagtacaatcaacccaatgtcaaaaaccatagagtgaaatattaggacttttaggaagtgaggtctgcctccactgtaacctttgcatgtaattaaattggccgcagaagcctgggccttctgggtttatagaataaactgtcagtcagtcttgattccagctctgaaaggcaccctttaccacctccaacatgtaatacgtctaatgagccaggctttttcctaattgtggtcatggaaaatcgatagtcacaggttctcatgcaaattttcttctcccagggtcatgctgctgat

SEQ ID NO: 3100 - DNA, 1529 bp, Homo sapiens
tttaggctgcacatggtccgtctaatgctgttggagagattactgcagaccctgcctcaattacgaaacgttggcggtgtccgggccatcccatacatgcaggtatctcttagctcacctggatctctgtcaggtcatgattggaccgtccttaagcatgcccacatctctcttccagaggacctggaagccttcgtttggtgttaggccacagaataatgaaatctaatttttgagctacaaattatagctcttcattttataaatgagaaagctaagggtcagagaattttttaaatgcacaagttcatccaggtagttattgacagagccagtgcaaaagcccacttctgagattctgagtctctagtctttatgttgatattagagtgtgggccaatagctgttcttccactcactagctgtcttcctcagaggcaaaactgttctttaattcttagtttggtgtaccaccctttctcaagctacttgcttggatataatataggttagtccattaattttacaaactttttacaaaacatttttttgtaatgtcaagtgtggcatatatcagaatttgacttttctgactctgaacactgaagctttggatacctggaatttagaacgctataatggattacagttatgattgatagggatgtcaggaagattaggatttcttctgaaacaccccgtatttcaagtcgttcttctttaggaaattgggttttgtgttttctgtctttgacttctaggtcattctaatgctcactacagatctggatggagaagatgagaaagacaagggggccctagacaacctgctctcccagcttattgctgagttgggtatggataaaaaggtaaaatctgagaggcagactgtgtgagaaacaggattggctgagatcctttctcaggttcccattcgtttcatagaggaacttcacctcgtttcaaggggtaaccatccactgagggctgcattctgttgagtcaacaaaagcgtattcagggcctgctttggcccgagcatagttttggaccctgagcatagttgagggcaaagatgaagttcttaccctcatggcccttttgtgctcagtgaggtgagaacattaaattagttgttcgtatcttaatatggcctcttaagtgtatcgggctctaggtaccccaagtatagtccatggatatactgggggttgttttgtgtctgattcaatctgaggaacattttagggctgatgggcttgacttgaagggatcttgttcagaggatgcctcaagcatcgagtaagtagaggtttctggacttacgctttggcctgcaggatgtctccaagaagaatgagcgcagcgccctgaatgaagtccatctggtagtaatgagactcctgagtgtcttcatgtcccgcaccaaatctggatccaagtcttccatatgtgaggtatttttgctttgggttcatgggtttggggaaaggtaagcggattgtctgggtagtgctagggccagcaca

SEQ ID NO: 3101 - DNA, 1048 bp, Homo sapiens
gcacccagctcttcctctctggacgcaggaaccctctctgacaccacagcatcaggtaactgtccacagcaaggagcacggctcagggccccaggaccctcaggccttgtttccactgctgtgagagtgtaatgggcagctgctttgacaggccattctggacttcctgcttctgccttggctttagaaagatgggtgtggagggtgtagtgctgtggctcggccccgccgcgcacagctccgcttcctcacactttgcatgctgcctggcttcagctacttccccacggaaaagccgagagagcggcatgcaggctgatcagctacagggcttccacttcagcttccagcgttctttgtcagagttctaacattttagacagtattaaaagagagacaagaaatagaactcataccttttaccttttttatcttcatttgcaaataaaaggagagctataagaagctagattatacttcagaattcttgttcagtgtgaccaaccatcaggatctgtgagcttgagagagagggtttttatggacaattaaaatctatagcaaatctccagaactcatcttctctttattttcaatcttttccctaatctgattaaaaaaaaaaaaatgtttcctgaatagagagttggaccaaatggagatacctggtcaacccctgagtaatttaagggttgatttatagttttttagactgatgcttccttgtgtttgttttttttcttttcttttggaagttttagcctgggtagttaagaaagggagagagcggctggccccacctgctgccatggcttgttgcttttcttaggtctctttagttgctgtcatttcaggctctgaggttgctgttgtgttgtgccagtcgtgttcccgctgtgctctgtggctgtcttggctttcctcccccatgtatctcatccagcattttcctcctgtctcagctcagccctgatcctggatgctgtggctgtctctggggaatttccttgcttcattattagcatctgatgaggatgattaggaggtg

SEQ ID NO: 3102 - DNA, 1033 bp, Homo sapiens
ctctaacttcttacactattgaaaattcagatggaagagtaaagggtctgaatagcaatatagaaaagtaggatgatcctggtgctcattcatgtttggaggacatttgggtggtaaacctaaaaggcaagtcaaggtcatgttttgtcatcacctgaggttgggggatattagggaacatttagtatctgccttcctcttcatatttccttgccttgtcttttgatatccagagagagtggacagctacttatttctgtgactcaagatatctggaaagacttttgaggacaatttgggagtttaggaaactgttaatgaaacaaatcataaataatacaggctactgtgtgtgaatgagtgtgtatgtgagtgtttgtcattttgtttgcatgaccttttacatggagataaaaggttacacttttgtctcagactctcaagtagttagagttttttcctccagattttcaaataatgtttgtctctcctttaggactaactcatattgaagctactgtcaatgctctggtggacatcatccatggctactgtacctgtgagctggattgtattaacacagcatccaagatctacatgcagatgctcttgtgtcctgtacgtagcattacaatcccagagagctcgcagcagccagggaatatctggaaaattgtttttagcttgctaagctaatgaaataaaatatatttagaggaagctgaagggaatgaagtttcaaatatcaataaaagctttaagatcttactccatggaagagaaagatttggaaaggggatgggctcagtctttcttattcagtgctgaatcaccagggacagcctactgcttgctacatagtaagtgctaggtaactcggtgaattgtgacttaaatgagcacatgaatgaaagtagtacatcaagatttctatttccagtgaccctttcacagaagctaagtgttaaaactactgattttagcacagagctaagacgtgcgctgggggcttgatcatctgataaaaagccag

SEQ ID NO: 3103 - DNA, 1036 bp, Homo sapiens
cctgaggtgttccagaggctagtgatcacagctcgctccattgccatcatgcgccccaacaaccttgtccactttacggagtcaaagctgccccagatggaaacaggtgaacttggcctctgtggccgtggtcctgagatctgcttcatatgcctatttaccctctcattcttactgttcttactggcctctgactgactgcatgctcagagacagggattttgcttcctggtctttataccttgtagggccttttgacattgagattgtacaattttaaacacattctttttccagtgcttatactttcgattatccttgagtttatttagtgttctagacatcagatataatctgtctctgaagttattacctcttaggagcttcaggggaaagctaagcttggttgggccctggttgctttaaagcaactatggcatatctttcgctttcatgccattcttttgccagtgctattattaataatgtgtagcaactttctcagtgctcagtgctgtttcctcatctcctcttctgttggctgggtagcaaacctgttttgtcattgtcaaattgagttgattgctgcctttacaattctgtgttatttacatgctcccatatgcatcatcattctgttcctccttttaatactacaatcccagaattgttctagagagatctctagaatgttcagatgttcctctacgttttagaagttgaacagttggaactgagatctttgaatctgcggtaaacatcctaaatgctccccgttctacttaattctaacatacaatgttttctgcgatattcctttcccagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttg

SEQ ID NO: 3104 - DNA, 1088 bp, Homo sapiens
cctggtgcagactctgtcctcattgtgactgcgaaattgggagccactggcctgtggctgtccaacattctgggatctctccactctgctgatttttctgtcctttcatcaggaaactttgagcttcatttgatgtattaaagaggcaaggtgacaggaaaggagtacaccggagcatggtagcagtaaagatagggctgcactgtgttgagtattcatttcaatagtgttgtgtccacctcactaatggggctacttctgtgtttaggccgagaggaggcagattgacatgaaattgcaaggctttcttaacgcacagaggaagacctcaggtcacacatggctgagagatggttggcaatggcttgctatgccactgaaaactaaactctcagaatacaaatccttgagccttactcaagactgcatttctctgtcatttattggccactgtctgatattctttcttctagatatagttgctgttagtgtgaatgatcatgatctgtactttgaacaaagaaagtgtgtagagacccctgggagtgaggggtaggggatacaatactctgaagcagaagaggacccttgcagtgatggttagggactcttctgagtaggagacgtaatcggcttttggtccatggaacttttaccacatgtattcagcatatatacacgattaaagtgctgcaaatatctcagaagataaagtttctctatgtctataaaattgacgtgatttacttctttgctccaactgttctggtctttgctttggaggggtggctttttagagaatgtgcttcctaaaggcctctcttgcttattgcagttggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggtaccagtgctggcaggggttggcttcagtttttac

SEQ ID NO: 3105 - DNA, 1093 bp, Homo sapiens
tggtcctagaatttttctacttttaaatccagaatcactatgtgctagcttctcccaggagttaaaaaaatcagctgggtgccatgactttcacctgtagtaccagctacttggaaggctgaggtggagaattacttgaggcttagttcaagggtgcagtgagctgtgatcatgccacgccactccactccaatctgggtgatagagcaagaccctgtctctaaaaatgataacaagccatattttgtcacttttgctatgttgctgagtaggagctttctgtctttaggcaatagggaattgattctggttctaccctcactgtaccaagtgcacacctattaccatacttgtttcagaatttatttatgtatgtctgtcccctactcattccttgaaggagagtgaaaggtgttctgttcatctttataagaccagtgcctaacactccatttttttactgaatggagaatgaatgcctgttattggtcagttccggctatttggattcactaagatatttgggggatgggactgagatagatttcccttatttaatttttcttccatcctgcagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggttagagcacatgttgctatttccttctattccggatttaattatttagcaactcctctattcttttttctttgttcttttataacatttttctgtggacttcatctaactggatctttttttctttttctttgtttttccatctaactttctacctaatagcaaactctcttatcctttagggctaaattaattcaacttcaagttccatttttctcagggtctttgtaagatttacccacagggatctcatgcttagagtatgagagcacctgatcatgattgaaa

SEQ ID NO: 3106 - DNA, 1020 bp, Homo sapiens
cctatagagaaagcataagatgttttttcttaaccacaaacccctaagatctcactcacctgaagtaacaacagattttcagccagctagctatttccagttgtggtagatttccacgggtcatttgcgagtcaactattcaccccgccatagggcgttgaggcacatgtgtttttgtgggtgtttatatgcagggatatatttcgaattaaaaagacttattatttttgaaggatgaagattctctttgcaataaactctgcacttttacgatcacacagaaagaattcatgaaccagcattggtaagggtagttcttcctttaaggtgaagatttgctgggcaccgattgttgggacttctgagcttatttgctggttcttgttctttgtaggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggtgagaggaccctccctgagctataaagggtggcttgttagtgacacgggattactgaagccaaactggaaaattcccatcacctccaggatacctgagtctaggaatatgttccagctcactcatcgatgatctgcacagttgtggcctaaggacttcatttagaatatcagaaccagcagattccttagagatcttgtagttcgtttttcctaagacctccccacaatttcacacgttataataaggcctgatactgtgagtgggtaaagaagttagatattaggtgaatactatgaagatcagaatttaggcttttggataacattgaaacgcttagccagtttcttctttgggtcaaattttcctcggagatctcaggcagtatttcctctgtgcttgaggcaagaacttagggactctgacattttctgtccctaggctctggtgaagagaactcctagcagtggcatgagct

SEQ ID NO: 3107 - DNA, 1614 bp, Homo sapiens
tacatcgcccccaaaagattctgatcagctggatgtaattcaggagaaccggcagctgctgcagttactgaccacatacattgttcgggaaaacaggtagaacaactacatttctgtcgtgtttccctagcaaccccagaaacacgttgatatttgcagttatctttccttcgggcaccagtcttagcattctcagcatttttgtatctacctctctctagactcaaggattctagtgtagctccttgatttttttcccatggaaaaacttttggaatgacttggcctgtcagttacaacctgaatgaatgttttatgctctactagcccaagtccaaagctgggattggtattgtagttatgtatttaatgtttaatttaaaacttcctttataacacacagaatgagattcctgttgattattcaccaacttgctctttcttttctcctagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatggtaagatgatgaagttgtatctgtaggttacaacattgatcttgagaagtgggttactttctttatagctcaaagtgagtacagaagaaatttgaatctctaccctttcattggagtttgggagttgggtgggtagcaaatagctctgttcactttagacttcatcttcatcattttcttagtagagtttcctgttcattgttcccaagataattcttggggaaagtatgccaagtgttaatgataattctaaggccagagcaccccaagctatgtaactatatagtacttatggagttttctaagaatgcttctgcttcacagtgtcctcagattgattcaaagttaatgaagatgcctcatttcgttggtttcttcgatgattttgtgtctcctctttcccctcttttttttctttgggacagcaagaaatacctgtcacagaagaatgtagttgaaaaactgaatgccaatgtaatgcatggaaaggtaagaaaagtgaggaatgacaatggggggtgaagggaaaggtgattctcacctctgtggtcaggtggaagtctctcgttcctattgagttctgtgcctggctagcctaccaaggataaggctgataatctcaaagactggaaatatgtagttgctaactgtgtgcctttaggcatgttttggctggcaagaagtgatgggaaggaaatatactggtaaataagcagacagaatctttcttaaaacatagagttcctgccatcctaagatattggaatgttatgggaaactgtctccctgctcaggctttggaactgtgccactctgagtcagtgttataaaaggccaaatacagcctcctcagctctagtccagatgctaagctttgtttaatttgcctgaaggttctggttactctggtaagaaaagcggtttgaaactgacagaaatcctgcattcaggcattttctcctcctgcccaac

SEQ ID NO: 3108 - DNA, 1035 bp, Homo sapiens
ttttgctttcaacatgaaaccacttaggggcacttgcagtgttttttggagaaattttaaagaatttttttccttgggggaagctcagattaatcatctaaatccactttagatggacctgtatttgccatttttgtttacatggttagaagtcttcaaagcagtttgttttcctaaaaggctttgctttctgttccccattgtaggatcaaatagctctaatgctggatttgagaaagcataaaccttcttgagtgccaaagacccgctatatttttcctggtggaatcttgcaaaaaggctgagagggtcgaggggtgcaatgagggaaacccttgttaaacacacaaatctctttcctaatattaaaacacaaatctctttccaaatagccaaaggcaatggaaacagttggctacattcattccttttttgcattaaagctcttctgacaaattctctgaatagtatattttcttttttattgctttatagtctatcgagttatttttgactattatcatgcagtgatttttaacctgtagtataaactctcaaaactagaattaaatgatagaatcaaaatatggggaaaagtaattgaactggttcacctgtccaagtttgttaatcagaaaggaacaatagcaacatttttgtgggggagcttgtagtacttttcatggccacaaatgacagggtgggcattaacacgcctgtgttaaggcttgcctcaagcaatcctcccctcgacctcccaaagtgttaggattatagactgagccactgtgcctggctggccaagtctgactttttttagccaaaatttagtttctgtcttgtctttaccatgtagcctttttttcttccttaatttgttatcttactgcctgggtttaggaaatttaactcttctagtgcttgacattataactcctggggaatgctctttttcccaccagatatagtcatcttttctctctggtaggtttttgtctacaatgaagcagaatgccctgcaaggtgtggtgccca

SEQ ID NO: 3109 - DNA, 1047 bp, Homo sapiens
gtggtggtgcatgcctgtaatccccgctactctggaggctgaggcaggagaatcgcttgagcctgggaggtggaggtttcagtgagccgggatcacgccatcgtactccagcctggacaacaagagtgaaactccgtcttaaaaaaaaaaaagtgatctgatgtggagctgggcatgctgcttttgattcggaggagggatggcttctgagaaggtgacatttgatccaaatgaaaagagggagtcagctccatgtgaaggtcaaggaaagtacgatggaatgtatcattgaaaagaggatattgaactcttcaagttaaattgtttgggtaggatttagcatttatgatgaaatctgtcagcttgttcagatttttgtgtctgtttgatattgtacagctcgaaatctatgacatgattggacaagcaatcagcagttctcgccgggctggtggtgaggtaagaagcgtatctgtctctgctgcatacttcctatcttgtcctctctgagatgtaaatatctctatgattatgttttttattttgtgcctttcacaacagcactatcagaatttccaattgctgggtgcttggtgcttgttaaacagccttttcctcatactgaacctcagtcctactgcgttggctgataaggggaaagagaaggacccactggctgccctccgagtcagagacatcctttctcgtactaaagagggagtgggctcccctaaactggggcctggaaaagggtatgtgtctacttgattataacttatattttgttttatttcgctaacattttatatttacagggagctagtatgacttcatatcaataggaaaatttgccttcctacctggcttgaatttagcaactaagataatgatcatgacctgttatctccacagcatagctttgtgatttttagataagtcactcattctctttgattctatttcctcatctgtcaaaggggaaaaatatctgtgcaatgtgtatttcaggaattttatgaagttcacatcagaaaaacatgtttctgt

SEQ ID NO: 3110 - DNA, 2100 bp, Homo sapiens
tagcctaggggactattcacctacagccaagaacttattttccacaaagagggcaaagactagagaacccccacagttgttgagctggagtcccagctcttcaggtctatccctaggatttgcagtcttttcttgttggtggagcctgacagtttgctcattttaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtactgtcttcagaggggatggagaacatgctagcggagtccggtttggggccaggtggtcaaacacagcggcccggagatggagtgctctctgcacccagcacgtgtttgggctctaaggccatcccgaagagaaatgatggctgtgtctgcatttgtgaaaactcaggttcttaacagaactgaatgtaaaccctaaactgagttcaaatcaactgatttgcagttttattcttaaggctctctttgatggggaaatttcctaactctttccttgggctctctgggtttttcaaggtcacagcttttccagccactcggaatgtcttgcgacagctacatgagcttgccccttccatcttcttctatttggtggatgcagagcagggacggctgtgtggatatcggcttcgaaaggtaggaaggcatgtcctggcacaaccctttgtggatgagatgcaggtgtttcctggccatttggctaagaagtgaattatgctactcattctactgtaaacttagattagcataatcctgatgtctgatacaaagtcaatcatttgttcatatttgttgggcagctactacatggcagatacggttctaggtgctgtggatggagtggtgcacagtagaacaaatctctgcccttgtggagctttcattccacattctttttctttttttttttgagatggagtcttgcactgtcgcccgggctggagtgcagtggtgcgatctcggctcactgcaacctctgcctccttggttcaagcgattctcctgcctcagacacccaagtagctgggattacaggcgtgcgccaccgcgcccggctaattttttgtatttttagtagagacagggctttgctgtgttggccaggatggtctcaaactcctgaccttgtgatccacctgcctcagcctcccaaagtgctgggattacaggcgtgagccaccgcgcctggccccattatttttctatagcagagagatgggactttttttccattcttgggagggtagaaggtaggaatgtgggttgagtaataagttgtacttttatatgaagatgatgttgaccaactcgtgatggaatgtgtgctttgaattttatttctagaaagggggtcagtttgctttaatcctcacatacttgagaccaactcttgtaaacagtaatacacgctggctgtgaagtccagctctgaagttcacgaggggctggcatggccttgttagcaggactgtttggagaagtactctgtggtgtgtactcacaaacagctctcccatcctgtcctgtaaggccttttgagaggcatagagtttaaccaatttgctagattggaagtctaggtttgtcacttactaactttgtgaccttgggctctggtcttctgttttcttatctgtaaaataaggtgataagtacctgtctcataaggttgttgtgagaattcaacacataaatcacataaaactgcctggcacatggtaaatgccatctgagttggaggtgctgttgttttgaaaatgcagcgcccttttgtgacatttgtaacagctaaccttagcataaacagcactggaaatggtctgcccagaagacacatcctttacccttgtgaatgaaaacataaataaataaaatcatccttctgagttaataaaaagaggaccttgaaagagacagttttgtagattcaggggagtgaactggagtgtgggtgtcatgaatctggagtcctgaggacatcatctgagtga

SEQ ID NO: 3111 - DNA, 1032 bp, Homo sapiens
catgtacctccttatggacccctagtctgatgtagagtatgttacttttcctttacaccagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaaggtgagtggggtttaagctccagttactgaaccttttcaaattctgagggtgaggaacaaaaagccttcagtgagggataacactggttctagttttcaaggacagactcagttctttggtttctctttctagtagtgagccaagtatttgtttatcttgcagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggtgaggcatccagctctgacttgagccagactcagtgtggcttttttgctattttgtaacttaaattgctcctaggcccttggaattgtgtgagttaatgaggaacattcaggggttagaactctgtttcttctagtttcatgcatgggtggaggaaccatccagcactgatgtggaattgtttagaaagtgggtgtgacttcaccagctatgtagggagccagctctcctcttttctaaacattggctgttggttgctgagtggctattttctcttctctctttgaggaagagcaggacacaaagatatttttgtgtcttcccagaattagaatggatttttgtgtattcattctagcatagaaggcgggcttggtagacactttcctggaacggctgcctggtgcgatctcggctcactgcagcctccacctcccaggttcaagcaattcttgtgcc

SEQ ID NO: 3112 - DNA, 1060 bp, Homo sapiens
ttctggcctggcatggtgtctcacgcctgtaatccctgcactttgggagcctgaggtgggtagatcacttgagctcaggagttcaagaccagcctgggcaaccccatctctacaaaaagtacaaaaaattagccaggcatggtggtgcgtgcttgtgatcccagctacttgggaggctgaggtgggaggatcacctgagcctcgggaggtagaggctgcagtgagccgtgatcgcaccactgcactgcagcctgggtgacagagtgagacgctgtctaaaaaaaaacacaacaaagaaaatgctatgaggcgggttatgaaatatccatgagcaacactggctggatgggagctgcagtgctcctggcctgcctggagggggcagccttacccacctgattggtgctctgtatttaggcctagtgttgccacatcttctaaccgtaggaaaatttagaaatctgattgtgaagtataatatcttctaaatgttgacaactaattcaaattaagaacaacaacaacaaaagcccccaaactgtgtgagccaaacaaaacctatttgggaattactagtttgtgacatctggctgaggcctggcagcccctgaggataatcctgtcctgggttgaaagctgacgctgcggtttcttcttccctctcttagtgacagcatccactaccagatggtgtattcttacggctctggggtggtgtgggccctcggagttgttcccttcagccatgtgaacattgtcaagtttaatgtggaagatggagagattgttcagcaggtacaggagggtgacaggagcctgtgaataaggtggggttgggggagacttgatagatttctttgtactggggaacagggaacttggctgggcagatgcaaaagctacttatgctccctcattctggtcacttgccagctgccttcccattaggcctctatttaaagtactcatatttgcatgtgttatcttctggggtggctaaaaaattacatagatctagtctctgcctgtaagtatcttacagtgctgtgaaatcacagta

SEQ ID NO: 3113 - DNA, 1012 bp, Homo sapiens
ttgccctggtggagaaggccctgcaggccgcgtatggcgccagcgcccccagcatgacctcggccaccctccggtggatgtaccaccactcacagctgcaggtaaccagtgaccctgtgcgctcagcttcttcccttccaggggaaccagcaatatctttagatgaaggctgaaacatttgtttatcgattcctctgaaatttctctttctttcaactctcacaaacattcttcccactggtctttttctatgttttttttttggggggacagagtctcactctgtcacccaggctggagtgcagtggcatgatctcgggtcactgcaacttctgcctcttgggccgaagcaactctcttgtctcagcctccccagtagctgggattacaggcgtgcgccaccatgcccagctaattgtttgtatttgtagtagagacagggtttcaccatgttgcccaggctggtctcaaattcctgaactcagacaattcgccctcctcagcctctgaaagtgctgggattataggcgtgagcccctgcgctcggccttctcattggtctttgatggtatctgagtgccaggctttgtaatgagagcttcattgcagggatttcattattccttcagctttatgaaatgactatcccagtgttattgacgaggaaactgagtttcacccagctatgaaaggggcagacattttaacacaggtttaactgtaaagcccactagtctcatccttttggtgggagctggagtttccctctctcagtgcctcatgtcttcctcacttatatccaactccagccttagatgttgcaatagtgtctggcatatatacagtaggtgctcaataaatgggagctaagtgctctacataatttttcacacccataaccatgttgaaaatagaaaagaggattgaatctcagagaggtttaataacttagccgcgtttacacagctgctggggggcagaactgggctgtgaatgtaggtctgtctggaag

SEQ ID NO: 3114 - DNA, 2035 bp, Homo sapiens
tggggcggggagcttcttcctgtactatgtaaacatcgcacctgtttcaaccaatctttgagccctatgtaaatcagacactgcctcctcatgcctgtccttgtgcatgctgctgcaggctggaagacccactcaggtgcccctctctctgcaggagagagagctattctctttttcttttgcctattaaacctctgctcttaacctcacttcacatgtgttcgtgtccttgacttccttggcatgacgcagtgaaccttgggtattaccccagatgaacgacactgcttcattccttggcatgaggcaatgatccttgggtcttaccccagatgaacgacactgcttcattttggggccccaggtgggatcaaggtatcatcatcagaacagtgaggacaggagtggacctcaaccatgtcctttcatttcaaggttcttggcctccattttaaaatcaaatcaaatactgggcccccttcagctatttaaaaatgattagtgtggctggcagccttacaagacttgggggacaggcttgctggggagaacattctgaagcagtgggaatttttacagttcaaggaagtaatcctgttaggcaagatcaggaaataccgtagtaactgaggtagagctcaaggcaatgccatttttgtgattttctaggaacagtgggtcttcccctcctctccccatagtgaggtctctctctgcccttggtctggagagcacatggcatttaaaggtcaacggccctacccagtggcataggaatcctctccatgaggcacattgtcagccctttgccaaaacactctggcttcccaattctcctccctttttgcacccctctgctggacaccaggctttatgctacttccataaatgggaaaactctgtcttcaacaataaggaggaaaatgtcctccaaaaccaaattttagtctcaatactgtcccatcagcaggaaaatagccatttggttcctatgttttttttaaggcacctattctgcttgtaattaaaatagtacttaaatagtaagggtaatttaagtccggaagttaactggaaccattctctaagggtactttagcacgagtcataatagcaggatatagagctcaaaccagcacacttcctccattatggagggaaatacaacagttgcctaaatgcaactgttacatagtctctcccaagatccatttttcagggagccacacaggtcacacaagtcttggaagtcaaaaggaaatcataagtgcaggactagagtcacatgggtaagcatgactaaccccaatcacttagttcctctggttccatggctgggggtcacacctgcaaccatgggaggcatgtttaacaagatgctgggacccaggaaccaaggagggaaaacagtaggggtggcgccctcactgtcttccccttcccctcctctggagtgcgttctgaagcactgggactcctttgactctgagatttggaagaaaaaacagctcattttcttttgcacaagagcatggccttcttactagacctttgcaagcattgcacaatggactcagctctttcagcagtcatatcagacaggcccaaagggaatgattccccaaaactagagaaacaaactcccaggaacccctcaaatgaaacttccagatgccctggcccttcctccctccctttcacattgtcagcttctccaattctaccacccaaacccccagacttttctatggtatttttccttccttcattcatgatttaaaatggctcctatctcttcttctataatgttcctccaaactgggagaagttaatttcctcaaaccttaaaatgcttggcttagggttgagctcggggaacagaacccagaagcctgacatgctgtcaaaagggtaaaaatttttatttttatttttatttatttattttttttgagacagagtctcgctctgttgtccaggctggaatgcagtggtgcaatctcaactcactgcagcctctgcctccctggttcaa

SEQ ID NO: 3115 - DNA, 1049 bp, Homo sapiens
ggagttcaagaccagcctggccaacatggtgaaactccatctctactaaaaatacaaaaattagccaggcgtggtggcacacacctgtaatcccaactacttgggaggctgaggcaggagaagcgcttgaacctgggaggcggaggttgctgtgagccgaaatcttgccgcagcactccagcctgggtgacagagtgagactctgtctcaaaaaaaagaaaaaaagaaatatatgtccttattaaaaattacgtgaatgttatagcagcattattcataatagccagaaagtggaaactgcccaaatgtcaatcttaataggtgaatggataaacaaaatatctgtatgtacaatggaacatttttcaaaaaaaaaaaggaattaagtatgaaacatctacaatgtggatgaaccttaaaaacatgttaagtgaaagaagccagtcacaaaaggcctcatattgtatgattccatttatatgaagtatctggaataagcaaatctattagacacagaaagtagatgagtggttgcctaggactgagagggagtttgggaggaaatggagattcactgctactgagtacagagtttcttttggggaggtgataaaaatgctctgaaattgactgtggtggttgtacaattcagaatacactaaacaccattaaattatacactttaagtgggtcagttgtatatagtgcctcaataatatgtaataaaacaatcaattagctcagaaatctgttagagcagggctcagcagggaagcctcatctgttcctcagtgtctcagaggtgatctagcagctggaggctagggttgcctgaagacattcactcaagcatgtggcagttgctgctgagggccagctggaatatcagctgctgtcatcaaccggcacacacgtgacctctgcatgtggcttccaagggagcacatcccaggcaaactaggcagaagccatgtggccttttatgtcccagcctcagaagtccataacatcactcttgtgtcctgggaggagagtcaaagatacctgtg

SEQ ID NO: 3116 - DNA, 1069 bp, Homo sapiens
tttggtttcactatgtatcttttcacttaaacgagaggacagagatcctctgtgaaattacagtgtctttggagaaaaatcaacttatatatgagttatgtttgtgtatttttacctggtcttttcccaaaaagatttcaggtgacagaagaatacaagccaatacgataatctttttttttttaattttttgagacagagtcctctctgtcacccaggctggagtgtagtggcgccatctcggctcactgcaccctccgcctcccaggttcaagcgattctcctcccttagtctcctgagtagctgggattacaggtgctcgccacagtgcctaatttctttttttttttttttttgtatttttattagaggtggggtttcaccgtgttggtcaggctggtctcgaactcctggcctcaagtgatcctcctgcctcggcctcccaaagtgctgggattacaggcatgagccactgcgtctggccaataatccttaataaaaatgtggactgagaaagctggaccgaggactgaggaccgtccgggaagagaacagcagctaccccgtgcttgccttcatgctgggaaggctgcgggtctggctttaggaggagcctgtgtagggtacgaggggcagcggcagctccacagcaggcggcagcccacgcccagtgggtgcacaccttcatccaactcagggctggcagtcaggaagatgaaatgccatccacgtcaagtttcggtctgtctcccactcaccgaagaatagtccctcctttaagggaggtgctgaagagtgctgagaacttgcttcccaccaaggcaggcttgggcttcaaaagatcagaacctgacccaagtggccctagttttccaccatcccacaccatcccaccaacgcttcagaagtcctgccagcatcaagccgggcatgaggccgtccagacagctcatcactgccctggggagacacatgcatgtcacaaacctgtgaggctcaagaccgcatcctgcacagggtgcaggagtagaggcggggcaacggcctctgccgtcgcggctttgggag

SEQ ID NO: 3117 - DNA, 1038 bp, Homo sapiens
tccagggtcaccaagtatgatggtggagctaagctttgaacccagacaacctgactccggggctcttaactaccacatggcattgcctccatcaataggagaagtaggaatactttgttagaagaaagagctggctacataggcaattcacagaggaagaaacacaaacgcctaatatgtgaaactttggtcctcactagtagttagaagtgcaaaataaaccgagatgggatggctggaaaagcctccttcatggatgactgttccttctgcttggtgggtggattcgtttcttgttggactgtgacctgcacatttcgtgactttctaatgaagtggatcccctcaccttggcattgagtctcttgagggataaagggcagcgattgactgggagaaatccagagtctggataatcagactccattatccattaagagcatcatcacccatgttggcatattaaaggctctgagaagtcccacagttaataaaaaaagaactgaacctgttatcccaactcacgttcaaggaatgtgctttgggaaacattgttttcctgggaaggatcataacctacacactaagtggcctggattctacacccttttttgacaatggccctaagtgtgatattagccaaaccttttattttcataagtgtttggtaaaatggggtagaaggaaacatagcttttttggaattatttatctatttgtgcaaatagagaactgcttcaggaaacttcctgctgcttcaataggagggacaaaggtagatgaaaaggaagcactatgtccattaagaaggtgccttggcaaatcttactggaagtcaggagacctgggctgtggctttgagtctgccactaatttgctttgggaattgcaggtctttgggtctcgggcccccactctgcgaagtgcaggcctgatggtctctcagtctctcagaactggaggtctgttgcctagaactaaaagaacatcaccatggatacccttctgttgatgtcaccactttcaggctcccctttt

SEQ ID NO: 3118 - DNA, 1026 bp, Homo sapiens
gtgatttttgaggaccctgtgtttttcagtccttcagagcagctgggctgctacaaagctgcatttagggtttcgtttggccccctgccccgggagggctttcctggaccgagtgcgagtgtgagtgtgagaaaactgcctaatgtccagtaaacattcgactcatactggccttaaagcttgcaagagcctaggagtaggtggcaaccaggccttaccgtaagggaactttaagttagtgttgcctgatttaaattcagagaactttttgttacagagaatttcaagcacgtgatataatgagcccccaattatctgtcactcaacttcagcagttatcctccgtgcccagcgttgtttcagctgctcctgctcactccacgcccccccactccccagctcgaatcagtttgaatcagatcctctggtgtaattgtcatgagcagtctgggtctctccattctgaaagccagattctaatagtgtacccgatgtaaacaacaggactaagcactgacttttgttttttgaaaattgtcagttaaaaaatttgtgagccttttttttaggattacagtaataatgtaacaggctcattgaaactggaaatcacaaacagggtttaaagatgacagagcccttcatctttcagcatttggagctatcactgatgctttttaagggctgtggatacctctcctgtgctttttttttttttttttttggagacagagtcttgctctgtcgcccaggctggagtgcagtggcacaatctcagcgcactgcaacctccgcctccccggttcaagcaattctcctgcttcagcctcccaagtagctgggattacaaggcatccaccaccacgcccagctaatttttgtacttttggtagagatggggttttgccatgtttgccaggctggtctcgaactcctgaccttaggtgatctgcccgcctcggcctcccaaagtgctgggattataggcatgagccactgtgcccggcctctcctgagcttttgagc

SEQ ID NO: 3119 - DNA, 1055 bp, Homo sapiens
ggggcattaatgtcattcatgaaggtggggccctcatgatctaatcacctcttaaaggcctcacctcttaactctggcattggggattatgtttcagcatatgaattttgagggggtaccagcattcagaccacaacacacataaaacactgccttctcttctcacatgcccagtgtcttccactctcccctgccaaccacagctaagatttctagggtcttcttttttttgtttttaatcagggtattatttgcaagtaataaaattaaccagctttaagtgtacagtttgagttttggtactaatcatgttgccaccaccacaatcgagttatagaacagtttcctcaccctaaaaagtcccttcatgcccctttggcccttttccccctcctagacagccttgttccccatccctagacaaccactgatctgctttgtcaccgcggttttgccttttctataattgtaaataaatggaagcagatagtatggagtcttttgtgtttgacctctttcgtgtaacatgatttatttgattcattcatgttgcatgtattaatatttccttttcttgctgtagagcattccatagtattccatggtatggacgtaccattcagcagttgatgaacatttgggttgcctccagtttttggatgttgagagtaaatctgttataaatcttcacagatagggccgggtgcggtggcttacacctgtaatcccagcattttgggaggccgaggcgggtggatcacgaggtcaagagatcgagaccatcctggctaacaacggtgaaaccccgtctctactagaaatacaaaaaattagccgggcatggtggcgggcacctgtagtcccagctactcgggaggctgaggcaggagaatggcgtgaacccgggaggtggagcttgcagtgagccgagattgcaccactgcactccagcctgggcgacagagcgagactccatctcaaaaaaaaaaaaaaaaaaaatcttcagagataagcttttatgtggactttttctttttcggttttctttcttcctt

SEQ ID NO: 3120 - DNA, 1055 bp, Homo sapiens
ctctgcacagccaaggctttctggggccccgaaatgaaaccttacagtaccttggaagtccagcctgggtagctttgtccagcctgtccaacccgggtacccgaggatctgctgtgacccagaaacatgacttaggttatagcccagcccccattttactcacaaggaacctgaagcttgagagcttgagtgaccggtgtgaacagcaggcctgggattcggatccctgtcagcccaagtcatgtgctggaccccactcactgtgttttccagaacacagtgagcagagggccccgtaaatacaggatcttgtcccatttccccttgcagcagatccaccagtgagggtgcggtgtggaattccaggggatgcaactgcaagatcacccatattgggaccagctagagccatatgctatttccagacctaggctttcacagattcatgtttcagtggaaggaaagggaggtttaatggttatggagcaccagccacatgctatgcactctgttagaacggtcctcaccacagcctgacaaggtaggttcaactttaggctggaggcagcatagtacaagaaaatagagttaggagccagactgctttaggataacagtacctctgcataaggtcgtaatgagggttaagtaatatctgtcaagtgcatccagtagcatctggcacatagtgatgtaaacattaactattgttattatcaccattttccaaaagtgtgcaaaggggtgtatggttagtccctgtctagctactaagtggaggaattgggttttctgactccagagcaaaccgtttttctccactccgtactgcctgccgatggctgctttggagtttgtctggctctgggttgtgccttgaacgcacaacttacctaatagagcctggggctcttttctccattaaagacaagctcactgtgagctgggcaccatgtgttgccagagcctcatgctatatgtcaggcccgaattccttgtttgtgccagtggaaccccctgtgactggagggttcctgccctcttccaggcttgga

SEQ ID NO: 3121 - DNA, 1062 bp, Homo sapiens
gccactgcactccagcctgggcgacagagtgagactccgtctcaaaaaaaaaaaaaaaaaaaaaagccaactcccagctgggcgtggtggctcatacctgtaatcccaacattttggaggctgaggtgggtggatcacttgaggccaggagtttgagaccagcctggccaacagtgaaaccccatctccactaaaaataataatcccagcgctttgggaggccgaagcaggtggatcacgaagtcaggagatagagaccatcctggctaacatggtgaaaccccgtctgtactaaaaatacaaaaaaattagccgggcgtggtggtgggcgcctgtagtcccagctactcgggaggctgaagcaggagaatggtgtgaacctgggaggtagagcttgcagtgagccgagatcatgccattgcactccagcctgggtgacagagcgagactcagtctcaaaaaaaaaaaaaaaaaaaaatcaaaaattagctaggcgtggtggcacctgcctgtaatcctagctactcaggaggcggaggcacgagaattgcttgaacctgggaagcagaggttgcagtgagctgagatggcgccactgcactccagcctgggcaacaaagcaagattctgtctcaaataaataaataaataaataagtaaataaataaagaaataataaaagccagttcctctagtcaattattttaaatcttctagttcaaaaatttatcagatgtatgaatctccttacaattttcctaggcaagtggccattcagcttctacttgaatgcttccagtggtaggcaactcatttccagaggcaactgggcttacatttggacagctttcattgtttgaaaaatttaattaattaattaatttattttgagatggactctcactctgtcgccaggctggaatgcagtggcacaatctcggctcactacaacctccgcctcccgggttcaagcaattctcctgcctcagcttcccaagtagctgagattacaggcgcccgccaccatgcccagctaatttttgtatttttagtagagatggg

SEQ ID NO: 3122 - DNA, 1039 bp, Homo sapiens
atcaaggcaaaattgtaattctttaagggtacgtagatgggattaatttgttatatcaaggccgagtatagtggctcaacctgtaatcccagcgctttgggaaggcctaggcaggaggatcgcttgaggccaggagtttgagagcagcctgggcaacacagaactcctctctttaaaaaaaaaaaaaaaaaaaaaaaacaaaaaaaagttggccgagcgcagtggctcacacctgtaatcccagcactttgggaggctgaggtgggcagatcacccgaggtcaggcgtttgagaccagcctggccaacatggtgaaaccccgtctctgctaaaaatacaaaaattagacaggtatggtggtgtgtgcctgtagtcccagctacttgggaggctgatgcaagagaattgcttgaacccaggaggcggaggttgcagtgagccaaggttgtgccactgcactccagcccaggtggcagagcgaggtctgtctgaaaaacaaaaacaaaaacaagtcagactccattgttatatcaagacaagagctaagtggttggcaattaagaaaaaaggattcattcctgggaagaactggctctcggggatcccatgtccttgggctcagttcctggggccagtgctgggctgctctcgtcctgctgcaggatggtggccgatcctgataaccctttggtgctggacatcctgacgggctcttccacctcttactccttcttcccggacaagcctatcacccaggtaagggcttcacaaccttgaggcttcgaaataaaaatgaagcagaacagcacatttggctgaggcgaaggaaatgactagttggtggggtggggcatgggcagaagcggtgtggtctcaggctcccccttcaggtagggccagggtcgttttggtctggcctgctgtcctcttgttcgggaggcgtggcagcttttcccttacttggaactgcttgggtcacagcctcgttttgttcccagtatccacatgcggtggggaagaacaccctcctcattgctgg

SEQ ID NO: 3123 - DNA, 1756 bp, Homo sapiens
aagtgggctccagactagggggcgggaggccggcctgggcggagcaaagggcgctcggcctcgttgattggccgcggctgcagagctgtctctctaggattgagccttttctttagggggacggggccttgattcactcccaccaatagggttcaaggaatccacctcccaccagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcacgtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaagggtgagagcggggtccgagggggtagcgtgtgggggcctggggttggtacagcatcgagggcattgaccactctccttccctctccctttcctggagcaggccgcccgggtctggcctgccgcttggcgtgcgggtccgcgatgtctgcagcaggggtttcccttcgcgtcccgtcttcctcaactacctgttttttcttgtccagaccggggctttgagctcacattcaagaccgctgatgaccccagcctgtctctcataaagtatggggaattcctctatgacaatctcatcattttctccccttcggtagaaggtaagggttccgcgtcgcccctagcactggaattcgagacccgggacttgatggattgctttcttctggttcttgggcatgtcctgggtcacaggatgggttgccagtcctggatggtgctaccacggagataaggaaaatgctcatttctgacctgaccctaggagggtacatctttctaaaagaaacagctaaggattgtggagtcaagtgttgctgcagaccgtggaacccagggccctgctgctctgctgagaagggagtttactctgtaaagggcctgataaaaagatggaaagctcctgggttgggtttgcctgggtggaaagaggaaatggcctgttattaatatggattgctataaagaggcattgtgcattgtggcagttgatcttaagaattcagatagattcatagtctcgggctgaaaaaagagccttagcaattatctaccaccccacccctcctcccatttgaggctggataaatatgtccagcagccttgcagtgggctagtcgtttaacagaatgaatatcttggccagattatccagttgatacttgagtattcttgttttacgaggcaatccactccaccactgaacaattctgttaagaagttcttatattaagaaatattgtctcctgctttattttgttcttatgctccccagcaccttagagaatagatagaatgcttatcttgtttgcaggcatagccttcacataatcacagcttattcggttgtttctcctccagactgaacatccccagctccttagctatttctcttttgccatacttttttggtgagcatgttagtcattctcttctttatttgcttcagtttatctttttcttaaaagactcaagttgtccctgtctgggtaagacaggactgccttcctcccttcagttaatgaagcttaggaa

SEQ ID NO: 3124 - DNA, 1083 bp, Homo sapiens
gccaggtgctgctgatggctcatgccctgaggcgcatactctactccacctggtgccctgccgactgccagtttgccttcatggctcgaaacccacggagcccagccagcaagctcttctgccacctctttgtgggcagccagccaggagaggtatctggggcttgaggcaggggaccgccacggaggccggaggggctgtgcgccaggcatcagggtgggttccttgagggctttgccagggcggcctgatccccctccaggcatgcacccctcaccacattggctctttctgtggctcttcccactgaggacaccacaaagcaagtcagtggcctcagcattccctagggcccaggggcgggaatctggccacgcgcttagagagtggagagtcacacctccaggccttcgctcatgccgttctgtctggcatcccctccccttctcatcctagcacattccactcactcttcaaggctcagcccatgtgtctgaaccccgccttgactcctctggatggccactctctctggggtcctgtgacatgaactgcacgctaccatcgtctgccctaattacaggcacctgagttctttgagagccgagtctgggtccaggtcttgagagagtgcttggcccagagcggtcggggtgggcgggtagatcagaaagtcaaagccagcctggctgttgtgaaggacagagccttggcagctaggcgcttggcaggcagacgctgggtttggttctgaccagcaaccatttgctgtcatcctgtatatccaggccatgtgctggatactggggtgacacgtggctgagtcatgttccttgagctgacgctcacggttctaactcgttgggtctggatggtgtgtgtggcggttgggatgcgctgctcccgacaagcactgggcctgtgctgggaacttcctgtgctctatttcactgactcctcaaaggggcacagggaggtggggatgaggaaaccgaggcacagagaggtgccatgctctgcccagggtcacacagcagctcctacatgacagagccaggattggaacccaagttctgacttcag

SEQ ID NO: 3125 - DNA, 1078 bp, Homo sapiens
acacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccc

SEQ ID NO: 3126 - DNA, 1033 bp, Homo sapiens
aaaatcaattgaccataaatataagggtttatttccggattctgagttctcttttgttctgtaggtgtatccttcatgctaatactgcactgtcttactgactgtagctttatagtgaattttgaaatttggaattataagccctctaactttttcaggaatgttttgactatgccgggtcctgtacagttccatacaaattgtccatttctgccaaaaaaaaaaaaccaaaaaaacagctggagttttggtaggaattgccttgaacctatagatcaatttggggagactcactgtcaacaacgttgagttttccaatccatgacacagaggtctctttatttaatttctctcagcagtgttttgtagttgttcggtgtacgagtcttgaattttttttgttaaatttattgccaagtattttattctttttccatgctgtcttgaatggtggaagtgttttctaattttcgttttcaggttgttaacgctaacctgtagaaatacaatcgatttgtccattgctcttgtatccttcgcccttgctgaactcaccagttgtagtagtttctttgtgaattccttacagttttctacatacaggatctgttatctgcaaataaagagcattttacttctttgtttctagtctggatgtcttttacttcttctgattgcctgattgctctagattaacctccattacagtgttgagtagaagtggtaacagcagacatcttcgccttgttccacatcctggagagaaagcattcagtccttcacaagttagctataggtttttcatagatgcctattgtcaggttgagcaagttcccttctatatatactactagtttcctgggagtttttatcatgaatggctattggatttgtcaagtggtttttcagtgtctgttgagatgattgtgtggtttgtgtcctttgttcgtgtggtctgttaacattatttgttttgtggtaaattctttaaagtttagttgccatgtgaaacctgaaaccctaatcagtgaat

SEQ ID NO: 3127 - DNA, 1046 bp, Homo sapiens
ttttgtgtgtttcaaaatttaaagtatttgatttcaagtcagtgaccagttggaaaacaaaattttaagcatttgaaaaaaattaagtatttgctgcctttgtgacataatgagctacttaattcttccaggtgcattagtcaaatggagtataagtaaaataggatggaaatggaagagggcacattaaattcaaatagaacaccttcactattacccaaaactctccttcagcactttgccatctgtaaacccatttttatgccacttattcagattatctttgattcttctttctgctgacattcatacagagccttcagggaaatgtcctggcatgctcattccttaagctcgtgccttaaaatgggacagatctgtgatcctgtaagtgataggtttgttctgcttttctcattttgatgccaaagattcatcttctaaatacagaatggaattaaaatggaaagaggttcttcattatacatagaatgttgttcgtgttcagtatggtctcttaggctgttttgaacaatttaaaattgtagtagaaatatttagtaattctgttacttctctgtagtcattatgaactgaagtcttctgaagttcattcttccctaccgtttttgtcatctatcatcaaattcacttccaaaataatttattttgaaaatatatgtcaggctctatctaataaaaaaaaacaactagtttaataaatcttttctaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggtattacacaattgttagtagtaagatcatttcattgtgtattagctttaagtctacagttagtaacatttaggctttttgtgccttttttgttaaaaataagtttcatgatgatgaaattccttaagtttaacctagttgaattatctgaggctaggtttcgaaaatg

SEQ ID NO: 3128 - DNA, 1635 bp, Homo sapiens
gaatgaagagaaggaagaaaataagtcttctgaggaaaccaaaaaggagtaaggagttatgtcttcttgctatttatatttgaagaatgtgtaaaaggactttagattagattgttttaaagtgttataacattggtttatgctaggtatttgctatttggatttaatttttagaattaccatttgaaataggtttattatatagttgtttgacctgttagaatatgctgtagttagcagaacacaatggtttgaataatccaaaagtctttgtcattggctttggaatgtgtttttgagcttgtaatttattgtgggagtatctgatattttaagcattggcaagacttcaataagaaatgaaacataactataaaaatctgacctagaagacatttcactattttattcctacttctgtgccaggagtgggttgtttttgtgtgcttatgttagaaggcattgatttgtatcaagccattggtagtgtgacctaaaagtctatatatgtttgatgaaatattcagttgaagaattggctttgagaatctgaaagtaaaatttgctattgatgtgtatctatataaagtgatggcagttactttttaatttttaatttttttttttttttttttgcaggagagctgatagtattcattccactcttttcataattggtcagaacagttagaaattgcttttaactatagtcatgcattgcttaacaatgggtatacattctgagagatacatctttaggcgatttcatcatcgtgccaacatcataaagtgtacttacacaaacctacgtggtacagcctactacatacctaggctttatgggatagtctgttgcttctaggctacaaacctgtacagcatgttactgtactaaatactgtaggcagttataacacaacggtaagtatttgtgtatttaaacatagaaaaggtacagtaaaaatataatataaaagataaaaaatggtatacctgtgtaggacacctaccatgaatggaccttaaaggattggaagttgtttgggtgagtgagtgagtggtaagtgaatgcaaaggcctaggactactgtgtgcaacttttaaaactaaaaagtttttatttttagcaacttttaaaactaaaaagtttttatttttaaaaacttttaaaactttaccaaaaacaaagacacaagccggacgcaatggtgcacagctgtagccctagctacttaggaagctgaggtggggggattgcttgagtcctgaaatttgaatctagattgggcaacgttgtgagacctcatatttataaaaaaacaaaactaagacacatacacacaccttaacctaggcctgcacaaggtcagggtcatcaatatcactgtcttccacctccagatcttgtcccactcaaggccttcaggggcagcaacacacatggacctgtcatttcctatgataacagtgctgtcttttggaataccttctgaaggacctgcttgaggctgttttacagttaactttttttttgtaggtagaaaacatatactctaatgataaaaagtatagtatagtaaacacataaactagtagcatagctgtttattatcaggtattatgtataattgtaat

SEQ ID NO: 3129 - DNA, 1080 bp, Homo sapiens
atatgacagtcttagaagcatacttttattctcctaggtgatggtctaaatttgcttctgtgggtctggaagctattagaatgtcatgttattcagcagtatttttccccttgtgttttcccttaatagaaggaaaaaaaaagtactttaatagagatagagtttaagattacagttaattttcctgactctttcgagaacagtaacaacaaaagccttctcttggtaaactgatctttgactaactgttccttagtctctttattctatccttctaagttcctgatggtggcaggaggggatggggttaggttccttaggagcttccttgcccttgttgtctttgttcatgtggaaggtgcaacagctgccgtggcttatgcattcgtcttagttgctgctttatgtagtctatattttggtagttttatctttctgagtaaccaaatcatctgtcacttacctataaattttatagttatattttttccctttggatgtgtattaaatttagacgttttagtttagttttgtttctgttaatcttcacaccaggtcttttctgtgctttaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgaggtaggggctgacacattcttgaagctcactcttggatcaatccctgacttcaggccctgctgggtccttcttggtacatgttccttcccttactttggggagtctaggttgtgaatttgaaacaaaatcagattcttttcatcttccctttcccctcaaattcctgagaaaacctccaaccttctaaatttatagcaaatcaactataattatgtgtttccatttgaaattcaagctaaaataacatactttaaaaagtgtatcttaaaaatcatatttcacttcaaaaaaaacttgttaaaagtaatttg

SEQ ID NO: 3130 - DNA, 1060 bp, Homo sapiens
gccccccgggttctccgcccccgccgccgccattacggagctcccagtggtgagtgtgcggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgaggtgagagccccagatctgagggttggtactgcattaacagctgtgaccggggacagccacttaacctttttgagaaagagttgtctcccgtacggagaccggaccgggtgaactgtgctgccgcatccgcgtgcacgttctctctgttgtttattgtgcttcctgactttgcattgcattaaaaagtgagaatccaattcgaaataacgtctaaaaatcgcctggggctttttgagcacgctgtcttgtcttagagtgaaattagaggtgactagtgtcatttttgaaaggtgctctaattttgtttaacctgacataggcaaaaaacttgttagctttttgatttttcattgctcttctcaaaagtttagtgtaatttgtttcaaaatagaagtaacattttaaagtttgctgggttggttggttttggctttgtttttaagcttgcttggaagattgtagggctggaagttagtggagaacgtatactgaactcttcatttccggatgaaagttttaactccttacccagttagattgtgatttta

SEQ ID NO: 3131 - DNA, 1058 bp, Homo sapiens
tcaggactcaggacaataattcactttgagactgccactaccactgattttaaaatcttccatcaattgcctgcaatgcttaagaaacccaaagatgtcctctaaagaatgaataaaaccaaaagctatattatgcttttacaaaagtgggggtgggatttttataaaagtgggggtggggtttaaaatcaagccaataccatgtatgcaaatcacattgtctgccaactccaacctcattcaagccattctggtgagtataaagctgactgtgggcctctgcttgggcctctgcttctcctacagatattggagtgctgtgctttctaattttcccaccctttcatgaagtcgcagtctctacagatggttttccatttcagttgtttgtgggccatcaacctacaaaatgtatttatgaagaaagccagactactcccagataaatagtctttttcttttgtatctggataacaagagatttctgctggcttccatctctgaagaaataccacattaagagacttggcaagacttgtgaaacacaagaacaaaattttctatagcaataaaatgtttctctgaagtgtagttgaacacaatacaagatcccactacataagcccacagaggccatttttcagtggtggaatgctgtatgccactggtccccaatgcacaacctagatccctcacatgtgcagttcacaatgggttcgcgctcctgtgagaatctaatgccaccactgatctgacaggaggcggagctcaggtggaaatgcttgctcacacaccactcaccttctgttgtgcagcccagtttctaacaggccatggaccagtacgtgtccttggcccaggggctggggacccctgctgtatgctgcttttgttttgttttgagacagggtgttgctctgtcacccaggttggagtgcagtggcttgatcatggctcactgtagcctcaaactcctgggctcaagcgatcctcctgcctcaccctccccagtagctgggactacaggcacacaccaccacagaatactattgttgaag

SEQ ID NO: 3132 - DNA, 1034 bp, Homo sapiens
tttaaggctgcagtgagatacgatcacaccactgcactccaacctgagagacaaagtgagagcctatcaaaaataaaaaataaaataaataaacaaaagccacacacacacacaccaaaatctgtaggtagctatctaagatatgttaatatgttaggagatttggaggaaagaatgagagaacatctaacctatctaattggagtcccagaaggaaaattagcctaaatggagaagaggcaatatttgaagagacagtggctgagacttctagaagtgataaaatatacaaatctataatgaaagcccatatatgcaatacaggataattatattttagtgaaactgcataataccaaagacagatgaaagattttaaagaagctgggaagaagaagcacattacttacctgcctccccctcaaaaaaaaaatacacaaaaaattagactttgcagtagcaaccatgaaagccagaagatggtagaataatctcagagtgctgagaaacgagcagtaaatgtagaattccctgtgcagctgaactaacctttaagaattagggcaatgcatactgagaaacttaacaacatacttctaaatacccatgggtcaaagaagaaatcaaacatgatagtaaaaaacatttttaactgaatgaaaacaaaaccacaacatatcatcgatatttagaaaagaagaaaggtcaataacctcagcttcaaccttaaagaattagaaaaataaggccagacacaatggctcatgcctataatcccaacactttgggaggccaaggcaggaagattgcttgagcccaggagcttgagagaccagcccaggcaacagagcaagaccctatcaccaaaaaaaaaaaaaaaagaaattagaacaataagaacaaatgaagctccaagcaaatagaataaaggaaataataaacattatatcagaaatcaatgaaatagaaaaatttttagagaaagaccagtgaaatcaaaagctggttctccaggaggtggaggttgcagtgag

SEQ ID NO: 3133 - DNA, 2006 bp, Homo sapiens
ggaaaagacacagtgtggaatttataaactctgtgtattggactttttttgatgtttataaatcccaaataaccagctgtagctccccagattagtcacctcataaatcaattatttaatcttaagcagctgtacttcaattattcaccattgtatttatgtgcattcagacatcttagtttgaaagtcacaagtcttaagagattaactttttatcagtgaggaaaagtttgttttcgagactggtcttgctgtgtgtgttgcctgggccagacctcatactcctgggtgaaagctgtcttcccacctcagcctccctagtagctaggactatacaggtgtgcaccaccatgccctgctggaaacgttttgatttttcagctttttggggtttgcactgtttgacttcaagcaaatctttttttttttttttttttctgtttcttcttccactgtgaaagtaaatggattggatttatctctattttagagccataagaaagtgggagccttatggagggaggctgacctcagctggaaggactttttaccagaaggagaagatgtacataattttcttttggagcaggtaagaacaaggcttatgttttgctgtttgatagtagttgatctatttcatagaggaagtgaaggtaatttccttcgtattccagtcgttaaaattgcatcaaaataggaatcttggtaaagatgtccttttaagttcatgcttttaaagccactccaactgtgtggtcatcagatgattgatatttaaaaaaagaaaatgtaaaagacttagcaacctatagaaaaacaagctacagcaagcagaaatgaagttaacaaataaagcagggtgacagggccaaagctgtctcctgatttctgggtctgatggcaggccagaagcagccagaagttattctgtggggaatggagaccattaatacccttataaggtagaagattagagacaagcttatagcttgaaactacacaggtaaataagtgcaaggaagtagacacagtcttatacccagaaccttagctatcctgcctactgactggtaactagatccagaaatctacaaaacagaagaccccatgatcagtataatctggtcctataggaggatttgtgggctgttaggttgaggtaaccataaaacaaattagatcaagaaaagtaacagaaagaaaacaaaactctctcaaaacgttactgaaaatcaaaatcctaaaactcatgaggaaaactaaagctaagacagccaacaaaatcaggaataaggagaaaaaaaatcaccataggtaaaaagagaacaagaatgcaatctgaaaatgactttaaaataagtattttgttctggataaagatattatattaggttgctacagacattagctttctttttggttgtagtctggaacactgaagagcattcttgccacagcaataagaacctgcatgaagcataacttctgatgtgttactggacttagaagaggtggaagtaatttccttcaaagggacaaaaagaattaatgagggggaaaagccagagatgaaacctgaactgtgaatagtaattacatgtgaagggcatattgcccaaaggacacatagcccagtgggaagatactattacaaatgctgtcagatgtcatggaaaaagttgacttagtcccagttcagtattaccttggctcccagaagcagcaaatcaaaatgctctttggagaaacatcctcaacttaggtccccttattttctacaaatccaaattatttaaatatatgagttgacacttggtgttcatttaacatacaattaaagaagtaaagataaaagtaaacagacaataagtagtagatttagaccccatggacttgaggtaatggaattatcattcagagtataaaataacactatagtaaaagaaagaatcacaaaaatgagcaaacaagagactagtcaaaatggttaaagagatttgaaaaga

SEQ ID NO: 3134 - DNA, 1001 bp, Homo sapiens
aaaaaagagaaaggacgattttagattaaaggaatctgaacaacataacatgtaaagtcgggttctcaactggactcagcaacaacaaaaagctatattagacattcagagacagttgtggaaatttgaatatgtactatatatcaaatatttttattgacattatagtaaatctcttggacattcagaaagaaaacaacaattgatgaatctaaaagtgaagatatgtagttgtatattgtatgactctttaatttttctgtaggcttgaaattttgttagataaaaagttaatgtgagggaggtattaaataaaggagcagggaggaaaaagcggcagtggtgagacacctagatgagccttctcccttctgcatcagttcatcacccttcctacctacatcctcccccttcctacctacatcctcccccttcctacctacatcctcccccttggaagagctactttgctgcaaaggttgaaccaaaagattgtgaattcagggcaccagactaatttccagtagctgagaacagagagatacactgctttattggtgtatcagcaactctggctgaccgactttcacccttcagaccaaagatattgacttggctggatactctatagtaaacaccagttaacaagcacaaattaagaagcataccacaagaacttactaaaagaattttaatgcttaacctaaccatatcacttaaatttaactttcatatgaaggaagacctttttcattgaagattgtgcaaatattaacctacacagacacagtaacctctgttgacacattaaggcttttgaatcatgacattaaatttctatttcataatataccattttcaattttttaaatcagtgatcataaaataagtaaatattatgtagaaaaatacatttgactcaccctttgagtgatgtttaataaaattgttaaactaaacatgttagctttgtaaagatgcatcattataaaatttttttt

SEQ ID NO: 3135 - DNA, 1032 bp, Homo sapiens
gttgcagtgagccgagatcatccactgcattccatcctgggtgacagagtgagactgtctcaaacaaacaaaaaaaaagaaaatattacttgttttcttaacagtgtaatcatcatctgctttccacatataaaaatcaccttggttatctatagttcaatcttctaaagccttcaagcctctgaaattcttcaaaattcagaagaagtagaaggaagtttttgatgatgagtgaggtggaggtgagtgctttgcagaaactgttggaaatgtaccaaagtaaatgaacattaacgggaaatagccaaagaataaacctgatgtactgtgattcatcagttagcctcctggaaaattaggggtattcttataaattggcagcatagcctttttcttgcatggaagtagggaaatgtgaacgaattgcaaaaaaattagaatggccaagaaagatgaaacgccaagacagtaaggaagaaaacagtggagattggcttcagatgtaatttgaaggatgtacaaagtcaatgaataaccctttaaaaggggaaaaatatgatcctgtgatgaactggaggtatagggagtaaaagaccttagtaacacctaaagagtacaataggaggactctttggagaatcatgagccctgggccaggcttgcaatacagaaggggcagaatcgttgtatctttagaatttcattgtgcagtgtacaaagcaactgtgcctgcaatatggttaaaacaggtattaacattgggcatttactgaggacttactctgcgttgggtgctgttgtacatattcggcatgtattagtttgtattgtcctcgtaacattctcctgaagttgatgttattatcatacccatttttcagataaggaaactgaggtgcaaagatgtaaatcaacttgttcaaaatcttaactgctaataagtgccagattgaggattcaaagctaagtttctagcttcagaggagaaaatgctttatctcattacctttggggtattagtgtgtcaggcta

SEQ ID NO: 3136 - DNA, 1048 bp, Homo sapiens
aaagtgttaaatagtatcccttcagagaaaaaagttaaaacatcttaataaatattccctttaaagcactcttttacttgtttgttgaataaactttgaaatataattggtgcctcacacatctaatgttatctgtgaaaaattctgtatactttcagaaagtcttagtgttattttataatttgaatatgtgggggacatgggcttgtctttcctttgaaaagtgttgttttgtcttttaagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcaggtgagagacttggcttaaacagatgcagatttgggttttaaatttggaaggaaaaataaaaaagagactgtgcctgagtagattttagaattaacacataatagcaacacataccagcatctgaagagttaaagggtacttcatagttttataacagttctcattccctaggtatgccttagctgaacagtttgtaaattttctcctttctctattaaatgttatggtgaggaggtcctcctgctgtattttaagcaatctgaatttcttacaagtccctgtaacatcccacacttgacgttgctgttagattgtgtatgctgtgtagagctcctcaaatgtgtgaaaattctcattgagccactgcaagacaaaccaaagagaaggtattaggttatctttagctgacttcatcttccgtggtaacctgttgtttttgtatgcatttagcatgtatatacttagaggacttgctcggataatgctctaaaaattgcttcatgtatttaacctgtgtttcagtttccttatctgttaaatggggataagttgtacctaccttttcaggatattatgaaaattaa

SEQ ID NO: 3137 - DNA, 1054 bp, Homo sapiens
ttggagaaataaaagcatgagtcatccttgacttagaacccctatggaatgtgatatgatctgagtagtaatcccacagattaaggcaaggccaaggaatcctcatcatttttatttttctctcctcctttcaaatgtacaaaatactgatacagataaaatccatttagtccacagagaaatatatgccatgcttaaaaatataataataaatttgggccagtctttcaccctgttctttgtatccattggctattggaatatgtagtatacaattggccagttttgactgagaagattttaatccttcagctctaatcctaaactgctcatagtgtcatctataagatacatgagaaactgccataatacagcttttgtaggtattttgtacttttccagtagtaaaaattgctaatttttaaattttaaaaaatgttcagtttatctggcagataaccttattttctgcttttatagtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgaggccggaatccaccagggtttagagaacttggaagtttcaggaatacatattaagaattatgtatttaggtataaaatgagatcagaaagaacagcccaaagaatagagtggtgattgttaggtgaagcagtttcacctgaagagtaaagttactgagtaaaagtagagaatgcaggaacaaagcatgatttctttcactacttaaaagccagtaagcaataagactttattgagcatcttctatatactcagaattggtgagacgagaaaaggaagtggaaaatgtagttacttccctctcaaagtgtacagtttatctggtaaggtaaaacttttgacaagcaaaagaggaacatttgttaagcaaatggaagatagtatatcaattatgaaatgtgttctccattaactgttaaaatttagagaaaaagaagag

SEQ ID NO: 3138 - DNA, 1093 bp, Homo sapiens
tgagacagcattgaaaatcctgaacatgccaagccaaggccaggacttaccattccattttcatttctgtttgattaccataattactacactgctgacaacccttgatgattctctagaatttgatccttttggggataagcatgtccaccctcaatactaacaaatatgtcagcagtataggccctgttgcttgaagaaaattactacctgatgctgacaacattcatatctaagattgctgagtgacctgtatgtggatgggtctctttacactaatgccacattgttagtttactactgtgtaaaaataaaaagctaggtgctttctagtgaattcagcttatcaagcagccttcctaaaacattctcaccgactcccttgctccctgagaaaaagaaacccgtcccgaacaacccatttaaacacacacattttagtgctgatcatggactgttaagtgaaaattgcagttgtctaaatagatccttttcccactgtcacatacctttcattcttgctattatccatgatcatatttgcatgcatctgccttgtccactgttgtgtctctgaaaaatcatagtttgaagccctgactcttactataattacattaggaggtgggtggggggcagtaactaggtttagttgaggtcatgagggtggagcccacacaatgggattagtgcccttggaagaggaaacacctgagctgtttctctccctgtcatgtaaggatacagtgagaagtcagccatttacgagccaggaagagggtcctcaccaagaacttaatctgccagtacattgattttggacttcgcagctttcagtactatgagaaataaacttccattgtttaagccacccagtctatggtattttgttatagcagcccaagcagattaaggtatccactcttcatgttctgttccaactaaccaatctcagtgggtctcttgaccacccagtgtccagcagacaacaagtgctcacttacagccctgtcaaatttaccatcccctaaggacaaaaaaaaaaaaaaaagaaaatcaccatgaatcactattctcagaggatatgttctca

SEQ ID NO: 3139 - DNA, 1031 bp, Homo sapiens
caatagatgctagcaaggctgtggagaaacagaatgcttttacactgttggtgggaacgtaagttggttcaacagtatgacgattcctcaaggatctagaaccagaagtaccatttgacccaacaatcccattactaggtgtataatcaaaagaatataaatcattctactataaagacacatgcacacgtgtgtttattgcagcactatttacaatagcaaagacatgaaaccaacccaaatgcccatcaatgatagactggataaagaaaatgtggtacatatacaccatggaatactatgcagccataaaaagaaatgagatcatgtccttttcagggacgtggatgaagctggaagccatcatcctcagcaaaataacactggaacagaaaactaagcactgcatgttctcactcataagtggtagtttcacattgagaacacatggacacagagaggggaacaacacacaccagggctttttgggggatgggggttgaggggagggaacttaaaggacaggtcagtaggtatagcaaaccaccatggcacatgtatacctatgtaacaaacctgcacatcctgcacctgtatctcgtggtttttttttttttttaaggaaaaaaaaaagacattcaatgttattcattattagggaagtgataaactaagaaaagataaaccatagttctgtaaaattcacccccactagattgaaaaaaaaatcccattttaaatgtttttaaagacgaatataaccatttatgagggcaattgggcaataatgttgaagatgttcatgtactatgcaataacatcaaattgctaaatgtaccagatatttacaaacgtgaaacaacaagaactctcgcatactgattgcaacagccactttggaaattgtttagcattatatactaaagctgaagtttttctgccataactagcatttcaattcttaggtatatacacaaccaataaacatacatatctcatatgctaggaaatatatacaaaaatgttgtagc

SEQ ID NO: 3140 - DNA, 1030 bp, Homo sapiens
ctatattaaagtttcagttacaatttatgttcttatagtagtactgtctggtttaacaactgttccctgttggtatttttccaatctgatgatctttatttcctttcagttataccatgtgtctcatacctctgggtttatctgacctgtttgttttttttttttaatgtttatcaaataatctgtgatatcatcagtactgtatccttagctggatgcatttgacaagattggtgtgaaattttgcagaaaccctaacttttgatcctgatgcattcttgatactaccatttctaattggggcagatggtgaagcataaaggaataattctgagaatgattgatgtgtaaaggtgtttgagcttatcagcttaggccccagactgtgttatcgcctagaaactgtatttttatgtaatgaatgacattaaagtctagacttttttctctgaagcgttaaatgaattcaaaagggcagcattggggccttaagtgagaaatgattctcatctatgtgtgctttgtatgaagtttttattctctcttgaaatctaatggctagcccttcagtgcaactcagaaagaaaaaaaaaaaaatctggtggcagtatttgcccagcactaacagaatgatatatcagaaaaagtaaaggttgtcaacatgcagcaggtctgcttgaaggtagcagagcttagtatcaacccaaatatttaaccttgaaaaattatttccaagcatttaagatagtaattatgaatattttgatacacaaaatgcaacttttaacttactctgttatctctacttagtgtgctggcagtataacatggcaacatacattggttttaacataagggtatagtgggaatccagcaggaacagagcagacaaataaaaggaagccttttttttcagggagtaatttagtttgactctcattgatgatatataacgggcttattttagtatttctgacccagcataatgagtggaatcttttatgatctacagtaaggcttagtgatgata

SEQ ID NO: 3141 - DNA, 1047 bp, Homo sapiens
ttagagagatactggatggaagaaagaggtttatcacaatataatatttacaggacagatcagcaagcccaagttagtgactagcaaatccagagagttctgtattgctggaaatgatacccgacactggtattccccttttactggcattggaagagcatctggcagagggaatcagacagtgccatgctagtgggtgcagtttgattttaaaaattattgcattcgttttaattgaaagggatatagagatattaccacattcctcgagatggcgttagtcatctttcataagacttgatctctgttgacagaaatcactctgtggaactgaattctgaaacaatgtattgagtacctgcagtatgggaagttccctgtggtaaatatgtatgataaacaagtaaataaggaatatatatgataaacatatggtaaacaaatataaaccctggaggatttttttatcttcagataccatcaaatgcattaaacctctgtcataatgctatataaactgtgactgactttgagatatatggagagatttggtatggatctgtaaggaaagatggttcctttgacagaaagtttgggctgggtgcggtggctcacgcctgtaatcccagcacttagggaggccgaggcgggcggatcacctgaggttgggagttcgagactagcctgaccaacatggagaaaccccgtctcgactaaaaatacaaaataagctgggcgtggtggcacatgcctgtaatttcagctacttgggaagctgaggcaggagaatcgcttgaacccggaaggcagaggttgcagtgagccaagattgtaccattgcactccagcctgggcaacaagagcgaaactccatctcaaaaaaagaaagaaagaaagtttggagtaggtgaaaagttttccttagtctgccaaatctagactaagttttgcaggaggtggggtttgagtgtaaaataccagacctcaaaggtaatctagatcaatatttttcaaactgttggatttaatacatttaatagattgtga

SEQ ID NO: 3142 - DNA, 1022 bp, Homo sapiens
gttccattattagaacattctactttgtttatgcacaactctgtggcaatgcaccggggctgttccctgagcattagtgaagtgtctatagttggaaagtcttcgcagtctcagttttgtgtcacttcaatctaagagacccagactctggacacattaatttcaaaccttggaactagggagtttatgttgtattccaaaagcatgtggagctacaagggagacttttttgtaattcagagtctcttacttagccgttatgtggccacaagatcttcagctaatctgcacaattcaggcgcttcaggccaacccagaaaattatctccacaaatgtagaaaataaaacagctttattaattttttaaaaattttatcttgagaccaagtctcactctttcacccaggctaaagtgcagtggtgtgatcacagctcactgcagcctcaatgtcccaggcttgggcaatcttcttgcctcagcctcctgagtagcttggaccacaggtgcatgacactatacctggctaattttttaattattctgtagagatggggtctccctgtgttgcccaggctggtcttgaactcctaggctcaagcagtgctccaatcttgacctcatggtggcatgagccaccatacctggccttatttttttagagacagagcctcactctgtcatccaggctggagtgcagtatattttatttttattttatttttttaagtgacagagtctagctatctatatttatatttatataaggggtagaggaagtgtttgcaattaaccacaggtgttctttagctaaagatctaagaaaagggagagagaaaggaaataaaaggaaaataaagatctctttattataccaaggaaatagaaaaaatgttaaactcttacaacttacttggatgactacctgattaataaataagttagtaaagagaagcaatattaagtttatctaaaaattgctgtcagatttatattgttgcatagctaatagtaggatactct

SEQ ID NO: 3143 - DNA, 1060 bp, Homo sapiens
attgatattgtttcttcctcaagtatttgcaaagaatccaaacagtctctaacagataaaaaagacaaggaaatagattcttccacagagcctccagaggagtcacagacctgatgatatcttcttgctttttggcccagtgacaccatgaaaacaatatgacccatgatgaggagaaaacaaatcgattgaaactcacaactgacatgcttagaattagcagacaaaatcattagagggttattagatacggttgctataactgtatttcacatattcaaaaagtagagataaggaatcgacataactggaaaacacagaattggtagaaccagtaaacagaaaactagtaaggacctaggagctggaatagcatagtcagccaacttgatttaattgactaaacattcaaacagtagatacacattcttttcaaatacaaattgaagatttaccaagatagaccatattgtggttccagaaacgaggcttaataactttaaaaggattcaagttggaaatcagtgagaaaaatatctctggaaaatcccccatatgtttagaaactaacacacttttaaataacgcagaggtcaaagaagaaatcagaaattataaaatattttgaaccgaatgaaaatgaaaacccacccattttctattttctattgctgttgtaatcaccacaaacataatggcttaaacaatacacattaattatcttacagttttggatgtcagaagtccaaaatgggtttcatttgggccaaaaatcaaggtgtcatcaggtctgtgactcctctggaggctctgtggaagagtctattcctttgtcttttttatctgttagagactgcttacattctttggctgtgtccccttcctccatcttcaaagccagcaacacagcatcttcaaatctctctgtgtttctcctacctccctcttttgcttgtaatgagcctttcgattacattggatccactgggttaatctaggataatagtctcctcatcacaagatcctttattatcacatttgtaaagtcagttttgccagg

SEQ ID NO: 3144 - DNA, 1037 bp, Homo sapiens
caaactggaaactgtcatggaaaaccaagaaatatgaatgacttaaccatgagtttttatgatgtgccaaaagagatgtgataaatccatgcttcactatgtttggtacaaaatccagaattaaattggttaatagattgatttcatttgttctggcaatgctaatttatatctaccatgtgacaggcccttttctgacctctagcaccacagagatgaatgaggcaaagtctttttccactgagaacttgataattttgtagagagacagataaatatatatatatatatatatatatagggatgggtaaggtgaagagaggagggaggaagtgatggtccctgttagagtgtattttttattattcatagtagctcccacatattaaggttaaagcaaatttctctgtgctttgcagtctggtaatgtagactcactgatggtcagatggaaagtagattttttttttccatctagagttatatattcgaggcagtgagctgtagcattttatttggagatgaaaagtgttgagtaggtgtaagggtaactgtattatagtctctttcctaattaaattacatatttgtgctgtagtgattgacttttttgcatctgtactagatttaccttgaattaaattgcagtcttttttgatgatggtagaagtggttcaaaagtgtcttattaaaatgcaaaagtgcctaaaacacagagcagtaaaaacagaggcctagaagatatgccagtggtctcattggagtcatctttgttctcagtgtcgacaattgcttaatggactgtcctccactgaactttttggagcaaacctacttagtgtcactttgccattttatttttttaatgacatactgtgctgttggggcaacaaactgcacatcctgtcatgctacaaaagcaaaagacaactttaaccaagataaaaatgaagctggaattcaggcaagaaagtgaaggataaggcagacttgagaggtggggtattgagtggggaagcgttttgaagttagatctg

SEQ ID NO: 3145 - DNA, 1060 bp, Homo sapiens
ccatcttaaaaaaaaaaagaaagcatcagttgttttcggattgaagaacaagctctgtaaaattagaatttggtgtgtatatatcttcagtgtactctgaaaagcctcagttattggccacacttttaatatcaccgtcactttagtaattaaatgcataaaactagatattaattggatgatatattaaagtcttgggaatttttattgtttattctctgtatctggtgggaggaaaaaggagtgttttgaacttgtgggaaagcattccccattaatcatccaggagtttgttttctacaattttaggaatgtatatgatgtatagtatgtaacattaactttcccactttttaaaagaattgtgacttttttattttattatttttacctgtatcagatataaaaccattatttaaattttcttaggcagagggagatttctaatttttctatttattttgtttttttggctcttgcttatagtacatttttaatgtatattttgtaagtttgttttatgaacttatccagataaattttcctggatgtagattgatggcaagttattctaaagcagatttgtgtttactttatctgctgcatgtcttggggaaagcatttgctggaactaaatctgggtttaatgtttgttagaactaaatctgggtttaatgtcctaaagctacagttctatcccaaagcctaaggacagccataccgtatggcttggatactaattttcagggtaacagcaatcttctctccatccagttgaaacaacgtcctttctcatcatcactgtgttggttcagtggtttattccctctctctcttttttaagctatcttttcactgagcatgtcacccatttgggagtctcagagctttatgtgagcatctcagttccaggttcccactttgcagggatccaagatctctcttttcttatgggtgttaaaaatacaaattcattggttatagagactggcacacccttctacacccccaggaatgtaaggatggcatcagccactgacctgtagtttaccttatattc

SEQ ID NO: 3146 - DNA, 1067 bp, Homo sapiens
tcttccatagcctgccgatagctaaaatattactgttttcagagttttttttttttaaccaaatttatgtaatgttagaaagggctcactatttttttcagagaaaatggttttttttctttacactgaggatttttttttcttttttcttctattttgagacagggtttcgttctatcacccaggatggagtgcagtgacacgatcatggctcactgcagcctccacctcccaggctcaagcagtcctctcacttcagcctcctgagtagctggagctacaggcatgaaccaccatgaccagctaatttttgtatttctagaggcgaggttttgccatgttgtgtaggctggtctcaaactcctgagctcaagcgacctgcctgctacggcctgccaaggtgctgggattacgggagctacctcagccagccaaggagtttttaaaaatttccttcttcactgtagattccttttgaaattagcatataaaaactgacttttctcaaagattgttatattactcccagaaacaacagtctctacattttgcagattgtttttttctttctcaatagaaatgtctttactgagagtttgtactcagttacacaatctcatgttaactctaaagtctccctcctgcttgattgacttaagtacttctgtttccataagcctcccctttcctccaaaaagttggaagaatgtgggatttgaaatcattctcagacttgagcacttgctacttatatgactttgggcctgtgactgatctctaaaaccctcagtttcctcatatgtaaaataggcaaataatttctaccccaacaatcgtggttgtgagaattaaaagggacaatgtatgtatggtatttgacccagttcctggcacataataagtgcttaacaaatgttagctgccattattaagcttccggtttctcagagtttttgacatgaagagctagaatatttacatgaaggccaaggttccagacaaatctaccattttacatttgtttggcaccttatgaagacatagggaatacttcacattggtttgta

SEQ ID NO: 3147 - DNA, 2042 bp, Homo sapiens
tatgattatgggatgcatttccatttgtttgtgtcatctgtgatttctttcagcagcgttttgtatttctccttgtagagattttcacctccttagttaagtatattcctaggtatttcattttatttttgcagctgtggtaaaaggtattgaattcttgatttaattctcagcttggtcgttgttggtgtatagcagtgctactgatttgtgtacatttattttgtaacctgaggctttactgaactcatttatcaaatctaggagtcttttggaggagtctctagggttttctaggtatacagttatatcatctgcaaacagtgatagtttgacttcctcttttccaatttggatgccctttatttctttctcttacctaattgctctagctaggacttccaaaactatgttgaatagaggtggtgaaatgtaggcatccttgtcttgttcctgttgtcagggagaatgctttcaactttttcccattcagtatgatattggctgtggttttgtcatatatggattttactattttgaggtaagtcccttttttgcctacttggttgaggattttatcataaagggatgctggattttgttgaatgctttttcagcgtctattgagatggtcatatggtttttgtttataattctttttatgtgatgtatcacatttattgacttacatatgttaaaccatctctgcatccttgaaataaaacccacttgatcatgataaattatctttttgatgtgctgttgcatttggttagctagtattttgttgacagtttttatatctgtgttcatcatggaaattggtctgtagttttctttttttgtgtgttctttcctggtttaggtatcagggtgatactggcttcatagaatgatttagggaggattctctctttcccagtcacttggaatagtttcagtaggattggtaccagttcttctttgaatgtctggtagaatttagccatgaatccatctggtccaggctttttttgtgtgttggaaattttaaaattactgattcaatcttgctgcttgtcattggtctgttcagggtttgtctttcctctgatttaatgtaggagggtggtatgttccaggaatttatccatttcctttaggttttatagtttgtatgcataaagttgttcatagtagtctcgagtgatgttttttatttctctggtgtttgttgtaatgtctccagtttcatttctaattgagcttatttggatcttctctcttttcttggttattctagtgaatagtctatctattttttcaaagaaccaatgttttgtttcattgatcttttgtaatgctttttttgtttgtttgtttgaatttcatttagttttgctgcaatttctgttatttctttttttttttttttgagacagagtcttgtttagtttgtgcttgtgcttgtttttctaattccttgaggtatgacattaggttgtcagtttgcactctttcagactttttgatgtagacatttagtgctgtaaactttgctcttggcacttcttttgctgtactccagaggttttgataacttgtatcattattatcatttgattcagataatttttccatcttgatttcattattaacccagataccatgtagaaacagattatttaatttccatgtatctgtgtagttttgagggttccttttgcccccaagaactttaaaaatcattttcttaagccctcttaagtctgccttcaagcttttattttgagtgtccgggtttcctctcatcatttctgaccttggcaacctttcattgctttcaaggatgttctctattgcagatgtgtattgtcttgtcaggtcagtgtttaaagaaaaaacaatatttcatcaatctgaatgctgttagcccaagcatacaccctctagtttgttaagttgttctgttattatttactcccttttgcatcacatattaaggtttctgaagggatttgagtttgtgaccccttcgttataaactatttcagggctaggcg

SEQ ID NO: 3148 - DNA, 2444 bp, Homo sapiens
ttttttggttcagctatatgttaatattaggaatatcattagaaacactgtttttacttcaaagttactgaggaaattagtttcatactgttcagaaacctcattgaataagatgtaacctcagttattctggacaggctggttaaaagttttatcagaacagctggaaaatagtggtaagaaaatatttcacatacagactgttaaaatttttggaaaacattgcccgtatctatttttcttactctgcataagttaatggattcattttctttctcctctccttaccaccccgtaacaccctatttcttcaggcaacataggagtattttgacattatttgatgatagtgttaccataatagatgatcacctgtgttcatttgatacgccctttatcttggctgggctgccctctacagttgatttcaaaggatctttcagtattaagatttttatcctctgcctgtgttatttagcaatgcccagtaagttgaacagataatgactcttctctacttgaggcttgtatcattcttgtggctcctgatattaactacattataaaaatacttaagtttgttcctgaagtgttgtttacagatcacatgcattgatgcatgatagattctgtttgctttgtaattacgagaaatgcagtccagtaatgggaggtttactgctttattgttccttttagcagccaacaaaaaaatgttgtcaccaaaactgtgtcagtggagataactagaagatggttcctgtagttgtattgcatcccaggttcctatgttaccaactttgcctcctgtgctttcttttcatctccatcacctactctctgtggcctgcccctttggtttcccccatttattccgttctcctgctatacctttctggctgttgtttttctgtgacttaatttctttagggctatctttgccatggggtaggaaggctgaatggggatgagccttggacactagatcccagttcttccttttgagcacaagatcaagttacttataccatctgtgggtggtttgatgcctaagagtaggacaaaataagaccagagtgggcccaaaggtcgaagcttggctttatttggactgatagcaacgaatattttgctgctttatttattttggtgcaagaccacattttaagattgttattatagttctccattttagagctataagtgccctcttatatacctgattagttaaaaagagcaagcaagtctctgtcattaagagtctgatatatattgaaaagtttatttcttaggacttttacaaaaataacaaatgacacagatggcaagtagatcacagagatgctagacaatgccagatcatgaaatgggtgatcatgagatccaagagtaagaaccagtagtcacaactgtacttgtgccaccaagcagacatttccttgcacactactataacttgtggctattaataatcatagaggatttttgccactggatttcagttaaatgtaacttgattctttgattctatgtgtggttaaattctcaagtgaagaactgtcattctgattttctagtcttctttcttctcctattattactaaatagaaagatatttttgttgagctgcatgctatttcctgtcccttccaactgatctgtaagcttttccattggctttctttctgtttcctgctgctttcttgcttcatatttgaagggaggattcagacctatccaggtaacaaactactggttctgcatggcctctttataactcagtctgcttattattacattgagattgattgctaatgaatggatacattcacattggaaatttactattggtatattgtttcaaggcttttaatcttgcagtgaaaattataactacaggtactggttgccattttgagaaatttgaactctgctgattccagaccattcttaggcctgtctagattgtccacttttattgcaaactattctagaaggctcagtttagtatgggattgtgccaccttttggagaggaaaaaaactgcttagttcagcatgtgacaaccctacagatggtttaatttagcttgaccctgatggactgggtaaatattttatgatcaaagagattccttgttcttctaagtattttataaattacttgaacagcagtcttttaggaggctacttttaatttttaatgatttgataatgaaccacttactctttatcagagtcagttcttttatataatagagaaatatcaatattagctaccccttttgttatactttattatacatatatgtatgtatatatacagtatgtgtgtatacatatatgtatgtatatatacagtatgtgtgtatacatatatgtatgtgtatatacagtatgtgcgtatacatgtatgtatacatacagtatgtgcgtatacatgta

SEQ ID NO: 3149 - DNA, 1033 bp, Homo sapiens
aaaagtatcctatcttgttggatctgcccaaaatactgcctcaaatgagagttttcaccttcctctgccatccttctggtgtattaataataaatccttgaaagatgaaagaagtaaaacagattgaaatgaagtttaggaggtgaattttatgttgtacatggctctcttttctgtgcctagctctttgcagcatttttatcagttacttggataagtgacatttatgtcaagttttctttttttttttttttttttttttttttggagacagagctctgtcgcccaggctggagtgcagtggcatgatcttggctcactgcaagctctgcctcccgggttcacgccattctcctgcttcagcctcccaagtagctgggactacaggcgcatgccaccacgcccagctaattttttttgtatttttttagtggagacggggtttcaccttgttagccaggatgggtcaggttttctaatgatcctgtagtttgacactgtcatgcagtcggtacaatctgaaatgatggcttgtttagccagataaattttcatagttacaaactacaaaatcctctatatgagcttcaaaacacaattgtaagagtacacactgaagtgaagaacacagcttatttagccaggttatgtataaagaggatttaaatgctttaaatgagtgtcagtaccaatcagtagtaaaatatcaaaactgctcctgtgattcttggtttcattaatggaattggagctggcaggaataagagaggtatattgccttttcactcagcaacaaatatttttttagtgagtgccaggtacattctgggcagaccccacctcgatacctttgtgttggaacaagattgaaagaaaagatcaagctcatttgggaattaaaaatcttggttggagggacaggatgctagggagagggttatgattgacttgaaacaaaaaatagtggtgtgaaaattggcagtaatggcagcgttcacataacttagtggtctgttgctgatggagaaggatt

SEQ ID NO: 3150 - DNA, 1031 bp, Homo sapiens
ccatgctgcaaacagatgtgctatcattctggctttgttattttatttatagggcatagtctgagtagatttagcataattcttaagggccctaggattttccagatagtaaataagtattggcttcaaattaaagtcaccagctacattagcccctaacagtagagtcagcctgttgaagctttgaagctttgatgccaggcattgacttctcactagctgtgaaagtcctagctaaagagaagtcaatgcatgacatcttgtttcaatagatggctgtttcatctacactgaaaatcatgtgtttagtgtaggcacttttatcagttttcttggctggatcttctggataacttgaagcagtttctccataagtacttgctgcttcaccttgcactttcatgttatggagacagctgctttcactaaacctcatgagctaaactttgctagcttcaacttttcttctgtagctttcttacctctcagccttcacagaattgaaatgagagttaggactttgctttggattacattttggcttaagggaatgttgtggctggtttgatcttctatccaaactgctctttctccatatcagcaataaggctgttttgctttatcatttgtgtgttcactggagtagcactttaaatttcctccaagaacttattctttgcatttacaacttggcttttgaagtagctttcagcctatctcagcttttaacatgccttcctcactaagtttagtcatttatagtttttatttaaagtgagagatgtgacacaagaccatatagaggccactgttcagttattaatttccatataatggcctaacttcaatattattgtgtctgctgaataggaaggtctaaggagaggagaaaaatgggagaggcggggggacaacagacagtaggtggagcagttagaacacacaactttcttaagtttgctgtcttctatgggtgcagttcatggcgctcccagttacaatgataacataaaaggtcagtgatcacacat

SEQ ID NO: 3151 - DNA, 1050 bp, Homo sapiens
gaatttttagtacaagtagttaagtatggcttgtggctcctgtattgaacaactcagctctagggcttccatatcccgattcttagtgaaacctaaattatataatattgaccacatgccgggaaatatagaaaaaatttagaatggaataatctccattataaattaccatggattaacagattatcaaattgacacctgagtgatgtcccattatgtggactctttaaagcttgtccctttctaacttgccagcaaatcatagcactgttcttcaagagtacttcagacttttaaaagatattcaccaaggaaatttctaattgcagatgttagtttttcatcttctagtaggctgacctatatactgaagcatattttgtattgctttgcaagttaataaatataggcatgcctcggagatattgcagacttggtttcagaccacgacaatcaagcaaataactgcaataaagcaagtcgtgaattttttggtttcccagtgtatatatgttatgtttccactgtgctgtagtctactaactgaacagtagaattatgtgtaagaaaatgatgtacatatagtaattaaatactttctcttttttttgagatggagtcttgctctgtcgcccaggctggagtacagtggcgcgatctcagctcaccgcagcctctgcctcccgggttcaagcaattctgcctcagcctcccgagtagctgagattacaggcatgtgccactacactggctaatttttgtatttctggtagagacggggtttcaccatgttggccaggctggtcttgaactcctgacctcgtgatccgcccacctcagcctcctaaagtgctgggattacaggtgtgtgccaccgcacccggctggtaattaaatactttctggctaaaaaatgctaatgattttctcagtcttcagtgagttgtaatctttttgctggtgaagtgtcttcaatgtagatgggtgctgactgatcagggtagtggttgctgaggattgagatggctgtggcaatttcttgaaataaga

SEQ ID NO: 3152 - DNA, 1032 bp, Homo sapiens
cgtaggtgacagagcgagaccctgtctccaaggaaaaaagaagaaaaatgaataaacacacttatatatgcataaagagaagtttataaagagaaattttaaagcaaaattaagaacttgtataaattaataggaatagcctattttaaaacttattggtatagctatgtagtcttattcagattttaagattttaagtctttaccagctctaagatgatagagatagatttgcatctagcccctttacaatttcaaattttacattccaacattgtaatcaatctggaatttcttttggtataatgagttgaggatggttaaccacctttcttctaaatgattatttagttttctcaacacaatttattaattttggtatttttctattaatttgaaatgtttctaatacattctgcatatatgtgggattatttcagcattctctgtattactcattccatgtcattaaatgttcttctgtatcttttttaatgactgcaaaggattatacactgtggctgagtaagtgcttcttacatctatatctctttattgatttaataataaatttcttaaagattaagtagccagggcgcagtggctcacgcctataatcccagcactttgggaggctgagcccggtggatcacctgaggtcaggagtttgagaccagcctgaccaacatgatgaaaccccatctgtactaaaaatataaaaaaattagccgggcgtggtggcatgcatctgtaatcccagctactcgggaggctgaggcaggagaattgcttggacccaggagggggaggttgcagtgagccaagattatgccattgcactccagtctgggtgacagagtgagactccgtctcaaagaagaaaaaaaaaaagattaaaataagtgaaacagtcatctatcttaggccttatttacgcacatagcccacagcacagtgttttctttgtgctagatttctgctaatgctgttgatttaatttttattatcaaaaattatttagaactctataaaa

SEQ ID NO: 3153 - DNA, 2084 bp, Homo sapiens
tttttacaaaggtactttggtcggtatgttgttcacttggtgttttcattgggtgatgtggacctggatcatcgtagtctgttatcttggtgatgtcctgtgtttttgaagcagatacacatgtttttgaagcaaaaagtgtcctgctttatgaagcagatatgcatcaatagaatttttgctacttctcttatttcaagcattttattgcagtgggatttgaaatgtgcactaattatacagacttggggaaaaaatttctcatgaggttgcaggtgcctctaagcaatgtgaatggaaaaccattttagggtcacaataaaataatgtgccatacctgtggaaatatggaatagtaaacgactgtcccgaaacccttaggaatgagaatgttggatttttttttaagacaaaaacttaaggatggataatgtaaatgtttaataattaaatagcaagaggtaaaggaggaaaacttttagttctaatatcaatataggccagtgttctcaaacttttatacttcaggatccctttatactcttaaatagaactctttgggcttctcaatcctatgtgcattgtatctactaataaaaatgtctgccacatacccatgtgtataagcatagtttatccttctttcaagtaaaatggcattgcaagaaaaagtggctagttcagtttataactctaatggtgttacaagtgcttttccttagtactactaatttacctctgaactgttttatgtcttctcacttgatcaatacagtatactaaaaagacatgctaaattttgttagtttactgttttatttatataacattctttaaatgaccaaattatagagatggaggataaatttgtggttgtcaagggagaggagtgaggcaagaaggaagatatttgtggctattaatagggtaggtagggtagggtaataccacagatccttgtcaaggaatattttgtattttgactgtaatggtggttatatgaatttatacatgtgataaaattgcatagaactaaatatacacacagatgtgcatgcatctgtagtgaaactcaggaaatctgaataaggttgatggattgtatcgatgtggtttttctggctgttgtactgtactgtagttagatattaccattagggaaactagatgaagagtatatgggagctctgttttatttctcaaattccgtgtaaatctataattatttcaacttaaaaagtgatacattctgttacagaagtgacattcttttgtcaattacctgtagaataagaaaaattgaaaagttaaataaagaagtgacattcttaagaactggcttttttttttctttcctttttttttttttaaaaaaaagtttaatttgtcgtgaaggcttagggatgaagaatacaatgactatcattgccttggttttcactaagtatatgtaagatttacttagtgaaatctcagatttcctgagtatatatttaagatttactagtagctacatccaccttgcttttctatcattgttgaaaatatcagcacaggcctgtgacatcttagtatttattttacgaaaatatttcacctcccacacctgctttaatagcattacagagatgcccaggactctgtggaccacactgtgataatcagtagcttaaagcttcagtctttattagctgaggaaaacaagtgctatgcttaagactgtgtaggaaattcagtgataggtctctgtcactgtctccagcgttttatattgtggtcttgtttgttggatattattgtacttctatgaaagtagagttgcagaagtttagagtgatataaaatatagaactcataaaagcaaaacatgggaattaacagtttgctatacctgtgttgtgcagtatgttagccatgggctatgtatgtggctatttacattctaaggattaaaatgtatataaatacaatttaaatggaaatcagtggttatagagtttgttttttgcaagaagaaaaagttctagacatctgttgtactatgtgcatatagttaacagtactgtatacttagtggttaagat

SEQ ID NO: 3154 - DNA, 1039 bp, Homo sapiens
ttttcttccccccctccttttttttttaaactatttctatctctttgttaatattctctatttatgtatcttttttctgatttcatttaggtctctcctcccccccaccacctttctttagcttattgagtgtatttaggacagtttaaaagtctttgtctagaggctgggcatggtggctcacgcctataatcccagcactttgggaggccaaggcaggcagatcacttgagatcaggagttcaagaccagcctggccaacatggcaaaaaccccgtctctactaaaaatactaaaactagccgggtgtggtagtgcatgcctcttatcccagctactagggaggctgggcaggagaattgcttgaacccaggggacagaggttgcagtgagccaagattgtgccactgcactccagccagggtgacagcataggactccataccaaaaaaaaaaaaaaaaaggtgtttgtctggagctgaaagccattatcctaactgaactaacacaggaactgaaaacgaaatactgcatcttgtcacttacaagtgggagctaaacactgagtacacatggatgcaaagaaaggaacaacagaccttggggcctacttgacgatggatggtgggaggagggtgagaatcaaaaaattgcctaccagatactgtgcttattacccaagtgacaaaatatctgtacacacgcaacccctgtgacacacaatttacctgtttaacaaagctgcacatgcactcctgaacctaaaataagagttaaaaagaaataaaaaccaaataccccaggaacttgtctttaacttttgaactgggccagacaaccacaatcacaacatccttgaaaacagctgaattatgccagcgcctccaccggtgataattctttcagaacaacaacaacttgttttgttttgagatggagtctcgctttgtcacccaggctggagtgcagtggcatgatctcggctcactgcagcctccacctcccaggttcaagcaattctcttgcctcagctcccaag

SEQ ID NO: 3155 - DNA, 1071 bp, Homo sapiens
ggctgtggtgagctatggttatgccactgcactccagcctgggtaacagagtgagaccttgtctcaaggaaaaaaaaatatgtaattgtcaacactgtgtatcttcatacctcttttcatcttgcaaaactgaaactttttgtccattaaatacagatctagtgtcccttatccagaatgcttgggaccagaagagttttggatttcagatttttctgaattttggagaattacattatttacaggttcagcattcctagtctgaaaatctcaagtgctccaatgagctttttaaatttttttgtttcatgccaactctcacaaatttacagattttggagcatttggattaaggacactaaacttctttttttttttttttttttttttttttgagacggagtcttgctctgtcatccaggctggagtgcagtggcacgatcttggctcactgcaagctccacctcctgggttcacgccattctcctgcctcagcctcccgagtagctggaactacaggtgcccgccaccacgcccagctaattttttgcatttttagtagagacggagttttgccatgttggccaggatggtctcgatctcttgacctcgtgatccacccacctcggcctcccaaagtgctgggattacaggcgtgagccactgcgcccggccaaggacactaaacttctaactccccattatctcctctccccatcccttgccaaccacaattttattttctttctctgtgatttgccatggtgtcggtacctcatagaagtggaatcaaacagtatttgttttcttgtgactggcttatttcatttagaataatgtcctcaaagctcatccatgttgtaatgtgtgagaactcgcttctttttaaaggatgaataatatttttttgtatgtatgtgccacattttgcttgtccattcatctgtcagtgaacacttgggctgctcctacctttttagctattgtgaataatgctgatatgaacatgggtgtggaaatatttattgttttgtttcgttttgttttgttttttaaatgagagtctcgctc

SEQ ID NO: 3156 - DNA, 1086 bp, Homo sapiens
tttttacggtattgattttatatgccaatttattttggtgatagaaccaaattataccctgccaggtactatgtaattgactcttctgattcacccagaataagagtgggtgttttttgcttccatacaatcagatacgcctagatttaaagttatactatagtgttttcaaactgttaaaagcagccaaactgcttccccccatatgacgagcagtgcctgatccatagtaagcccctaaatagttgaatgaaaactagctgtaaatgaaattttccagaagtgtcactttttggctgtttgcagtgtggatgctttatttggcgcaatagcttttttttttttttttcctttttctgactggtactgttaattttgtacagttcagtaaaagtttaccagtacaagcttaacttaaaaagagccaaatactctaagccacccttagagaccttattctgtgagggtctgggaatcttaatattccagctgttctgtcattgtgaatcaaataattaagacttaattgctaagctggaaaagtcttttttaggatgccatgacagagatttaggtcttttaaaccagttcagtactatactgaatagagaatttcttactttttctgagtaggtgatctcattgtttagtatgaatatttctagaatgtaactcataaataagcttttattttattatttttttagaggtggagtctcactctgtctctaggttggagtgcagtggcacgatcttggctcattgcaacctctacctcctgggctcaaaccatcctcccacctcagcctctcaagtagctaagactataggtgcatgccaccacacctggctaatttttgtatttttttgtagagacggggttttgccatgttgcccaggctggccttgacctcctgagctcaagcaatccacctgcctcagcctcccaaagtgttgggattacaggtgtgagccactgcgcccagcccacaaataagcatttatatagagacatggtatggtggctaggtataaagaaataccatctctgtgtaactgattttaaatattaaggtgtttaaagaa

SEQ ID NO: 3157 - DNA, 1435 bp, Homo sapiens
tggacacatgagagtcctacacatatgaaacacgaagaagggagagaaggttgagggcttgagtaccctcttcatagggaagagggaagcagggtggggaatgggctatcgggagttttagaggggaagtaaatggtttttaggtgaaatgaatgagtccaaattacaatagtcttagacaaagttcctctgagctcctgggaggtggcgggaaggtgaggaatgagacttcagtgtgaacaaaggttgtcttattatgaaggttaaatctcctaagagttacccccaaaagtaaaatgaaaagtctgtcttgatgtggtgatggctttagtctcttctgttttccatgattaatcttttgtgattatttgatgagcttccatgggagggtggtcttaagacaattgtgtttcttttggaaagacattttcttagtcatatctctgtgccccaccaagttcatggatggtaatggaaagaagagcgttcaaaatagaggggaagggattataggcttgaagtcaaaccataggttctagggctggctttgttactttctggttatatgatattggataaattatttaatatctctggaacttcgtttcttcatctgtcatatagggggaaattagaattctactgccctgtaagagcgttgttatgatggttgtgtaaattcctgcctcagaacaggatttcctaaatttagtaagtgcatttattatttgtattcctgccagacttggttctcctcaagatttatatatatgtatgtgtgtgtgtgcatgtatccttgcctgctaattcttttatttggctacctgtcgagatttagtgtgaaacttagaagctatctccaagagtttgaaatgtcttccatgtcttttctgatgttcggataaaagtaggatattaggcttggttattttctgttggcggtaatttgttttattcttctatacaaaacagattcagtcaactgaggataagatcaaagaaactattttttagctacatgtcctttttgatgtgacagtctccccttcttctgtgaattaaatctttttgtccaaagtaactacctatgtctgtgactcaatgtttgaccctcaatctactaaggtctaagtgaaagaagctaagctgaagaaaagtgaacttcataactttgaaacgtgaaagagggaaaatgaagaatattgtttccaatgtcctctgcaatctcattacctgcttctttgttaagacaggattttacacatccacaggtgcttcaccacacctgtgtatgtgccaagttttaaggcgtaatgtgcatttcccttttttacatgagctgtagttctttctagcttcgtcctctctggagattttgtttaattagtcaaagactttagactatgacatttcagacaatggtaaattggtgaga

SEQ ID NO: 3158 - DNA, 1048 bp, Homo sapiens
ttcatataagtacataaaacttaaaggtagagtttaacaaataattttaaagcaaaaaaaaaattttaaaccagctttaaaaaaatcacatgccctttctgtcataatttcctctctccccagaaataatactatctgccttttaaaagtcattttcctgcttctctttatagtgttgctaaacatgtgtacatctattgactaatacggtcaagttttgccggttttggatatttggataaatggaatcatactttatatattcttcttaatcttttactcagtaccatttgtgagggtcatctaaattgtgttatggtagttttttattctgtttctgtataggaaaattttcagtgtatgaaaatttcattattgatcaattctgttaatgaacagttgggttgtttccaatttttggttattaaaacaatacaactatgaacatttttgttcatgtaccctggtgcacgttttcattgttttcaaccagaggtatacctaggagtggaatggctgggtcatagggcatgactgtttccaagcttaccagctactgccaaattgcttcccaaagtggttgtaccagtttacatttctaccagcaagagaatgagaattttggaagccccacattgttaccaatgcaaaaatataatatctgtaagaagcaaaaatgtttctcgggcatattttcttttaaatgcaataagcagtacacacaaacatatattgcactacaagaaatggttgatgtattttgcttaggattaatattatagaaaagacaacagtctgtttagctttggaggtagttaagtagttgctgttttcagctgttctacacctctgctccctcccagccttcataattgagaaggtagcaatatctttcaaataatgggaaaacgtacttgttttctttgtatgagaacttgttgctactccctttaaagaagatggatttcaacagtatgacctgaaattgaacagtttaccaagagagaagaacccttagctagataatagaggattcagtaatcattaa

SEQ ID NO: 3159 - DNA, 1025 bp, Homo sapiens
caaagtccatagtagaacatacatggtatgtgtttgcttgagtttttaagtattacttgaatcatataaaattatttttcttttttaaggttaaaatatacttgaatatctgtaaatctggaatttcatgtaattcaacctattaagtataggtaagagtagagcaaggaggaatgccattttctttttctttctctttttttcttggtggttggggattggcaatgatattaacagaattcaaatggtgtcatgtataagtaaaacttccttcctcatatccactgtagtgctccttttagttgagcagaccagcttttatttagttctcaatatctgtagatttggggaaataaatgacctgaaggaagaactaggatgatacaaaatattaatgaagggaaaaatacttgacttatctattctgctgcttgaggagcataaagtatagaaattacccacataagaaaagctttgggatctttcaaaactacccagaattgaactttgttatttctgtgtatgagttgcagctgctgaaatgttttgagatgacctcactaaataaactttatcttgggatttagaaaataagggatgtcacacatataaaccatgtgccttttacctttataggaatcatttgttgctgaaaaattaatttacttgataggaatcctggagtttcctgttattcttttagtaactgattaattactatactttttaaagcagtatgttttcattcatattatataaaatatatagaataaaaacagtggtttgtgtgtgtgttatatttaacaatatatctattcagtcaatgcctgtttgtgtagaatccagtcacaagtctatatctgagtatttatagaaagtttggccaggtgtggtggctcatacctataatcctggcactttgggaagcggaggtaggaggatcacttgagtttcagagtttgagaccagcctgggcaacacagtgagaacttgtctctacaaaaaaaaaaaaaaaaaaaaaaaaa

SEQ ID NO: 3160 - DNA, 1033 bp, Homo sapiens
aacacactttttatatactaggcattatgataaatattatcttaatgtgttgaataaatcagcatgataagtccttacttttcacttttacagaagaggaaactaaacttaagtaatttgcttatatagtttctgtatagtagagccagaattcaaacttaggtctctgacaccaaaacccattctcatttttttctttttttcttccccccgccgccccaccactgttttttttttaagatagagtttcagtctgtctcccaggctggagtgcagtagcatgatcatagcttgctgcaacttctgggcttaatccttctctcccagcctccctagagctaggactacaagtgcacaccaccatgctaaatttttttttttttttttttggtagaaacaaccccatgctcttttattgatgctgtttagcctacttggatgccttgaatctgtttaccttctgtttatgttccttctttcaagtttgtgtttggaaagtgataattcgtgactcagcctcagaatggaggcatatatcacacatcttacatgatttggatctgtgtcagaggaacttaatattgtggttttgataatataattgaatttatgcttatagttgaatactaaaatctgagatttattaataccttggaattaaaatagaattcacttaccttggatcagttaaataactagttgattagcaactgactgaagatcaacaggaaaatagtaaggcattagttttaaaaaattaagttgtaagttggtaaatgactaattccattgcagtcactgaatgtatatcagtaatctccagactcgcatacaaccttgtcttggtggaaagctctgactatggattttgaacataagaaagagaatgtgagtgtctgttaaaagccatcactcctcagatgatgttaaaagtcttcactccacatcttctgaggagttgtcaagtgttcctgcttctgaccacaaggacagcaattggcctgtaatatatgtattccttgaaaaagtaagg

SEQ ID NO: 3161 - DNA, 1061 bp, Homo sapiens
ccatgttggccagcctcatctcaaactcctggcctcaggtgatctgcccaccttggccttccaaagtgctgggattacagacatgagccaccctgcccggccctatgtgtgtctttacggggaatttcctataggcaacatataggtgtgtaatgttttttaatccagccagtctatattttttaattgggaaatttaattcatttacattcatggttattattgatagataagtactaattcctatcattttgttaattgttttcttgttgttttgtatatcctttgttccttttttccctctccttgtttattatttcagtttgttggttttctgtagtgataagattcgattcttttttctttcttctttgtgtatctgatctatcagtgagttttatactttcccatgttttcatgattgtgattatcatcttttcacttacggtaaccaccccggcgaatactttactttttgtagaggcagggtcttgctgtgtttcccaggctggtctcgaactcctgggctcaagcgattctctcacctcgctcggcctctccaagtcctaggattaaaggcatgagccagtgtacctggattagttttcttttttaatacaacattgtattggaaaatatttttccaagttattacacagcagttataatcttcctaattctgtaggaacataataattaggaatttttaaagaactttcttcttagccatttaatctttttttcctgtttaatgcgtttgaattatttggtatggaaaagtaatgaaattttcttgattgttaagacagaaaggatttggttgtaagaagatttatgtatataaattattattatttttttctccagtagcatttatgaatgataactgaccatagttagaaatccagatttttgtatttgataaatttaaatacgagatgatagcatttagatattttcataatgttaggcattcttataatgtttagcttagaatttgccagtcatttggaaatacctaagtcagttgttctcaactggaggtgagtttacccccagag

SEQ ID NO: 3162 - DNA, 1097 bp, Homo sapiens
ttttcgtttgtgtttccctgatgatcagtgatattgagcacttttcatatacttgtcagccatttgtatatcttcttttgagaaatgtctgtttagatcatttgtcctttttttttctttttttttttttctagacagggccttgctctgttgcccaggctggaggacagtggtgcaatcctgactcactgcagcctcaacatcctgggcttgagtgatcctcctgcctcagcttcctgagtagctgggactacaagcatgctgcctccataccaggccaatttgtttatttatttttgtagctatggggtcacactatgttgcccaggatggtcttgaatgcctgggctcaagcagtcctcctatcttgacctcccagagtgggattacagatcactgcctgcccatttttaaattggatttttttcttcttttctttttgctgttgagttgtgtttcttatatagtttggctgttaatcaattgtcaaatgtatagtttgcatatattttctcccgttctgtaagttgtctctttactctgttgactgtttccttaaatttgcagaaactttttaattggatataatcccacttctctagttttgcttttttctctttttagattttacccaaaagaaaaatcttttttcagaccaatgttctgaagcatttccttggtgttttcttgtattcgtttcatggtttcagatcttaacatttaaatatttagtccattttggtttgattttggtatatggttagagatagggatctagtttcatttctctgcatgtagatatccagttttcccagcactgttgattgaggagactgtcctttctcctgtgtatattcttggcacccttaaaaaaatgaattggctataaataaatggatttgtttcttgattctctgttgtcttccattggtctatgtttttagtccagtatcatgctgttttggttactgtagctgtgcagcatattttgaagttaggtagtatcatgtctctatttttttattttttatttttattttttgagatgggatcttgctctctctcccaggctggagtgcagtgggcatatcttggct

SEQ ID NO: 3163 - DNA, 2056 bp, Homo sapiens
gcagtgtgatacatgattgcgcctctgaattccagcctggacagtagagcaaaatcctgtgtcttaagaaaaaagaaaacttaaaatatttttttctggcacaacctttctctaggtcttagttttttatagttttttcaaaaagtactatgcaaaagaacagcatcattgtcagaatccctcttaaaatacgataatgttttctaattacctaagtatactttcaccatttaattattatttttaaattaagataagtaaaaatgaaaacttctagtaatcctgagtgatttatggaggcaaatactataaccatttttggagtgtagcttgtctttcttgtcttttttttagaccctatgctttattctgtccctttatctcgtatcagctttttgtatgccattccttagataacatttcttaaataataaatggttatatattgtttattataaaagaatttaatcactcagcattgaatacttaagcttaagcttttactgtgtgtcatgcagtggtctaggtgttcaggatatggtaatggagcaacacagaccctcagccctcatggatattacatctttatgggataagaagacagcaaacaaatatatatacagtatactattgggttttagtaagtaacttgatgagaataaagcaggataaagggatagagaatgactggccattctaccttaactaattctctcagggaaagtctctctgaaaaggtggcaattaagctgaaactgaagatttctaggaaaaaaaaaacatttgtggtagaaggaacatcagtgcagaggcccagagataggagtgagctcaatgtagtcttagaaatggaagaaagccagtgtggctggaatggagggaggttggatttgagacatcagattatgtggactggtatggtttggctttgtgtccttacttaaatctcatgtcgaattgtaatccccaacaagtcaggggagggacctggtgggaggtgattggatcatgggggcagattttccccatgctgttcttgtgatagtgaatgatttttcatgagatctgatggttcaaaggtgtggcacttctccccttgctctctctctctctcctgccatcatgtaagacgtgccttgcttcctcttcgttttctaccattattgtaagtttcttggggcttccccagccacgtggaactgtgagtcagttaaacctcttttttttctttcttttttttttttttttaaattacacagtctcaggtagttctatagcagtgtgagaatggactaatacatggacattacagaccatagtaaagattttggattttaatctagatataatagaaagccagtggaggattaagaggagtaggtgtgaatttacttttaaaaggtcactgtggctgctgtatggagaatagactgtgtgatgtggacatgtggtggtgattgaaatgggagtaaggagaagtaaagtcagtagaatatgttgatgtcttggatgtgggatgtgagagaaaagagtaaaggtggtgtcgtagatcttggtttgggcaactgagtggtcctatttgtggagatgaatactgaatgaggaacgagtattttgttgaaaaaacctgagttataaaacctcataaatgaggacatgtaattctgtaattttattactttggagaatagatcatccaaatcctgtgagcaacagcacactgcctgtcatgcagtttacaggaaatatttgaatctaagcttttgaatgtatttttttagtttgatctaatttgatttttactatttaaaactactgtcatatttgtagtcctttgatcagttttaaaaaatcgagaccaggcatggtggctcaaacgtgtaatcccagcactttgggaggctgaggtgggtggatcacttgagctcaggagtttgaaaccagtctgggcaacatggtgaaaccctgtctctattagaaaaaaaaaaaaaagtgtgtgtgtggctgggtgtggtggctgacgcctgtaatcctagcactttggcatgccaaggag

SEQ ID NO: 3164 - DNA, 1016 bp, Homo sapiens
gttgtagatgtgtggtattatttctgagggctctgttctgttctgttggtctatatctctgttttggtaccagtaccatgctgttttggttactatagccttgtagtatagtttgaagtcaggtagtgtgatgcctccagctttgttcttctggcttaggattgtattggcagtgcgggcccttttttggttccagatgaactttaaagtagttttttccaattctgtgaagaaagttattggtagcctgatggggatggcaatgaatctataaattaccttgggcagtatggccattttcatgatattgattttatgaggccagcatcatcctgataccaaagcctgacaacaacaaaaaaagagaattttagaccaatatccctgatgaatattgatcctcaataaaatactggcaaaccgaatccagcagcacatcaaaaagcttatccacagtgaccaagtgggcttcgtcactgggatgcaaggctggatcaacatacacaaatcaataaatgtaatccagcatgtaaacagaaccaaagacaaaaacacatgattatctcaatagatgcagaaaaggcctttgacaaaattcaacagcccttcatgctaaaaactctcaataaattaggtattgatgggacgtatctcaaaataataagagctatttatgacaaacccacagccaatatcatactgaatgggcaaaaactggaagcattccctttgaaaactggcgcaagacagggatgcccctctctcaccactcctattcaacatagtgttggaagttggccagggcaatcaggcaggagaaagaaataaagggtattcaattaggaaaagaggaagtcaaattgtccctgtttgcagatgacgtgattgtatatttagaaaaccccatcgtctcagcccaaaatctccttaaactaataagcaacttcagcaaagtctcaggatacaaaatcaatgtgcaaaaatcacaagcattcttatataccaatgacagacaa

SEQ ID NO: 3165 - DNA, 1151 bp, Homo sapiens
gtaattttgttcaatggatatactgctgtagtggtgaagtcagggttttcaatgtgtccatcacttgaaaaacatatgttgtacccattaagtaatttctcatcatccccctactccttgtgagtctttgttttctgacattccacactctacctccatgtgtatacattatttaaatctcaacagtaagtgagaacatgtgatatttgtctttctgagttgtttcacataagatcatggcttccagttccatctatgttgctgcaaaagaatgacctcatttttttatggttgaatagtattccattgtgtatatatactacatcttctttatgcagtcatcttctgatggacacttaggttgattccatatttttgctattgtgcaaggtgggcatttttgaggagagaggcttactttgttgccttctgcctttgctttgccatatggattgattgtatttgaatctgaattgggcattagaaaacactgttaaagcatattagtctgttgtagaactaaaaatgtgagggcattagaaacttcatttgaaacttttgtgagtgtatcattcatttttgcatatgaatatcattttgtctcacagaaaatgtgtatgtgtatttttatcttgtgtagaaataacagcgtagtcagcagccattgttgcatagtctctggcaatattgttttgttttttttttgtttgtatgtttctaaacttacaggatatgtttctgggtaaacttaaaaatgactagcaggaaatcaattggcaatatgtgctgacttgtatctgagttaatagaaaatcagagccagaacaaggggttttctggctaagctctttgagactaatgtttctggatttgttaaaaatctaatataggtcaggtgtagtggctcatgcctgtaatcccggcactttgggaggctgaggcaagaggattgcttgagcccaggagtttgagactagcctgggcaatatagggagacaccatctctaccaaaaaatttaaagattagctgggcacgatggtacacacctgtagtcccagctactctggtgagtgaggtgagatcacttgagcccagaaggttgaggctgcagtcagctgtgaacccaacactgtactccaaaacaaaacaa

SEQ ID NO: 3166 - DNA, 1047 bp, Homo sapiens
agatagggcctctatcagccaggccggagtacagtggtgcaatcatagctcactgcagcttcgactcctgggctcaagccattctcagcctcccaaagtgctgggattacaggcatgagccactgcactcagccctttttctaaatatttatatgtttctgatttttaccactcacatttattttaaagtctttataagttggctatctttgagaaatggcatttgatttttcaaaactttttttggtagagttttaaatttggacttacgatactggataagtagtgattagattgtgctgaaatttatggaagaaagtcactttgagtatgccccttctacataagaacatagaatgtgctgaaaagctttctatttgagaatatttttattataacatgctttcctttaggcgttttattttgaaatgaaatgctgctgaatgctataagaaagaaaacatctttgtgggaattgggtatatctagaatgagaaagtaaaatattgcctgtagaatttttatacctcagaaaaaccaaataaagtaacattgacttcacatgggtatccatcttaagaaattatgtttagagttttgatagtttgtaggatttttttttctcagtaagggcattttaattgaatttaggaagtaaattataaatgatgtaaaagtttgtattcttcctgttaatgttataaccaaaagctaaaagataatgtagttcactgttttgcttagtgatcaaaaattttattttgtttattcattgctgttcactggaagacctgctgtcttgggtggctctgagtggggtgagattgacttgtagaatggttttcaactcttactggttgtgaatttacaaatacaggtagtgaggaaaagtttttccagtgtactctgatattattgagaatgatgactacaggatgaaggaagagaattatattttctgagtggtggtagctaatattttatgttactgttgataaccatcagatcattcttctttaaggggaaaaatagacttaattaaaaagt

SEQ ID NO: 3167 - DNA, 1035 bp, Homo sapiens
aataccattttagactgggtgtggtggctcacacctgtaatcacagcactttgggagactcaggaatttgagaccagcctaggcaacatggtgagacactgtctgtataaaatattaaaaattagctgggcatggtggctcactcctgtagtcccacctacttggaggctgaggtgggaggactgcttgagcccaggaagttgaggctgtagagagtcaggatcatgccactgcattccagcctgggtgacagagtgagaccttgtctcaaaaacaccccaaaaaccattttacaggttaggaaactaaacttgttggtctgacttaagtttatgctgcatattccttaggaagctagtaaaaagtaaaaaagaaggtaaagttcatactcgtgctcttatactgagatgcgtattaagtaatgtgagttgagattcatattcggtgccatagtcttttttcttaaccccatcaatcaattgggatatgcatatttataactggtatcttggatctattaggacatatttactgaagactatatgtatttgtataatagtatgttagatttttttttttttttttttgagatggagtctcactcactctgttgtccaggctgtagtgatctcggctcgctgcagcctctgcctcctgggttcaagtgattctcctgccttctgctcaagtagctgggattataggcatgcaccaccatgcccaactaatttttctatttttagtagagacgaggtttcaccacattagccaggctggtcagcctcccaaagtgctgggattacagatgtgagccactgcgcctggacatagatttttattagttggtttttttacatcaggacatggagtgctattgttagtttatgatttgacctaattttgcttacaaaggagtgattactcaattggaacagacttaatgatgtgtaattgagaggaaatagaggaaaagaagatggactggattgataaattgttgtaaatttatagattatgtaacttgtcaaaagtgac

SEQ ID NO: 3168 - DNA, 1564 bp, Homo sapiens
tgaaggacatttcttgaaagctttgtactacaccttgaattttttttttttctttgagaccgagtctcgctcttgtcacccaggctggagtgcagtagtgcaaccttggcttactgcctccgcctcctgggttcaagcacttctgcctctgcctcccaagtagctcggattacaggcgcccacgaccacagctggctaatttttgtatttttagtagagatggggtttcatcatgttggctaggctggtctggaactcctgacctcaggtgatccacctgcctcggcctcccaaagtgctgggattacaggcgtgagccaccatgcctggcctacaccttgaatttgaggaagagatacgtaatgtttaagatatttgaagaatatcttaaacacagtatcatgtgtttccaactcctaaattgatccctagatagaccatcagaaggctgtgtgtaccatagcaattctgtctcttagaaatgccttccatctaaagcctgctctttgtcaacactggaattacagcactggataaggtttgtgtattttttataggacctatgtggcagaattttacttaatcataatctaggaaggaactctgcagataagtttgttttctgtggtttaaaaagttatccactacaatttgtcttttcctgccactcacttccctttttattttaaccttaatgccagtaaattttaagacaagtttttggcccaaatgctctgatctattaatactttttttttctttctttttttttttttttgagacagtcttgctgtgttgcccaggctggaatgcagtggtgcaatcttggcccactgtaacctttgcctcccaggttcaagcgatatctcgtgcctcagcctcctgtgtagctgggactacaggtgcgtgtcaccaaagccagctaattttttgtatttttagtagagacagggttttgccgtgttggacaggctggtattgaactcctggtctcaagtgatctgctcatctcggcctcccacagtgcttggattacaggcttgagccaccgcatctggcctctgaactttagatattgaaggcatcgcatctttctttttttgatgaactgtttttcccacagtgttatgtcttgtattatttaagcctaccactgtctcagagtcattgtggactagggcagattaagaaaattggagatccttttgtgactagacagatgtcttacaacttttaaatattttgataatttaccattaagaaagaacggcaatgataatggaagacacaagaggaaaagcctggccatcaagctgtatagcagttttccagaggcttttactttttattgggattggattatattaaccttacattcatgttccaaccgtgtaattttgccctaatacattattttaacttttctctagcttctgtagacatcatgattcctgtcttgcttgaatccgaatctgtatagcttgaaacagcattattactagtataagtgcaattacacatcatccatatgtgtaatacaaactggcagactaagaccccagcc

SEQ ID NO: 3169 - DNA, 1023 bp, Homo sapiens
tatcactttggctatgtttattgagttttgaataaaaatatctaacaatatgtttactttgatacggagaacattatttatattaatgatattgatctttctattgccttcatttttgaaaaatatttttcctcacataaaattctgtgttgacaagtatttttctttctttttttgattattaaaaaaattttttttttgagacagtgtctcactgtttcccaggctggagtgcagtagtatgatcatggcttactacagccttgacctcctaggctcaggtgatcctcccacctcagcctcccaagtagcttggactacaggcacacatgaccacacctggcaacgttttctgtttcttgtagagatgggttttgccatgttggctaggctagtctcaaacttctcggctcaagctatcctccagccaaaagtgctgggattacaggtgtgagccaccatgcccagccacactcttttaaagtagtgcaaatgtcattgttttctgactcgtattgcttctcacaaggtctgctgtaattcttacctgtttacttaagtatatgtaattttttgttttcttcttcttgctgccttcatgctgtttgattttgatgtttccaggcttgtgtgtttgttggtttgttttatatttaccttgcttaggatttctctaaacttcttggatctgtggtttggaatttttttttttttttttctggaaaattctaggtcattatctcaagtatttcttttttttagtctcttttttcttctgtgaatccagttatacatatattataccatttgatactttcccacattagtggaacctcttttttttttttcttccctatgttgtagtttgagtaatttctgttgatacatcttaatgtatctttaagttcgttgatttttttttttttttttgaggcagaatctcactctgttgcccaggctggagtgtagtggcatgatcttgactcactgcaatctccatctcctgggttcaagtgattcttg

SEQ ID NO: 3170 - DNA, 1015 bp, Homo sapiens
ctccaaagtgttgggattataggtgtgagccaccacacctggccagcccagtgtatttctatatttactatatatgtatagctgagttttctaggtgtctttttatttcagctgaagaagaaattggaattattaaatctcaattttgacatgtgtatattttttcagcctgtaagatattttctgaacttagctccaacattgtatttctggagagttattaagtctcattatgactgagatacaggaatgtgaggtttgaaagagctaatcttagtattaatacccaatattttgagctgttaagattttaatcttataaagggcaggaataagactgtttaaaattattttgctcagtgaagtaaaattctaatgtgagattttattaaatagggtctgctttactatatttaggcgtaagcatagaagcagcaagtgacattgaaatccatggtgtaaatctccgcagtaagtacagttcaacgactgagaacattgtgatgatggtgacctttaagcatctgaattctgatgatacttatttatctataaatgagaatgacaatacttagattattaggataatggggaggactaggggaggactagagtatataaagtgcccggaatcatcctgggtgctgtcttagtgtatcagatatatttcaaaccttagtatttgtggcctttgaatttaaacagttgctgttattagcttcaattgttagagatagtgtcaatgagtggaatatgtcagctagaagctactccttttagattttccacattctgaaaggtaggactatgtttcctttttgatagttgcatcttcactctcctatagggagccagtgggactccaaaccaatagcatagacaacagtcattaagaaagaaggcttaggctgggcgcggtggctcatgcctgtaatcccagcactttgggaggccggggtgggcggatcacgaggtcaggagtttgagaccagcctggccaatatggtgaaaccct

SEQ ID NO: 3171 - DNA, 1045 bp, Homo sapiens
agccagagtttgagaccagcctgagcagtgtagtgagacctcgtctctacaaaaatttaaaattaattagccaagtgtggtggtgcacacctgtagccccaggtagtcatcaggctgaggcaggaggatcactttagcccaggagttcaaagttgcagtgaactatgattgtgccactgcagtctagcctgagcaacagagtgagacctagtctccaaaaaaaaaaaaggaaaaacaaacaaacaaaagcaaagtaatatcatatgagccacccatgtaattttagattttctagtagctacattaaaaagtaaaaagggaaaaacaggaaaaatcaattttaataatatttgactcaatatataaaaatattattaagacatcatataaaaattattagtgagatactgtattttacattctttgtactaagcctttgcacttcagtgtatgttttacacttacagtaacagcacaccttgtcttgcactagccagatttcaagacttcaatagcccagcgttcctggaggctacctattgaacagtgcagttctgtaatatattcaagtgtaaatactgttttctgtctgctttcagaaagaatcagaatgagcagatttgaggtgcaagggaaaggatgaagaggcagagctatatgacaggcaatacctatcagtattgtgatggttcataccatttccttcctgggttagttactctactaacaagtgtgggtaactttgtccaggcatttgggcactgtattgtgattttattatttatcagtttttcccattaaaccatgtagttaaggcaagggagtatggttttttgtttgtttgtttttgttttttttttgatacggagtctcgctctgccacccaggctggagtgcaatggtgcgatctcggctcactgcaacctccgcctcccaggttaaagcaattctcctgcctcagcctccagagtagctgggattacaggcatccaccaccatgcctggctaatttttgtgtttttagtagagatggggtttcaccatg

SEQ ID NO: 3172 - DNA, 1034 bp, Homo sapiens
atgagccactacacccagcccatttactgtaatttttagcctttgagaattttgtgatattggctagattttgccatagagatttgtaagtaaccaaattttattcctaacattgactactagataactgaatggttttggtgagactttaccattcacacttgaatatttatgttttctttaagggaaatcacaatgtatataagtttttaattttgtttcaaatgaattccatttgataaaacacgtagcatagctaggtggggtgactcaaaccagtaatcccactgagtcaggggcctgagtgggagtatcctttgaggctacgtgtttgagaccagcctgggaaacatagtgagaacctgtctcttaaaaaaaaaaaaggcataaaataaactggacacttttaagaggtatgttggtccggatcattggttttagaagatagagcaaaacttgagagttaaaccctagggttttttttgtttgtttgttttgttttgttttttagctctgattctactagaagtagtcatgtcatctttggcaattctcttaatgtaacattttggaacttggtttccttgtctatatgagagagttgatgataccttacaagttgtactgaggattacatgagccctccatgcaaaatactaaatacactgatacagatatggttggtactcaagaaataatggcataattttttttttcttgctatgttgcccaggctggtctcttaactcctggcctcaagcagtcctcccaccttggcttcccaaagtgctagaattacaggcatgagccaccatgcctggccaagaaacaatgctgttattactctagctagcagaaaacaaaaatcattttctggagaattagactatttaacaaggcacatgcttatcagtacgtgcgttacctcttctagtgttctgctgtgttgatattagtgaccaagatctgcatagtttgagaaccctctatttcaaggattaggaggtagaaagcttatgagaaagaaatctggc

SEQ ID NO: 3173 - DNA, 1035 bp, Homo sapiens
aacagaaaagccccccttctctagaaaagccatatgtgatcattatggaaaatacagggaaaaaaaaagaataacagtttactcataactctaactcattgatgtatttcgataaatttccttgaaggaattttttgtttatatatgtatacatatttttgtacatatttatgtacacataggttggcatatatgtgtttatatatatacatacacatttgcatagctgcaaatcatactgtaaatgtaactttgtattatttttcctattttaacatattgatatattaacatttctttctttcttttttttttttagagatagagtctctgttgctcaggctggagtacaatggcatgatcatagctcactgtaacctccaactcctgggctcaagctatcctcctgcctcagcttacccagttgctgggattacaggcatgagccaccctacctggccagtatagtcacatttcaaaaaacattctgaaggcatctttaatggctttatagtattagatatatgactgtgccacaatttactgaaaacacattccttattgttggattttttttttctttttttgacatgaggatcttgctgtgtttcctaggctggctttgaactcctggctatcctcccacctcagcctctcgagttgcagggattacagacatgcactttttttttttttttttttttaaatgagacagagtctcactctgtcgcccaggctggagtgcagtggcgcgatctcggctcactgcaagctccgcctcctgggttcacaccattctcctgccttagcctctcgagtagctgggactacaggcacctgccaccacagccagctgattttttgcatttttagtagagatggggtttcaccgtgttagtcaggatggtctcgatctcctgacctcgtgatccgcctaccttggcctcccaaagtgctgggatgacaggtgtgagccaccgcgcccggctgtttactcgatttttaagttaacagttttgctattgagaagaatgc

SEQ ID NO: 3174 - DNA, 1050 bp, Homo sapiens
taatagttcagctagaatttgaaatgttaggttaaattggctgcctttgaatgaaaaaggaacttctatttgtgttcagggtataatgctcagatgaaccgttggatatgcaaccagaaagcagttaggaagtgtttttcagtttagtctttcactggaaaccaaaactttgaaaaatatatttggagcggaggctacttatgacagaaggattcttaaagttcaactacttttgactcagaaggaaaactaagttgaaaatactcaaaaccagaaaaatagataatttcgtagaatgttgcaggttgttttgcctttctggctctcacaaaaaaggttagtgattgatactgtatctgcatattttctattcctttctctgtactttagttaatagcattttgtgattaaaaaaaatacgcccttgacttacttttcttgttgttattgaaagcagtttttcctgtgtctgagcatgtataacattagtgatctatatagagagtttgtttattgcaaccagaggcacattcctagggaagaatggtttttgaatgttccgttatcttatttccagtaggacatctttagaaatgagcaaattccattaaactaataaccctgattttggtggataagcacttatactaattctgctttgagaaaagagattgttcactctgctttaggagctgctggctaagtctggtgcttcttaacctttaactaagaaaaatgaggcttgctgacaataggtagtttttactggcctgtgaaacccaacagcatgttcagcaatgtaaaccacagcagctatcttttgctggcttcactgttgtttgaagtataatgaaatgcttcttggccggtctcggtggctcacgcctataatcccagcactttgggaggccaaggagggaggatcacctgaagtcaggagttcgagaccagcctggccaacatggtgaaatccagtctctactaaaaatagaaaaattagtcgggtgtggtggcacatacctataatcccagctactcaggaggctgtgg

SEQ ID NO: 3175 - DNA, 2032 bp, Homo sapiens
caaacaaaaaaaaactacaagaaaaaaacagtactctcaaatggaggtacgagatcagaaccttgaaagtcagtgaggactaggggaataggaagtagtatttgggctgacttgaagttgaggggaaggacatctacagttgagggaaatggtatgggcagagtcgtggtcagtggttaggaaatggtgtatggtgtatatggggtagtccgaagatccactgggataaaatagaaagcagcaaatgtgcatctgacaattttggagaacctttggatatctaactgtataatttattattcatttattattattttttgagatagggtcttgctttgttgcctaggctggagtgcagtggtacgatcatggctcactgcagcctcgacctctcaggctcacgcagtacttctgcctcaacctcccaagcagtagggaccacaggtggtcccaggttgatattttgtagagacgaggtttcactatgttgcctagcctggtcttgaactcctgggctcaagcgatcctctggctccagcctcccaaagtgcgggattaacagatgagagccactgtgcccggcctaatttttccaaggttttccaaggttttgctgaggtacatcctgtctagagggaaatgaaaaggaaagggtgatcatatcatgaaagctatcataaaggaagaaaaatagggatttgactatctttgatttctgaaagaagagttaaagttgactccagggttttgagactagaaaatgatgctgtcattgatagagtaagaaagatgtaggatttaattttatacgttgttttgagatagtggacagataaattcagtttaggacatgttggatttgaaatgagtgaaatatccaactcattttacaaacaaatggagataactgaagatgtttggaaatagggagatggaagtcagatgagcagaaatggttggaaaaacaaatctgtgataatataagcataatggagagagggaagagaaaagcaaagattattagtctatgcagtgtctggttacttgaggaagatgaggaagcttacagaaaagagaaagaagctgctgagaggaaagaggaggatcaacgcagcacaacctttaaactatccagaatagattcccactgagttttgtttatgtaattggaggaagtgacatttaatccttgatagctagtttttgattgaaagctcttgagtttttttttgttgttttttttttttttgagacagagtttcgctcttgttgcccaggctggagtgcaatggcgccatctcagctcgctgcagcctctgccctcagggttcaagcgattctcccatctcagcctcccgagtagctgggactataggcatgtgccaccacgcccagctaatttttgtatttttagtagagatggggtttcaccatgttggccaggctagtcttgaactcctgacctcaagtgatcctcctgcctcagcgtctcaaagtgctgggattacaggcctgagccactgcacccggctttttgtgtgtttctttacaagtctaaaattagttcttaaagggctttggtttggagagttacatttaagtttatacttttgcttattttctataatcatatattttagaaataaaaaaacttctcaaaatatttatttatttattttttagatggagtttcactctttcacccagggtggagtgcagtggcgctgtcatagctcactgcaaactcccaactcctgggctcaagcaattctcccgcattagcctcccaagtggctgagattagaggtgtgaggcaccgtacctgactaaaacttcaaaaatatgtaaatcacttgctgtctccctaataggctgctgttggggttctgggcagtagttactgtgaaatcattaatttgaacctggagttttcaataaaagattttaatatgctaatcaggaattgaacagagcatgataaactccattactatccttagttgataaattttaagcagaagaaaaggaactg

SEQ ID NO: 3176 - DNA, 1033 bp, Homo sapiens
tgtgcccagctaatttttaaaatttttggagagatagggataggggtctcactttgttgtccagtctgatcccaaactcctgggcttaagcaatcctcctgcctcggcctcccaaagtgttgggattataggcctgagccactgcacccagcccttgtttttttatttttaagctttgccaacatctgagttccccgacaatcgtgttcttaattcttgttaatatgttattagagttagaaaggattccttcttatattgcagataaaagaaggaaatgtgtagaaggtttttttttcttttttttctttttttgcccttttttttgtgcctcaaatctgaaggccttttatgtatagattgtactaggacctgcagatctagtgtctttactcatcataggtaacaattggatttagcgagaaaatataggtatttctgtttttgagtttcgttaacagcaaattgtttagatgggattaaaggcccaaaatgtactctagttatctttgtggaacccatggatgaacacctatatatatagagagagagtgtgtgtgtgtatgtatatgtatgtacgtgtgtatactcaccgttggactcaaactcaggtaattctactgcctcagcttcttgagtaggggggattacaagtgtgtgccactgtgcctagtttatgttgtgttttagtggtgttaaatcttgtgtaccaggtcagaataattgttttagttggaggagctaagttgaaataagtatttggttatcataagttacagttcataagcactttaaaaataaccccttttcttcaattaactatatattggcttggtgtgttggctcacacctgtaattctaacactttgagaggccaaggtgggtggattgcttgagcttaggagtttgaaacccccctgggcaacatggcaaaacctcgcctctaccaaaaatacaaaaattacctgggcatggtggtatgtgcctctggtcccagccactcaggaggctgaggtgggtggattgcttgagt

SEQ ID NO: 3177 - DNA, 1030 bp, Homo sapiens
tagttatttctctttattctcttatggtttgtaacgattcctgtgactttccttatcttttgtgactttgacacttttgaagattgctgatccattgtttatagggtgtccctcgttttggatttgtttgatgttttctcatgaatggggcgaggttatgcattccttctcattgccccatatcaggagattcatgatgtcagtatgatgatgattaccttgactacttggttaagttggcatcttgctggtctttctattgtggagttattctctttccttttgtagttgataagtatcttgtgggagatatttgatgagtttgcaaacaatgttagaatcttctcaaactttggttctcaattttagcaactgatggagcttgtctgcaacatttattgcttttgtggttgcccaattgtgactttctatttcactctttccttctacatttattgattataattctatgaggaaaagctttctttcctccatttgtttattattcatatcactatggactcatgggtatatattttattttatgggttaaaatccagtaactatcattgtttgttttcttactcagattgttctagctttggccatcaggaattccttcaggttgatttctgtgttctttcaagaagccattatcttttttttttttttttgagatggagtttcgctcttgctgcccaagctggagtgcaatagcacaatttcggctcactgcaacctctgcctcccaggttcaagcgattagcttgaacacagcctcctgagtagctgggattacaggcacctgccatcatgcctggctaactttttgtatttttgtatagacggggtttcaccatgttgcccaggctggtcttgaactcctgacctcagatgatccacccgcttggcctcccaaagtgctgggattacaggtgtaagccaccgcacctggcatctggataatttttcagttttttgtagagatagtcttactgtgttgcccaggctggtctcaaactcccagcct

SEQ ID NO: 3178 - DNA, 2164 bp, Homo sapiens
tctcatttagtggcttatcttttcattttcttgaggtctgtctctgtcacccaggctggagtgtaatggcataatcagatctcactgcagcctcgaactcctgagctcaaggagccctcccacctaagcttcccaagtaactgggactaactgcatgtgtgcgccactacacccagctactttttgtattttttgtagagacgggatttcaccatgttgcccaggctggtctccaactcctgggctcaagtgatctgcctacctttgccttccaaaatgcgggattataggtgcgagccaccactcctgcctagttttttattttcggtagagacagagtctcactgtgttgcccactcgtgtctcaaactcctgagctcaagtgattctcctgccttggcttcccaaagtgttggaattacagacatcagccaccccgcccagccttgtgcgttaaggttatataatccattaagtgcttgagatttagtgaggtgtgctatttataaaataaggcctattggataaacgaactttgaccatttctatccttttttatgcccggaaaacaagtgttgtctgcttttattattaagataaattactattaggcagtggtagttttgtaaaaaatagagtataagcatttgactgttttgctgtcctgtgaataattgaaattatgagttacaaattcttaggtttttggattttgcatagtgttagttctgtcaggttaaaattggttgttgattgatatgaggttatactcccaggctattctaatgtatatgttattataaagaaacaaaattggagctgggcacagtggctcacacttgtaatcccagcacttcgggaggctgaggcgggcagatcacctaaggtcaggagtacgagaccagcctggccgacatggagaaaccctgtctctactaaaaaaatacaaaaattagccaggtgtggtggcacgtgcttgtaatcccagctacttgggaggctgaggcaggagaatcgcttgaactcaggtggcggaggctacggtgagctgagatcacgccactgtactccagcctgggctacagagccagaccctgtctcaaaaaaacaaaacaaaacaaacaaaaaacaaaattgggaaatactgcttaatctcttgtttagcaggattctttttgctatttaggaaaagaccacattaaagaagaggttattttgttacccttaggtgtaataaaaacagtttatttgttttggataaagactttccacaaaaaaactcttcagttgcttaacattgggaagtgggaatgagtggagttgctgattttgtaagattgtatctgctttaagttttaaattattatgcatgtctccagcttagctcttactcaatattcaaaggaagtgggtcttaattagtccatgtataattttaatggcatcaagtacctaattaataattgttgaatctttgaggctaatgtagtcagctgatactccctgtgttacattgttgatctttttcagaaatattagagtttgaaagtagtccaacttcctggaataaatgctgtttcaaaagcagactacagagcacttgaccttagcttattaccttttatattgtgtgactgagtgagtgtatttaaatgtggtacattttaggtaaggcaatgaaagctgagtgtggctctggaatgtcattgatttcattcttgatcttcattagaaaaatcatagttaaaggatccaaacataagtatgcattagcttatttttcctttacacatagtagacagtaaatttaaaaagaagtgtctttgaaaggtgccaccatgagccagtgatttttctaagctggaaaggagtttggggatttttctggttcagctttctgccccctctcctacctttgttctagaggctgaggggaggttagggcaacttgcctaaccataaagttcatgccaactcaaatttatttgaggtctttaacaacactgaccagtgacctactaatagatcctgtttctcctgtaatggtcctggtttggatagtaaattatatggatacccccacctggtaaccattacatagcttagacaattaggaatctttttatttatttatttttttttggagatggagtctcgctctgtc

SEQ ID NO: 3179 - DNA, 1069 bp, Homo sapiens
taggccaggctggcctcggactcctgaccttaagtgatctgcccctctcagcctctaaaagtgttgggattacaggcgtgagccactgcgcccagcttattcattttttcgagatggggtctggctgtgtctttcaggctggagtgtagtggcataattatggctcacagtagccttgacctgctgggctcaagcagtcctcctgcctcagcctcttgtgtaactgggaccacagacacactccgctatgcctggctaattttttaattttttttttttttttagagatctcagtttgttgcccaggctgatctcaaactcctgggctcaagggatcctctcgctttggcctaccaaagtgccgggattacaggtatgagccattgagcctggcatggaagtatgaatttttaaaaggaaaaaaaagagtttaagactatagtcagggtttagataggcagaggtgggtggattatgatgagtgggtgatcaatatgaacaaagatttgggcctgaagcaagtgtagtgtatgctgtgttctaaggatttggatctgtgtgcttggaatggaggattctcatggtagaatattcaagataatggatccagattctagagcattttgaataaataagaggaagttagacttcagctgtgtgaaaccattacttttttaaaaaacagctttattgagatgtaatccacataccgtatgagtcacccatttagagtgtataattcagtggttttgggtatattcaaaaccagttgagaattgtacaactactaccataattttagaatatttttgtcactccccaaaggaacctgtttgactccccatgactccccattttcccccaattctccctgccctaggcaagtccaagtctattttctgcctctatatatctgcctattttgaactttttacgtaaatggactaatgtattttttgtgtgtgatttgtttcagcataatgttttcagggttcgtctgtgttgtaaccatgtattagcacttcatttttaaaattattgagtaatattccatgtaccatggacattt

SEQ ID NO: 3180 - DNA, 1095 bp, Homo sapiens
gaatagttttattctgtatctacttgaaatataagtgaactttttgtttatttggaatgcttttcttgggaatattttttcacctttggcttttagcttagaagttatgactgcacattacaaaggggaatgttcaaacctttatcagtaagtcaaacatcttttgagttattgttcctgtaatgttttgcattatttgcaagattaaaactcagtgtaacatcacaagtttttttcccatacaattatttacatttctttattatctctttaagttcatctttatatgttcaagtatactaagtttttaaaaaaggctgggagccagagtcctaattttttttttctttgtgacggagtctcactctgttgcccaggctggattgcagtgttgtgatcttggctcattgcaacctccacctcccgggttcaagcggttcccctgcctcagcctcctgagtagctgggattacaggcacccggcaccacgcctggctaatttttgtatttttagttgaggcagggtttcaccatattggcctggctggtcttgaactcctgaccttggccttccaaagtactgggattacagacgtgagccactgcacctagtgtatttatatattggccaggctggtctcgaactcttcatctcaggtgatccatctgcctcagcttcccaaagtgctgggattacaggcgtgagccatcgcgtctggcatttagttggttttcaggaagtgttagtatcatgaggagtgattgaaggaaggaggaaaagaccacagggattcatgcgggatgagggaaagaggattgaagtgtgggaacaaacataattttggaataaggagagaaaattaagtgggaatagaaaatgaacacagccagttttaaaccagaatactatttttacattgagaatggaaaggactgaaccttgaaggttaaatgagatgattcctgaccttttttctaggtcctagtaattagtatgtaagaaatagaacttggtcggagaacttggccaggtgcagtgactcatggcctgtaatcccagcacttcaggagcccaaggtgggtggattgcttgag

SEQ ID NO: 3181 - DNA, 1841 bp, Homo sapiens
ataagacattgaattttgttaatagaatgtaaactccatgaaggcagagatttttgtttattttgttcactgtggaattgctagcacctagaatactgcttgacagacagtaggcagtctgtaaatttatttgtttgtttgtttgtttgtttgtttatttatttatttttgagatggagtttcactcttgtcgccctggctggagtgctagtggcacaatctcagttcacttcaacctccgcctcctggattcaagtgattctcctgcctcagcctctagagtagctgggactacaggcgtgcaccaccacgcctggctaatttttgtatttttagtagaggcggggtttcaccatgttggtcaagatgttctcaatctcctgatcttgtgatccgcctgccttggcctcccaaagtgctgggattacaggcttgagccaccgtgcctggcctgtaaatatttattaaataaaaagtgtgttggactttgggaatcaatttgaagataagttttaggattaatatagatggcatcacaactcacttacagcattcaaagctgccctcaaattattttgcagggatgtataattgaattgaaaataattctgtaatttcctttcagatggaatagcattgacccagtttacaaagccatctgaagtgcctgagttgtatttgaagtacatattgatactgaggattagggttggtatgaaggccaaagaggaacaacatctgtagtcaaatattattattaaaaacttatgattataagagcaagacataattaaatgagaaatttggaaaaatatagaaaagtaaaaaatcactcataatcttattagtggagacaaccccttttattttattttattttatttatttatttttttggggggagagagtgttgccctgtttcccaggctggagtgcagtggcacaatcttgggtcactgcaacctctgcctcccgggttcaaacaattctgcctcagcctcccaagtagctgggattacaggtgcatgccattatacgcagctaatttttgtattttgggtagaggtggggtttcaccatgttggccaggctggtctcgaactcttgacttcaggtgatctgcccacctcggcctcccaaggtgctgggattacaggtgtgagccaccgcgccttgccacttttttaaagaggtggggtcttactctacctcccagggcatggtcatggctcactacagccttgacctcctgggctcaagcaatcctcccacctcagcctcccaaggagctcggaccacaggtgtgtgccaccacacctagctaatttttttgtagagatggggttttgccatgttacccaggctggtctcgaactcttgggctcaagccacctgctcaccttggcctcccaaagttctgggattacaggcatgtgtcccagtgtgtagctgtgataaccacttttaacattttggtgtatttctgtcctgatttttttttttctgtggattttaatattagtggtcatacatttttgtaacataaagtcagattatgtacctagttttgtatcttgcttaatttgctacctaagtatctgccatgaaaagtactttttttggccaggtgtggtggttcatgcctgtaatcccagtactttgggaggctggggcaggaggatcacttgagtctaggaatttgagaccagcctgggcaacatagtgagaccccatctctaataaaaattaaaaaatagtttgccaggagtggcagtgcatgcctgtagtccctgctactcaggaggctgaggccggaggattgcttgagcccgggaggtcaa

SEQ ID NO: 3182 - DNA, 1033 bp, Homo sapiens
caaaaattagccgggcgtggtggcgcctgcctgtaatttcagctactcaggaggccaaggcaggagaatcgcttgaacccacgaggcagaagttgcaatgagccgagactgcaccactgcgctccagcctgggttacagagtgagactccacctcaaaaaaaacaaaatcaaaggtcttctagaaaatgtttggaacccacgtcttttttttttttttttttttttttttttgagattgagtctcgctctgttgccaggctggagtatagtggcatgatcttggctcactgcaacctccgcctcttgggttcaaacgattcccctacctcagcctcctgagtagttgggactacaggtgtgcgccaccatgcctggctaattttttgtattttagtagagacggggtttcactgtgttggccaggatggtcttgatctcctgaccttgtgatccgcctgcttctacctcccaaagtgctgggattacaggcgtgagccactgcacccggccgagaaccacatcttaagtcaatggagaggattcctgtaatcccagcactttgggaggccgaggtgggcagatcatgagatcaggagatcgagaccatcctggctaacacggtgaaaccccgtctctactaaaaatacataaaattagccaggcgtggtggcaggcgcctgtagtcccagctacttggtaggctgaggcaggagaatggcgtgaacccgcgaggcggagattgcagtgagccgagatcgctctactgcactccaacctgggtgacagcgagactccatctcaataaataaataaataaataaataggattgccacattttgccatttatattgaggcttcaatagatgtggcaagtttatgaattcattaattcagcatccactgtgtgctgctacactcagtgctagatgtaggattgaagagctaaggtagaaatctttgccctcaaagaacttggtccttttggttagaggtgggtaaacaaaacgtcatgaggcaagtacagtgataac

SEQ ID NO: 3183 - DNA, 1285 bp, Homo sapiens
cgtttgacttttagagattgtaggatgtttgagcaagtaagaagctaactgctgtgaggtccccagattatttcacagtctgtagtttgattcttgtctgtatagattactttgagaagggaaagcaatctcccttctagagtcatttcaggtcattgtttgttttctgccaagtgtcattttctctgttctttaaacctagttcgtgattttcaatccaggcaccgcggtgcagtgtaaagataaattccattccagtgtgacgtgtgtactgatttcataatgtttttatcctgcatgattctgttcaattaggaattgttcaccgatgagaaagtgtggtgataacttagcgttgcttatggaaaacctggttggttttgttcagtgtctctggggtgggggaagattggctggtttgcctacttaaaggcagagttcagtgttgaatcttttaaacctgtctttgcttactactttgtgagtttaaattcctttctaatttcattttttaccttgattgcctatactcggttaggacttttaagtttctgaattgtgctaccacgtaaattactcattacctgcatctttgagctgttttggcaattgaacagaaataaaaggaaacctgtagtaggtgtccttgatgtacagagtagtaaggaccacagtgctgaatgtgacactgtttggtgaattgggtggctttttgggatacagctgtgtttcaagtatgctttttctcagtgcatttcatagaaggacttataaaagctctgagttggttgcaacattcaagtagttacaaaagctgaaacttaattttcttttgaataaaaagcacttgttaaagagataaatttaagtgtaagttccagtgtagataattttaaaccaattttagtcatatggaacacttacttttgtgtggctttaagtttttactttgcctcatgccattgaagctaaaattaatcttcctcttgatgtgtttcacagctcttattgttttctctttgcttttacacactgaaaggttacaattgctaaaatagaaaattttattatataaacagtaaaggaagtataggttgtagatttcatcagacataccagtggtgaagtgttatcaactggtaatggggtattgattaaaaaaggattgaaatagagcagttctacttttctaccctgagggagtatgggaatttgtatttgacgcaagtggtcattgttcaataagtggataacatttaagcatcttggcaggagtgcatagctg

SEQ ID NO: 3184 - DNA, 1055 bp, Homo sapiens
tgtttcctgggctggtctggtggaagatggccatgagaaagcggcacttcatcttccttcgcccctgagtgttcagtgggtggttactcggcatcctgttgggcttccggtgtggtggctgggagccagagagaggagggcatgagagctcacagagtcacaggaggtgggacttggaggtcatctaggccaacttcctcatagggcagaccaaggctcacaaagggaaagagacttacctgaggctatacagcaggttagaggcaggacttagaccctgattctagactcctcatccagcactctttctagataagatggaggtatggaggttttggagccagacagatgtgggttgtagtcccagctctgtcacttagtcccagctgggtgacctttggtgagtgaccatctctgagcctcggttttctcctctatgaaatgggatgatggtagcacctttctcatagtggtgttgtgaaaagtggttgataatttatgacaggttgtaaagctcacaggacggtgcacggagttggcccttgggaggtgggagctgttattacctttgtggctccgtcatttttttttttttgagacggagtctcgctctgttgcccagattggagtgcagtggcacgatctcagctcactacaacctccacctcctgggtttaagcaattctcctgcctcagcctcccaagtagttgggattacaggcaggtgccaccatgcctggctaacttttgtattttttagtagagacggggtttcaccatgttggccaggctggtctcgaactcctgacctcaagtaatttgcctgcctcggcctcccaaagaagttgggattatgggcgtgagccactgcgcccagcccgtggctctgtcatcctaacctcctgaagcaccggaaagaatggctgcgtgctggccctcacatatgctgttttctgatgaacgcggttagggagggaagatgagaatgggccatggttggcccatctctctgctacttattttatttccccactatatttgagagactccttagc

SEQ ID NO: 3185 - DNA, 1065 bp, Homo sapiens
aaacaaggatgttgttaccttttgttaaagaataaatacattgttttccctgcagagttggggaggccaggggaagaacaggatttgaggcatgagagggctacaaggtgggcttggcagaatgttctgggcgttagcccagaaaaccagcttggccaagtccacactttcatgtctacggtgagagaggaaccatgagcaaatgtttacaattttttgtgcttctgctcaatttttttctctccaattgactgggtaagcctcctgccatagtcaaagggcttcattcatttgttcattcactcactcaccaaacaagtctgtctggcacaacacgaggcatgggggccgtggtcagtgtgagtgagactgataggtctctctctcccacagtctgatggacaggcaggcagacagatacagagcaggaaattacaagcgcaattactgttgtcagggagacacgcggggggctgtgggattggaccgggaacctgacctgaggatcagaaaaggctccctgagcacatggcattaaaatcataacctaaagagcgagtgggactgggaagagtgttggggggcggggggtggagggagcagaatgtgcaagagtacagaccgctgtgccttcagggatggttcatctggaggcacggaggactgtgcttaggaggtggcccggagggtgcactcagggatggtcatatgaaggacctggggctcaatccttagggcagtggggagccactcaggagtttattttttaaatttaattaatttacttatttattgagacatagtcttgctctgtcacccaggctgagtgcagtggtgcaatctcagctcactgcagcctcagcctccctggttcaagtgattctcctcagtctcccgagtagctgggattacaggcgtgccaccatgcgactaacttctgtatttttttagtagacaccgggtttcgccatgttgcccaggctggtcttggactgctgacctcaagtgatccacccgcctcagcctcccacagtgctgggattacaggtgtgagccaccgcaccc

SEQ ID NO: 3186 - DNA, 1101 bp, Homo sapiens
accaccactgtctgtctgcagggctgttagccgggccaccccctctgaaggtgaaactgagcaggttagacccagcccctcagcttgtgtttggtgggagagggtgggggtgtgtagagggctgagctgattcctccctgttcttctgtcacctctctggggtgggagctatgtatctgggtttgagccccctggtcctcagttgctgggtgacttgggcaggccacggcccttccccgtgacctctgcccttgcattgttggaggatttgatgggagtgtgaaagggacttggcagttgccaggtggggagaagtttcaggggttcccaatgggatggaaagacctggagcctggaattccaagggtgggcccctcccagggtggggttctctgaggcagggacttggcagagttggggcacactggtgccagccacccaccatgccatgtttcatggtgtctccatccccctttgccctgcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccct

SEQ ID NO: 3187 - DNA, 1032 bp, Homo sapiens
aatcacagtgagataccatcttatcagttagcatggctattatcaaaaagacaataacatgtaactaggatgcagagaaaagggaactcttatacggacttttggtgggaatgtaaattagtacagccattatggaaaacagtatggaagtttctcagaaaactaaaaatataactaccatatgatccagcaatcccactagtggtatttatccaaaggaaaagaaatcagtgtatcgaaaggatatttgcactctcatgtttattgcagcactgttcacaacagccaaggtatggaatcaacctacatgtccatcagtagatgccttgatatgttatatttatatgtagacatacaatgggatactattattcagccattaaaaaaatgaaatcctgtcatttgcagcaacatgggtggaactggaggacattatgttaagtgaaataagccaggctcagaaagacaatactgtattttctcactcatacgtaggagctaaaaaagctgatcttttggctgtagaatggtagttatgagtggatgggaaaggggccatatgaagggaggttggttaatgggtacaaacatacaatttgatagaaagaataagttctggtattcagtagtacagtagggtgatatgttgtatatttcaaaagagctagaagaaaagataatgcaatgttcccaacacaaagaaatgataggccgggcgcagtggatcacttgaacccaagagttcaggaccaacctgggcaacatagtgagaccctgtctctactacaaattttaaaaaaagagccaggcatggtggctcgcacctgtggtctcagatacttgggaggctgaggtgggtggattgcttgagccggggagttggaggctgcagtgagctgtcatcatgccactacactcaagcctgggtgacagattgagaccctgtctcaaaaaagaagaaataataaatattcaaggtgatggagataactaaataccctgatgtgatcattatacactgtatgcatgtat

SEQ ID NO: 3188 - DNA, 1138 bp, Homo sapiens
cagggtgtctaaacatttccatgtctaaaggtgtctttaagaatgggaaaatagtcccccctgcctttcctcttcacacacacagtataccacttctgcagtgttgactctagacccatagccagcagggcatctgctgttaaacctggacgctgctggctgtggctgaaactgagttatctactggacagtgtgtttgtgtcttatagcaatatcagtagttgaatcatgggccatacttcaaatttcagactccctctcccttgtggttttgaattgtcttcatttgttttctaggctgatgaaccaattgcagattatgctgcaatggatgatgtcatgcaaggtaaagatgaatttgttttaggaatctgctgattaggttttagacggaggtgggattttagatattgaagctttagtgtacagtgcttttactttgaaccttgaaaaaagcttccacatattgttacagtagaatacattatcttaaaagatcatagaaaggagggaaagatatctacaaaaacttggaaagctaacctgaggaaactgaaataaatgtgagctctgcctgtggaggaggtcaacaagaagcaaaactaagtcagattgcagtgccccagacaggcacacacaaattagaggcctaggtacctctgaaggtgggaatgaattgtgagcctaaaaagaagataacatgatacttgtttggaaaactgtataagaagcagttagacaactctctacctttcacatccttgtcacttccccatctccacctggacctcagatgggcacccagaattatgtgtttccacacttggaaaaattaaactagaaaggtgggaacgaagcctataccaaataggagaccatctcttagccctttgctcaaattcgggcagcccattacttaccctcccccaggtgggaagggatttctctccagggaaactagtcaagaaaataaccagtggatgtaaaaagtctggttctgtatgatcaagtgagatttctcccagggatgcaaggatgttcaacatatgcaaaccaatacatcacatcagcagaatgaaggacaaaaatcatatgatcatcttaatagacaaagaaaaagcatttgataaaattcaac

SEQ ID NO: 3189 - DNA, 1040 bp, Homo sapiens
tggagtctcgcactgttgcctgtgctggagtgcaatggcactatctcagctcaccacaatgtccgcctcctgggtttaaatgattctcctgccccagcctcctaagtagctgggattataggcgcccaccaccacacccggctaattttttatatttttagtagagacggggtttcactgtgttggccaggctggtctcgaactcctgacctcgtgatccgcccaccgcagcctcccaaagtgctgagattacaggcaggagccaccgcacccggccttttttttttttttttttttgagatggatcctagccttgtcaaccaggctggagtacagtggcacaatctcggctcgctgcaacctccacctcccaggttcaagtgattctcctgcctcagcctcccaagtagctgggattacaggcatgcgccaccactcctggctaattttttgtatctttaatggagacggggtttcacctaggctggtcttgaactcctgatgtcatgatcctcccgccttggccttccaaagtgctgggattataggcgtgagccaccgcatccggcccataaattgtcttttgagaacaggaaatcgtgggaatatggttgatgtaggtggagataagtttcagcttctcaaaaagtcagacccccacattggaggatattttgtactttaaactcatggattttctactcaaagttttatttttaacagatgagatgtttgttttctttctttactactaaaatagtgtagtgaaattgtggatggtgttctccctgaaagaatgaaagtgttacaatagccatctgcaatatctgtgacagggcagaggtatctgggcttgttggcctgtctgcatgttgatactgttacttcatttttaacattgattgagagagtctgaaaagccgtcttgatttgaatcttggtgtgcccaaaataaatgttacttgtggtttcccaaccggtgtaaagggatgtcagcatttgttttccgtggcttattggcgctcataaaataacctcaa

SEQ ID NO: 3190 - DNA, 1042 bp, Homo sapiens
tttgggtttattcccagtgtagatataagcccctggagagtttcaagcaaggtcatgatatgatctgatttatagtttaaaaaaaatcaccctggctatagtgtttggaattgctgtgagggcataacagaaataagagaggtcagttagagcctcttccattgacctgcaaggataggtgaaattgattggatatgtttgggaagtggaggtgttaatacttgcttggattggatttccaagcatttttattatattagggatggctcttgggtagatcctgacccatatctctagatatcttattaatttatttaattccatgctttctgggattaaagacaaaatggaatacattttatttgatgcttgtttccaaacacattttttagaagggtaacttataattatgccctggaggccaagggttctgctttacaagctaaataaactaaggccttcatttcctaatttgccgagaaaatgaagttaatgagtataaatgtctctgtttctccctgtaaaattttcttaaatcttttgttctctggtataaaatattatccaatttagatgtagtttcattattcagtttaataagagtatttcatagtgtttgcaagagagcgcttcttccatctttcgttttctcaattcttaaagagcatgtaactcctgccacttgaatagtttgagaacttgaaaaggcttggcaatcagtgtgctcgggaaggtgtcaagcaccttcgaacttctgcaaaataacatcattgtacaagactgataataataactgctctgcagagacctcttaaatgtatggtgagcacattaaatactacaagaataagtcatagggtaaaaaactaacatgttaaaagagcatagaaaaccgtgaaggcttgattcttgatccactctccagtctataatcccaccatgataaaggtgttcctcgtcttgataaaggttgccggtcccagcccccacatcctccatagcctgccttcctagggtctgacctacttctctttgttgtcct

SEQ ID NO: 3191 - DNA, 1053 bp, Homo sapiens
ggctggacacagcttacaaaatattattttaatgcagtgtgatttcaagattagtcaaatgggaggcaataaagtctgcaggaaatgataacctttgagtgtgggagtagatgtaattttgttaagcagcgcttgccatggcacagaggtcccaggactcctggaatcccatttttgactacttccttccttgcaaggagaaagaaaatgcacggttttagctttgtacgtttgtttttatctcatgatttttttttcaatcacagacctagattaaggacgtaaaattgaggttaatggctacctcctttagaattaaaatgaaatcggaaattcagaagtttttgaaaacaagaaaagagagctagaaataccaaactttagcaaagcaagaaaagcgtacctgtggatttttcttaagtttaagaaataggaaatagataatgactttttttcagctgttttttttttttccaaatatatttttttaaactcaggtgagttatgcatatctgaaaatgaaagaaggcttgtttctaaagaggcttggagcaaactgcagcagtactttccaaaggctcctgagtttccaagttacaaagagtgctgttcacagtgcaaggtactgaacgctactgacatctggggaaatggcatgccacctccctgggttgacttcccaggggaattaacactgtacttctgacgggggtgtagggaggaggcaggtcatgtgctgtcagcaggagacagttgattgcttcattctctttcagattttagaaagagaaggggaagaaaatgaagccttacataagatgattgcaaacgagcaaaagacttctctcccaaatttgttccaggataaaaacagaccgtgtctcagtaactggccagaggtataatgattcccacaaaagaaagaatgcatcttttctttttaaagcccttgccaaattcccagtgagctatttcagaacaacccagaacttctcatattctcatttgtttagttatctaaccaggggatttactccagcctgctattttttg

SEQ ID NO: 3192 - DNA, 1074 bp, Homo sapiens
tgtacgggttcatttattatgctaggcactctgtggaagccaggtgtgttttggaggggcttggtgactgagcttcactagttcggagccccagctggcttgtttcactgggaaattcccaatggcactgtctgctattgggccactaaggtttttccgtaagtatcttttatttgcctgcctggaaaattcagacctgctgtcgctcttcggaagctgtagaaagaagaggacttaggagtccctgcattgaagagtggaaaggtttaattatccctgtctcagcttgtcacttcatttgtctctgtgttttgtgtcccctgttcaggggccttaggttttgttgtcctagaataagcatctagtcttttgtggctagagggggcagtgatctcaagggcagagaaggggactgagcatctaactacatacttcttaaatagactttccatcccttctctcattttttgtaaatccctacctttacttcatgaggacccagtttttgggtctgtgggacagtactgcagtgtagcaaatctggctacttcttgactttcgccaacttagagttaatttttattgtgtctcattaaccttcttttaaacccttataatttttatccctgttgttgcctctgttgtcttcatcattataactgtatgtcttttatatatatatataaataattcctttggtgtggtggttcacatctataacctcagcacttcaagaggctgaggcatttgagagcagcctgggcaacatagtgagaccccacctctatttaaaaaataaaataaaaattaggcaaagtggcacacggctgtagtcctagatgcccaggaaactgaggcaggagcattgcttgagcccaggagattgtggttacagtgagctatgatcacgccactgcactccagcctgggtgacagagtgagatcctgtctctaaaaataaaagtttttttttttttaattctttattgtgatttgatgatgtttcatgaggcacttaaagtaaatgcagttttaaacatcattttaacctggaaagtccttgatttaaatttt

SEQ ID NO: 3193 - DNA, 1040 bp, Homo sapiens
ttgccccagctggagtacagtggtggaatcgtagtgcactacagcctagaacttctaggcttaagcagtcctcccacctcagcttcccaagtagctaggactacaggcacacatcaccatggcttgctaatttttacactttttgtagagacagggtctcactatgttgcccaggctggtctcaaactcctgtcctcaagctaccctccctgcttggcttcccaaagctcttggtggtatgagccactatacctgccactgttcttaattcacaatgaataaaccatgcaataggaagagcgttcacattttagatgattcctaaaacttctttgtgttttaaaccaggcccttcattttgcttttccttttagtgtgctttgaagatcactttcacatgaagatcattatttataattatcagctatatttaacccccccaccttagaacctcagtgatttgattatcatcttgtaaagattgcatgtaaaccttgtcagatactgtatttagatacttttaatgtaatacaacattttgtctctcattgttctttattcagataacagtattgccgtcttggtttctaattgtcttagtaaaataatttagggtatataccaatttgccatattgccaacatttgtgactttggtttagaatgtgtctgtgtttgtgaagtgctgaaaacattttcctaacaggaagtctgtttgaatgaaatatatttcctttcattctttcttgcctgtagtgaaagccctgtgtaaggaatgtgtagtagaacgttgtcgcatattgcgtctgaagaaccaactaaatgaagattataaaactgttaataatctgctgaaagcagcagtaaaggggtatgttgcacagtgtacattgttaatgataaactaagaagttttcaagaggtcataaccaagcatctcgttatttattaaaaataggaagttgggatttttagaagaagggtgataaagtggatggtagagccagatcaaaagtaaattttgcaatgactgcccctgtg

SEQ ID NO: 3194 - DNA, 1063 bp, Homo sapiens
aatatattttaactaaattttaattcaattctgacccttctttgtaatctgttactttaactctgtccaagggttgggattaccctaaataattaaactgaccttaatgtaactggaaatgatttggaaatgaacccatgattcagatctctaaatttataggtctttgttcaaaggtgttgggacctagaaatctattttccaaactttattcacggtttcctgtgtccactgggcaagagaaagggacttaactgggtctaaagtgaaatactcatttgaaccactctttagaactatagagttcaaagatgttatgtgtcaagttagcactgtgcttcctttggctgttttcattcagcatataggaaccttatgttcttagaatatgcttatgttcttagagtatttctctgtgttatttatacttttaccaattatgagctatataattcttttccatttgcagtaaacttatattgtagacagtccacgctgtaaaattatgtagaatctcaaagttaatgagcatggttttgtgctggcaagagaagtcttttgttatgcattttctaaatcttatttttgtgtgtgaacatatttaaaaaaacaaagatcacttaccctaaaatctaagcctcagtaggaacgtgcttttggccctttttatttccattgaaatatacttaaattatctctaggtaaagtgtttcagatgtttttgatgctgtgattgttctagactttataactttccaaagaaaatgtgtcatgttcaaaatccaggtttttttttttctttttaaagaactttgaaccaaaatgtatatttccctgtggtaaatattttaatattttgctttcctcatcaaatgctgaggtttcatatagtccggtatctccagcttgataataggagagttctccctcatttggagttgattatgtccatggcctttggaaagcaatgcttgtagtttactgaatcacaaatactagggaatatatttgaggggcctacttagagtctttttctagtgcagaaacatctgtagtgtaaaaa

SEQ ID NO: 3195 - DNA, 1047 bp, Homo sapiens
attttctcttaccatttcctgtggagagcagattcattttgataatcttctaaaccaaagaattctagtttcaaagaaaatgtggtatatatacacaatggaatactattcaggcttaaatggaaaggatactctatcatgtgtgatcacatggatgaatctggaggacattgtgctatgtgaaacaagccgggctcagaaagacaaatactggcctgggcgcagtggctcatgcctgtaatcccagcactttgggaggccaaggcgggtggatcacccgagtttgggagttcaagaccagcctgaccaacatggagaaacgccgtctctactaaaaatacaaaattagccaggcatggtggcgcatgccagtaatcccagctactcgggaagctgaggcaagggaatcacttgaacctgggaggtggaggttgcagtgagcccagacagcgccattgcgctccagcctgggcaacaagaccaaactccatctcaaaaaaaagacaaatactgcatgatctcatcgatactatatatagaatctaaaaaagtcaaacacgtacaaacagagaagaaaatggtggttaccagaacccagggagtggaggtggtggatggcagaggcgatgaggaatggggaggtgatgttcaaagagtacaaagcttcggttcaacaggacgagtaagttttggagctttattgcatagcatggtgactgcagttaataatgcgttgtgcattttgaaatagctaaaataacagattttaagtgttctcaccacagaaaatggatatattagcttgatttaatcattccatgatgtaaacatatcaaacatcatattgtacccataaatatatgcaaatattatttgtctttttttttttttttttttttttttttgagacggagtcttgccttgttttccaggccggagtgcaatggcatgatctcggctcactgcaacctccgcctcccgggttcaagcagttttcctgcctcagcttcctgagtagctgggattacaggcactcaataccatgct

SEQ ID NO: 3196 - DNA, 1078 bp, Homo sapiens
tgttatccgcctgcctcagcctcccaaagtgctgggattgcaggtgtgagccactgtgtccggccgaaaaggtgtattttcttttaaccttattcccactcatgctctgtaggtaaccaatttcattagtctcttgtttttcctttctgtatttctttttgtacaaaatgagcagaaatatgtacatgtatattttccttatatatttcttacacataacagtatactagagatactcctttgcattttgctttttttacttaataatgtgtcctggatttataaattaccttatatctgttcatagatatctttttcatgctgtgtgtgtgtgtgtgtgtgtgtgtgtgtgtgtgtgtgttttacagttgcatagtactctgccatatagatgtaccatattgtctatttttgggcatttgggtggcttccaatattttgcaattaacagacagtgctgtaatgaataaccttatgagtgagattttgcattgttggaggtatagcctaaggaacagtaaatcctcagaaatgagattgctaggtctaaaggtagttgtctatgtagttttgttagtgactgcatttctaccagcagtatatgcatgctttcttctccacaccctcacaaactgagtgtcttatactttctcagttttgctaatttatagatgagaagtggtatctcattttagttttaatttgtttgtctctcatgaaactatggtcttttaaaaattaaaggttttttttttccccttagacgaaactgcaaaggaaatccgaattgcttggttggtattggtgagcatatttggttaggagaaatagatgaaaatagttttcataacatcgatgatcccaactgtgagaggagaaaaaaggtaaaccatcattttttaagcgattgctatatgctgttttttgtttttgtttttgcttttgttttgggcctgtgatcagaaaactctactgatttcaggtaacctgtgcagctttaagataagcagtagaacttaagactctaagccacttgaattggaacacttcttaatgatatgctttaaaacaggcagct

SEQ ID NO: 3197 - DNA, 1015 bp, Homo sapiens
ctgcttagaattttgatagatgtcaaaagttcataccatttatcctggtcctctagagtgagtgtgcctattaccttatacaaagcatttctattcccagcttccatctgattagcgaaaaatagcatcttattttcatttgccattttttgctggtgacattgagcatctttttaattttattttttagttttatagagataggatctcatgttttgcccaggccggtcttgaactcctgggcccaagaaatcctcagccttggcctcccaaagtgctgggattacaggcgtgagccactgtgtcccttctcctttttatatttacttgccatttgtatttctcctgtgaattgtgtgttctggattgttggtcattttcttactgattttcaagagcttattgaatatttctttcttttttttttttttttttttgagaccgagtctcagtctgttgcccaggctggagtgcagtggtgtgatctcagcttgctgcaacctctgcttcctgggttcaagcgattttcctgcctcagcctcccaagtagctgagactacaggtgcctgccactatgcctgggtaatttttgtatttttgtagagaggggtttcactatgttggccaggctggtcttgaactcctgaccatgtgatccgcctgcctcagcctctcaaagtgttggattacaggcgtgagccatcacgcccggccgaatatttcttttttctttctttttttctttctttctttcttggttttttttttttgagacagagtcttgctctgtttcccaggctggagtgctgtggtgtgatctcagctcactgcaacctttgcctcccagattcgagctattcttttgcttcagcctcccaagtagctgggattacaggtccgtgccaccactcctggctaacatttgtattttcagtagagacggggtttcaccatgttggccaggctggtcttgaatacctgacctcaggtgatccacctgccttggcctctcaaa

SEQ ID NO: 3198 - DNA, 1026 bp, Homo sapiens
tcatctccatcgacccgcccagcagcaccgtgcagcagggccaggatgccagcttcaagtgcctcatccatgacggggcagcccccatcagcctcgagtggaagacccggaaccaggagctggagggtgagccaggctggtgggcaggtgggcaagctgggggcaggcatgggggtgccgtcatccccactgtgcaagggtggggcagaagtctggacgccccacattcatggtgtggccctgagtaaggcccttcccgtctctgtatggcaagagcgctggacccaggagtttccaaggcctttgttactttctgctatctgcgactccatgagctagacacacccaggccggagggattggggaagtgggcccaggggcacaggctggcagcaccaagacacgagaaggaccaggtcaatcctctctcaccctcccccatgcaacctcacagacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacggtgaggggacgttgaccctgtggggctctgccctgtttccagccctgattctcagctcagagcctccaagtttaaatcctccttccaccattgactctgtcttgggcattctccctctctgagcctcagtttccacctcagtgcagtggggagacaggtgcccacccagcagttactaagctggaggccatggcagtgtgggtgagcagcagagccctgcctgtgtgtcagtggttgtcattcctccgcacagggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgca

SEQ ID NO: 3199 - DNA, 1028 bp, Homo sapiens
ggtgttggctaggtgatccctcccagcttggacagtacaggatccaggaatgcattggaaccttttgcaggcaggtttctcttgtgtctcattctccccgggggtctttggagagctcactcacttggtgtgtgagctctggggtggataggactgggagagaaggaagaagtggtacttacacctcgtaagtgcctgatactagcacttaggttgtcctgttgaattctgacggcagccttgtgagggggtcatttttattcccattttacagatgaagacacagaggctcagagaggtcaagtgatttgcccagggccacacagctaggaaactgccaggctaaagtgtccagtcaacagttaacagtggtatggggtggcatgtgcccaacacacatttcctaggatggctttgacttattaataaaatatgatagatatagtagtcatcgcaaaaaactatcaacgtgtctcagagatttgaatacctctgcatccaaacttcacctcccaggctgcctctgacactcagaagtagcccagaaatcctttatttagtggtttcttgatttctgctttggaaaatatggtcagttgtaattatgggtatgtgagagttcagaggagagagagctgcgtgggctggagcgggctggaaaggcttggcaccgaactgggagtggagctgggctggccggcagctgagggggctgagatgggctggggtgggccaagctcacagcctccagggacgtttcctgaagggcctgcagtggggctgtgcaccagggaaattgcaagcctcttcaggactccctccctcccggccctgcacctccccacgggggccctggagcaggccaggctccagttaaggcatgttcagccccagacctttgctccggcctctccacccaggcttcccagggaactgggtaaagggctgtgctatgggacagcgaggccaggcaccctgaggcttgagcagttgacagcatgaggactaagatgaccccagccagcccg

SEQ ID NO: 3200 - DNA, 1124 bp, Homo sapiens
aacagttccagccacgcacggtggctcacgcctgtaatcccagcactttgggaggccaaggctggcggatcactcgaggccaggagttcgagaccagcctggccaacatggtgaaacctcatctctgctaaaaatatgaaaattagctgggtgtggtggtgcatgcctgtaatcccagctacctgggaggctgaagcagtagaatcgcttgaacccgggaggcggcagttgcaatgagccaagattgtgccactgcactccagcctgggcaacagagcgagactctgtctcaaaaaagaaaaaacagttccagtcccttaggagaatttcttatagatcaaatcacaagaaacaaaggcatagctcacttttacggagggcctactgtgtgcagtaatccctttatgttcttataactccgaggatggtccaggcactagcagcccgggcctcaactgggagcttgtcagaaatgcagagtttcaggcccccttggacctactgactcagaatctgcacgccgacaagatctccaagtgactcatgtgctcgttaaagctggagaagggctgctttccgtctgctgtctcatttcatcctgaaaaccacccctggagagatgactgccatagaaactccatcaatgctcatactcttcccagattcttcccttcttccctttctttggtccaggtgggggttcagtgaagaatagggtgtcaaagcccctgacaggactgaagaaagttgagagtattacttgcttttgagactttttttttttttttttgagacagggtcttgctctgtcacccaggctggagtgcagtggcacaatcttggctcactgcaacctccgcctcctgagttcaagcgattctcctgcctcagcctcccaagtagctgggattacaggtgcacaccaccacacccagctaatttttgtatttttagtagagacggggtttcaccatgttggccaggctggtctcaaactcccgacctcaagtgatccgccagccttggttgctcaaagtgctgggattacaggcctgagccactgcgcccagcccctttgagacttaatcagactctcttgtttccattcacctgcaggctcggca

SEQ ID NO: 3201 - DNA, 1954 bp, Homo sapiens
gctgactgaaacccagaagtatgtgtggaactcacttcgcggggagccgccggcctcactgcccagcctggtggcgtcagggctgtgtcaatagcagccttgagaggggtgtggctcgtggctgctggggtggccgggtcgggggtgctgtcatgaaagccctgagaacaaggtggctctttgaggcctgggaatgtgaggcctttgagtcttgctgcccccagaaccactctcccttcccttccatgatgctcatctgtgccaggcctgcaggaacctcagagcatccctggaggcatctgtggcatcctgagatagccttaggaccagctcctagctcctgaccagggcccattccctgagccatgaaggagggtgtcctgttgctctgggttttaggggagtatctggtgcgcaaagccttgcagagtgtgttgaatgaatgaatgaacaaatgatgtatgtgattaagcgttttttaaaattcatttcacaaatatctgtggagcatcttctatgtatctgactgtgttctagatcttttttttttttttgagatggagtcttgatctgttacccaggctagagtgcagtggtatgatctcgccgcactgcaatctctgccccccaggttcaagagattctcctgccttagcctcccaagtagctgggattacaggaacacgccaccacgtccagctaatttttgtatttttagtagagatggagttccaccatgttggccaggttggtcttgaactcctgacctcaagtgatccacccatcttggcctcccaaagcactgggattacaggcgtgagccactgcacccgccctgttctagatcttgaggttaccgcagagaataaaaatgtcagattccttcctctcatgtcacttgcgttatagctagtgcaggaagacagacaataaatgaaatacatcaggtggtgataagtgctcagaagaaaaaataaaacagggaagagggcagtgagtgatgaggcggggtaggtagggtggggtggtaggaaaagcctctgataagataaatttgaactgaaggagacctgaagtaagtgagcgggtgagcctcgcagatatcaatggaaagggcattccaggcagagggcacagctagtgcagaggcccagaggtgggagtgtccttggcatgtctgtggaaaagcaaggaggcccgtggggctggagcagcatcagtgagggggagcatggtggatgcagcaggcaggggggtggcagagggtgatcagcagagctttggccatgggaaggaccttggatttgcgtctgagtgaattgagaagtcactgaaggggcccggtgttccataggattgctttggctgctgtgtggagaggagcacggggagggtccagagcaaaggcaaggaggccgtgacccaggacagacgatgggagctcaagctaggaccacggaggtgggagatggttgaatccccagtacattttgaagatgggtcaccaggatttgctagtgggttggatgtggggcgggacagaaagagaagagtccgggatgcctccacagtctttggcttcagcatcccgaaggatggagctgccactacctgagatgggaaagttccaggaggagtgggcaggaggtggagtccagaattctcagaacagttaatttatttgtgtcttctcttacgatctcttgtttggacaataaaaattcctaaaaaaaaaaaaaaaaaaaccggcaggtgggccaggagtggtggctcacacctgtaatccccacactttgggagaccaaggtaggaggatcacttgagcccaggaggtggaggttgcagtgaaccatgatcttgccactgcgctccagcctgggtgatagaacgcgatcctgtctcttaaaaaaaaaaaagaaaaaagaatggcaagtgatggaggggacagcatggg

SEQ ID NO: 3202 - DNA, 1065 bp, Homo sapiens
aacaaacaataaaaagtttttcggggccaggcgcggtggcacacgccagtaatcccaggactttgggaggccgaggcgagcggatcatgaggtcaggagttcaagatcagcctggccagcatagtgaaaccctgtctctactaaaaatgcaaaaagttagccaggcatggtggcacgtacctgtagtcccagctactccggaggctgaggcaggagaatggcgttaacccgggaggcggagcttgcagtgagccgagatcgcgccactgcactccagcctgggcgacagagcaagactctgtctcaaaaaaaaaaaaagagggcatcacactttgttgcccaggctggtctcaaactcctggcctcaagcgatcctctcgcctcggtctcctaaagtgttgggatgacaggcataagccatcatgcctggcctgtctctgaagtcttacagacccaagtatgagtctctgggctgcggtttctggctgtgtgatctggggcgagttcctctctctgagccttagtttccaaatctgtacaatggggttgaggagtttgttgcaagtcaaaaatgagatcaattcctagcccaggctcccagcacaccttggaccctctttgcctgctacccttgctctcatctgcccttcagtttggtccggagccagtggcttatggggaagggttgggcacagcagcagggtgagatgggccttagggagctccaggcttccccgggacgggggacaggaccacaggaagctgatctgtgattaagtgtgggtgtaatttcagctgttgggaggtgaggaggcttgctggaggagggggctgggcctgggtgactcggcaggccttggcctgctgacccctttagggcggccctgcaggggacaggcgtcttgagggagcctcggtggtgattaaggtgttttccagggcctaggagggaagtcgctgagatacctgtttcctgcctcagctggatttcctcactggggaggctgccagctgaactgcaggagcctccccttcctggcggtccctcagccctcctccacgcag

SEQ ID NO: 3203 - DNA, 1110 bp, Homo sapiens
agaaactagctcactcaaggctgccatccttcacttgcagcctccctgccattctccttcactggttggcaaccttgagagttcaaagaaaatcaacctctgtggtggtcaactaaaggtattaggaaactaagtctgtggctcttctctgctgatggaaacagaagggcgccaagccatgcctaaaaagatctcgccaataattcttgtctttgagtgttggagccctggattctggtgctatagctcctggtgccaaagtctggatctttccacatttcagcagcaccaacatctgctgctactcaaaatgtcctgttgaagagggacagctgtgatgcccttttgctggggctgccatcttgaaatctgagtgcaataggatttgcttgtaacagttatttcaggatattttgtttctttaatctgcacactttctagatagattttatttttaagtgtcctcagcattgcagaaaataacattgtaatagcaagtaaaggctggaggctgtttctctgggcttcaaatggctggcaaggctggctctcaaatcccaaagttgggaggcatgtttctgaaaagcaactgaggtgtgactgtttggacccaggcctcatcatcaggggtcctggaggaagcctccaagtagaggggagacctggtagttgaatagttgtttaatcaagccaaatagtcccactgcccccggtcaacaaacccacttttatgacagttttcttccgcagcttggctcttaaattttactggcaggtgtatggttgttggagggttcctagtgagttgggggacctggcaatagagctgcttggttggaggaagtgaagctggcttagtaccagcagctgatctcttccacgtgctgctgctttttttgccactctgatactaaaccagagaaagctgcaggtggataaagaagctgtggctgttttttgcttttgggtggcaatgagaaagagtcacagtgtgggttaaagggatctgcagtggggccaaggatgccaccccaccctcagctgtaggcaagcttgcacataaataacccccgtcagtggagtgttcgggatgcagggggcactatagtg

SEQ ID NO: 3204 - DNA, 1029 bp, Homo sapiens
aatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagagaatgaaacaagaaacaaatcagaaaatgaaaagaaccgcaatcaggaagacaacaaagtcaaagaccttaaccaagagattgagaaacttaagacacaaatcaaacactttgaatcgttggaagaagagcttaagaaaatgaagtccaaaaataacgaccttcaggataattacctaagtgaacaaaataaaaacaaattattagccagccaactggaggagataaagctac

SEQ ID NO: 3205 - DNA, 1032 bp, Homo sapiens
agccataccagtggggatgaagtgtcatctcatttttttttttgagatggagtttcactcttgtcgcccaggctggagtgcagtggcgcaatcttggctcattgcaacctctgccttccgagttcaagcagttctcctgcctcagcctcctgagtagcagagattacaggtgcctaccaccacacccggctaatttttgtatttttagtggaggtggggtttcgacatgttggccaggctggttttgaactcctgacctcaggtaatccacctgcctcagcctcccaaagtgccgggattacaggtgtgagccaccatgcctcgcctcactttggttttgatttgcagtttcctaacagttaatgatgttgagcatcttttcatatgcttattggccattcgtatatcttctttgaagaaatgcctgtgcaaatcctttgcccatttttagttggatattttttattattgagtcgtaagatctctgtatctctctgtatattctggatactcgtctcttactggatataggatttggaaatactttctatgtgggtttttttatttaattgcctagagttcattgcccatgccatgtataaagatgatatagtggaactagaggttctgacagagcatatgttgactgaagtgattgccatatgacagatagcaccattgttgttatgcagttctagaagcctttgattacaagaaaggaagtaagcatttaactgggaactggggaacttttattttatttttttgagatggagtcttgctctgtcgcccaggctggagtgcagtggcacgatctcggctcactgcaagctccgcctcccgggttcatgccattctcccgtctcagcctccctgagtagctgggactacaggcacccaccaccacgcccggctacttttttgtatttttagtatttttagtagagacagggtttcactgtgttagccaggatggtctcgatctcctgatctcgtgatccacccgcctcggcctcccaaagtgctgggatt

SEQ ID NO: 3206 - DNA, 1050 bp, Homo sapiens
ctattgtatagatgtattatagtttgtttattgaccagttgaggagcatttgggttgtgtgtgtgtgtgatagagtctcactctgttgcccaggcgggggctgcagcctcaacctcccaggctcaatgattctcctacctcagcctcctgagtagctgagatgactacaggtgtgcaccaccgtttgtgggtaatatttttgatttctagtagagtcgaggtctcactatgtcactcaggctggtctcgaactcccaaagtgccatgactggctgcgactctgtcttaaaaacaaaacaaaacaaaacaaaacaaaaacaggtaagagaaagggcatcatctcagattaaaggggtttttcatgttgaataatttagccttatgaaaaatttactattcttgggtgaaaataccattgactaaaatgactgccctaggaggtctgttgttatgctaatagtgtatgttgaaatgacaggttacagtttactgggattagtttaggctgaagtggtctgtgagggcttcatgcaggcagttagactagagtttttcagtggtggatggatagaggttgaagaggcagaaaggaaagagaaggttttgtttttcttttactttttaaatttttttcttttgtatttgagaaagttaaggatgagggaatggttttctaggcaagagcaaatcaagggcaaagatagagattagacgtattattgatgggaactgggaatacttgtctggtctagtaatagagtttagattatggactaggaaggagataagatagtgaagtaatgctcattgagattatgaacagtcttaacagtcatactgaggaatttggacctgatcttgctaacatttgggaatcattgaaggtttacaagttgagcagtgacttgatgaacttggaattatgacattaatcaagaagtgttgtatagattatctgaaaggaagccagttaaggaatttttttaaagaaataaaattatgctgcaggcatgaatttagcaagtggaatgggaagaaaaaggaatatat

SEQ ID NO: 3207 - DNA, 2124 bp, Homo sapiens
aattctgaaatatttggtatatttcttttgaatttgtctttagagcatattacgtgttcttaattctggtaagtcatcattgtgcaggtgcttatatttaacttttggagataggaaagtctggtgaaggaagtgagtggtcagcattgtttttggccacaaatgaaatgttattctaaaaggtggagactagcattttgtgtgtgtgtgaggtttgtctttgagaatcctataaatggcacgtcaaaaaagttttgagtcttggccacatgattggaagatgcgcccagtcatcccaatccttggaaggtcttacctcccaagatggcgccattgaataacagcacttgttttcagtgctgaaacctctataaaacaaatcatggtatgaatatgacccatattacaattaaattggaattctcttaatgaaaacattaggttgtattaatgtcactgtgattttatttataacgttaataaattaatattgttaaattttgtctaagaaaggaacatgtttagtctgctgacaggcaaatctgtgtaggaacagattcgaactgaagtataattaaagggtgaaatgtatttttctggcccactttccaatgctttattttttgtttttattttttgagacagtctcgctctgttgcccaggctggagtgcagtggcatgatctcggctcactgcaacttctgcctcctgggttcaagcgattctcctgcctcagcctccccagtagctgggattacaggctcatgccaccatgcctggctaatttttgtatttttagtagagacagggtttcaccatgttggccaggctggtctcgaactacgacctcaagtgattcacctgccttggcctcccaaagtgctgggattacaggtgtgagctaccgtgcctggccggctttatttgcataggctttctacagatgctgaagaactcaaatagaaaaatggtatcatttaccttggtctgacagcatttttctgtttctaaacataaatctctgtttttatctagtttcaagttaactggtaacgttaactgttgagataaagttaatttttggttaagtcctggaacagctttatcaaaaatgtgctgttttcccaattatctgcgggtatttatctgatttaggccattttagtgattcaccagtgaatgagcagctcatttaagtgttaatttttttttagatggagtttcactcttgttgcccaggctggagtgagtgcaatggcacgatcttggctctcgggttcaagtgattccctcatctcagccttccgagtagctgggattacaggcacccgccaccacgcctggcccatttaagtttataattcagatattttgaagaattcttagtcattgaggactaatgatgaaaccagttgctgacttctatatgacagctacagtacttaagtaccttttatgtgtttatttaatctcttttcagcaacccattagggtagatattaatgaggataactattattatcctcattttgcagaggaaaaaactaagtccctaagatgtgagatcggtttgacccaaggtcagtgccaagctaggatttgaccttgagtttactcttgaacattacattgttttaacacataatgattttatgaactgtgtactgccctgtaagtaaatgaggtcaacattgtcttatgtttcctaggattgaaagaaagccatttttagatcttgatggacttaaagattcattaaatggaagactttacagaagtatacagaaactagttaaatatagaagattcttatagagatatttagaaaatgtagttagggtgtgtaaacaaagtaatggtccctggtagatttaaatcaggaataccagtttttatgcttcttgccacagctgtaatggagtataatatgatatattcttagtgtaatttgataaaattagacattttccaacatatgcgaaaatattttctgtaggaacttgaggacttatcattatgttagaattttgttttgagactagatcctagggcagttttaaagtgactaccagaatcttaaagacatgtgatggaaaaatagatgggaggacagttaatggagc

SEQ ID NO: 3208 - DNA, 1029 bp, Homo sapiens
cacacaaatgatttaatacattgtagtgcatgttgggatagagcaaaggagggcagattcaaggaagacttccaggagacgagtcctgaactcaatctcttaattcattcaactaagatttaatgtaggagatctagattctgtgggggttcagatgaggtagggattacttctgttttatatgaggtaggatgacaatgggggtaggtggtagtagaaattagaatatttctttgggatgatacttgaagtaagccaggattttagatacagaggtatatgagaagggtgtgttctaagatgataaagcagaaggaactaaaatacagaagtcaaatggcacgacgtataccagctgtatttactgaaatatgcctagaggtgctgtgttaagcctcaggtacacaaaaacataaaacatgaccctgccttcataattagaactcaagtgagatgtttgaagtgtaatacaatgtgatttgtatgaaaaatcacattgtgtgtgtggtaggaggtatagattagtttttaagaaggcgtaattttcttgactggtggttggttctgtttggtttgactcatgggtgcctgaaataaaaggagtaggaaatacagatgtaaaggtaagttgggctgttatttactgttgtttactttggcagaaatggtctaaaaaactaagcatgtgacgagtaatgagaggggagcagcaggagtctgagtttgggttccttttcttccattagttcctgtgtgactctcccttgtgatcattgatctttactggaggtacagagtacctggtctggtcctcagttttaagaaaatgaattacctagtatactccaaggcccaacttctgtaccccatagttggaaattgtcagctttcctacaaagattgatttatgagctgctctttaaagcaacttcttataacattttcaaccttttgactgttcacaattaagagtccttcaatcttttcccatcccaatagatgaaatggcaagacaaaatttccatgagt

SEQ ID NO: 3209 - DNA, 1024 bp, Homo sapiens
agtgtttctctgatctagctactcacaattccattcccaaagtagtgacctagttctgtcacttgggtttcaaagggagttgaagtgtcactgagtgagtacagcaaacctgtttaatgatttataggaagcaaataaaaagaattttgtttgctaacctagaagtatatcagattttggtttcaatttataattttgcaaaatataaagacatttcctggctaactccatccagatgaattattcagtattttttctcctatcttaatgaagttaatttgaatgctaatttcctataaccaagaaaacagttgaattaaataacccttatcttttaaacttaaagcttatactactaataatcatttaacattcacttccttttttctgacttaattggtaggtaaataaaatacttcaaatttgattggcaaattggaaaatcacttagaacaatctgctagtattttttattccctttgttttttcctttacacatttgtactgcaaaataaatcaaggacaaagactcacactgaattgatcaacttgtgtttggtcttcatgggaattacatcttttttcccctcaacatttattaaaggaacatacagaatttcagactatagcaaactaatacctttagcttgactaagagttgattttcgttaaggaacagaacttgtaatttatttcgacatactttaatgtatgactcatccctgttaaagttgtgagactcaaaactacgcccaaatcacttaattttatgtccttccctgtttactgtgtctgaccttcaagatttcgtgactgatgctgaaatggaagccaaccactgcagaaatttgggggaaaatgagatctgaagaatacaaggggaagtaggaattcatttctagcatttccaaacctgcttaatcgtgtctgctccaccacagtcagaggaaaagactgagttcatggaaattaccagctaagccttacatctgtctttaatgtttttaggaagtatactgaaaag

SEQ ID NO: 3210 - DNA, 1052 bp, Homo sapiens
ctgccttagacggagtctgttagacgtgccttcttatggtgtttatgccttagctgtctcttcctgaggaaatgtatgaataagaaaggcttcttgatattttgaccttagacttgatatctaatgcaacacccttcctcccccatttataggaatagtactcattcattgagtactattatatgccagacacacgacgctaggtggtttgtattatctttatatccacaataaccttgatttaggtagtagtatccctgttttactgtgagaaaactgaggcccagaaaggttaagtgataattgtatggctagtttgtgataactatagatactacaactaaaaatttacctttctggttcttttttttcattcttacctttctctagcaatacatatttagctctttagagctagttacaatatattttttatgttagacttactgtgtggggagttttgaatttaaaaactaaaaaaaaaaaacaccagaaggtttattctaaaggtttaaatttttaaaatttaatctgctgttgtgtgcttctgttacccctgaccttagttagcattgcaggatactttcttttccatattttgtgattgatatatgtgtgattctttgtatgtacaaaagcttgagcttgagttttttagaggaaaggaataaaataaattaagttggttgaattaagtatgtcttggtggatttggttatccccacagcaaacttgagcattcagtttacccatgattaagggtgctgatactatatttaagggcgttctgccttccatctcttttctaatatcaatagtattaattgatgccaggcaagaggagtgctgccatatttgggtcagctacttcgtcaagagtattttgcagaatgtacctgaagctattctgaaagttaaatatcattagatacattgtcaaaccctgaagctgaaattccagccattcagggagcccctcagggagatcactgcttttcccttgcaaaaataaaaatagtgtataaaatactatttaaatatatactcttatc

SEQ ID NO: 3211 - DNA, 1212 bp, Homo sapiens
catcattcaaaaatgctgctcaaacttgaagtgggtaggaatttctggggattttgattaagatgcagattctgactcattaaatctgagatgggcaagagtctgcatttctgacaagctcataggtgatgccagtgttcctgactacactttcagtagcagagttacagattatcccacattttgggggattttggagaatgatcttagtagaaaagataacaacagatgtttgcagtgatttgcctggatgtagttggtctgagatttaaaactatgataaatgttgccacaaatgtttaatagtgtttgggaccccaaggaaagattaggaacattgtctgcaaaaaaatgaaatgaatttagaaaaacaggctttaatagtttcaaggaattgctagaaaataatgggaaggcatatgcagaaaagatcaggatgctgagaaaatgtcatggcatgtttatttaggaattagatctgaaaacagttacatgagttatagaaaaaataaagctcagaaaggaaggattgataggttactaaaaatgcctatgtggttttatttttggaatctgtaactttgtctccccaggaaggttttcactaactagttcaaagtaaatcttgggccaagtgtggtggctcattcctgtaatcccagcacttttggaggccagggcaggtggatcacttgaggtcaggcgggcgtgcacctgtacctagctacttgggaggctgagacaggagaatcacttaaaaccgggaggcagaggttgcactgaggcgagatcgcaccactgccctccagcctgggcgagagagtgagtctctgtctcaaaaaaacaaccaactaaccaacacccccgccaccaaaaaaaaaaaaatcaaagtaaatcttgggtagtaagtgaaagcagactaatgaagaaaattgttaaaggtgactttttttttttttttgagatggagtctcgctctgtcaccgaggctggagtgcgatggtgcgatcttggctcactacaacgtccgcttcccgggttcaagtgattctactgcctcagcctcctgagtagctgggattacaggcacatgccaccatgcccggctaatttttgtatttttagtaagagatggggttttgccatgttggtcagactgatcttgagctcctgacctcgtgaacccctcacctcggccttccaaagtgctgg

SEQ ID NO: 3212 - DNA, 1053 bp, Homo sapiens
aggaagttttaaggtaagcagtaggaatattcatgtaattctgatgagtttatgtaagttaaggaaaatgcaatgccagtttgttgactttaaacactaaaaacaaaatacattttgtggaaccaacaaaggagacattctggggaaaaacttaaattgctcaaatttaaataagggctctcactttatatagtagatttgtcaggatcccatgaacattgcttttcttgatttctcacatatgagggttgggcaaaagggacttctctagcctcttcgataatgtaggtagacttgtacttagtgaatcccattataatgttaggtactatgttctaagactatttctataattggactgaaggctcctgcaaacataaattgctgatatggatatagtaacataagaaataccaaaatagggacatttgcaagaccttttccatttaatcatcagtttaataaaaatcatgcttttggtacagtgttcatgtaccataactgtattggaatatttgtacgatgttaaatatttttaataaaatttaacatgttcaaaatgttgtgttggtgattttgggtggggtgtgatgggtttgattgtgcaaaacagatttagtagttatgtgatttaggcttttgtagttaaatggagtttctgtcttcaaatttagtactagatactgtacctgttctaaggaaggtagtgaaggagtaggatagtaaaaatgaaaaggctgaactccccagagatttattaaattgccaggaagcttgactgaggttagaactagatctacaggtggcagataggaatattggctgtggcataacaggctgccaatagcgtttttgtgaggaaattgtggcattttggaaatgatcctagagaatctacagaggtgggcaaacgtaaacacttgtacagtgctttcagtaggctttttattgccccagtgcccttgtgccctcgatgtgacatgccacaagtgaaggagaagtggtgaggggattatttgaggaaagctttgttggacagtttggatgcatcat

SEQ ID NO: 3213 - DNA, 1062 bp, Homo sapiens
ccttgtagaaaaataggactttaatattaaattattttgttcttaataggaacatataataacacttcacttacttttaaattggtagcagatcagcaggaaaggcctgcaagtatgaagtaatgaaatactcagggtatattttaagtgagcaaaatagacaccttataatcttaaaaagtctcttggagagacaataaatttgctttaactgtcatttcagtctagtattatattttctatattttgttggatagattaacatataatgcatcttaaagagatatttattgcacactaattttagtgaaaacaagaagacattgatagaatggagggcttaaacaccaaagatactatttttaaaaatcttccaaagtaatcttaacactgtaaaatgaaactttaaaaagttttagcagtttgacaataatggcctcaatttagagatatgttgagacaatgactttgggtcaagaggaaattacatagctgaaatattaagaccttgaacatagcagaaacataaacctatgaacaacttgtgttttgtgtgaaagctagggtagctgataggattagcagatattggtagaattaagagtcaatatttaaattattgctaaagattaaaatccctcatcttatagtttgtaggggattccatgatggtaaggtatagattgaaattaaatttagtaactaggcatttctgaccataccatataaaaaataattgtaatatggtataaacactgattaaaagtaattatggattttcatgcctgaagaaccttctcagtattcttacagcactgtatcttctttattggttgagaatatcagtctagaaagactttcctagatgttaaatgtgctagtcagtgtcatgaatataaacccttacttgtaagtttgctatagactagttgtacaacactagaatgaaattatgtaatacttttaagaattgtagtgattgcagggttgtgttaaggtaacattttatgcatgtgtcagtgacagaaaggatcagggtataaaacttagcactaaatagca

SEQ ID NO: 3214 - DNA, 1054 bp, Homo sapiens
agacagatccagttgtttttcttatgcccatgtatgcaagtaaagacaccaaacattctttaaatgctgcttttaaactttgaaagtacaatttgaagttgtaactatacatctaattagacttaagtaaaaccctgatttttttcctggaaagaacaaaatctacaaataaaatttgagttgtttgtatttcttaattaggtgttacaagctacaaagttgtcataaagaatgctaagaatggggatagaaatgattctgagaaaacaaaccctcgcaaaaacataagattaaaacttgggttccatgtcaaaatcctttcctttaattgcaaattatattttgaattttaaagtggccacctcctcctctgtccttttcactaattaaaaatatatttgcagaggtaccctctaatatttggtttataggttttgtggctattttaaattgtaaagcataatcctataaacattaaaactcaagagcttttcttctttcatgtcttgtaaattaacactgtagcagcattcagagaaaatagattcagagctcaacttttcacataaataaatctaacagtgtaatatataaacctgaaaaatgtcagttgagggaggtctttattctagattggcatttttttttttttaaattaggtacaaattatgagtgtaaggaatttggtttcctgctctcctgtctttccatcttttttgttccccaagctaattgatttggctttatttatgagcctgttacagtaaagtgtgtgttgggaaatatattgaggtatagagctattctttgtaggtaccctggtgagaccgatacaaatatgcccctccccataatggaatactaatttttatttgatcactcatttatagcagttgcttaaatgtatgtatttatatgaaggtattttaatttttaagagcaaaaaagttctaataagttgccagatttctaataaatgcaggtttatttggtgaaaagataaggaaaatgagttatgattctgtagtttttttaaaatgagttcagcataatt

SEQ ID NO: 3215 - DNA, 1260 bp, Homo sapiens
attatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacattacctatttcaaattcaattgtgtcctaaaacattattttattcgtaatccttgcaaggaatattgttttcaaagtataactgcctatgtgagtgatcaaattcatgcaaaatttcttgtt

SEQ ID NO: 3216 - DNA, 2108 bp, Homo sapiens
ttcatagatcctatatcctgagaaaggagataagaccaagaatataaaaaataaaaattaaaggaatatttagacattgtgataagacactgaagcaggaaatacaggatatttagctagagaatagctactatccctgtttccatggttttggaagacttttctgataagatgacatgtcaaccagcacctgaaggatgaagaggttgtagcatacaaagagcaaaaggaagtgcattccaagacagcaacacgtgccaaggttccaaggcaagaaagaagtcagtatattacagtaactgaggaggccagtattattaaaaggtagaattaggagtagagttgtatgaaatgaagtaggcagggcttctgtaggccatgtaaggagttgggtttttattgtatatataatgagaaggtatttaaaggttttaagcaggaaataacacctatttcttgtttatgggatattattcctagcgctctgtggataggggcttggagagaaggggtgtgagtggaagctgataaattagttgaagctgtcatactagtacagatacaggattagactagggtaatagcagtggagatagaaagaagtaaatgagtttggaattggataggagagatgaaggaagaaatcaagaatggctaaccaatttctggcttcagaaccaggtggatggcactgtttattagataggaagtctagggaaggcagattttggccatggtggttcagttttggaaaagttaaatttgcaatgtctaagacatcaaagaggatacatcgggtaagaacgtaggcacatctagagcttagagaagtctggggtaggaaaaaaatctaagtatttataagggtataggtaacatttaaaagtagggctagctgacattatttagaaagaacacatacggagagataagggcaaaggactaagaccagaggaacactaatatttagtgatcacttccattcttggtaaaaatagtaacttttaagttagcttcaaggaagatttttggccatgattagttgtcaaaagttagttctcttgggtttatattactaattttgtttttaagatccttgttagtgctttaataaagtcatgttatatcaaacgctctaaaacattgtagcatgttaaatgtcagaatatagtagatttgttgtatatggctgtaccttcagaacccctaaaattaaaaaggaacatcaaatactgtcccaaaccccatatctaattatgttgatctaattgtctacaaaattagtgactcatgttgaggctgcttcacttatattttgctcatcgtcaagtggatttaggtctgcctaatcgctagatgtgtggtggatgcttttggcttatatatctggctgttggtttaacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaatacagttgcttggaatgggcatagggtcatcatttaaattttgtactcagaataaagctcaaatattttgagttttatgataaatagaaattgtagctttagacttcaactgtttggcaaggagcggctttaacactaaagttaacagcctgtcttggtatccaggaatttccattaacaatcccttttcctgcagattaaatgtgcaaaaggaactgaaatgaaattccttcaattaagtagtcccatacacactgggtgtttgtttagtgctaggcactgtgagggatagaggttttttttttttttaaaagtcctgagtaaagagagaagtaatgttttggagattataagttataatcttcattgactatattatgactttattacttggccatgaattatgttttatttagatttatagctaatttttctttttttaagctttttttgtagtttttatttttaaaaatattttatttattattatta

SEQ ID NO: 3217 - DNA, 1029 bp, Homo sapiens
cacctgtaatcccagtactttggagggccaagaaaggaacaggaagatcacttgagtccaggagtttgagaccaccctgagcatcatagtgagagcctctctcttcccccaaccgccacccccagatattagctgggcatagtggcaagagcctctggtcccagctacttgagaggctgaggtgggaggattacttgagtctgggagtgtgaggatatagtgagccatgatcatgccactgcgctgcagcctgggcgacaaggtgagaccctgtctcaaaaacaaaccaaacatttatcagtgaaaggaaataaatataatacaatctaaagtaaggggtgttttgttgtgttttgtttttggattgtttggagacaggaaggagccagtgggaagggaaggatggtactgagcaaaatatgagagttgaaggaataacgatttgcagttatttccagaaagtggtaagaagaaatgggcttatttattgtggctaaggagttaaccttagaaaggaggtagatctctttctctgaggtgcgatagaagtgaaagtagacattgtgagaggtaagaatatgaagaaaccaatgactttctcaggtgatatccttagaatgaggtttagtgaatgaggattggggaccttaaggaggtagaagaattgcaataactattgtgtgagaatcatgccaaggagtcaaaagaatacctcaagttttaccagatagcagtgaaagtgagtcttgattattttggaaaggattatctctagatagtacatctgttgtagagcttaacttcagaaacttaatgtccataataatgtcggcatattttggattggattgctattattacttctatatttacctattattccagctatttttcagactgtgaaatggtgatgtagatgagtttcactagaaaatttgtcatgcaaatactaattttactcattcagactttgtggattacaaatgttttaatataaaattttttgttttttttttgagatggagtctc

SEQ ID NO: 3218 - DNA, 1028 bp, Homo sapiens
ttgtttacttttgtctgtctctctcagtagaatataaacttcatgaatgcctagaccttgtctgtggtagtcactatatttctagaatctagaaaaatatatggcacatgagtccaaggtatatctaattacttgtctcttgaaagatttgtattatacaagttctgagtagggtgggagccatgtgtttgtataggctaggcatttacgtggagcaacttcaagcagatactttaaagattaattggatatgggtggtaatgggaggaattgaaaacatctgagatgtctgtttatggaagtagttcctcagtcacctggaggtgggggctaggaggggagagaaacagaaattatattcttctaaaggtagacgggggcaatcagaggagccagttgacaaggctgggttttaatcattttgatttttagaaaaaatcatttgttacaaacatgtcttcatcatagatttcaaggtataaagatgagattggtattctgaatacttcaggtaagaaaaggttttgacggtggtagttgcatcaccagtgttaatacttgtagagaaggcaaggatgatgagaactgagggggaaaaatacttttatttttcttcctgagacagtttcactcttgtcacccaggctggggtgcaatggcgcgatctcagctcgctgcaacctccgcctctcaggttcaagcaattatcctgcctcagcctcccgagtggctggaattacaggtgcctgccaccatgcctggccaatttttgtatttttagtagagatggggtttcaccatgttggccaggctggtcttgaactcctgacctcaagtattccgcccgtctcagcctcccaaagtgctgggattacaggcataagtcactgtgcccggcctggaaaaagacttgaatttggttattagaagtttattagtgacatctgggtatacagctcgagttagaggaagaagccaattatagagggttaaagagaacatagatgctgtgtgcttttctcagtatg

SEQ ID NO: 3219 - DNA, 1074 bp, Homo sapiens
ctgggattacaggcgtgagtcaccatgtctggcctaataaactcggagataaccaattcgaaacaaatagttgatatgttaattgtaaaacacatacgcattctcttagattgcattgttcctttaggagaaagatgcattcttctgtatgttaaatgttgttgtatacagcaaatatgattccagcaaaatccctatatgtgatcactagcctaaaaccactcctgtcaagcaatcactttcagcaaagtcctaatggaaagtttcagatttctctcataaagttaaagttcatgagattgtgcaagtacttgttgacaaagttttgaaaactcaggaaaagtaggtttttaatgtgttgctagtagatataataaattggttttaattgtgatttttgatgttgtgaggtttggattttgttcttttatatgttctttcagtcatcattaaacatttttaggtcttgattgaggaggttgaagttagagtcagtgcctgagactgtgcagtattaaaattatgagaggactatgatatctcatttttgggtaaaatctgtaaattaacccattagatgagcactcattaacagacattgttgctaagtattgttctgagatgagaaatatgcaaggatgataggtagtaattttgaaatatattttttagtgtgtctgagctctcagacctactctagttgtagtatttttgtattcttcagctagtattgttaagctgctttgggaagcaagttctgtttttgtttttgtttttttgagatggagtctcactctgtcgcccaggctggagtgtaatggcacgatctcggctcactgcaacctccgcctcccaggttcaagcgatcctcctgcctgagcctcccaagtagctgggactgcaagcatgcaccaccatgctcagctaatttttgtatttttaggagagacggggtttcaccatgttggccaggctggtctcaaactcttgacctcatgatccacccgcctcggcctcccaaagtgctgggattacaggagtgagcaacctcgcctggccaagttctgtttgtac

SEQ ID NO: 3220 - DNA, 1019 bp, Homo sapiens
gcgggtggatcacgaggtcaggagatcgagaccatcctggctaacaacggtgaggccacctgtctactaaaaatacaaaaaattagccgggtgtggtggcaggcgcctgtagtcccagctacttgggaggctgaggcaggagaatggcgtgaacccgggaggcggagcttgcagtgagccaagatcgcgccactgcactccagcctgagcgacagagcgagactccgtctcaaaaaaaaaaaaccaaaaaaactgaagtgtaaatttctcttttctaggtagattgtgtttctttgtttaccattgtatcttttcttctctaagctctttatatagatgttgcctcaattataacataaattcctgagagcaaggagattatcttcttttctatgattgctcttaatacctaatagaatgtaaggaaggttggtaatcaggaaacacaagattttacttatttttcggaacctgactatacttatttggtaattgccaaatatttttagtctgtactgtatgattcttgtctgattacctgattcttgtggagcttatgatatggcaggagtacaaaccagaaggatcaaacaaaatcaagcttaaatgatggaactttaagtacactagaggctgggtatggtggctcattcctgtaatcccagcactttgggaggccaagtcgggtggatcacgagatcaggagattgagaccatcctggctaacacggtgaaaccctgtctttactaaaaatacaaaaaattagccgggcgttgtggcgggtgcctgtagtcccagctgctcgggaggctgaggcaggaaaagggcgtgaacctgggaggcggagcttgcagtgagccgagatcgcgctactgcactccagcctgggtgacacagcgagactccgtctcaaaaaaaaaaaaaaaaaaaagtacactagaaagacagtgggggctgggcacagtggctcacacctgtactcctagcactttgggaggccaagacaggcggatctcat

SEQ ID NO: 3221 - DNA, 1035 bp, Homo sapiens
gatgaggtcaaatgcctctttccatgtttcctagaaagtttcactttttttttttttgagacggagtcttgctctgtcgcccaggctggagtagcggcgcagtcttggatcactgcaagctccacctcccaagttcatgccattctcctgcctcagcctcccaagtagctgggattacagccatgcaccaccacacccagctaattatttgtatttttaggaaagatagggtttcactgtgttggccagattggtctcgatctcctgaccttgtgatccgcccacctcggccttcaaagtgctgggattacagacgtgagccaccacgcccagctgaaagtttcacttttcaaaactagtgtttagaaatgaaataatttagaggaattacataagaaggataattttggggatcgacactcaattgcatgtttaatgaaaagccctaattcatactcttcctcattccctcttttgtggccatgaatgacgtatatttattgatgcttcgctggtagtttcttggattgatccagtaatgtctcttggttcagttattttccagccactttgtttcttttctcttgataaaaaggttataacttgataaaaagttgttataactgctttcctccttttgaatattcagttacctcagtttctttatttataaaatggggatagtaatagtgactaccttacagagttattgtaaggagtaaatgaattaacatatataaagcacttagaataatgcctggaatgtagcaagaactatataaccatgaaccattattattattaccattttattacttagataaacagctttgaaaaggtaaatatacagcttttaatgaaagaccagtgaacctaattccttagttaaatggatactcgtgtcttgctgtagtgacatacttttcttttttttttttttttttgagacagagtctcactctgtggcccaggctggagtgctggagtgcagtagcgccatctcagctcatctcagctcacttcaacctctgtctc

SEQ ID NO: 3222 - DNA, 1042 bp, Homo sapiens
atctgctggtagcatttaccctagccagcttttaatcttgtgcaagccattttccttctctggatctcagcttcatcatctgtaaaatggtccctgttctgagagagactgttatctctcagaaaataaacagtgtgactgtcagcagctcgcaggaatgaggcagggaaggaggaatggaacaaacctgagtcacagtgttggttgcttgggctgcccctaaggcttaggcaccagccagtcctgggttcaactcctggccccaccacttaacagctgtgtgacttggacaaatgacttatctcagccataggctcctcttctataaaatgggataatgatcctgccttatggggctataattttaacatatgaagggcctagcagagtgcctgggcctaaaaattataactaggagcctgtaatcctagcactttgggaggccaagacaggaggatcacttgggctcaggagttcgaaaccagcctgggcaacatagtgagaccttgcctctatttaaaaaattgataataataatacatatataataaatataatacatatatttagaagccacacatggtggctaatgactgtaatctcagctacttgggaggctgaggcaggaggattgcttaaggccaggaaatttgagaccagcttgggagacagagctagaccttgtctctaaaaaagaataataataataattagtaataatagcagcttctactttagagtttcctttgtgccaggcagtggagtaaggtctttgcatctattaccagatttattctccctggcagggaaagctgctattgttattcccaatttataggtaagtagtgaggaatccctgccacctaagcgtggctcaaggtttcaaggttggtgggtgtgtggtatttaaatactttcctgcctgcaccaggagtacctgtacccatcccatgaataacactggactgttgctgtagtctccttctgcaatgatctcggtcttagtaactagcatttaagtactttcacccactatttcatt

SEQ ID NO: 3223 - DNA, 1688 bp, Homo sapiens
taccgcacccggccttcacacccagctgatttttgtatttttagtggagatggagtttcaccatgttggccaggctggtcttgaattcctgacctcaagttatccacccgcctcagcctcccaaagtgctaggattacaggcatgagccgccgcgttcggccgaatatctttatacatagaatgctttcccatatttttacttgtttcctaggtcagatccctaggattgaaatgatgaggtcaaagagcatggactttgctaaggctctttcatacattttccaaaatcatttcatatctaattggttttggatctgaccttgtatttttggaaggatgctaggcattgtgagaaatataaagaaataaaacacatcttcctgccttctcagagctaatgatctagtttgagagatgaagcctttacataaggcaacattttttatgatttataatgtaaggcaacattttttatgatttatattcccatttgctttccaaagggatctaaggtagcttatgagattaacaggttacagattgtattatttctaagttgtacaaggagtgagaaagtaatgttcagaggcttaggagaggtgggtgaaggtgctccctggcaggtttggggtttgaattttgaccagacagtcacttttcttgactctcctgccctacgctggcctatgtgacttaccaggatatccgtgctgttggcaactttaaggagcagacagtgattgccgtcaaggcccctccgcagacgagactggaagtgcccgacaggactgaggtgagaggggaaatatttggtggagagcagggttgagaccctgccagggagcgttccaggcggctctgcagactctgtccctggcactgcctagccccatgctttgcaggcccattgtggtgtccatggcaatattggtggccttcaagcttgggcagaaatggcagaagctggaaagggcaacggagactgagtagtggcctgagaaaatctctgttcctggtttctttctgcatcccaccagccctgggttcctgcgcacatgcacactcatgcccacgtatgacggtgtcaatactcatgaaaatcctttcatgctgaccgtgctttcccaggttaaagaccaaaattcctgacactccctatgaggcttcggtgctctgagaccccagctgacgttgccaacctccttttccccgctgccccatctgtctttgttttggccacactgacctgtctgcagtttccccattgcactaagctcattcctagtatgagatcttctgttttgtttgatttatttatttatttatttatttatttttgagacagagtctcactctgttgcccaggctggagtgcagtgacacaatcttggctgactgcaatctccgcctcctgggttgaagcgattctcctgcctcagcctcccaagtagctgagattacagatgcccgccactactcccggctaagttttgtattttttttttagtagagatggggtttcaccatgttggtcaggctggtcttgaactcctgacctcatgatccacctgcctcggcctcccaaagtgctgggattacaggcatgagccaccacactcaacctatttgattttttttaagacagcgtcttgctctgtcacccaggctggagtgcagtggcatgatc

SEQ ID NO: 3224 - DNA, 1651 bp, Homo sapiens
tctcagcctcccaagtagctgggattactttttgtatttttagtagagatggggtttcaccatgttggccaggctagcttcgaactcctgacctcaggtgatccacccgccttggcctcccaaagtgctgggattacaagcgtgagccaccacgcccggtcctccttttctttcaatttgtctacattttccagatttcctcttgtgaggcatgaaagaaaataaacattttaacacacaactctacaaggcaggtcaggtgaggaggtgtaggctcagagaggcaagacagtgaatcccaggctgttcagctacgaagtggcagagctgggatctgaaagcaaggttcgaccccttacatttgctcctacccccaccatctgacttagggcttaggagagaccaggctccactctgcgtgaccttgggcaagtcaattcctcttccccaagtcccagtttcctcaccgtggtgcccgtaagggggttgtgcctggtgatctctgaccctctgcacttctgcagctgcctgaggaaggagctgtactcttctccataggggttggcagggtgggcttgcgtcctgaccaggccttgaagatccagccaaaggggctgcctaagagcgtccaggatagggctaagctggcctctggctgtggccatagcctttgctctcctcccctcatcgcagtctcttttcagctcacccttgaactttccccttttcccactggtgctccccatacatcagtgctagcagctccctggtgggggcactccctatgggcaaagcgctttgctgcactatctcactgaatcctcagcataggtggagacaatgatgcccattttataggtgacttgacgtcaactgatttcccagctaagaaggggaaggcctagatgcaaagccaggccagtctgactccaagacctgtgctcagcctcaccttgatgctgatcctcctgggcttgtcctctgccacctgtgttctgcaggttcagcccaagccataggctgactttcctctgggcactgtccaaaggtgtcagggaggtatccttagggggacacttgccgcattgggaccctgggagtgcagaataagggtgaaggagagtgagaaaagagagaaggctgtgtgtgtgtgtgtgtgtgtgtgtgtgtgcaagtacatgcagtgatgggggcaggtgggcgtagcccaggccttggcccaaattctagcaaatcctggggcagcgtgtgtgggatgcagctgaggcagcctggtacatggctttgcagtcagacaggcctgggttcaaaccctggctccggcctttgtgtgaccttgggcatgtgcttactctctgtaagtctccattttttggcttccgagagccagtgccaatactgatgtggtaggactgttacgagcatgtaacaggctcagcatagatattctgttcaaggtcttcctgggattctttctggtttgttctggcgggggagacaggtgtggctggggaggctctgggctgccccacctctgcctcaggtagaactccacctgagcttcccttcctctccctgcccttggtgctcctgctgggggatatatgaagaatactaggatgtgcagccttggtcaggattgatggaggcc

SEQ ID NO: 3225 - DNA, 1065 bp, Homo sapiens
atagttagcctatcctaggcatgaactattctcattttagataggatgacttgataaataggatgaagtgagcaacctgtttgtcttcggttattgctatctacaagacattctgctagtcactgtggaaaagtttccttctcttgggttttttcctcttccccttcctcttaacagtgttggttatctttattatgtttctgtgtatttgtaacagctgtttcacccttgtattgcataatggggatttttcttggaataaaaagtgaggcatgtaaattcattgagaactaaccgtagtttgtaaagaagtaaaaggcctttgtatctagttttttgcagatcacatttctttgaatgctggaaagtgaaataaactggtctaggagccaaaaataaatcttgggtttttttaagattttgctcttagatttgtaaccacctgggtacaactttttcctaatttgtgtaagaggttttagagatgcactctgtccctcttgctttacaaattgcctacaagaatgcaaccaaaatactagaaactgaaacttacacaaaacctttcaggttttttcctgtgttgtagttctagggaagaggatagtttattagtatttattttaagcttaaggataggttttggacctggattccatcatagtataactgccatcgaaaagaagacaaattgaaattacagcatttacctaaggttcacagtatggctgacttcagcagccttacatggtaagttctctgtaccagctatttttggttctcgcaattgcatcgacttgggaaattcctatcaccattctctatataggctaaccaaaacttttatcagtacctttcctaaagtatgaagttaggtaatcttccactcccacttccatttactcattttgcttgagtcaaaccaaaaatctagtgtattactagattagtcactaaaaatctagtgtattcaatatatacactagattcaatatatagcttaaaaactaacagacacctaggctgagatttgtccaatacatgaagttcaattctgcaatcctt

SEQ ID NO: 3226 - DNA, 1048 bp, Homo sapiens
tcatgattgctcattaagcctcttgggttaactaacttaagaggttatttggtagtgttaagatgaaatttggatcagctaattccaagtttatattttcattattggatggatcagtaattctgctctccctcttataaacaagacgcattagggcttaacgtttatgacatgattttaaatcattttaaattgaatgttgatgagcaactaatattaagtgataacctctttggggaagtaggttaggtattttgtggtttgaattctatctactttatgacaattatagctaatttattaagtattcatgatgtgccagacacttgaaaaggctatgtgttaactcactcttcacaaaaccttatgagaaagatacttttattttccccatatcacagataaggaaactgaggcacaaagaaaagactgtaaggcagagccaggatttaagcccaggcctggtcccttagttttgggggggttttgtttgttttacagactataatttgagagaagtagattgaggagatagctcattgaaattgttcattttctgtatagaactagaaggcctaatttcatttttatttttacttgtgtcaacttatttttagacttggactattgagaatcttatatgttgttcctaaagcgacacacctaacagcttcaaaaggactatattacagttgaacccatggtagtttggatcctactgatacttgatgaggatctttacgtagtgttttatgttagttttgggtgatgtagttgagtcccccacttactgagtttacctactgtgtatgactgggctcaatgataaatagaatggttatatcaacactcaaatgagggctgacacacttcacctctccttttacttaagatctctctgcattttttttttttttttgaagccaagtaagcaagaagaaaaatgagagataatgcttcagtgagagaggaaaggtgctacatagagtatgagctgttaagttacatcccaggggaaagacctgggaactattgtattattctcttg

SEQ ID NO: 3227 - DNA, 1082 bp, Homo sapiens
tgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggccgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagtttt

SEQ ID NO: 3228 - DNA, 1035 bp, Homo sapiens
ccttaacttctttaacttagccctgtgaagactgctggccctgcgctgctttagcacaatgatcagttggccctgaatgagttgcagaaggccttctccctggtataggtacctaactgggacctatgggagactggtccctgacccagagtttcaggtgaccttacttccgttcctttcagtgagatcatctccctgcaacaagggtttgggttgtggacctcagactaggaaaagttcttcctgcttaaattcagtgagcctcaaacttttaagttagtggagtcctagtgagacttagggaaaagccaaaaactactcctgcagggccagtgatcaaggacagttgtgagaattggttgcaaagctccattacagagaaaataatagctatatctggcttagtaaataaaggtagcagtgcgttctggcttacaacatagacctcattttacctagtgttgggtggccgaggaatcaaggtcagtagtagtttgattcaagagtgtgtgatatttgaggcaaaaaaggctagtaattcaaagcaatctaaaggagaatgataattttaaaatacatattcagtaagtctatggttttaaaatagttgaaaagaaataagtaacaggcttatgaatttcatttttgaaaagaccataaagtacaaatttctccatgactgacatcagagtgatactcggctgcctctgctgctgctgtctcttctgtctgactccattcgcaatagccttttcttcctatccctggcttaccgagtaaagtagaaacttgccatcagcccaggattctgttttcgagggtagccccagagaggatgctctgttctcattaataatttttacagctctcaatataaatcctttttatacttattatattctgtctcttggggtaacaaagtagtgtacccattaagtgaacgtattccttctaattagtttagagcccagctgcattaaccttgagggatgttcagttacagtattcaaggttctgaactccccatcagccttt

SEQ ID NO: 3229 - DNA, 1965 bp, Homo sapiens
cttaaataggctttgttctcaccattcccttgtttcgagttgccttcagattattttggaagagttcttactacaagatgaggctttttatttcacaaataatgaatctacacacagaaaataagtggtttgggtttttggtgtttcgtgggggttttttgctagctttgtgatttgcttttgtcttaaatttaagaaggaaagaaagcaataattctttccataaataattctttccataatttctaatagttacgttagcatctagagaaattttctctttacgtcatcttgacacttaactatttaagaagttcgatatttgtgactttttcagaccatatttatctactgttaagtgtgtaaatctgtcgctaaaattggggagtaaaaataagtgcttggtatttttcagagtgctagagtcgatttgatgctgtaaaagtaaaaaaaaaaaaaaaaacaaggcttatatacaacctaatgctgctgtaccttttatgaaaaatgacggctgtagataaaaataagttgtggtcattcccttgtaccatacatatgtctgctgttgtcctgttaatgtaaactgcatttttatcttccaaattcttggatcctagctttccttcatcaaaaagatatattgcctatacatcttaaggacttggacataaaaatttgaggtctttttatgatgttttaggtctgaagacttgcggcgtgaatttggtcgttatggtcctatagttgatgtgtatgttccacttgatttctacactcgccgtccaagaggatttgcttatgttcaatatcctttcttcagatggctgattagtgaggggtgttgaagtttgaaattcaagtttatgtaagtggtaacatctaaaaagtagttctttttgtcctctaataaatgtctgtcttcaaatttttgaaaattaattctgactcacacattgctctcgttattaaagttaatccaaaaatggtaaaatatataaattcccattcatgcttctgaaactcatatcgatgattatatatgtgatttaaatttgaatgcactctggttgctactacctttaatgtaagtcctttaaaagttaatatgttcttgtgcttagcaattaaaatttggtattcttgtttgttaatttgaatcacttgatcaaaaacaaattgtataacaatgaggtaaacttctttaatattgtcccctaatttgctgtcctctgttgttacctcagagaatgtaaagctgtacagttatggcgaccccaaagagaaagcatgaaagaacctttagagtagagttcaacacttaaggcaagtagacaagccaaagacctcttaaggatcaggcttgaagagaagggagagtttgggaaaagaaaaaataaagaaaagctggaagaaggacaagcctaatgggagacaaagcctcgctttatctacaaaagggggaaaaggttgtttttcaaagttaaagataaagccatctgtcatatttggccaagcatctcatgacaagtccttctgacaagcacttaaagagttaaaggtcaagatgaagttgaatgatggccaagattaaaggagtcatacctgatgtatcctacagaataactatttttcttttttttttttttaatgttttgtaagcagttaattttcaaaattattctggtttggtctagtgacaaaacctgtaacttgatttatgtgggcctttgatgttgtgattgtggtcttgtgtaaatgcactctctcttatgaagttaaagtgtaacaggatgtatattcttaagattaaattcagcatattttggttttggaccaggtggtcagatgccacggagtagcaggcagtgctctttggagtagcgtggggttctggggttaagccacagagccctgcttaaaggagagacaggtgcatgcactggggactacttagaaacagct

SEQ ID NO: 3230 - DNA, 1028 bp, Homo sapiens
ctttatcccaaaacatacatacttgcctcttaatagtttcttgctcttttcgcccaaagggtttgtgatggtcaatattaggtgtcaacttaattgggttgaaggatgcctagatggctgttaaagttttgtttctgggggtgtctgtgagggtgttgccagaggagactgacatttgagtcagtggactgggaatggaagactcgtcctcactcagtgtgggtgggcacaacccaactggctgccaggctggctggaaagcaggtggcagatggtgggatagcttcacttgctgggtcttccagcttccttctttctcccgtgcgggatgcttccttctgctcctcctgcccttgaacatcacactccgggttttttggcctttagactcttggacttaagttagtggtttgctgggggctctcggatctttggtcacagactgaaggctgcactttcagcttccctggttttgagggtttcagattcggactgagtcactatggcttctttctttcccaccttgctgacggcctatcgtgggacttcgccttgtgatcgtgtgagccaattctccttaataaactccctttcatatatacgtataacctattagttctgttcctctggagaaccctgactaataaagggttgttgctttttctttaaaatctagtaattttatttgactgtgtgttggtattgctcattcattctgagttgatatttttaggcactcaatattctcacttaatacatggttccaaggcatttttattttaggaaggttttcttaaattatagttttagtatttgttctattctcttgttttgattttcttctttagggactcatatcacttgtatgttggatcttctttttctgtgttcagtatttgtcttttgggcacagagactcacacctataattccaagactttgtgaggcataggtaggaggatcgcttgagcccaagagtttgagaccagcctgggcaacatggtgaggccctgtctcaaattaaagaa

SEQ ID NO: 3231 - DNA, 1033 bp, Homo sapiens
tgtcaacaacaacaacaacaaaacaaaagctaataagttaaagaattgagatttgaacccacatctttctgattccattcttgcaggactggactaagttagggagtgccctgcgctcaagttctgcctgacctctggctacttattgtgtgactgagtaaattctctcctctcagagtctcaatttccctctataagaacagattagtgaatcactataaggggggagttccctattaaaatcatcttgatttgcttttctagattactgatgttctttctccagacgttctgatctgccctcttggaggactgcacagtccttcatccctcccctcctttccacgatcatgcctgtgcagaagccactgttcccaaagagtatgacacttctccttggcatgttggggaggagtaaaagttagggccactgtaagtgagcactgagagccagggctcctctgtgtgtctgtgaaagttgtgtactgaacaatgacggcaccatttaccagacgggacatgcgctgctgaacatgaggaccttgctgacagccgtccttttctaacacttgaatgctttctaattatccagaactcttaatgcaaatctgttgacctatattcaaatattgaaagaatatatacccacatgtcaacagtgcttctctgtgggcactgaaataccaggatttcaatcttttctccgtcttcccccaaacgggctacattgaacttgcactgcttttgtaattagaaattctatacaaagccccagtttaaatgtcattaaaccaaaataatttcccattgacaaatggccattgtgtccctatccttcctgggacaagggcagggatgaagagagtgaagactgagtccttgcccagtgatcccctgggaggcacaggaatggagacgggggggctgtctggcttgcaggggggctgtctggcttgcaggctctcagcagcgagctcagctatctgatctcattttgattttgcaattaaaattactatcatttattgagcac

SEQ ID NO: 3232 - DNA, 1028 bp, Homo sapiens
atccacttctcctgcccctgaacactgcttattacctctgagcctcagtttccttatctgtcaaatgaggactatggtatttacctcttagtatggttgtgagagttaagtagtgtgtgcttagcctcgtgtctgacacatagtgagtgctcaaggggatggtggtcactataatcattatctttataatcaaatggcttggtttcccagtggccttgaacctgggtcttctgacacatgaccctccacttctccctccaccccacccaggaggtcatatatgtaacaacccttccacttgtctcccactcccatccttcccagttgtgacccatgtctggtctctgcagatggagaggtgaccagtggctttggcctggctggggagctctccaccccaactccacatcccctcagcccctccacaaaggccaagtacaaacattgctcagcactgagcaaccagctgggggagggtgaactaggcactcaccctcgcttgcatttcttgtagactttgtaaatgttctcttcagggaacccatacttctcagagatctggaaggaaaagacaggtgattcattgcctgctgcccacgctagatttatacaagtcttttatgccatcactttttttacttcctgattacaaaagtaaaacatatgcatattgtgggcaaatatgaagaagaaaattacaatcatctataatcctgtttctcagagatagacaccattaacatctgggtgtgcatcttcccatcttttggtcatgtgtacgtacggttgtgtgtataaatgtttttaggttccacatggttttatatatctttttacttatcatcctagtataagccttcctatgtcacaacaaacacttgtcaagcagcatttttagtggctgaaaaatatcctgaagagcatctaccatttccctgaacttgcccatgagatattgaaactgtcctagtgctgagggtgcacccatgtaccagctggctggcctcgtgcaagctacctgtggagac

SEQ ID NO: 3233 - DNA, 1035 bp, Homo sapiens
caagtaacagcgctgaggcatgtggagaggttgtgtgtggcgtggggccacgtccctgctggccccttgcaggtcgtgagggtttggatgctcgagaggccttacagctccttaaggatgatctgaattttgccgtccagctcccccatgtccagcaggaaggcgacgtggttgctgtaatgctgaatgatgttgttgtccatgttgactaagattctggaatggaagaggggatgtggttggaacacagcaggcgccctgttttcaggccttctgagtgaccaggatgagtgatgggtcatacccagtgggtacctgccacattttaggcacctcacaaaccttccctctgatcctcacaacaaccccacgaggtgagggagtcacagtctcctttactgcacaatgcccagtggccgagccacaacccaacccaggcctgctggcccccacactcacagctactgcgccggattgcctctctcctggtacacccgaggatggacactcaagcaactagtatgtagatctgggggagacgcagtgctcccttagtcaccatattgaggactcggacatgaagtgtgagttcaagccccggaggggtggtgggttgggttcaacaagaggctaggatgtgtccctcaggcatgcctgagccagaggcaggtgccacacaagcccctcccagttccattcccaggaagctgaaatctcaggaggattgtccgatagacttgaggggctaggcccactctctccccatattctccaggcaaggacctgggtcaacctgagagagacggaatcttcatggctgtgggcccctgcagggagtcagagccattgtttatgccaaagaaagagcagccctctagaagctgctcctgatgaaggacccaccaagatgtgacttgagctgatcacatcaaccttctccttgccccttccctgctgtcttctgagcatgtaatggagttgggtatatccacccacacattcaccatccaccattcattcacatacacacactcc

SEQ ID NO: 3234 - DNA, 1872 bp, Homo sapiens
tcagcctcccaaagtgctaggattacaagcgtgatccactgcacctggccaatttaatagtaatgccaaataaagtctacttaagtgccactatagtatggtctccaatactgcaaaaccttgttctgatccaataaaaagggaccacacaactcaatagaggcaaagctgattttaacctccagggctctggaacagcaaaccagtgcaactcaacacatttttcttgactgcataaaaacgtagaccctattaggctattccctggcttaaaatcctgtgatggctctctattgcttttaggataaaatggggtcagcttattaatatgtcctgcctgaccctcctcaaagaaggcaaggtgtatctggatttattttcatgttttagctgacagacttcttgtgttacggttttagaatgaagctcgtaaattaaatcaccaggaagttgtggaagaagataaaagactaaaattacctgcaaattgggaagccaaaaaagctcgtttggagtgggaactaaaggaagaggaaaagaaaaaggttaggaactattctatcttcataagtgatttagtcaatcattctgttgtatcaagacactacaacatggtggttgtatacactggctcttaggccaagctgccagaattgaaattctggctctgctcagtaccaactgcaacacgttgggtgagtttatttaacttctctgtacctctgttttctcatcaataaaacagggactgtaacaataattatttgagttcattatgaattaagtgagttaatgcatgtaaaacatttaaaacaaggtctgacacctgataaacactcaataagtatcatgtgctcacttatataccatagtatattcccaaatttcctttaaatgctattaaagtggccgggtgcagtggctcatgcctgtaatcccagcacttttgggaggccgaggctggcagatcatttgaggtcaggaatttgagaccagcatggccaacatggtgaaaccccatctctactaaaaatacaaaaattagccgggcatggtggcatgtgcctgtagtcccagctacttgggaggctaagagatgagaatcccttgaacctgggaggtggaggttgcagtgagctgagatcgcgccactgcactccagcctgcgtgacagagtgagtgaaactccaactaaaaaaatactattaaagtattggttgatatttattggatctttcttgatgtaaagtagatcaaattattgcatgtatcataattgtaggtgtcagcttttttcttctttttaggaatgtgcggcaagaggagaagactatgagaaagtgaagttgctggagatcagtgcagaagatgcagaaagatgggagaggaaaaagaagaggaaaaaccctgatctgggattttcaggtcagattgacctttattgaaccttattgactgggctgttagtcatttccttcattgtttctggtttcaagaaaggatgtgcctcttgtgcttcgtgggatattcttgatgaggcttaagaccaagaaaagtacaaatatgtctcttaggagagaagttaaaaaaaaaggctgtacttcagttagccaggtttttaaatacttgatgataaaatttatcaaagtctgtttgtcagcatcttcaggatagaagctatgcttagaatagtgttatgggcatatattacttcacacagattgagtatccctagtatgaaaatctgaaatcccaaatgttgcaaaatccaaaactgtttgaatgccaacatggtgctatgatgctcaaaggaaatgctgattggagcatttcagattttgaatttaagtataataaagatattccaaaatc

SEQ ID NO: 3235 - DNA, 1073 bp, Homo sapiens
caggcgccggcttccgcgactcgacttgttttttctctcttggttttttaggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaaggtgggtgggtcatttacctttccatttgtggtaatgtatggtggcagtatatgagtaggctagggaaccaacgttgctgtgtagtttcaatattagttcctttagtgcccgaaatctttttggaggaaagagggaggacattacctgtatttaagtggacagcattctctttagggttaaaggtcaactggatgttaaatggctcaggatgtagggaactttttttcctattggctgactgttcttagtgggtggagccttttaaatgttatgattaagttaaaggttctaagttaacgtgattgggaagaacaatatcaaaacacgccttcttttagttgacattattactgaataaaattggattgtcgagtatcctaagtgacctaggaggccgggcgcggcggctcacctctgtaatcccagcacttgggga

SEQ ID NO: 3236 - DNA, 1061 bp, Homo sapiens
tgcccttccaacatactcacctcaaaggacgcccgggcacacggcttcaagggtaggttggtcccaattcttcttactacacttcgagcagccccatgtggcttgttttgccagattgggatggtctggagcaaagagacggagacagctacaaccccagagaatgaatccaactactgtccttgtcctctcctctctaggtttgtggagactgaattccacaaacctagggacagggcactctctaggggcaagtcaactctcaattatagtgagggcaggttccccagttgccagcctacaccctggccagccacccaagggaatacctgctgctgctaaggcagtcaatgttgggagggtcagggaaggggagaggaagtagctgagtgtagagattatccaggctttccttcccgtcctctgtacagaaaggcagacatacactgactcctgaagtgccccaggatcatagttggttcttcttagggggagggagtgaaacggtggccttgctccaattccaggcctctggagaaaggagtgctcaactggagagtctcagaaccttttacagtacttcagcaggcccagcacccaaccttccccaccatacccctgccctgggaatgccccttaccacagtggcttccattcctgacatttgaaccagctcctgcacttgaaggacaaggcagccactgggcagctccgggaggcgggaggcgtgactccttcatatcaggccatctggaggagcaccagatttccctcttgtgaaacaaccccccacagtggggatttaatggtcaccacacaagccccaaaaaaccaggccctgcagagccatgacttcacaggggagaaaaccagcccaagaggctgccctcacccaacacttagctctaagtccagactcttaaaggttctgttaaagatctgcggccaggcgcagtggctcacatctgtaatcccagcactttgggaggccgaggtgggcggatcacgaggtcaggagagcgagaccatcctggctaacacagtgaagccctgtctctact

SEQ ID NO: 3237 - DNA, 1048 bp, Homo sapiens
agttaaagccttgctctctgaattaggctttgacttaagcgaatgttgtggctactttgatcatttatccagaccactcaaactttcttcatatcagcaataaggctgttttgctttcttatttgtgttttcactggagtggcacttataatttccttcaagaacttttcctttgcatttacaacttggctgtttgatgcaaaaggctcagcttttggcctcttggggcatgtcttcctcacttaagcatgatcatttctagcttttgatttaaagtgagagacctatgacttctcctttcacttgaacacttagaggccattatagagttcttcattggcctaatttcagtattaaatagggcagcccaaggagagggagagagttgaggcagtggccagtgagtggaacagtcaaaacatgcacaacatttattgatgaagtttgccatcatatagagatgtggttcatggtgccccaaaacaattacaatagtaacattaaagatcactgattggccaggcgcagtggctcacgcctgtaatctcagcactttgggaggccgaggcgggcggatcacgaggtcaggagatcgagaccatcctggccaacacagtgaaaccccgtctctactaaaaatacaaaaaaattagccgggcgtggtggccagcacctgtagtcccagctactcgggaggctgaggcaggagaatggcgtgaacccaggaggcagaggttgcagtgagccgagatcgtgccactgcactccagcctgggtgacagcgagactccatctaaaaaaaaaaaaaaatcactgatcacagatacaataatgaaaaagtttggaatactgcaagaagtaccaaaatgggacacagacatgaactgagcacatgctgttggaaaatggcactgacggacttgctcaacacaggcttgccacaaaccttcaatttgtaaaaacaaaaacaaaaacacatcttcaaagtgtaaagcaaggtgcaataaaataaggtatgtctatactgtataaaatacaaacagccgcc

SEQ ID NO: 3238 - DNA, 1071 bp, Homo sapiens
agggccagatttggttggaaatgggagtgcagtgggacattatgaatagtgccacagaagcaggaagtataagggatgtttgtgaaacacgaaataaaagttaaggagtcttgaagaccaccataatttttgacagcaacttcaagtttgggggtccccagaaccattctcaggtttcataatttgctagaagtactcacagaagtcactgaaagctgttatggttacagtttattgcagtgaggagacacaaatgaaaatcagccaatggcaggggtatagagagccaagtctgggagaatcccaagcctaaatcttccggtgtcctcctagtgaagaaacagacaatgccaactgctctcagcagtgatatgtaacagtacacacagagtactgccaatcatggaagcttaactgagccttgatatccagagttgttttgggggcttagtcacatgcatgtggttgactcaccttcctgctgactttagttttcagcccttatagaggtcatgctgttaatgcatggcctgaagacccctccataaatcacattgttagcacagattatttggtgtggcccaaagctcccaggttaaaaaacaaaacaaaacactcctatcaggtgggacattccaaggatttagagattatctctcaggagctgccaggcctctccttgcataagattctttttttttttttttttttttttgagacggagtttcaaaaatttttgcccgggctggagtgcaatggcacgatctcaactcactgcgacctccgcctcctgggttcaagcgattctcctgcctcagcctttcatgtagctggattacaggcgtgcaccaccaacccaggctaattatttttgtaatttttgtagagacggggtcttactgtgttgggattacaggcacgagccaccgcacctggccaagattctttactacatagggaataattcaatttggctaaagtgtagactattccctggagttgaaggtgagcttaggagggtaaactagtgctatgttgttggaaattgatggaaggcgtttgttgtcatgg

SEQ ID NO: 3239 - DNA, 1006 bp, Homo sapiens
ggctcacacctgtaatcccaacagtttgggaggctgaggtgggtggatcacccgaggtcaggagtttaagaccaacctggccaacacggcgaaaccctgtctctactaaaaataccaaaattagctgtgcgtggtggcaggcgcctgtaatcccagctactcaggaggctgaggcaggagaactgcttgaacccaggaggcggaggttgcagtgaactccagcctgggcaacaagagtgaaactcctgtctcaaaaaaaaaaacaacaaaaaaaaaaaccttaaataatctaatcttctaccttaagaaactagaaaaagaagagcaatctaaacccatagtgaccagaaggaaggaaataatacaatttagagtgaaaataaatagtaaagaaaaacaatcaacatcaaaagttggttctttgcaaagatcaacaaactcaacacacctttagctagactgatcaagaataaaagagagcacagtggctcacacctataatcccagcattttaggaggctgaggtgggaggatcccctgaacccaggagttcaagaccagcctgggcaacatagggagaccctatctctaccaaaaaatacaaaaattagcctgatgtggtggtacatgcctgtagttccagctactcaggaggctgaggtgtaaggatcactgaacccagggaggttgaggctgcactgagcggtgattgagccactgcactccagcctgggtaagagagtgacaccctgtctcaatcagtcagtcagcaagaggccaggtgaggtggctgaaaaaaccctatctctactaaaaatacagaaattagccagttatgttggtgtgtgcctgtagtcccagctactcgggaggctgaggcaggagaatcacttgaacccgggagacaggttgcagtgagccgagattgtgccactgcattccagcctgggcgacagagtgagactgtctaaaaaagaaaataaagagataaaaataattagaatac

SEQ ID NO: 3240 - DNA, 1027 bp, Homo sapiens
agctctgtggagaggttcatgcagtgaggagctgaggccttttgccaacagttgtgtgagtgagggagtcatcttgaaattggataccgcacctctagttgatattttgaatgcaacctcactagactgtgagacagacccacccatctaggcttaacccaaattcttcatgcacagaagttgtgagataataaatgcctggctggatttcagactggtgacccacttatacctcttatctccccctttttgaacataatgtctgtaacagttatgcccgttccaaattgtatgttagatgtatgagggaagataatttgtctttagttcacaggcctgcagatctaaaggaactgtatttaaactacatttttggacttcacatgtacctgttttagatgctagtatccttgatattaagctaatgctataaagagatgagatttttgtagagttttgggagggagggagtatattttgcatatgggaagaatgtaagtaatttgggccagaaggtggactgtgatggtttcaaaatatgtccacactcttcccttcaagaggtggagcttcattctcctgcctttatgtttggattggacttggtaacttgctatttatttatttatttgtttgtttatttttttgagatggagtcttactctgttgcctagactggagtgcagtggcatgatcttggctcactgcaacctccacctgctgggttgaagcagttctcctgcctcaccttatgagtaactgggattacaggcgtgcaccactatgcccggctaatttttgtatttttagtacagacggggttttaccatgttggctagactggtctcaaactcctgacctcaggtgatctacctgccttggcctcccaaagggattacaggcgtgagccactgcgccgggccgtaacttgcttctaatgaatagaatattgcgggaactgatggtgtgtgactttttcagattgggtcataaatggctttgtgacctcttttgattgctcactctg

SEQ ID NO: 3241 - DNA, 1031 bp, Homo sapiens
agatgagaagcaggagttgagcagataaataaaagcagtggggccaggcacggtggctcatgcctgtaatcccagcactttgggagaccgaggcaggcagatcacgagttcaagagatcgaaacgatcctgtccatggtgaaaccccatctctcctcaaaatacaaaaatattagctaggtgtggtggcaggcatctgtagtcccagctactcaggaggctgaggcaggagaatctcttgaacctgggaggcggaggttgcagtgagctgagatcacacgactgcattccagcctgggcaacagagtgagactccatcccccaccaaaaaaaaaaaaaaaaaaaaaagtggtgggggtgttccagacaaagggagcagcacatggagggtggagagaggcgagatggcagcatgtgagcatggctggactgtggatgcaggtgcactcgtctcccactaaggagtcccgcctaagcatcctagaaatctggggccagaaggatcttaatcatcaacaaatccaacctcctccttttccaaatgaagcccagagaggggaagccatttttccaaggtcacatagaaagctaatgatggagaatagactcaaacttgctgcactgcctgagttttggattttctttttttccttccattccttccctctgcccttccctcccactgtcctccaattcatatttgtcacatgcctactttgcaccagcccagtaccctgacctccttgccttagaaccttaggcttccagagcctaggtcatcaccacctcttcctatcaaacctcctccccacaccccgttcctgcctgacctttcctactcgttaaaaatccagatgcctaggttgcttcccataccaacaagatcagaatgtctgggggtgggggccaggtgtcagtattttttaaagatccctggatgattccatttgtagcaaagtttgagaaccactgttttagccctgatgaagggcccctccacctcctgtcccttggcctctgggttgcagatga

SEQ ID NO: 3242 - DNA, 2069 bp, Homo sapiens
tctcagaacttaaattgtgtggttcccacaggctgtaatatatgcactgaggttgtgttgggcctctttgaggtgggggctgggggtcgtgacttgacaggcttttttttttttttttttttttgactgatgacaccttacccttcctttacaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgtagcaactcctgtgaaatgactaaagggaaccttaattatttctaaagtagcatttgactcgggtggttaaggttggcagatacgtcatcttgtatccagaggctgtaatagtccccattgtcagtgctttgcctctcaattcagggaacgcctttggcagctttcctgtgctatttgagaaatagcctaattatacatattttgtgcctctcagacatctgtataaaagctcttggaagccaagcacttatagcaaaagatgattgctaatactgcggtggggtccatgtgttgctaacgcatgtgcctctgctgcttgggctgtatcttgagattggggttttaccaaacttattcatgagaacaataacagcctacctcaacttacctcctaagattgttaggattaaatgggtttgtggcaagagagcacacttagaacatagatatttagcattccgtataaatcacgattactgttttcaaccagaggctaatgagtgatctaagtttatactcttgagttggaaattatgcagtttttatattccttaaattgacttttaaatttacttaaatgatcaatcagaggaattctgaacaaagcttggtttaaggagttacgcccatgtagggcaaataggagcaagtgcaagtatagttgaatacaacaataggttctgagcaatatctaaaccaagaggacaggatgaggcttgtgtgcagtggtgcagcacagttcatcttggctcctgtctctggcacatagcaggtgctctgggatctttaaaataccagttctgaatagatgggaatataaagagggcctgagggtagaaacttggcataatgatacgaggtgtcctacaagtggcagtgagcttttgttcatctaagacatttagggagggaaactggcctcaggagaaagcaagggaaggatcaaca

SEQ ID NO: 3243 - DNA, 1059 bp, Homo sapiens
aaggaaataccagtcctcatttattgaactcctgttacatgcccgctcctttgtttatatttttctcctttaatacatggtgttgcctcaaataatggaaattagaaacagtttcaggaatgttaagtcgtttttctgcagtcatacaactagtaagtgttggggtcagaattcaagccctggtctatcttaaaccaaagctcatgcttctctcatgcttcctctttgaaaagatttgttgccagatgattctttggcactttggttttgttttttgagagctgtacaataacattttaaattgctagtgtgattgtgttgctcagctggtatcatggtagcttttctcttatctaaacaattctattataaagtaactatctttaaaagctaatcagaagaatcaataaatattaatatgctagttgtagaaaatttgggaaatacagaaatttataaatggaaattaaaagtattcattatcccgcttccgagaagcaaccagtgttaacattttggtgtgtttctttccattcaatgttactcattaacaactgtacataacttttcatttaactccctttctcaacaaccctgataggattgattttaaagctggggcaagtgaggcacaaaaggtaaggtaataaccttccccagaccagcatagtgatttgtagtatacacacacacccgcccgaagagcctcagtgcttacactaaggagtcgtcttctatgcaatagtgtgagttcatggagtaggaggaagcaatacaaccaaaggttggacagtggaaagctttttagacatcaaccctggccctgtagtcattagcctgtgctttacatagtaactggctaaatataatgaaactcccatcatgactaggatttggcagaagagaatcaatagaaccagtgtcagatgctctgtggttatcctgcaagtcagtggttccaatgtgttttgagaacaagctgttctgttgaaggggtcataccaaggtatggtctggtaattaatgcagtttcctgagacaaaagctaataagcctttt

SEQ ID NO: 3244 - DNA, 1045 bp, Homo sapiens
tcccctggcgaccgcagctggtgattgaggggcggcgctcccgggccccacgagggttcttctgtcttcgcggccggacgcgcggacagcgtgggtggcggcaggttgggcatggggacggcgggaggcggtggcgagctcaccgcgggaccacccgggggcctgttcccggggcctgccccacccgctgaactgtgaagggggtggtggcggcggcctggaggtgtttttggcgggagttggggggggcgtccgcgcagggggagtcaggcaggggcggagttacccggattggaccgttagccccgcccacccctccccttcccacgcgcgcgggctccggggtgttgagttcggggagattcgaaaaggcgcggggaggaagggggcggggccaggggccggagcgcaaggcgtgctctgattggccgggggcgaccggtcctcttttcctcgcccggaccagggccacgcccatcctgggtccggtgctgcgtctaattctctgcttttcttaaatcttgtcgctgcctctgattttaattcctagcttttgggaacctgtcatcctacgtttttggtactagctggcgtctacaaaagtcataatgttaaaaagatcaacaagagatacagcatttttcatgacataacggcagcaaatataagtcaaaatctagaggttcataaacattttgcttgctgttgggcaaggaagcttaaacctgagggacaataggagttcaacattattggttactattagcttgggcgttttcttatccaccacgtcagacacagacaaagcaggggtgggtatttcatttgcacaatgagttgtaggcagtattaagatggctccgggggcactgttgagttgaatctggaatatcttcttacagtttcggtgaaatgttaaagagtttatgggggaaaaattcttcacccttgtgactttgtctgattttaaaaatccaagagttttatgaccgagaaagctcagttaacttgattttctggaaccaatatcatattcaggtcatat

SEQ ID NO: 3245 - DNA, 1152 bp, Homo sapiens
tcaacctctcaaatagctgggactacaggtacatgctaccatgccctgctaattttttaatttttttttttaagagatggtgtcttgctatgttgcccaggctggtcttgaactcttgggctcaagtgatcctcctgcctcagcctcccaaagtgctgggattacagggatgaaccaccatgcccagcccaaggtttttcatttgtgtatctattatttgagtggaagatgattgtcctttattgagatggagaagaatagaggagcatttcaggggtctgaggaaggaaatggcaaaatcttaaggcccataatattgctcttggtgacatggttttgctgttggcaccaaggaggcttttcctgacctcacatagaaccttgtgcaatcagggcactaagttatattgttttgccactttgtctattctgtcttccctgctggactgggagctccttgaaagcaggaacactcatttatgtctatatccaaagcacatagtagacactcaatgaatgttgaatgaatgaataattaaatgaatgaagtgccattctgtggaactcaggtcagtcacctgagagtagatccaggagaagagggatatctgatccttgttctcagagagtttgaaatctagaaggatctttggtgaaaagtaaaagtgatccctacctaagatcctgactgaaggccgtgggccctggtacccccctcctggctttctgagcctttaccccaccagagggaggaactccgcccttccctccaccaccctaactattcttgcctgggatccgcatggcaattccaaatgtctggtcctattccaggtgtgcggtggctctggatgcttggatgtttcctctggaacgtgacttttaccccaaggcccgaggacctgtgttctttatcaatactgagaaattccagacaatggagagtgtcaatttgatgaagaagatatgtgcccagcatgaacagtctaggatcataaccgttctgtgagtaaaccacaaggtcgtgatcccagggccctctccatttgccacttgctgtggtgcccttaacttctggattacccaaaactttctacccattagtaggatacctgaatacttcctgaattgcaaagtctaaattcttttaga

SEQ ID NO: 3246 - DNA, 1035 bp, Homo sapiens
acttcaaaaatgaaatacaaggctgggcgtgttcactcatgcctgtaagcccagcactttgggaggctgaggcgggcggatcacctgaggtcaggagttcgagaccagcctggccaacatggtgaaacccctctctactaaaaacataaaaattagctgggcatggtgttgcacgcctataatcccagctattggggaggctgaggcagaagaattgcttgaacccaggaggcggaggttgcagtgagccaagattgtgcctacattccaacctgggcgacagagcaagactctgtctcaaaaaaaaatagtaagttgtgtaaagaaaaatattaattatataatatggcagttcctatgagagtgtggcaaaaatcaagagggcttggaagttttttctttgctcttgcaactggctggatgcagttcatatatttttcaaccagtaggtggcaccccaacctaattttttgcagttgtaacctggtggcagaaggggcaggactgatggcttgggcaagactgttatgccaagttttatttgcatgtatttggactttctttttttggagacaaagtctctctctgtcgcccaggctggagtccagtggcacaatctcggctcactgcaacctccgcctcccaggttcaagcaattctctgcctcagcctcccgagtagctgggattacaggcgcctaccacatgcccggctaatttttgtatttttagtaaagacggggtttcaccatgttgttcaggctggtcttgaactactgacctcatgatttacccgccttggcctcccaaagtgctgggattacaggcgtgagccactgcacccggccacatttggacttattaacacatatgaagtgcttggtattttagagtgcttccacacacacaatcctcattagagatagacaggatggggagaattaataagccattgcccgtgttacagtgaggaagcagaaagatgagaagtttgaactttggtcagcctggctttctcataacccattttgctgac

SEQ ID NO: 3247 - DNA, 1066 bp, Homo sapiens
cgagatcgcgccactgcactccagcttggtgacagagtgagactctgtctcaaaaaaaagaaaaagaaaggtctgtaactcgaacatcatttggtgggctaagtgctttacttgcagggtcatttaatcctcatttcaaccccttttataattgaggcgacaggcccaaggtccctctcccgggatgttttggaagaacagttcaaaccttggttttggtgggtgtagaatctgtttcttactttggagccatctggtagtacaacagccatggtgtcctaacatagccaacctagccatggctaacctccatgtcctcgtcagaccccagacccagacatcatcaggttttgaactcccttagtctggctccagagcatgtgccataacgcaaaattgcaaggttagtactgtccagtcctttgatccgcagcagtgtgtggaagaggcagatagaggagcatttgagtctgggtgtttttggaggcttctcatacctgattggtccctataattatgaggaagagagggatggacatggttggagtgtaggcatcagcggaagtcagatcctgcccagaccagctccccatcctctgcctatgctatcagccttgacgcacccttcctcagcacactgggcatccaggagaagtacctggcaccctcgaaccagtcagtggagcaggaagccatgcagctgtagcaacaaggtggaccctggagagcaggatgcataatccagcactggggaaagtggaggctcctgatgcaggctgcagacccaagagcaagtcctcccagccagagctggcgggctggcaaggggatattcagctctgcaaaggacttctggccaaaaagccagacatggtgccaagcagaacaccccccatactgtcagtggtgtccgtgagctctgggccctgccaccagaaagtcgagcactggtcctagtcaggctgtgatgaaatgtgctacaatacaagagtttattttctactttttgtgacttccaaacttttcttcagtcttccgggcccaggggtttggggaagaatgaggg

SEQ ID NO: 3248 - DNA, 1045 bp, Homo sapiens
cgctcttgttgcccaggctggatcgcacaatggcgcaatcttggctctgtgtaacctctgcctcccatattcaagcaattctcctgcctcagcctcccaagtagctggtattagtgtgcgccactgtgcccagttagtttttatatttttagtagagacggggtttcaccatgttggccaggctggtctggaactcttgacctcaggtgatccacctgcctcagcctcccaaagtgctgggattacaggcatgagccactgcgcccggccgtggatgactgatttcatattgatcagttgggcttcctgatgactgtctctcatgtgcaaaggtggtcccttggcttcagagttggttgtactgaggacaagagaggatattgatcaataggagtaacaaatacagaggcccagaaatgagagggcattagtcattcgggagagatgcaggagtccagttcctggtgtgttgcatgtgaagaggaaagggcgttgcaggggtacaggcagggctgccgagggaggggcctgagtgccctactaaggaatgtggacttcagttcatgggtgggcagtgggagcaagtattcaagcagtactgttgaacagggtgtgacacaatcagatgtacattttagaaaagcccctgcaattgtggaaaatgcatttaagggacgtgattgggggcaaaagagttttacagtcttgctaggtgagaagggttgaaagatttgtagtgagaatagaaagaaaggtgtagaatggaaaaatactaaggagatagactgtaagagtcagtgactgaatgggatagatggagctggagtagaacttagcttcccagatctctggcttagacggtgggtggttgtactaatcactgaggcaggaaaaggaggagggagcaggtttgtcacatggatgaaagggacaagagctggcagatgtgctgtgttcaggggtccatgggacatccagagctgtccaagaggcagccagacttttggagcttggttagtgactaatgaggctggagccaaggtca

SEQ ID NO: 3249 - DNA, 1022 bp, Homo sapiens
agcgctgcctcagtgacccaggcccacaccctgagcctggggagggagaaccgttcttccccaaggggcagtaacaccagggccagcaggcagcgcctgtcccctcacagactcttccaccagagcaggggctgctgggggctccccttgcccttcctgacccggattggccctgcccctccccctaccgcatggcagctgggcccacagcccccaccccagcacagctcctcccctgccgcctcccgggaagcatcctccccaccagagctgcctccccaatccatttggcagaactgctggggctggtgaggccggccctgcccctccctagatccaggcttctcccggacctggactagggcctcggaggctcctccctctgcctcatcctcctcctcattcagaccaatcttagtttctaaccaaagagtctctggctcagctgtggtcccacccaggaagggagggagctgaggcctcccttgagtaggccctgctttatcaggggacaaaccaggggtaccaggcacatggctgggggagggactgctgacccaccaaggtctcacactcctcctgccagctctgtcaccctggccaccacccaacctgtccttactcagagctgcgggctgagggcatctctgagtgtctctgcctggagcaggggtggtttctacggtgacagtgacgtgactcagagcttttcgaactgtgctcccacggggaccactgggcccctcaggggaagctgctaggggaaggactggccgtggctccagaatgtgctgcctttttaagttttgtttgttcacactcctatatatgattgtttgcacagagggcgctcctgtttttaaaacattttgaaaacccctggctgaacagtgctctgcctctaactccctcctcacactccagaattacccttcctcatctgtgcctgtctgtccaacccctcccccacgtctctctgcctgctgggctcttaactgttgctcgaagactgtgacatcaga

SEQ ID NO: 3250 - DNA, 1026 bp, Homo sapiens
gccagtattaaggggaaaaggtgtgccctttttaagctacatcaccctgtctgagcctcagtttccccagtctaaaggggggtgatgtctgtaaagccctgagcacattgtaagtgctcactaatgggagttgctactattcctggagccttaaaggaagaggtgagggtggggtcaagcactggaggatggttttaggtatatggactggagggcattggggtgagctgagtactgaggttaggggtgcaaatgagaccattagctgaattgtctgagctcgttctttagttgggaggtggggagacacatgttcagcaaatggattcgtgctgataaatactgtactgaagatggaaagatggataaatataatcccagcctcaagggagaggctggcatgtaaacaggcacttgtgatgtgctgtgaagtgctgcagcaggagcctgcagagctgtgggtgtgcgggagggaggagtggaggtgggtgggtcaggaaaggcttcccagagctttgagctgggtcctgaaggttaagaatgagtgttttggccaggtgcggtggctcacacctgtaatcccggcactttgggaggctgagatgggcggatcacttgaggtcaggagttccagaccagcctggtcaacatggtgaaagctcatctctactaaaaatacaaaaattagccaggtgtgatggtgcaagtctctaatcccagctacttgggaggttgagacaggagaatggcttgaacccaggaggtggaggttgctgtgagccgagatcgcctcactgcactctagcctgggcgacagcgaaactctgtttcaaaaaaaaaaaaaaacaatgagtgtgcttagctcacatagaggggagaactggagaagggcacagagatgtgaatgacacagagccacagatcatgcagaaccattgacctttgcttctaaaactcattgggatgtttccaacccttccacctcacccccaaacacgcctcactcacctgttttgctgggcagag

SEQ ID NO: 3251 - DNA, 1059 bp, Homo sapiens
cagagggcagtcggaccccagcgcagaggaatttttggttgctcaggtgatggcttcttaaaaaaataaaaaaccagaggctggtgtgttccccttccaaacccgaggagggcaggcctggggagaaggctctggtttctatgatctcttcgataaaaaataatccaaaataataacaaaatacgtggtttctctttcaccctttcccccctccaggaactgaggtcagaaatgggggtgaagggacaagggataccctggtatggcctggatatcaaggtgtgggcctcttttttgccccttaccacccataagtaaatttataaataaataaatcaatcataaatagacactgtctttgtatatgtgcatatataatctttctctctcctatttaggcaactatgtgactaatctctctgactctttagctcagaaattcaaacgtaaagtgacatggtcaaggtcaagtttgggggaagagggacatctgggacttggaatggcactgtaaaactcccagcattctggaattgcaacccagctgggctgtgagacatttctgagtagaacactgaccacctgaacattctggaaccgtggagccagctgggcccccatagggatctgaacagaaccttgaaacacccaatgtcctagaactccagaaccagctgggtctggggggtgtggagctgggggtttggaaagaagccctggagagcctaacattctggaattctgtagtaatcagggttgaagggtcatgaagactcagctagacatcactgggggagcgggatcggaaggggatcttggaagaggaacagcagcagcagacagcccacagcactttctgcacatcctggttgcggaaggcgtagatgatagggttgatcatggagttgtaggtggcagggagcaaggtaagataggtgtagagaggtggagagtgggcatcacccagcaggcagtagacagtgaagggcaaccagcaggcggcaaaggctccaagcaccacggccagtgtggcaatgcccttgcgggtggccacatagt

SEQ ID NO: 3252 - DNA, 1093 bp, Homo sapiens
caacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaaggcttctttagacccagagccctttaagatgataaaggacccaatgcaggtaatcctg

SEQ ID NO: 3253 - DNA, 2068 bp, Homo sapiens
tttaaaaactatatctctaaataattttaaagcattaagaaaagattgctgacacttgatctagcctagtgttctccctagttcttcttttgcaaataaacacatttttcaaaaagtaaaaactgaggctcagagaaattaaatacagtggtctcctgccttatccagtttcaattacctgtgttccactctggttcaaaaacaggtgaatacagtgcagtaagatgttttgagagaccacattcacttaacttttactaatattactgtaattgttctattactgttcttaatgtcttactgtgcctaatttataaattaaactttatcatatgtatgtatagaaaaaaatacacctcagtactatctgcagttttaggcgtcatctgagggtattggaactatgttctgaggataaggggtgactactgtaatttaattgttcaaggaagaaagtgtacctggtctttcaaacccagtatagcacactttgtagcatcctgttttgcaactctcctgttctgtagattctgtcaattagaaatgcttccacttggacttctgccttagtctttcactccctcatgtagtacattctccatactgctgccagagagagctttctaaatgcaaatctgatcatgtcactctctggcctcaatcttaaatagctccctatagcttttagcacactctgttaagtgctgtagcccggcatacaaggctctctgtgcctcagcttttgtctgccttattagtctcatcactcatgacttcctgcacttcagccacataagccatttactgttcctggaacactgtttttgcctctgcatatgctactccctccacctggaagttcttaactagctttatttgtcctttaagacaccttttcttaactgactgcccctctttgccccaacttgagctggatacttccattataccttgaacttaacatttgtagtcacacttaccagagtattattgtcccctttatttatatctccaggagcttgcaagctctgtgagggcagaggaagtattaaattaatatcctaagtgtgtggcacagtgcctggtatataagtttcactgaatgaacaaataattgtatattactttatacaaagacaatatatatgtatgcttttttttttctttttaagagatgggatctcactatgttgcctaggctggcctcaaattcctgggctcaagtgatcctcctgccttggcctcccaaagtgttgagattacaggtgtgagccaccatgcctggctccatatatatttcatagttgtcatttgtgtgccagattttcaccagctctacccatatttattgaggaaagaaatgaagaagggagggaagggaggagaagggaagggaacagaaaagaagggagaaggaggctgggtgcgatggctcacacctgtaatcccagcactttgggaggccaaggcaggcagatcacctgaggtcaggagttcgagaccagcctaggcaacatggagaaaccccgtctgtactaaaaatacaaaattagccaggcgtggggcgcgtgcctgtaatcccagctactcaggaggctgaggcagaagaatcgcttgaacccgggaggcagaggttgtgatgagctgagattgtgccattgcactccagcctgggcaacaagagtgaaactctgtctcaaaaaaaacaaaaaagagtctgggagagggaaaaaagaaaggcagacagcttggtgggtagatgggtgggacaaaagtattgaggagaggaagacaagaagctggtttgggagattcagggtcttattaacattttaggccaagtacctggaaagtttaaaacaccctgtatttctttggacatgtgctaattatcatgacttattctgacatttcttagcctttttggaaatttctcttcttggctgataactatcatttttctctctttacattagggagtaagagctttgaggtacaagaatgagacggttgtggcagacactcatgttgtcacggtagtcttggtctctaattttttttttctttt

SEQ ID NO: 3254 - DNA, 1049 bp, Homo sapiens
caaaaagttgcagaagggtatatacgttaatattagaaataaaaaaatcaggtcaagaccaacctgggcaatatagtgagacactgtctctacaaaaaaattttaaaagtggctgggcgcagtagttcatgcctgtaatcccagccttttgggaggccaaggcgggaggatcccttgagcccagtagttcgagaccaccctggacaacgtaagaagaccctgtctctacaaaaaatttaaaaactagctgggcattggtggtgcctgcctgtggtcccagctacttgggaggatctcttgagcccaggagtttgaggctgcagtgatctgtaattgcaccactgcacttcaccgtgaacaacaggaaaacagtctcaaaaaaaaaaaaaattagttgggcatggtggcacacgcttgtggtcccagctactcaggaggctgaagtaggaggattgcctgagcccaggagttacaggttacaaagagtgatcatgcactgcattccagtctggacaacaaagtaagaccctgtatctttaaaaaaaaaaaaaaaaaaaaaatatatatatatatatatatatatatatatatatacacacacacacacacacatatatatatacacacatatatatacacatatatatgtatatatattagagtcatatgaagttctagaatgtgacactaaacaatataacatttagagatagaaatgtgataaaactataaagtaaaggaaatggtaaacacacgtcacacgtttaagatagttatttcaggataaggaaaggagatggctttgggagagtatgcagggggctttaaggctaatagtaatattcttttttgtttttttgagacagagtcttggtctgttgcccaggctggagtgcagtggcgtgatcccagctcactgcaacctctgcctcccaggttcaagcatccttctgccttagccccccagtagctgggattacaggcatgtgccaccatgcctggctagtttttgtatttttaatagagactgggttttgccatgttggcca

SEQ ID NO: 3255 - DNA, 2010 bp, Homo sapiens
ggtgcgatcatggctcactgcagccttaacctctgtggctcaagtgatcctcccacctcagcctcttgggtacttgggactacagatgcaggtcaccatgccaggctaattgttttattttttatttttattttttttttgaggcagagtctcgctctgttgcccaagctggagggcagtggcatgatctcggctcactgcaacctctgcctcctgggtttaggcgcgattctcctgcctcagcctcctgagtagctgggactataggctcatgccaccatgcgcagctaatttttgtatttttagtagaggcggggtttcatcatgttggccaggatggtctcgatcttgtgacctcgtgatccgcccacctcagcctcccaaagtgctgggattagaggtgtgagccaccatgcccagcctaattgttttattttttatggagatggagtctcactatgttgcctaggctattcttgaactcctgggctcaagtgatcctcagcttcagcctcccagagtgctgagattacaggcgtgtgagctactttgcctgggtgtgttttatttttaagtaaatgggaagtctggaagaagtgttttgtttttaaattgaggtgcttgaagatttaaaaaaaaaactttttaatgaaaaaatatcaagcatacatgtaagtaaagagaatgatgtaatgaactcctatgtatctatctcctagcctcaacaagtatcaactcatggccattacaacaggtctttgaataacattattttgttcaccttcattgcgttataatgttgatgagaaaaaaaatgtattcctggccggggctactgtctgtgtagtttgcacgttctccccacatctgtgtgggctttctccagtactttggtttccctccaggtactctggtttcctcccgcatcacagaattgttcgtgtttgatgaattggtgtctctaaatggtcccagtctgagtgagtgtgggtgcgtgtgtgattgatgggatggcatcctgcccagagttggttcccaccttgctccctgggctgttgggacaggctccggccacccatgaccctgaactggaataattaggtaaatacttatctttcttgtttttattaatctttcttaaatgtttgtgtagctcacatttgtttcagtgtttaatattggaagtgttttggtctttctttagaagtttggtgatgttttttgtgaccagaaatatgctataggaacttaactcttgtttacattagactgtggtaaaattggttttgttatacattgttttgcttaaaatagtaatatccaagaatctattgatgagttaagtgaggacttactgtgttgtttcttccaatacccctctttcctcctctgttacaattttttccatgattaacaatgtaactttttttttctttctttttttttttttttttttggccatggagtctggagtcttgctctgttacccagggtggagtgcagtggtgcagttttggctcactgcaacctcagcctcccgagtagctgggactacaggcacctgccaccacgcccggctaattttttgtatttttagtagagacggggtttcaccatgttagccaggatggtcttcatctcctgacctcgtgatccgcccgcctcggcctctgaaagtgctggaattagaggcatgagccaccgctcttggccatttattggctatttatatgtctatttaaatctgttgcttcttttaaaattgggttatttgtccttttattgtattttaatagttctttattccggatacaggttatcagataaattatttacaaagattttctcccattctgtgggttgtcttttcacttttcatgatcatgccctataaagcacaattttttttgttgtttgtttccttttttttttttttttttgagacaaggtcttgctgtgtctcccaggctggaatgcagtggtgccatcatggctcactgcagccttgaa

SEQ ID NO: 3256 - DNA, 1029 bp, Homo sapiens
caccttctgggcacacctgtctggaagaggcaggaggactcaggtcacagtcccctgaaactgttgcctctgtgctagatgcaaaaagctcatccacccaccaagccccctccctacatcccccagactcagagatgaagacattaccccacgcttcctgactgctgacggggaagacaacactacactcaagctaacgatgcaatatgagctggaagtgggggcaagaagcagtgagaccccctgagagttagggaggagggcttctctgaggagaaagcttctacagagccaagcctaaggtgctgggcagaaaagtgagggagttcctggaggaggaagaggatgtgcaaaggcctagagatgcgaaagggtaacaggaggcaggagccacaagcagttagctctgttgggcacacgctgtgtttagggaggggagagggctttggcaaggtcactctgggtaaggtggaggctggttggagcgggtgggcagcatcagagaaagcagtggatgaggctcagataggccaaccgcagagaaacctgtgttcagcctcaagaatcacccgcagggagaaaatgcctgtgttcagcggctgctgaggaagaagaagagactcggggaggctgtccaggtggggcaggccgggcccagttggcttcaagggaatcagagtggggcctggtgagtccggctgagggctcagaggagtggcggcccagaggaggtttcggggaggggaggagacagtggtggattgctcagtggaagggactggggctcaacatgagataggtcttgagaaggggaggaagggcagtgaagggttgtgggccccagggctttggaactggggcagagagaggagacccaggaaggaagtgggagtttgacgggttgattatggcacagtgaaggggccccttaactcgaagggaagatgggggttcactatgaagagaggggcatagggagagggaagtgatggtaggaaggcttggtgagaacaggggctccaggagatg

SEQ ID NO: 3257 - DNA, 1030 bp, Homo sapiens
tacctggaggaggctgggccggtgggcaggggttgagctgtggccaccagaccatttggggaattcagatctattgcccgtcttgttgcccacagagatctccagtgtgacagcccaggcggcagagccgagggtgagtggtgggggttctcctggagccctttcggggtaagaaggagggaggccgtgcccttgttagaacttcctggccttctccttaagtttgatcaccctgctgatgtgcttccctctcaaaggcaggggtcctgttcttcctgagtgcatagccagattcccaaaggggatgagctgtcaataagtgaaactgggccgggcatggtggctcacgcctgtaatcccagtattttgggaggctgaggcaagtggatcatctgaggtcaggagctccagaccagcctggccaacttggtgaaaccccgtctctactaaaatacaaaaattagccaggtgtggtggcgcatgcctgtaatcccaggtgcttgggaggctgacacctgagaatcgcttgcactaggaggcggaggttgcagtgagctgagatcacgctgcttcactctagcctgggcgacagagtgagactctcttccaaaaaaaaaaaaaaaagtgaaactgggcccatgaggggctcactatacacatggtggtttgagaaaggctgggagtcagcaaggggatggggcttggggtggggaggggagcttggtaaggagatgagacctcaggagggaggggtccaggagctcatcaaggatatgggaagctgatgaggatgtaggtgttcagtaagggacctcctgctcttcctgcctggcaggtcctggtcccggcttctcgcaccctcatgtcagccccggccccgcccggcggcctgcggaggacaaggtcaggatgcgtgtgaagccccagggcctggtggtgacttccagtgccgtgtgcagctctcctgactacctccgggaacccaagtactaccccggcggcccccccaccccccggcccctgcttccca

SEQ ID NO: 3258 - DNA, 1049 bp, Homo sapiens
aggtagtcagtcgatcagtgcaccggggaggatattggatttctgaaccgcaagtcagcactattcgggcctgttatctctcccaggctcgggggtcaggaggcgggaggcttggcgcactggccgcccccgccgagccagcttgggcgcgtccactccccctgcccacacatcccagctctggcctgtctactgcccacacaggcctcccctcggcccttctccccggcccaccctgcctctgcttcgctgcctctttctcaggctcctgcagaaacccctggtccctgctctctcctgcctttcccatctctgcctggctcgcttcccccgtgcctctctcccctctggggctcttccttggtccttactggcctcagactcactctgggcctgagctaccccctcccctcagcctctgacaaggtctcacccgcctctctctaccttcctctccatctcccttcttccatgagcccctcatcaccagtccgtctctgcttttgtgtttgtgcgtgcccgtcttccagtttctgtctttctctgtctctctgtctctgtttctctccccatgtctctgtgtctccctgtgtatctttctccctcttcctctctgtcttttcctctctccctctggcacgctctctctctctgtcttttcctctctctctcttgtgtggtctcggctggtgtctgcaaccagaacaaatctcccccagccaacaccccctgaacaaggaggccagagcagctaatgggaaacatgtgattctgccttgcgcctggagcaccgtgaagggagccttagtcccagcccagcccctgcacccctccttgctgtgttccccccaccacactgtcctctgcctcccagcagctcccccagcctgtgtgggcactgttggaagttcatttacactgggtgggggcctgacgtttatctgctggggagtatcaggttgtggaggggctaagggcagctttgctcctgaagttcccccccaacactcagggccaggcagaccccatgcagactcctcccacccacc

SEQ ID NO: 3259 - DNA, 1035 bp, Homo sapiens
caagtctagggagaggagccacttgctcagggtcacagatacctttggcaagaccaggctgggacctgggctgtttgcactccacctcactgtagttagagaattggaacagctgcagggggcctcctgggagtggagggggccggagcctggggagagaagcaggcaggcacccttgtggccagagcccccccaggggagggggaggcgccgctgctgccgggagagagagggagggaggcgagagaggaggggaaacagtgagtcaggcttccaagagctgaggatgagagagccagagctgggagggagagggcagggagggctgctcagaagggaggagagggagggggcccaaccaggggcaaggagagctcgagagggagggagccagcccctggccctggccctggccctggccctgtggtagggctgtgtggagggtgtagccaatatggactttacccatggtaggtcaggaaggagcctgattctgcccctgcagcatctctttcttctttcctcatttatgatcctaccccagggtctcaggagggatgactgtgtcctcccatcccttcctcttgggcctcagtttccccatccattgtgggatttggactgtgagctattggagagggagtgggggacagggacagagtagccagggagaatgttaagggatgctgtctgaagctgctggctttgtgacgggggcgctgtcaccagtgcaaggtagggtgctggtctctgcgttcatgtcatgacggtggatgctggtgttggggggcttgggcaggcggtgagcactgggatgcactgtatatatttgtgtgtgaggtgctagattcaggatggccagtgcctagacagggccagggtcactacatggccaaaaccagcctccactgttgtgggggtgacactggtgtgatccccccacgtccctatgggtagatggaggtgggaatggccccagtgcagttggcaagaacaacccctcatgcctggaactgggaccagagcaggaggggt

SEQ ID NO: 3260 - DNA, 1050 bp, Homo sapiens
cagtactttgagaggccaaagtaggaggatcacttgaggccaggagtttgagaccagcctgggcaacataacaagacgtgccatctctaaataaattaaaaaatgtgaagggatgtgctaaaaattactttctgtctcccagtgatcatcttgtgtttccctagggctgtgtgctccccactttggagaccactgcctagggggaatccctagtcccattataacaccccaccaccctgtggcttattccaggggtaaagaaaataaatgcactctgaggctggtatctacctctagttggatccctgctaatcctcattgttctgacgaaacggccagacccagtggctcacgcctgtaatctcagcactttggaaggctgaggcgggtggatcacctgatgtcaggagttagaaaccagcctggctgaccgggcgtggtggctcctgtaatcccagcactttgggaggctgaggtgggaggatcacctgaggtcaggagttcaagaccagcctgacgaacatagagaaaccccatgtctactaaaaatacaaaatcagcccggcatggtggctcatgcctgtaatcccagctactcgggaggatgaggcaggagaatcgcttgaacctgggaggcggaggttgcggtgagccgagatcgtgccattgcactccagcctgggctcaaaactccatctcaaaaaaaaaaaaaaaaaaaaaaaagaaaccagcctggccaacatggtgaaaccccgtctctactaaaatacaaaaattaactgggtatggtacacacctgtagtcccagctacttggaagtctgagaatcacttgaacctgggaggcggaggttgcagtgagccgagatggtgccactgcactgcagcctgggccacagagagagacttcatctcaacaaacaagagaaaacagtcacaggtgtggctttcaagcccagcgttcgctgctgtgaaatttttctcactgcagcatttggctactcagcccttttttttttttctttttttttttttttttgagacggagtct

SEQ ID NO: 3261 - DNA, 1054 bp, Homo sapiens
cagttctattgtagtaacttgtaaaaattctcgtttttctttctgagcagtgtaatgaccactttatcatctgaggcagtgtaacatagtgaaacttggatttgaattctggctttcccactttttagttagaatcttgagcaggctatgtcagctctgagaacctccatttcctcatttacaaaaagaaaacgttatttcccctgggtttgttgtgaagattgaaaaaaacatagtctgtaaagcgtctaaatctagtattgccatttaaagggattatataatggactttaatgttgactctttggcagtgtgtgatcatgtaactgaatcaaatagctacccatttggcctcaagatgagactttccaaaagcctatggtcattttttggccaacttgattggctgtttcttacagaaaaagaaactagttcaatgatgtttttgacaactcctgaaagtaatctacatcttgaataaaagaaccaattttgagataaagttagtgagacgtaacatcccaataagaattctctggccgggcgcggtggctcacgcctgtaatcccagctctttgggaggccgaggcaggcagatcacaaggtcaggagatcgagatcatcctggctaattcggtgaaactccatctctgctaaaaatacaaaaaattagccaggcaaggtggtgggcgcctgtagtcccagctactcaggaggctgaggcaggagaatggtgtgaacccgggaggcagagcttgcagtgagccgagattgcacaactgcattccagcctgggcaacagagcgagactctgtctcaaaaaaaagaattctctgctttaactctgtttctaaatgagatctagcagctgtgtagagaaggctccacctacttggtttctaacagtggatgaatgtatggttgttttctatacatgcagagttgttaacatctgcggaactatgcaaatgtgtaaaactcagccagcatgttcatttgcaagtgtgttccttcttggttattttctcaaagaacaatgactaaaaacaagtaa

SEQ ID NO: 3262 - DNA, 1072 bp, Homo sapiens
taaaaatacaaaaattagccgggcgtggttctgcgcacctataatcccagctactcaggaggctgaggcaggagaattgcttgaacctgggaggcagaggttgcagtgagccgagatcatgccactgcactccagcctgggcgacagagcaagactctgtctcaaaatgaataaataaaaataaagcaatctcaaaatactagcaataaaggattattaagtaaaccatgacacatttataacatactacaaatgatacagaaaagcgtgtattgccacaaagaagtgtttgccataaattgttgagaaaagcatattacaatgtggtatgcaggatttgacccaatttttacaaagcagcatatatataagtgtctttataaacatggataaaatagactgaaatacagtatatactttttatccttttatttttcaattgtgcagaaggcctcttggtgttttgtattttgtttttgaaatacattcattacagaaaatttggataataaagactgttttaggctgggcatggtgactcacgcccgtaatcccagcactttgggaggccaatgctggcgggtcacctgaagtcagaagtttgaaaccagcctggccaacgtgatgaaactccatctctactaatgatacaaaaatgagctgggtgcctgtaatcccagctacccagaagctgagacagaaaaattgattgaacctaggagacagaggttgcagtgagccaagattgcgccactgcactccagcagattgcgcactgctctgttgctctgggcaacagagcaagactgactcaaaaaaaaaaatgcggttctccttcaaaaaccacaagttatctatagagaaataacttggtagttatgtaatttttaaattttttccttctcagaaaaataaaggataattcattcagcagttattgttggagtaccaattctgaactagactgtgcttggttccaggtataaaaagaatgaggtagacacagtccctgccatcaagcagggaggtagatactatggatacctaatactacttgttcatataaaatgca

SEQ ID NO: 3263 - DNA, 1147 bp, Homo sapiens
gttccagaccagcctggccaacatggtgaaaccccatctctactaaaaatgcaaaatgctggcacatatagtcccagctactcaggaggctgagccaggagaatcgcttgagcccgggagacggaggttgcagtgagctgagatcacgccattgcatgccagcctggacaacaggagcgaaactctgtctcaaagaaaaaaaatttaaaaagatgtccaacatggccaagctcttactccatttccccaggagctccatttgatagtcaaaaaatctgtcctacaagaagctattcttctaccttttacagttcatcacaagacctacaagcaattccaaagtcctgtctccattagtcatttctcaaaccttttcccaataccatctcattttgtcagtgacctgaacagcagcaccagcctgtctacaccctaaagctggggtttcctcttgaaggtctgttctggcagcagcaggtcattcttccttatcctgtcccccactctgacctattcattttggtgaattctcagagcaacatgtgtatctattcagcaggagctctggagttagacaaacctgggtttggattctaaaagtgtggtattggtttgctatatgaccttggtttccatctctctgaagcaaggataatgagatttgttttgaaattcaatgttctaatatatttaaagtacttggcacatggcaggtgttgaatgagtggtagttattactttcttaattgaattttgcatgttttttcttttcagagagcccgagcccagcacattgtgccctgtactatatctcagctgctttctgccactttggttgatgaagtgttcagaattgggaatgttgagatttcacaggtatgtcaaataatttgtgaaagaatcacttactcataataaagaatgaaataagacttcattaaaaaatacaaaaatgtagccttggtttcagggggaaccagaccttttttttttttctttgtttcttctaacctaggtcactattgtggggatcatcagacatgcagagaaggctccaaccaacattgtttacaaaatagatgacatgacagctgcacccatggacgttcgccagtgggttgacacagatgtaagtggctgtttttga

SEQ ID NO: 3264 - DNA, 1048 bp, Homo sapiens
aagggggagaccctcttcattagagtcctcatgaaattagccaaatgatgagtccttccctagctgggcatggtgggttctctttttttttttttttttttttttgttgttgttgttgagatggagtctcgctctgtcacccaggctggagtacagtggcatgatctcggctcactgcaacctccgcctcccaggttcaagcgattctcctacctcagcctcctgattagctgagattacaggcgcccaccaccacgcctggctaatttttgtatttttagtagagatggggtttcaccatgttgaccaggctgttctcaaactcctgacctcaggtgatctgctcaccttggcctcccaaagtgctgggattacaggcatgagccaccatgcctggccaggcactgtgggttctacaggatgggtctgtaatgtcacggtgagggctctctctagtagtagatctggagtgaggtgtgtcttgggttgaggaggtggcttgactttcgaatgtaaaactgactgtgccttagcatcaccctgtccagtgcccctggggcagctggtagtgtccagaagaatggacacctgctccagatttagatgcccatctgggcttttgtttgatttgcggcgttcctgtcttctgtaaagctagtgagttgtcccaagagactgatgccacagcttgttcgcagtttacacaaactcagctttaaaattccaaatagaatctgacttgcaaactctagctgcagcatgtggagcttctagatgtttactaccttgaatggttgtcagtgtcactgaaccacaggggagaggagtatggggtagagcaatggtctgggccaaggaatggtgagcttagggtcttcctctgactccttactcctcaaggaggcagttagggtccctcttaagcaggcttctatttcttaccactaaattggtttcctttttcatccagaagttagaactccccagatattcacactataggatctgaattccgagattctaaaatatcttaaaccacaagagagaa

SEQ ID NO: 3265 - DNA, 1471 bp, Homo sapiens
acttacagtctggtgtaggacataagaacatttgaagtgtaagggagcttgtgcttattcccatgagctgttggagaaatgaaatattgagataggagtagaaacaagggatgggatagttacagaactcatgaagactgggatgtgaatcaggtcttaagaggaattggacagcaaggggtgtgagagtgatcacccacacataagagattccataaggcatttcattatcctgccactgtatatggtctttttatagtatgtcatgatggtaatatcacttctactccctggactgaagtaatatgttttgtcttttaacaggagtgtgaccaggtacatgtggaagatgtggcttctgatgacaatggccaagacttgaggtgataaacataatgattcttgaacaccagtacacctgttatgtgcaagatctgtctgtctaggtttggaggaaaacaaagataaatagaatatatctctgaaagagctcacaacctgttagaggacatagaaacaaacatagttaaccgtgatgtatagtgtgagaaggtgacaatagaaaatgccgtggagcacgagaagaaagaattctgttgggatagggagtgggtagtgccaacactggagaggtttctcagtggagtagcattaaagcagaacattaaagaatgggtagcaagccaggcacagtggctcacacctgtaattgcagcatcttagaagcgcgaggcaggaggatcacttgagtcttggagttcaagaccagcctggacaacacagggagatcccatctctgtaaggtagtcttccacattttattatagtgaaagttaaaccaaggagatctcagtggcaaaatgcttgctcaggctcctcattcctctttgttctggcccactagccttagctaagaaagatccaaaaatttatctagcttaaagacttataagaaaaaaacctgtcacatcttttcatattagtttgtttgaatgtttatccctttttataagtaaaatgttcttcccagtaactaccccaaaattcagtgttctatccaccagttctcaaatacggagtagaactggacataccaccttaataaggacctagtcaggtagagctgagaatattggaaggtttcactttcaggtacagcatccagttgtacatgttgtggtgtcacatggtcatggagggcacaattcttatgacactttactgttcttttcagggaaaagtctggtctgaagagtttatattctgctctgaaccccagttgttttttttcctcttatacgtgtggctaaccagtaattacttatcatgtcttagcagctatattttcttaagcacagaatctcactcttagcatattgggatctattttaacttttgattgaaccaagttgttcagtcatttttagatctttacttatgaaatattaatccttcctagtttgtataattg

SEQ ID NO: 3266 - DNA, 1068 bp, Homo sapiens
ggattttctttttaaaagtaggcttttgtgtagccaaaattatcaccaaaaccatgcacttaagagtgtttcactcataaagaatatccttggactctcatgcagatgcaaagctttgtttatggttgcctagtttattgcaaattaaaaggcagatactgctaaggaagtcaagaagtgacagaccacagaggaaaaacagtgaaattagaacctaaaaatcagaactataattaagttatatttagtactaaacaattgtctttacacatcacagtagcctctgcggtatctctgtaatatatgtagcacagcacagtttttatttttgaaacagtaactgagaaaatctaaaggtatgtgtgctatttcctccttgctcagaaggcaggaagggatataaatatattttagaaagattgttactcaggagcattatgataaaaagaaaataaaaatgaacagctatgatgtttgtcagtatgagatagatttatatgttctgacttggaaagatgaatcttagaggtattatgtggaaaagcaaattatgtacactatgtataacacagtccttggctggcagtggctcatgcctgtaatcccaacactttaaaaagccaaggtggaggattgcttgaggccaggagttcaagactggcctgggcgacatagcaagaccccacctctacaaaaaattagtcaagtatggtggcacacacccatagtctcagctactcctgtagctgaggcatgaggattatttgagcctaggtgacagaggaagaccctgtctcttaacaacaacaacaacaacaaaaaatcacaatcccatttttgttaaaaagaagattagtgaatacatagaagaaatctggactgagtgtagtggctcatgcctataatcccagcactaaaggaggctggggcaaaagtatcgcttgaggcctggagttcaagaccagcctgggcaacaaagcaaaaccctatcttatttaaaaaaaaaaaaaagaagaagaagaaatcatctgggtgactcttctgcaaactgttaatagtggttaagtc

SEQ ID NO: 3267 - DNA, 1023 bp, Homo sapiens
tttgatattctaaattggggtagggaataaagctgtgttagagttggacaactttgcatctaattgtaaccttatgtgtgttttctctccttttcacattctggagtgtggctctaaaataaagttgtgttgtattgcaacacgacagagtaatagaagtagagtggtggtatactggcataacaagtttttggttttcttgttatttgtctattttcagtacttgtgtgataagattatatacttactttagctttgtatgtgagttaggtacagtggttggtagaaaagctaaaaacagctgtgactttaattaaatatacaagcaatcacatcttttgggagaagtgctggtttcacttttgttagatagaaatggagtatttcatttttataatgtatgcagctttctaatttttgtctctttgtctcctgtcagtaggacatggtaaggtggacttagaatcccatttttccttttttgtttgaaaatcaggacagaaagagcagggtctgagaacgtaaagattttgcttaaataattgggcagtacagttagtagaagttcattatttcagaattaaattaggtcctatctttggatgattattttctttagttctaaaagtcaaggtttcactctacttatttatttttattattgagatgcagaagaattgagttttccttgaaattgatgacatatagacagatagttggttgtgaatgcatttagttgatattccggtttgtcctatttaaagtgattctgtgtgtctgtgttaacagttatgtaaatgttccacattaaagcaggttagatgttatcataacttgctgacttgctaggccagtccctatcatttttagtgtaactctaatccttaaaaaaatattttattatctgcacgtggctgtcattgtaaaatgttcaatgcattaggcaccatagtaaccagcagaagtggttccacatgttggcttttgcaaggtattataaaagtcattgtgtacacctctctt

SEQ ID NO: 3268 - DNA, 1034 bp, Homo sapiens
ttatgctcaattccacataaagaggacaaaaaacttcagacaagggagttcagagttttggattccaccactgtttctgctgcttacaggttcatgaggcagtgccttctcttttgtttaatttcctcaactttaaaataaggattacatttaatgatctgtgatactctatcctttgtagcatcttttgttatatattttcttgcatttccaagagagaatcgtgtctgtccaatagagtgaaaccaaatgtgaagtctcttccaatagcaaattctttaactattggaagttcgttgcttttgcttagagctgtaaaatgaaccaaccctgagtttgtgtacagtgtctaaataacttcttaggaaagagatgacacagccagaaaatcaaatgaatctttctgcctatactgttgtcacaaacagggtaagattttttaggtaaggcaagatcactgtgatttgaaatgcttttccctcaaaactgaaattttttttctaatggaaaaagttgggggcaagaatgaagaatttgtgtctaattttagcttaatgtcttgaacattttttatataagcatttaaaaatatgtatttaaacattttactatacttttaaatgtaagctttgtatctgcttttgattcttatcaaattatatgtaagctattattaaactaacataaaaacatgtattcaccttttaaataagcttgtattgaaatagtttacagttacagtgtagttaaacttattgttcacatgttgtttgtttctcatttttcgtttctgtagacaacaaacttatactatttttaaaagtagagtttgcttctttcccccctgtatgtaattcttgggtgagcacctaagaaaaattattcagattaggctgtggccaatcttatgacctcttttatactttatccaggaacagtctgaagacacatatgattttacagctgtgcctgactgaatatgtctttatcttctcataacccagataacacttggttttattgtttagattttt

SEQ ID NO: 3269 - DNA, 1025 bp, Homo sapiens
caaagagtgactagagaaagaaactgttttgtgcagaagtagaagttgaaaagttttaggagtcttttgttcttctaaaatgactttggcctgtatattctgcattgaagccattaaatgaaatgagcatcctgtgtagtcattggagcagttgtgttccatgctgctgatcttcaagcctgaccctccacctagctgccaaaccaaaacaaacaaacaaacaaacaaacaaacccagagacagcttaatgtgtgtttgtttttaaagctcaggaaaaaaaattaccgttgattttctacaaaaatttctactttagttggtagccctaagggctcaatttaaaatatgtttctgcatattagttttaggcttaccaagttttcttattttggtttggtttgattatttttggttcttttttgtcattttatttgctaatgtactttgtcttacttgttttgtttgtttgttttttggtccttgaatcctgtgtttacggagatgtagttttttgtttgtttgtttgtttttttgagacaaaaaacaaaacaaaaccttgctctgttggccaggctgtagtgcagtggcacgatctcggctcactgcagccctgacctcctgggctgaagtcatcctcccacagcctccagaatagctgggactacaggttcatgccaccatacctggctaattttgaaatttttttggagaggcagagtttcaccatgttgcccaggctgatctcaaactcctggactcaagcaatctgcctgcctcgggctctcaaagtgctgagattaaaggtgtgagccaccacccacaggcggctgatgtagttttgaaaatttaagaaacaaagtatacctccaacaagtccttgtcacttgtaccttgtagcattatggtttctgtgctgtgcctaagctgtttcatgacttcatttattttgttttgattataaataaaagcctcatggaacttctttttaggtagcggtttgtccaaaagatatttctgttctgca

SEQ ID NO: 3270 - DNA, 1027 bp, Homo sapiens
tggatgtgcacagctgaggcaaaaacgccaatattttgggacgttcagctctgttttcggcatggacgcttcttacaggacacttgtgatgatagaggacagaatttgtggagagatcattagccccagatttatgaatttattgtgttgtttccgaaaagtggtctgctgaagagttcactatagtaatttcaaagtaatctttaaacttagtatgcacatatgcattttttcatttttactgtattaagttttctatttgtcttcctcttccttcattagccagactttacttagaattacattacttagaagtacattacttagaatattcttctaacttttgtatttttttttccttaccatttccacctttgtagtaaaactatcattttctcattttgagatttagggcacctttcttaaatttccctagaggtttaaagtcatttataacatgaaggaattgcatttaataatggttagtgctccctttcccaaattttgtgatctagagtataggcttgggtaatctttattttttcccgatgtttatagtgtatatctagcacttgattgcagcggtttttgtgtcatcagtttctgtaatctataaattgtgctttaaaatgtagtacttcagtatgaacttaaatacagctttgagcacctgcttatcttttggctaattagctatagaaaaatcttcattatatgatacatatacatataagagtgtatagtccttggcttattccaaaattgggctctcttcagctgtttttagcaaaggactttggagcttggccatgttagtcctagaagccacggagaaggacccttctgattggctttcaggacttatctaactgctaagtgaagcctctttgaaagtttcttatgtgtacctcctccccactacctagctctagcttctgtccaacctggcctattttccatccttcaaaacaaaccccaatgtgtatggcttactccagctgcttccttaccttcaggtttgtgggct

SEQ ID NO: 3271 - DNA, 1030 bp, Homo sapiens
gcttaggcaggaaaatcgcttgaaccgcggaggtggaggttgcagtgagccgagatctcgccattgcactccagcctgggcaataagagcgagactccatctcaaaaaaaaaaaaaatagagttgttcctcctattggccctacccctgctctatggggttggaatcagactttcgtagagtgggccagccattgctcacaggtttccacaggtgattctaatattcactctgattgagaaccactgggccttgtaaattataaagtgtccattgggctatttttttcttttttgagttattacggtttctcgacatttgcaaaaataaagggagggggagttaaactcttttaatgaatgaaggagaaatgcaaaattttctcatgtaaaaatgtctctgggtgtaaaataaattattatttttatgatgaaaataagcattatgttatttgagtaccataagacaatataattgttattctgttgatttgatcattcatatttctttagcaatttctagaactgtgtgccagcctgtgttctagaacatggggtactattctagatgctgattataatatatataattactgagcaactcttaaatatacatgtaatttattttcaccttttttatggttttgattttgatacttccaggttcttcagatagatcctgaagttacagatgaagaaataaaaaagaggtttcggcaggtacagtactatttccctgtttgaactttttgaaaatgtatgaagcacatgattcttttatcacttgctattattgacttgatatgtttgggccaaaatttaacttttttttaaggctgtgtaactgttttgtaaaaaaaagctcataataatatataaaatcttaaataatttaatgaccatagcttacctatgaatagaatgaattttatatccaaatagaatctctgcaactccttaattaagagggataagtataaagtagaataatagagcttgcatggagttgtaactaccaaaccccctgtcttc

SEQ ID NO: 3272 - DNA, 1020 bp, Homo sapiens
ccgcctcctgggttcaagtgattctcttgcctcagtctcccaagtagctggacaggtgtgcgccaccatgcctgactaatttttgtatttttagtagagacggggtttcaccacattggctaggttggtctcaaactcctgacctcaggtgatccgcctgcctcggtctcccaaagtgctggtattacacatgtgaggcattgcgcccggcctgagaactacaactttagacttactgttgtgaaaatctcaaactagcctctattgcaaacatgtgtttgcatcatataggcatgcatagacatgctgacggggtttatgttacagccaaaaagctaatgccaacaccaaccgctggcacttctatatttacttccaggagcccttgcctttaccacccataccccgctacccatgtacctcccactcccccagattgaggagggagctagctaataggcaactgaagcactggattggaactgcaactcaaggttgtgggagcaagagttctgaagtgaagaccttgatcagcacaaacctgatcatgtgaccttgtgaaagttacttcacaattccctgcttcggttactatggttataaaattaaactaatggaatggatctatttgctaaaaatatgagatttaatgagcaaataattttaaagtgctccattaattctgcgattgttaaataacttcactgcataaaattctatagaactctttcaaatatataaaaaaaagcaccccaatgattctttttttttttggaaacagggtctcactctgttgcctaggctggagtacagtgccatgatcacagctcacttcaacctcagcctcccaggtagctgggactgcaggcctgtaccgccattattattattattattattattttgtattttctgcagaaatggggtttggtcatgttacccaggctggtctcaagctcctgggatcaagtgatccgtccgcctttgcctcccaaagtgctgggattacagcggggagcc

SEQ ID NO: 3273 - DNA, 1096 bp, Homo sapiens
tctttctttctttctttttttcccctcttttccttttcttcttttaaatatacgtttggaaatttgccgggcgtggtggcgggcgcctgtaatcccagctactcgggaggctgaggcaggagaatcgcttgaatccgggagacggaggttgcagtgagccgagaacgcgccactacactccagcctggacgacgagagtgatactccgtctcagtcaatcaatcaatcaatcaatcgtttgattttcgttttatgcttttacttccaaatttatatttattgcaaaaaatgtggaatataacaaagtgtaaaggtgaaactgaaataacccgaaattatatttccccctctgtggtttttttttttccgtctctgtgtttttcaatgtttttcaggccttctgtcttgagctcgtattactgctgttcactgatgtattgtaaaagcgtaaaaccggacgtgacccaaatgtctatcaaaggagactgatgagagaaataaacggatttgttcacacaacggcttctacagcaaagaaacagaaggtagctccaagtgctctgaaatggaaaggtatgcaggatttcctgttaggttaaaacagaacgaagcaaaaaccgaggttgcgcaatgatacatatagaacagtctcatagttgtatacatagttacacagaggaaacaaagatctggaaagatgtgtagtttgcacctgttaccattggttagctctggggtggacggagaagggagaagttttaagattctttatataatacacttatttaatatctatctatgtgctaagttgtattacatttgttgttttttaaagagatccttttaaacagagaagggagaactccctcaaatcccaattgcactacaaagagaaaccaacatgttggttatttttatagcatataagtttatataccgtattaataatgtatagctatatagcctgctttttccacttagcacatttcataatttttgtaatattaaatattccttaaatataattgttaatggttgcagactattcatgtatgctataatttattaatccttattgagaacatttagggttttc

SEQ ID NO: 3274 - DNA, 1124 bp, Homo sapiens
ccactatgtctggctaatttttgtatttttagtagagacagggtttcaccacgttgcccagggcagtcttgaactcctgaccccaagtgatctgcctgccttggcctaccaaagtgctaggattacaggcatgaaccactgtgccgggccagaaagtcttagcatcttagtaacatttacatttggcctccctcgtgtgcccttagctattcattaccagagggcaaagatggttagaacatgatttacccaccctaaaatgcattgaaggcatcagagggcaccgtgggccacaaggcctggtagccacaaatgttcagtggtggctggagctcatgatgcattctttggtgggacgtctctcagcattagggagagttgagagtggggtagaaacaaggggttccatgtagcacacactgtatttagaatgactggtccaggatgaaacctaatttgagtggacatccatggatgagaaatgcggatatgggactgagaccagctcctaggaaaatgtctgggtgggggaaatctgggaattagtaacacaatggcttacacttcctttgcaggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtatatttgtgtttgtatttttttgtagagaccgaactggtctcttcccgagctcaagcaatccatctcccaaagtgagccaccatgcccagcccttaaagagatctttggagattttttatgatgtaggatgaatgctttgcctcaagcagtaagtcccaacacatgacaaggttggacagtttccccatttacttgggaaacacggaagtgagcagtataaagttcacacggagggtctgctttggctttgagctatcttccttaatcctttctgagctgccttctcccgtgtcaaaatattgatcctaaagtgatccaggccttgtatatgcagatgctgcaactcatgaaaatagatgaaacccattattagagcaagtactaattcttaggccaactggcctgt

SEQ ID NO: 3275 - DNA, 2183 bp, Homo sapiens
atgctggtgtcaggatggcctccagttgaatctgtgacatttaccagctaggtgattttgggactggtgactacgcgcgagacctctggaggtcgccctggtagacacggttttcagaaggacgggttttaggcattcagacccttgcgtgcatcccagcttgttgctttcagcctcgctaagtgactaagcgaccttcaggaagtaacttaatcggtctaaacctcttacctgtaataggcggataaaacggtcccatcaagactgagaaaaagcacaccagctattggcacagcgtgggcagtggggcctacaggatgactgacttagtctacagagatcccggcgtacttaagcaggtagtaatgatggacaggtgaggctttaggcggccgccctgggatctgaattgccccttggcccttatcgaagctgcagctgcttccgcatagctgctgtggtcaaaaaggagcccagagtgacagttttccttgacggtcgccgttctgtttgttgtaactgatctgcaacattttgggaaaatacagttccattgtacctgccacctttcagctgtagccagagacctttatcaaaatgggcttgtttccacagaacagcagaacggttgggggtttgcatgtacagttaaccagcataagactcgtactgggaaaatccagctgggatgtgacacagcttaactgatagcttaaggcatcagtattgggaccaaaggctggtcagatttgtatcattctgaggaccaaatgatgggaacaataaaattgttcatgacagttgttctcattttgctgtccagatgaagactcttaagatgacagaaggtgatttttctggtgatcgaggacttccggggtaatgacagtgatgaaatgcaggggacctggtaggtttcttttggagactaactgggggctgcctggtgggacagaacagcatgtttccaagggctgtggctggtcatagccatgggatctccaactgcatgcaagagcaacctggaaagactttgacagcgcaggtcagtacaatacctgcaagctgccactcagctttcctataatgtttcaggaccagggctggaagccttccatgtgtcaacttcaatgtagatgggtttttttttttttttttttttgagacggagtcttgctctgtcacccaggctgctggagtgcagtggcatgatctcggctcatggcaacctctgcctcctgggttcaagcgactctcctacctcatcctcccgagtagctgggattacaggtgcccaccatcacacccagctaattttcttgtatttttagtagagatggttttcaccatgttggctagatgggtctcgaacttctgacctcgggtgatccgcccgactcggcctccccttccaaagtgctgggattacaggcatgagccaccgctcctggccagtttagttttcacgctaagctttttgttctgcaggttgcccccaagtttcctggcagtgtgtgatactgaggaggtgagcttgtttctggagctgtgctttaaggtaaagttgatcagcttaatcctcctgatccctttcccatcggatctgaacactggtcttggtggtcgtaaaaggaggaaaagtaatagtgaagctggcctaaatgttgtaatctggtatatggcatgtgggctagtttcagacaggtttcagagatggttggatctctgaaattgtaaaatgaagtataatcttaggctaagggaaggatgcgtgtgaagctctggaggttggtatagtaatagctgacctattactgcatttgggagggatctgtcatagcttccttgcctcttaattaagggtggtgtttttttcttttagattcatgttacatgtaaagctgtcctcatttgtgactatggacctatggagttgggtaagttagtgactacccaaagctttgtcacaacttggtgtgtagctgcaggtagtgctcaactatctgggatcctgtcctaagtagtcaacctaatagaactataaggttacttaggtctgtgtcaaagttacagctttttttttttttttttttgagacagggtctttctgtcacccaggctggagtgcagtggcacaatcttggctaattgcctcccaggttcaagtgattctcctgcctcag

SEQ ID NO: 3276 - DNA, 1050 bp, Homo sapiens
tgtcacctaggctggaatgcagtagtggtgtgatcatggcttattgcagcctcaacttcttgggctcaggcaatcctcctgccttagcctcctgagtagctaggaccacatgctaccatgtccagctaagtgttttttgtgttttgtttttttttttgtggggcggtgggggcgagtctcactctgttgcccaggctggagtacagtggcgtgatctcggctcactgcaagctctgtctcctgtgttcaagtgattgtcctgcctcagtctccccagtagctgggagggattataggcatgtgccactacgcctagccaatttttttgtatttttagtagagatggggtttcaccatgttggtcaggctcctctcgaactcctgacctcaggtgatctacccgccttggcctcccaaagtgctgggattacagacctgagccaccacacccagccccagctaaatttttacagagatagggcttccccatgttccccaggctggtcttgaactcctgtctcaagtggtccttccacttcaggcacccaacatgctgggattacagacatgagctactgcacgcggccctagtttatttttgtacataagattcttcatttcatttacttgcttccttgtttaaattttgtggactatttcacttaatatttggaaatgagatggtttctaaatatcagctgagagtaataaacattcttcattccctcaatttttaacctgtggatattaaatggtcaccattccatatatactgaagaaccctcaaagtctaacagacctcattttacttacttttttttttttttttttttcttggtagagactaggtctcgctatgttgcccaagctggtcttgaactactgggctcaagtgatgctaccacctgggcctcccaaagtgctgggattacagttgtgagccattgcaccaggcctctttttactctcaagattcatcctttattacaggttcttctagagctaattcttgtgcttttcttctccagttaattggccttggtcctcaca

SEQ ID NO: 3277 - DNA, 1069 bp, Homo sapiens
acatgtgcctctaaaacttttttctactcttctaagtggattcctctcagtttgtccatcagcaaaatagaagtaatcgttatacaaaacatataattgaatgaaagcatctcctccttcttaaggctcctctaaatgtcaaggactataacatattagggtacttatgtattgtggcatttgagaactaaattctgttttcacagaagcatagattattcaagatagaaaaacgggaactttgtagagcttttccttgcaatgtagaaagacatttaattttagatttaggaggccaagaaagactaatttggactgggcatgatggctcacacctgtaatcccagcactttgggaggccaaggcgggcgggtcacctgagatcaggagttcgagacccgcctggccaacatggcaaaaccccgtctctactaaacatacaaaaattagctgggcatggtggcacatgcctgtagtcccagctactctggaggctgaggtgggagagaatcacttgaatcctggaggtggaggttcaatgagccgagattgtgtcactgtactccagcctggacaacagaatgagactctgtctgaaaaaaaaaaaaagtaatttgaaaaacaagggcttaaatttgattgattttccagttaattatatcatgaactagatgtttgggggaattgggcttagttaaaactactattttttccccagggttagcctgtactatttgcaagcgcctattatatataaatgatcaaaactaacttataccaacttataagggaaagcataccgatgcccatgtcaccacttcaaagtacttgatggtttaattaatgataatttattcctgagttaacatccttacctatacttgcaaaatgtacttcatttcatttgtggctctagcgttgacttattataataggacttcaaaatacccgatcagaaaatcattgcattataattagagccgataggaacaaaggacaaaaggacatattacctttttttttttttttgtgagacggagtttcgctctttcactcttgttacccaggc

SEQ ID NO: 3278 - DNA, 1057 bp, Homo sapiens
gacttgggctcctaagaggcagaagcgggacagtgaagacccgggctcctaaggattcagaaacggggcagcgaagacttaggttcctgaggggcagaagcagacagagaaaacttgagtttggaagggaacagaagcgggcagtgaagactggggcttctttggggacgggatccgggctttgagactccgagttcctgagtctcggaacagggctgtgagtacccaagctcctaaaagccttggatctaagggaccatggatatgagatcagcctacaaagtaaagggaaagggtttggaaaagatttagtgatccattttttcacagtattccctgaacccagagagataaaggacgtattcaggggaagacaacttctccttcgcactgcctacttggctcttggcaagcttttcttgtgtcagatactcaatctaggaagcccatatgcaaacatcttcattttctgcttcattcttgggaatcagatgtgaagttgaaaacagttggaactcagttatgtacttgataagtgctttaaatcccattccactcaaccctgaatgagcacagatctctgcatctcaaataaaagaatgtcagtgatggaagagtcccaaaagatcatcttttaaaaactcctattttacatttaagaaggctaaggttcaaagaggcttaggattacagtgaggcaatggttagttagatcataattttaatacagtacccttctgtgcgtagcaaatgagatgcttggttaatgttccttaaatgcttctagaatctttgctttatcttcaaactcaggagggaattttttttttttttttttttttgagacaggttctctctctgtcgcccagtctgaagtgcagcggctcagtcttggccccgtgcacctccaacctcctaggctcaagcagtcttcccacctatacctcctgagtagctggaactacgggcgtgtgccaccacgccctgctaatttttaaattttttgtagaaacagggtctcactatattgcccaggctggtctcaaactcctaagct

SEQ ID NO: 3279 - DNA, 1623 bp, Homo sapiens
tctgattggcattgtgagggttcagaaaacaatcctcagccagtgccagccatgctttatattggggggtgtaactccacatgtatgccctttggtctttttatctcctgattagcatgaagtcacatgtgacacaaacagtatcccatgtctcctcaggtcgggctcccgctcccggagcaagagccggagccggagccagagtcggagccggagcaagaaagagaaaagcaggagccccagcaaggaaaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagggggcagcaggagccggagcaggagccgcagcaagagcaaggacaagaggaagggcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaagaaaagaaaagaattttttttaattttatttttccccgtcttgcaaagtatagtgacccctgtttccattaaatttgaataaag

SEQ ID NO: 3280 - DNA, 1136 bp, Homo sapiens
gtgtggttaacatttcaaaagttgaagtcttagagtaccttagttttaaaaatacgtcattccagttctaccttttcagaattatgactgataacctgagcagtacatcagctattgaatgacgaagatgagcgcattggcaatgggataagaatggactaaagtttagagcagcccatgtaattcagtgtggcttttgtttgtggtatccagatacctgtctatacttggtaagactcatggtgcctgcctttttttacagggaaaatgacagcaacttcccctcattcttttgactaggtttgtgaggatagaatgtgaccagaggaaaatagttttggtaaagacaacacagtgcttgggatcagacgaattttggatttcagggttttttttgggatttgggaatgtttgtattgtacttaatggttgagcattcctaaacaaaatccaaaatgttctgatgagcaaatttgagcatcttgttgctgctcagaaagtttcggattttcgagcatttcagattttggattttcggattcagaatactcaacctattgcagagaaacattaaagaaaggagtttcttctcttacttgaagggtgttgtgtattgaatagtgaggtcatgctttttattctttcatatgcataggggaggaagattgaaagtgtatcgcagggctctttgtgtttctgtcaatccctgctgtggaggggtttttacatttgtcttagattctttctcctgaattcctgcatcctatgaattattgaaaggtgttctttgtttttaatagagcagaagaggaaggatttctgctgttagaattagagaaatttatctcttgggttgttttgtgaggcttattcacaagtcacaccagagatgtatatacatatatgtacacacgtgcatacatataatagtatgtatacatgcatgtgtgtattttatattcctttttactctgacagaggattcaaaaggagattgctttctgagaaaagagatttgtttcacgttacttgctgcaaagcacaaagggagtgttaagcttggctttaaaaggctctagtgttagttaccaggaagagctttactttgttgaaggcactaattaattcaggaacag

SEQ ID NO: 3281 - DNA, 1024 bp, Homo sapiens
tcataattggtgttgaagacatggtccagtaagaagcaattatgaaaaataataaacaatctagcatggatcaagccttatgaagaatctagaaatttaacaacataaaccagaaacaacgactattagattttacactaaaaattcgaaatcaatgagtaggaattcaaaggctctggaaggaagaagtgagcaacccaaaaggaagatggagcgataagaggaaagagcctttcaggaccctaaatacctgggtggtttttttaaggaactgttcattcttacagttatgctgccaaaccatgatatgcatgaaatgtcattgaaagtcaaggttgaaatgaagtcattttagagtttcaaagacaggtatgacagtcaccaaacagcacacaatatgacctcctggcatcattgaggaatcattacagaggaaaacgacttctgggaagaagaccaatggtaaagatgtatttcaagcaaaaattgcctgtatggcaaaaacgctggagagtctgaaaggaaggagtgagtacaaaagaaaaagcataacttagctacgtatgtaagcttatagtcccctagcagaagggcagtggatctccctactgggaagcatgtttgaacatatctagattgtgattagtaattgaaactcagaggccgggcgcggtggcctgtaatcccagcactttgggaggccgaggcgggcagatgacgaggtcaggagatcgagaccatcctggttaagatggtgaaaccccgtctctactaaaaatgaaaataaaaattaaaaaaaagtagccgggcatggtggcaggcacctgtagtcccagctactcgagaggctgaggcaggagaatggcgtgaacctgggaggtggagcttgcagtgagccgagatcgtgccactgcactccagcctgggcgacagcgagactctgtctcaaaaaaaaaagtaattgaaactcagaaacagattttggatgctttagataggtctttgaagaattgctggagttcag

SEQ ID NO: 3282 - DNA, 1029 bp, Homo sapiens
ggttttagggaaaactgttgaggaatcaggcctggagaaaatactcaacggggaaaactgggaaccagatgttaggtagggcttggaaggcatggatataaaattaaaaggactggggtgacattttagggcactaaaccttgggtgttagagaactcttggcttaaaaaagaaactctactttgcaacagttgtaatatagctaccgtttactccccagggttatactagtaactgacacctgaaacattttgaaagttacctaagtatgtttcacgtatgagaaaactggtagctaccgtattctcaaatgatgatttgggtttaaaaagccatttcaaattaattattagaatcgttttctttctgaggacgtctttagtaaagtactgatttcttttacagtaaaaggctttaaaaactactccttttctacagtaaaacgttcagttcttaaggatatattgaagtggcgggtagacgttattgtatacataccatatatgtgaaagttgaaactccagtttttttcagagcccagctaaattgacagcataactaacttttgtggacaaagtgtggattttgaagccagccaggcctaagtcaaatcctggttccaccacttactacgtatgggcaagttacttctctgaacctggttgttcattcatgtggaaaaggaagattagagataataaatgtaaagcatttggcttaggcagtaagtggcagctataatcagagggatgaggaaacatctttgcttgttggtgtttgataacataaagcgtgtttggtgaggtcttttctaatgttactcaggtgatagtgtgcaggaaatgacaagactgttaatgggaaactgattcatcaaccaaatgtattgataacccatcaacaaaatgtccaccactgtgctaaatgaattgggggaggaggcagaaaacagttctgctcttgaataaattaagcattatgacatgtgcactttgaattaagaaatgtttgctttcgctttaaactcta

SEQ ID NO: 3283 - DNA, 1024 bp, Homo sapiens
ctgggctcaggcaatcctctcaccttggcctcccaaagtgctggtattacaggtgtgagctgccatccccagcatgcatttatttattcattcattcatttattttctgagacagggtctcactctgttgcccagactggagtgcagtagtgcgatcagggctcactgcaacctcaatttcatggcctcaggtgattctcccacctcagcctcctgagaagctgggactacaggcatgccgccttgcccagctaattttctgtactttttttgtagagatggggtctccttttgttgcccaagctggtcttgaactcctgggctcaagtgatccacctgcctcagcctcccaaagtgctgggattataggcatgagccactgctcccagctggaatctgtatttttcaacctttcccagagattctgagagcagggtttataaaggaaccagggttggagtagaagcgccatggcaggttcaggaagggctctgtctctgccttgcatccactctttgttctctttggacttttcaggcgtggaggaaccatggtaacctatggggggatggccaagcagcccgtcgtagcctctgtggtaagctgggtgcagagggaggcatgcctggagccgggccagacacctcagccaggccacatcccctggcacgacagctgtctaagcttaggcaatgccccgttcctggaggggagtctgtacccttaagcggtacctgaagttcttgccctcagagcccagcatgtccttcctgtgtctgcagagcctgctcatttttaaggatctcaaacttcgaggcttttggttgtcccagtggaagaaggatcacagtccaggtgagtgcatggcccagtgccaagagtcacagatgagggcagtgcctaaaaatggcagcagaaatgaccagctattctgagccctggaggggtgattgggtccccagccccacagaaggatcaaagagaatagccttagtccagctacagtcagcaaacagttattgga

SEQ ID NO: 3284 - DNA, 1059 bp, Homo sapiens
aatcccaatgtcattgcagggggaagcgttgttacgggtgtaggcactggagccagaatggctgggttcaagcccctgctctgtgacttactagctgtgggcctgtggaaagttaggcaatacgtgaaaaacaatccaggcctccgtctcttcatctgtaaaatgggggttatataaaccctctgcctctgaagggtggtctaacacgggtccccagcccccaggccgcagaccagtaccagttcgtggcctgttaggaaccaggtcacgcagcaggaggtgagcggtgggtgagcgagcatggccacctgagctccgcctcctgacagatcagtggcagcattcgattctcatgggcatgtgaaccctattgtgaagcacgcagggaagggatctaggtcccatgctccttatgagaatctaatgcctgagaatctgaggcggaacagtttcatcccaaaaccatctcccccactccagtccatggaaaaattgtcttccatgaaaccggtcctggtgccaacaaggttagggaccgctggtctaaaggacactgggcgatatacaaattgctgtacaaatgacggatggacttcagctttctcatctctaaaacaaggttgttacgaggattccctgaggcagtgcatgcaaaatgcttagaactgtgcctggcacatagtagaagcctggtaagtgtcagctagtctgattagatgaagtgcagcagggatacagaagagagagggcttggctcccaggagctactttctacagcaggtggcagtcaaggggcacttaagaccaaactacccagcagcctcagggacagaagtacctgccctaggacagcagctccttccatttggtagttttgaaagtctaccttgtgttgtccccaaatgtgcctgaggtcatccttaatcaacagactcctagaagagccagggagtggggaggtgaacataggttaagtcaagtgaactccaggcttattcacttaaaaattatgttagcctcaatcctgtatgtcagctgacatgggggtgtgggtgtcag

SEQ ID NO: 3285 - DNA, 1052 bp, Homo sapiens
ctcccttgcctacagaaggatccccggctgggagcctttgacctattgcagatctatacagggcttgatttggttctcttcctggctccacaggggattctgtcatccagaatgcatccaacagcggagtggggcaagcagtcatccagatcgccgcagccctgggcctaagaaccatcaatgtggtccgagacaggtgcgtggggaaggaggcttcatcccagaccatgtcttgggtctttcccacctcccatccctgcggtgcccagttgtccaccagagggcgcccttgcataagcataaactggctttaggcatcgctaacagttggcggctgaaacagatgagtcagtcctaagaaatgaagtccagctggcttttggcgataggatgagtgaatctgacatgtaaagagagggcaggaaggaggtggagactgcccttactgaatagctaagactttctgagactcttggcttgtgataacctcatgttttcaaaaccccagttgatatttgggaatgatttgagctgtattattctttctgtgaactgtctaacccaaggcccctttacccttgcttttgtgtggtacttggaagtgcgctaaatacagacgtgaaggagacaggggcaggtttgtcatctgtcttttacagatgaggaaactgaagtttcagggagcagcttgccctggaagacacagcaagtcagtaatagactcggtttcctcacttactctctttccatcatatcgtccagtttctctaggcctcactgtccatgaatgtggctgtggctgtcatggaagcccactcttagtataatcgacaccagcttcagttcctcagttgtactcgcaaaaataattccatttgccttaaccaaagagacccagagccactcctggtctagactgtgtatgtccaacactctgaagaaccacttgaaaagaggggggaagtggagtttgtcctttcagtagaagaaatcaggaagttaagtgacttctccctgggcacagatggcttctaacactattgagctgtcag

SEQ ID NO: 3286 - DNA, 1113 bp, Homo sapiens
gtgccaggattacaggcgtgagccaccatgcctggccatgactggcagttatgccacattttctcactagtgagaaaagttcgatcccagacatttgctcaacagtgagttaagactaaaacttctctgccctctgggagctcacagtctaacaaggagatagcacatatacacatattctgactgcaaaactaggtgataagtaaaaagagctctgaactcagagtctgaaagacctgaatccaagtttaaatttgtatctgcagttccaaaatcctgaaagcgctggaaactgacaggttttttctataactcatttgaaggaaacgatctaacgaggtttttatgtggtctttattcatcccacttagcctgagtattcctacattttgctgcagaaacattcatgtatctgatcacagggtgctacaacagcccccattgggtatgtagataatacatggccccaagagttttggaaaagggattgtgaacctatgtcttgtcctgatcaattgacaaaaaatgtatgaaatggcttcacaaactaaacattagtaaactcatatgagatagtcttaaatagcatgatgtataattctgtacaatgggaatactgagcaagtgattttttttttttctggactaggaagagggtcaaaagatatcttaagggaagtaaactttgaactgggccttgaagggtgagttgaattcctcacttcatagagaagctgtggaagaaaacattctgggctataggaagaacgtatagaaaatgtgcagaaaaaatgtctttaaacagcttgagcacatgaattttgtcagcttacagaaaaactctgatgatctgtgaaaatacaggagagaagcactgtggataatacaaaggggcagctagtccgaaatccatttgctctgggcaggatttttcttttgaatgcagacttaatacacacattgagagtgaaacatcactatctgggctgatgcctccttgcttagtgcccacctgttagcgctccctccatctccccataaggcaacggcagccggtccagcctgtgctcatttcactgccctctgcttggtgtggggtcagccccttacctg

SEQ ID NO: 3287 - DNA, 1018 bp, Homo sapiens
cccagattcaggcggctttacttgttctcgtatggactgaagccagagactgggattctctttgtagtcatgtcttacaaggtttagggtaaccacactgtcacagaaagaatcaggtgtcctttacacatcctggtaactggctgtctgggtcaggttacaccaggtaggggtcatgggactacctagagtctgaacagagcattgtcagaactagtgtggtttgtgatgcttgcgctgtgggccacacctctgcaagcaggagggaaggaatgaggaacagccttctcaggtctgaatcctcaaaaggaggcctccaggtttctcctgttctcacgtccctgttttcattcctgttggcctccaaacattgcagctgttctctcctaagccattttcccctgttgcttagtttctttccctttcttccaaaatgggattccctaaataagtatttgggccttttttatttaaaagattaaactgtagatctaagtaaagtaagactgtgcagaagaatgacaaacatttgagaaatttcagagttctccatagccactgtcccttgtgcagagttctagattccctatcagatagttcccagaaacccaggggccaggcatggtggctcatgcctgtaatcccagcactttgggaggccgaggcgggcggatcaccagaggtcaggtgctcgagaccagcctggccacatgtcgaaaccctgtctctactaaaaatacaaaaattagtcgggcacagtggtgcatgcctgtaatcctagctactcgggagaccgaggcaggagaatcgcttgaacccaggaggcagaggttgcagtgagctgagattgcaccacaccactgcactccagcctcagcgacagagtgaggctgtgtctcaaaaaaaaaaaaaaaaaaaaaaaagatagttcccagaaacgcttagttcttctcttgccttctttttttcctgaaagtccgctcagaactttgccattctctggatcttctggtgaaaa

SEQ ID NO: 3288 - DNA, 1080 bp, Homo sapiens
gccagatgggggccttgcctgaaagactggtccccttgatcgctggaggcatgtgggtggcaaccagggctgggcagggcttagggtgtgtgggccaaacccccctggggttggcaaagccgcctgtcaggcctcctggtgggggcccctggacacagggagcagaccctctgcctcatggggtaggagtggctgcctcctgtgttctctggatttcttctcccaacaactacaaccctggacttgcctccccaggcctcttgcctgtaaatagaagcccgcaaactgtacagatttacagaggcatcgagactgggccctgggagttgccatctgagagccgatggccccagcatcccccaggtgcctgcctggcaccacagtgaccctggcctcagcgtggcaaatgcatgtaaatatttttcgtaggcagcgtggctccagagagccccctgaagacagtgtccctccctcctgtgagtcctttctcctgtacagaacctgcctggggtgggtgggggtctgccattccctcccccaggccttccctgccccttctctcccctgtaacctgtttattaaccatacctgtcctgagttcatggccaaaaccttaaataagaaaaacaaaagaaaaagacagtggaaaaaagagaccaaggcgcctgccccactgcgggtactctcctgttccagccttgtgaaggaactggttttgtttttgtttttttttttttttttttttttttgtttgtttgtttttttaacacttcctgtgctgtgcccatttataagaggaaataaaattaagctgaaatgatgtgccgtgtccagagtatgagataaatatggtcatttggggagggcagcccatggccgcaccctgggccccagccatcttcccccatcaaagaaattgagaaccaagcagggaaaattgaccaacagccccttgtgggaaccattatggtaaaagctgctgttggttgagagtgtccaggaaaccacggagccgctgcggtgaggctgggatgggggctgtggttgggaggggccaggcagtggtgagaggggcctgtg

SEQ ID NO: 3289 - DNA, 1128 bp, Homo sapiens
tcatctcttgttcccctcatccctgccaccagtctggggcttcaggacctcatgtcagatggatgggaggaagaaagctcctgattggctggtggtggaagaaagggtggggcttgagatgagcctgagccctgacttggcacccacagtgctcactgagatctcctttttggggcagagaggcactcaggctggtttccaggacaaacatttggtaaacacagcccttgaaatcatctagacactgcaacctcttgctcgtatcccagggcctctctctagctgggtgagagggtgtcccttgtcaccagcctgttttgtcctggtctctctggggttgttgaatctctcctcttgcctgccaagtacacatgtacccagacttcatttctttctgcatcttcccccaagaaacagcttcctgagggtgctggggcagccactggtgaggaggggctgctctgatgtccctcctatgaggggactctgcacagacaccattgcccacactatcaccatattttcactcagtcacacacaagacaaaagcatgcaatgacaaaaccatacgcaatcctgaccgcccagccaatcaagacatatcacagaacacacgcgtccttccaagaatgtttatcctcatgcatcacttacacacccccagacacgtactgcaatgcaagtcactagtcatggtcacatgacagtgacagtgtggcctcctcctaccccaaatacacccacactctggcaccacacacattgtctccagctttcaggcttactggggagggtggaatcgagccagaacaatcagcccatattgggtccccctaagttgccccgtcatactcagtcccatgccatggtgcccacaccaaccatgcagccgccaaccccagccagtgtcagacacaatcccatgtggatgcacagtctcactccacatgacctgctctcaatgctggagggaaacaggcaggcccttgcctttctcggaaaaagtgtggggccacagcccttttagggcattgcatgcaggtgggcctggcttcacccctacctgcttcctccccaccgcagctggcagagggggaggtttggggccagacccccactagctgggag

SEQ ID NO: 3290 - DNA, 1046 bp, Homo sapiens
cagctgggtctagcagaatctcgggagagaagggcaccgcgaaccccactctgccatgtagcaactgtgtgcccctcggtgctccccctccctgaatccctgtattttcacctgtggatggtgagaaatacgacttcttctcagtgcctctaggagggtttgggataggaagctggggtctggcacagaggaggagctctcaaaatggtagcaaaaagaaggcagctgagactgggcccagtgagggcacgggctggcatctgaggagatggtacggggtctgcacgccacagagctggctccccacagccctcgcctctggtctcccctccttagccaagtcctttgagcctctttcaaattaatctttgtaaaacccgtttatattgggtcacatctctattcgcaaagttccctggctcccctccctcctgcctggttccgagcccaggagctggctgtggcttctccctcccccatcccctactccccatctcatttcctcccaagttccttcactgtcccggctttgcgtcagccagattgctcaagcagttcccctgcctcaagggcttcttttcccttttaccctccgcctctgcctctgggggaagcccttagtgtaccacccctgccttgagcttgtggtaggggtgcctttggggtctgactcttcccagaatgccactcctgtgttcccctgcaagccccagcaagttttgcagccagtagcgcctcagttgctgctgcctggattcaacctcatagaaactgtaggctgggtgggcaggaatagtcaaggaaggcttcccgggagaggcggcccccagaatttttgacttggcagagagaagttggggaacatcagcaactgaccacctttagctgggctgtgccttcctcctttctctcatcttttctgggaaaattgggtaaagagagggggttgggagacctaatcttgatggccattgcttacctgggatcctcatgcccctcacaaccacccagctccctagctctctccctctcccccaccccctcag

SEQ ID NO: 3291 - DNA, 1027 bp, Homo sapiens
caacagctatactgtcttgtcttctgatgatcaatatgtgcattttcctacatccttcaatattccttgtagcaagtaaaaaaaagccttctatgacacatttatgtcttttaataacctcattagacagtgtagatttgtgagaactcaattgttgatagctgcgtaatattccatgttatggttgtaccctcatttatttaactcgtcccctgtcgttcagtatgtgggttatttccattttttccctctcgtaaattacattgtcctggatctccttgacctaaggatcaaattcttgggagtccagagtgtcagaatcagaaaggcccttagaccaccatgcttggttttccattttgcaaatggggcaaaggaaaggcagagaagggggaagaggatttgtccacggtcttggaggctgtgggcgcctgagccagggctgctacctgctctcctgttggggctggggtggggatgtgggtggaggcaggtgccacagtgggaaaaagggcatcctggggggatggtgggaacacagggctgggtagagggcagactggaggtgacaggagagatacaggcttggggtagggagggctctgctgccatgatatctttgcagaggagttgactgggatgggacaggcccaaagggaacatttcctgccctctgagctgcctttgtagatgggagtagggggtggggataggtttggtttgtgagaggcttgagtgtgtgagttggggcgagtgggagggtgtgtgtctgggcttggtggatttttcttggggggggtctgtggtgtttcagcttggccttctctgccctccccattccactcctccccgggcttctgctctctgggacttgggctccatagccccttccccagcaggtgcagtcctcgtgcccctcatctccagccacaagtgggtgtgggactgccggcttcctggccagggcagctgtggctgggtgggggtggggactgagacatccccctcctggtcccggctcccaatt

SEQ ID NO: 3292 - DNA, 1047 bp, Homo sapiens
tgtggtcttttgtggccaatttctttcacttaacataatggtttcaaggttcatccacactgtagtatcagtattagttcatttgtttatttttgagactgagttttgctcttgttgcccaggctggggtgcaatggcatgatctcggctccctgcaacctctgcctcccaggttcaagcaattctgcctcagcctcccaaatagctgggactacaggcacgtgccaccacaccttgctaattttgtatttttagtagagatggggttttaccatgttgcccaggctggtctcgaactcctgacctcaggtgaccctcccacctcggcctcccaaagtgttgggattacaggtgtgagccaccatgcccagcctcagtattagtttttttttcttttgccaaataatattccattgtatgaacataccacattttatttattcattcatcagctgatggatatttgggtggtttcaatcttttggctattatgaataatgctaccttttttggtgtgtggacatatatattttcatttttcttgaatatataccctaggagtagaattactgagtcatatggaaactccatttaacattttgagagactgccagcctctttcctaaagcggctgtgctgttttacattcccaccagtggtgtgtgagggttccgatttccccacgtcctcgccaacgcttgtgattatctgactttttgatcacattcattcttgcatccattcatccctcaagtatttatagaacatctatattcaacaaggcagaaggcccactgcagagctgggaagggaatttatcccttgaagagttgtttagaagattccatggcataatatctagaacaacccccaccaagctcagcacatagtagatgctcagagacgggagacagggagcatcaaggagaggatctgggggtggtcagcaaccatggggcccccgggaatggaggaaaagaggatggaatttgtacgtgctgaccacgtactgtgtgtgggaaccagtgcttcagtccttatgaccct

SEQ ID NO: 3293 - DNA, 1033 bp, Homo sapiens
cctttatttcaccacctgcctggggaaaccctgatcagagtcttcggcactagggcctcgtggggattctgatttctgggggggattctgtttctttgatcagagcatttctgacttatgggaaaatgatgcccaaccaagagatgttgaagttggggccctgagcagggaggaggggtggttgcctgagactagggtgggatggggacgcctccatgaggaggggacgcgtgagctgggcattaagggtgctggctcctggggcattttgaaatttttggttgtcatagtagtggaagtgcagctggcattggccaggtgggggtcgggctgctaaatggctacagtgtccagaacagtcccgctggtggaaaatcgtcctgcccaggtaccaatagtgttgcttttgacaaatgtttggtcatgagacatggtggggggggggggggctcctggtgggtggggtgggtatggaccatggcacagtggtgagactgtctttgtcatgctgtgggagggaggaacattccacactgcctggggcaccgtggaggtgcacagagattgcatgggccgattcccctgaccctgcaccttccccaccctcagcacttccctcccttttgcctttccatgtttacagggatgtgtgtcccgtgttgtgtctaaggggatggccgtgataaatggtggaaagagggcgtttgggcatcagcccaacttggctgttgggctggcctttccctggtggagctccctataggggagggggccacgctgctgtgactcggtccctaatggcagcagctggcctctgatcctgccgggggaggctcaggggaggatgaatcagctgagacttgacatggacttggacttggactttgacctctgcatgtcagctgggtgaacttgggcaggtcactatacttgtgtcgtcctctgagcctgtgttgtcctctatgaagctggagggtgaccatggtgctacagggtgttgcaagagctagggcttacttggcgcagagtccag

SEQ ID NO: 3294 - DNA, 1047 bp, Homo sapiens
ctaccgcctcccaaggctctgtagcccataaaagcagctactctgagggccactgggggtgtatggggtggggagagagagctttataaactgcgaagggctgtcagcaagattgtgtgtgcgtgcatgtgtacatttgtgtgtgtgcccacacatgtgtatgcggaagggagtttatgtctgggtcatgtggtcagggcacaggagaggggaaatgtttggaatctcaggatgagaggggtctaaaaagccaccataagccctgatatgtgccagatgcccccagtgttggggactgagtctgcagaggtgaccaggcctgcctttaaccccctctggcccttagaaagtgtgtggaggccaaatccgtgttcctcctgctccatctctgagcactggccccattgcagccaagattctctctggcctcatagtgattgaggcttagagatggggtgtgacttggtgggggtcccccagctgtcaggagtgatgtcagtgctttcttgatagactttgagcttcctgggcaggctcgtggctgccatgttttctcactgaacccccagggaccactctgtgcttggtgcaggctcgagtgaatgattcaaaggaatgaatgaatgaatgagggaataaaggaatgaaggaagccgggactgtgagctatggagcccaggcaggggcttgtgtcctttcctgtgtaggtgggttggggacagtgaggctggcagagtcctgctgcatgcaaggcatgtgcccgtgggctgggaggcgccagggggctgcatcgggcgggccttcagtctgagtgccaaggcactgccaccaccacatctgggcaggaccgagggactgtggctctggactacagcccagctgcttggagccctttgattttgtgtctcaagggacagggtggccagagccaggagctgcccaggccccaggcccttgctcccatcatccccccaaacccctgtcccagcagggagcagggtcctggacttcctgacctgtctcactggcccctccaggcctctgtcc

SEQ ID NO: 3295 - DNA, 1112 bp, Homo sapiens
cccagcacagtggcttatgcctgtaatcccagcactttgggaggccaaggtgggtagattgctagggcccaggagtttgagaccagcctgggcagcatagtgaaaccccatctctataaaaagttggctgggcatggtggtgcactcctatagtctcagctgcttggggtgctaaggcaggaggatcgcttgagcccgggaggttgaggctgcagtgagcagcctgggtgacagatcctaagagaccctgtttcaaaaaaaaaaaaaaaaaaaatttattcccttctgacacttggttaatcactgtgtctcttgccttttgcttctttagcccctgccagtgtaatctttaatttaattagatgatatcttagttgctttgaggtactcaacattttgggcatttaagacattgtattcattaacatcactattttgatgtgacttgcagtcttctaacataaatccactggcagcacagtttagccaatgtacagagattggagacagcagggaaactgggcaggaggcaccaggtatagccatggtgcaggcatttaatttcaagatacctaagacctggggcaatgagtttgggggaagggctccagtcaaaatcccagtgtctctctttctatatatcctgtcaccatcacccatttcctactcacagactcagtttctggccatttcatttacttcctttgtttgcacacttttcattaattgagaaccattcctgctgactctgcagtcactgtgacctagtagtaagatcataggtgttggagtcacagcttaggctagaattctaattctgtcactttctatccatagtttgaaatatgtgacttaagcccctctgtctcagtttcttttatataccagcagaggtggggtgttcaggataatgtattgttgacagtttggtttactgatatagtggtttaccatacagttcagccagattgcttgggtttgaatgttgggaatctaggtctatagttttgtaagtcttttaatttgcctcttccttggtgtctccatctatggtggtgtccactccgtaagactgttaggaaaatttaattaaaacatgttacacggttaga

SEQ ID NO: 3296 - DNA, 1112 bp, Homo sapiens; identical to SEQ ID NO: 3295

SEQ ID NO: 3297 - DNA, 1033 bp, Homo sapiens
tccagtctgagtttgttttgcattttctgagtttttattgctggtgctcaggtgctaggttcacctggtcggcacatttcttcctcatttcatttactaggggccatgctaactgttgctccagccttactagcagtctaccatcaacggtaaaagcattcccttctcaatctttgtgcaaaagtttccttccaggttgttgagttgacccacgaaagtcatgacgctaatagaattgtcttgacacaaaaacaacagcattgaagaaatcagaaatggtgcaggctttcgggtgtgggaatgcttttttctctcttgaatgaagttgctgaagagtggtcttaagttatcctgttctgtaaccaacaggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccaggtgagtacttggctttggcactttaaggtacccgaaattgtaatgccttaactgtcttggctcagatgggtatctacttaaataaattgccatatagtaattttttaaaagcgtgcctcttagtttgcatcacattatttcatagggatttaagaaacaaacatgaacacaaagacatacatacacttcggctgctttaagcattatgaagaatcttttgctctcaaagagttgctattcaaatacaagtttgatctagggtgctgaggagtaagacagctctaccacctttctttgttgttccactctgtagaagtgacagtctatgtagagacgagagaagaaactattatagaagacagaatttggtttggtttaccccttcctgttgggctg

SEQ ID NO: 3298 - DNA, 1053 bp, Homo sapiens
ttttacttaacccatttctttacatcttataggtcttataggttcagatttttatttcttcttgagtcagttttgataatttgtgaccttctaggaatttgtccatttcatctaaaatgccaaatttgttagcataaaatgtactattttaataagtgaaatctctctctcaatcttcctctcccatcttccccatacatgcatatatacccatgaatgtgtacatataaaatatgttgtgaccctgaacaaggcagatgttgcaagtatttattttgtttgacttatgtgttacatgtctcaatttaacagtattattaatcatagttaataaatatgaattttcttaacaactagatctgtaactctcatttgtggtttatatgtgggttacatagaaaaccttaaactctcacctataactgaaacatccatgtctagtaaattctacttcccatctcaaagagaaaaaaagtaagggatgtggatatgagtgtccccaaagactgactgtaatggtttcatgccctgcctacccatggatctctttatcctactcccccgccctttctcacccctcatttcttagaatgcttctccatgcttacagttttttgcacaatcccctggctgtatcatttaaaaactcttaaacatcaagaggtagcaggtacagttttttgttgacgacacccaggcttttcatttgccctggaagaaaagtgttgtggttgttcattacttcagaaatgaaatatataatagtaaaaatgagctcaaaagttcataagctgtctagggcaaaaaaatgaaagcatttataactaaatttcaatttagttctaaacttagttctaaactaaaaagcatttagttttattattgtgatagaagtattatcttctcaaaatgtattctttctgtcctttatcttcagggttttatacgccttttagttttttaggaaaagcacagctcaaacagaaaatacctttctctgtccttgcttgaactgaaggagaagtttctaagttactggccagtaagcagtag

SEQ ID NO: 3299 - DNA, 1063 bp, Homo sapiens
ctgtcctgggcaaatcagcacatgtggccactttaccaagaagattctgttcttaaccagcaagattaaaagtggcttcatggactcagaagtgagaacttgactaaaaacaaacaggatgccttcgtttggataggcagactagaaagtgatttataagattcaagagaagtctgaagtgggtagggtaatagacttattattctagacctaggagtgatagctttgagtttgaaagaggcgagtttcaagtcaaaactatgtttatatatacacattggcatgtgtgtgcgtatcctgaagttttatacagtaagaactttagttgtagaactcattttctcaggttatatatgaacatcactttataaaagttactgtgacattcctgattagtaggtccataataggtagacagggggatggggtacattgcacaacagtgtttcctagtgacacaatgcctggctttaaacactgggggttaatgcagaatctggagagagctgtcaaactcccagtttgatacgtggctagaaggaaggaagtaatgttcactgacctggcatttacctgctggtgttaatggttttgggtcctgtacatacaacactggaaggtataggtattatttcgtgtctcaggacttaaatatcttgcctagcctgtgtcatctcagatttgaacagatttagaatcaagccttttcgactccaaagcatgcagtttcagtgtatatcctgttacatgatgtactcaggatatcttgaaccagtccattaccaaatccagaaatatgtatcttttaatttcttggtttaaaaacatgtgaactatgtcatcccatactacatactaaataaactgaacctgctaagtttttttttcataaagagccagatagtaaatgttttaggttttataggccagatggtgtctgtagtgaatatttaactctgctgttgaagtgtgaaagcaaccacagacaaaatgtaaatgagtgaatacgtagctatcttctaataaaaccttatttataaaaatagatgggccaggcatgatg

SEQ ID NO: 3300 - DNA, 1065 bp, Homo sapiens
ctgggatttggagattctatctcacataatattgaaagatcatgttatttaaagcctatctaggtttttcctgctattttgcaggatatttgttcttaaattattatgtagtatgaaagtactatgatttttataatcatttgtagcctctgtttattcaactatttaagtgatggagccagtatataaatctggccaattcaacctcaaagctgagtttgtgattattgacaatatgttggtgcccaggagatacttgtttgtttaacatatacatttctttgttggcttgatattcctaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcaggtgagcgcacatctgagtggactcctgccagagatctaaaagtggcgactgatagtgagattcttaaagtatgttgaaataaacttttggcaattctcagtatatcggttctaccctgtaatgtttcaaaaagagatcagaagcaataagtgaccttagtggattctcctttttgttggggggttggtgggttgggggaggggtggcatgtgccagctggttagaagcaaggtctgaaggtctggctccactgagaacatagaagttgcattactcacacaaaatggctttgttggcagaaatccaagtcattattttaagataattttagaggaggggttgttttttgccacaggggcaggagtggaggacgtgggaaagagtagtgagaagtgacaaaataatacatttggttgggaggagtaatagttttttactttaagtgtttatatttatttattttttaattaagaacaataacaggaacatctagaagacagcagtgtgctaaaataggaatttgaaggatgtgtatgtgcattacatggttctagaagaaaccctcaacatagatatttatggaatttaagattttaggaagtagttgtatttaatggat

SEQ ID NO: 3301 - DNA, 1067 bp, Homo sapiens
tcacttttgtgtgctttttgctgcttatagagataatgtgtttaaagtaagaatggtagaatgaaattccactctatgaaatgttattaattgaatttatacgctaacagctgtgacatataaaaaccattatagggaaacaatttacaattaagttttaaaagttgacccaacctgagcatagggtaggtcttctccaatgaaaagaaagtggttgagttatttctgtcttcctttcccaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggtgcggctgcattgttattcctaatactttggcagggaaaaaggctgcacgtttgaggtgattacagaggggaatgagcagtgctttcaccttgcttaggcttgtcatgatttggggactggcaaggatgatacacacttgccctcacttagactatagttcactgatgagagcattgttctgagccagtcttaagtcatattggaggtatctaaatgtccatgcagcttggaatatgtggtttttccttggtggattatctgttttctgtttcagaatcagggatagatggagtggccaagctagtttacaaggcttagtctttatgttgatgtttttgaacagcatgattagtgagaaatttctggtataccttgatagggtcatcccttacgtttttaaggtttctcttaaaccaatagtaggggtcctttttagctgtctacctctgagatacatgtttatatagatacatcttgaatatatgttgtttttggttcactgtcagctggtttggtgctttgcatgggattagatgtactttgatgttctacatgtgaaacaagtctttgagagatgtcagcgtatttttatggacctttactgatcatagagcatagccaatttaactgagccatttatgaattcaataaataactttaacctgtttcatttgttttttagtt

SEQ ID NO: 3302 - DNA, 1057 bp, Homo sapiens
tttgtatttttggtagtgacagggttttaccatgttgtccaggctgatctcgaactcctgacctccagtgttccacccaccttggcctcccagagtgctgggttacaggtgtgaaccactgcacctagcaaataaatttcttaataactgctctttgtggataagtctgtatttatttgtgtgatcatctttttgtttaaatggctgccaaattattatgcatttggaagactaaagtaattaccatgttttaaaattaggtctaatacagtgaacaagaataatactaattgctgtttattgaaagctttctgtgcagagttaagtgctgtacatgtaatttctatttctcttattatgatagttgtacaacttcttgttttatgaaatagaatttcataattgagaggaaatcgattgaggaaatacaatttgtgtgcccagggtcacacaaatacaaagttgttaagatttgaacataagcctctgtcttgacaacttttcttctgaccatattgtgatgtcttgacttaaagaaaatctgagatcttgtgtttcttctgccgttaactagcttacaactagggcaagttggatggcttctctaaatgcatatatttttgttataaaatggacataataatcattaacttttcagttttctgtcattccctacaggttctgtcaaaccctactaagaagtttttagcattagtttttaattagcagccattgttttagttccttttttttgggtgccagtttctgattttaagtatttgaggaaaatatgatttttttggtaaactgccttgtcatagtaattaaaatgagaggttctttttaaactttgctgttggccttttgggcccttgtattttatcagaaagtatatgttgcgttctagtcaagctgactgttctaggatagtttttataaattcagtcattttgtgatttattagactttaaaatgttacttgtgaaactgtatattttgtttccataaaatcatggatttgacagctattgatgaaatgaaaatatatgaattttgg

SEQ ID NO: 3303 - DNA, 1215 bp, Homo sapiens
ctagaatgacattatctcctaatgtctgaaacaatcaggtctctttatgaggacatctgtaattcaagatccatggtgtctgttaaacatcatccagcaatgtcagctgagctgttgaaaaatcctgtaggaagagcaggtaggttgaaggtcctatccagggaggtcacttcagtaagtgctttcagtctgattttagcaaacattgaagtcttcagtatgactccttggaaggaggcccattaaggtgatccacaaattaggttactggcatcccctttctttataccaatactattcatactaaaatgtaatctccatcagggcaggattatgtattgttttattgactgtcatatccctagttccttgcacagtgcctagcaggtatcatttgtttcataaatatttgttgaattaatgagtgaatgactggttttgtattaacgtagaatcgtaagacattcttagtgttgttaaggcctttgaactttcttttctttagaactaagaagtgtgctaggtgtgagctcataatccaagttttgttagtagctgctgtgtttctgctgttttatttttaacatataaagaatagtatcccagaagactctggagctcccgaaagttgggcaggtgtcttaatttactcattaggataagctactagttgaggaagttattcaataccattttcccaggaagaggcagctcagaggatgaagtgaacacttttcatattcttctccaaaatgtgagtaggtgaggattaattcagttatttgtggggtcttgaaagcactgaaaggagattcagcactagggacaatgtgacaaatcagttggtagtacatttgtctaatttttaactttgccttggatcaggcaggacctgtagacctgataatctttagggcttttgaatgcatatatatgagatatatagatagatatatagatatagatatagatatctcatatgtgtgtgtgtgtgtgtgagagagtgtgtatttgtggttcaggggacatataatctgtgaagcggtcagctcatggaaccaggacacagtaaattgaagtaaagaaagagagacagggagaacagaagtatgaaacattttaatcccatgggaatgaagtagagtgtgagaacatttattgttaaggtgtcacgcctaaacaagtgcttattaaaatttttagtcagagaggttt

SEQ ID NO: 3304 - DNA, 1661 bp, Homo sapiens
gtgagcagttcatgcataatgtgttcataccattttgtactgtgatgttggagcagtatttattttttacaaaatgctatacagttgcctgtttccttaaatgcagtttagaaaattattactaggttttggctaggcgcggtggctcacgcctgtaatctcagcactttgggaggccgaggcgggcagatcatgaggtcaggagttcgagagcagcctggccaatatggtgaaatcccctttctactaaaaatacaaaaattagccgggcgtggtagcacacgcctgtagtcccagctactcgggaggctgaggcaggagaatcacctgaacccaggaggcggaggttgcagtgagctgagatcacgccactgcactccagcctgggcgacagagtgagacgccgtcttaaaaaaaaaaaaaaaaaaatttgttactaggttgtattatgttacaaacatggcacaaaccaaagccaggattatatcagtgtagaattaattgtattgttgatctttatttagaattcagttaatctaaaaatagcctaatgtagtatgtttcacaaaattggacactgttgtactaaaactcatctgttaagcatgaattttaacaaagattcaatattctgaaaatgaaagttgaagtatggtattcattcctgcacgaccacagtcagaggggagtggaaatcggcatgtgttaaaagtgtggcagtgtgattaaatgtcattctcgtgaggccaagtgtgtatatacttttaatgtaggtatttaatatgctcaactttctctttaacttacaaatgattattctatcaagtgtcatgtgtatagtaactgacaaagagtgactagtaattgatcagttgaagcttaacttctattgttatttgacttcgttcaaattttacttatggtgaagtttttctcaaaaagtattaataatacttagtgaagggatgtgttttgttcttccctaggaccttagaaatcatttgttttggaatcagattcttcatctgccaaagaaatgcacagatgatgatgatgatgattttttttttttagtttagcagcatggtttaatttgtatgcgcctacgaaaaatcattgtaatcattagttgatcattgcagtagttcaaataacctggtataaactgggcttttatctagaagcttcaagcagtaacaagatttcacaaatttcatatgctgaggaatgactccaaaataaacctttttcttaaaattttagaatcccatcattgatatagtgcttttactgtttcgaagggattttctctgtgaaccctgaaaacaaccccacgaggtagggcagctattttatttttacacataagaggccaagcatggtggctcatgcctgtaatcccagcgctttgggaggctgaggctggcaggacacccaaggtcaggagtttgagatcagcctggccaacatggtgaaaccccgtctctagtaaaaatacaaaaattagccaggtgtggtggcgcaagcctgtaatcccagctactccagaggctgagacaggagaatcgcttgaacccaggaggcggaggttgcagtgagccaagatcgcaccactgcactccagccccggggacagagtctcactctgtctccaaaaaaaa

SEQ ID NO: 3305 - DNA, 1084 bp, Homo sapiens
tcgaactcctgacctcaggtgatctgcccgccttggcctcccaaagtgctgagattacaggcatgagccactgcgcccagccagaagaggtagttctttagctgtgccttgaaagacttttttatatacgaagaaaatgagaattctagtggaggaaatagtaaaacagatatgtgttcagtagataatgtagaagtagtcagtctggttggtggttaggttgaagaaaaataactagagaggttgaagagatggtgttgtgagtcttatgctgtgttgcctataggaaatgagaagacactttaaagcaggaattacttaattattatagtttgttttttttgtggttagtgtgagtttagcagcagtttgaggcattctcttactcttattattcagttaactgttgactgttgtgtccttctaggaaccttgggttctgaatgaaacagtagtggaatatttggggaactaagtgctaaattaatgggttctgaatcttatcagacaaggggagggctcaatgaggacaaaggttgcatgcaactgacttgaaggacaggtggaatacattttgttgcaggtcagagcagaggtatggagctgggaatgactgtggtgtagtcctaggctgaagagagtagaagacgagtgtacaagaggacaaggaggtacagatgcctttgaaaattgagtcccggaggccttgagaaccagctggaagtctcagacagtactgatgattgtgagggttggaccagaggtctagtgcagcacatacttttctgcacattctgctctttttatcttggctttctgaaataagcaacaaaggtgatcatttttcttggtttagagtttgctgcaaatggtaggtttgctttatttgtgattttttagaataggaatctggtttggaggttgacaaaataagtaattctctcttttgttatattttctttcaatcttggctttgatttggtgtaataagctggtttcatcaaacttattatcagcctataatgagatacatgacatggagcagcctgcaaatagggaaaaggtaattttcatttaattcatt

SEQ ID NO: 3306 - DNA, 1043 bp, Homo sapiens
atgggattttgtttgttttgatttagttttactttgattttcgttttcttcccctcttcatgttttctttttaagaatccaatctagtgtaggctatgctacaaagattgtaaattaactggtgaggtggaattttctaaaaggtgtcaatgcctgaagcgttgccaaaatgatagattttgcatttgcatagaactttaaaatctgaagaaagattccagagaagactatttcagtgattctcagatattaaaatcacctaggatagatgccttggaacctttcttaagtttctcccaaattaccgtattagagagctatggttactaatggaatatgtcatatccctctggtggtttagagggaaaaacagttgagaacttgtgcattatctcatttgagtctcatgagctctttttgaggtaggtggaccaggtatcattttccttattttgaagagccagagatgcagcttaaatgatttgttcttaatcatatctcttctgcagatgcctctcattccatctctggtcatgattaatgtacaggttttaccctattatttaagttacacagtattaaaataatgtatatttatcttccacaattggcacatattcttgaaaaatctataaaaatccttgtccagttatatatacaggtagaggatttttttttaatctccagtgtgatagtacaggtagagaatttaattttgagtaattttaatatcagtgtaaagctaatgtgtgtgcatgcacacactcacacccctctgcttattctaatgtctgccaaagtcaaaatgaaaatgtattttggaccatcgttgtaggacaagtgtcagttgttttgtatccctaatctaattattgttaatcttgcatgtgtaaataattacagtcttaaactttttaaaaattatttttatttatttattttttggagacagggtctcactctgttactcaggctggactgcagtggcatgaagttagctcactgcagccaccacctcctgagttcaagcagtcttcccactt

SEQ ID NO: 3307 - DNA, 1046 bp, Homo sapiens
acctcaggtgatccgcctgcctcggcctctcaaagtgctgggattacaggtgtgagccaccgcacctggcgggttcagtatttttttaaaagactgggctaggtgttatggctcacacttgtaatcacagagctttgggagaccaaggcaggaggatcacttgaagccaggtgtttgaatctagcctgtgaaacatagcaagaccccatctctacaaaaaatataaaaatcagccaggcatggtgtgtgcatctgtagtcatagctccttgggaggctaaggtggaaggatcacatgagccctagaggtcaaggctgcagtgagtcatcattgcagtactgcattctagtcagggtgaaagagcgagaccctgtctcaaaaacaaaaacaaaaacaaaaacaaaaacaccacacagctatgaatagtttatcttaaatatttttcagaagtgtaaaattttcataaaacttagcccatttatacctttcttctattgtctttagggtcttcatgtttttaagagaccattttaaggatcttgaacctgatactgctgtctattaatgaaataaactcagggtctcactttgtccccagactggagtgcattgccagtgcatattttgttctgagcattcactgtaaatttttggtagtattccccataggaatctcaaacttcaggagagcagctttcagaataacaggagagctcaaaatatcagtcaagtcttttatttttcttttcttttcgtatcctttattttatctattcttggagtagatcaagtgcccaccccacagctcactgcagctttgaacccctgagctcaagtggtcttcttgcctcagcctcctgagtagcaaggactacaggcgcatgccaccttgcccagctaatttttttaaaaactttttttttagagatggcgtctcctctgtgttgcccaggcttgtcttgaactctaggcctcaacctagatccttccgcttctgcctcaaagtgctaggattacaggcatgagccactgcgtgcagctgatac

SEQ ID NO: 3308 - DNA, 1049 bp, Homo sapiens
gtttagtaagatttcctagggcacttcaaagttgtccagtttagtgcttcccgaccctaatgctaccctcgatcggggctctttcccattttaccctgatcctcaccctcccccaaatgcccttagggtaataagtggtacaccaggaagactgctacttataactgttcattttcaaggaaacttaggtatctgtgcaattaaataccagacaaatgttttttttttttctcaatcttgtttaattagtaaacaacaaattaggtccttaagagcaaaatgtatggcaaactgctttggtccaggcagtaacccaagtccatgagatagattatagagccacttaaaggtagatgaaaattatgccgagaaacccagaaattagatttgggaagcagagatttattttagtgagagcagagtttaattatttttccattatcattgggttatgggttaaatgggaaagttaaacctttatcgtcaaggagaggaaatgttttgtgctttctggttttttattgtgttcttctgagaaattcaactctccaggtatttttgtgctcaaaaatggtggttaaatactatctcaaacatcttagtttcctgtgtaatagcagttgaaaacataattagaggaaataagagggggcattttagtcagtaaagctgatgaccagaaccaagaatgatagagttctgtggaattttactttgtaagcctggtcactggtgctttgatcttatgcaaaactgtactgtgtcttgcttgaagggtactttgcatttttttgttgaagctagtataaacttctcatgttggcttatggccagcgatccctgtttctctgaagcatggagtgatttgtgaagtcactttaatggcattaccaagtattgttaaaaaattaatggaggttagaagattttatttcccttccagtaatgaaggaatagcttttctgtccttccaaaatcttggaataggttagtgttgtggttgggaagtattttggttaatggagtctctgtgtataaaggaagtgaat

SEQ ID NO: 3309 - DNA, 1026 bp, Homo sapiens
ggaaggggattactcagggtatgagtacttgtaagtgaagatcattaagagtcatttcagatgctgctaaccacagcagttgagtatagacgcatatgttttggaggaaagggagaaagactgagtaagattcagagacttttaagagctttgctaattttgcttctgtctttgcccaagcaccttggttcagtcttttgctttcttttttttttgccatagtggcaaaaaccacacttttgcaccaacctaatagcactttgcttcatgtttgctgtattgttgtttccttttgagagaatttaccctgaaaatagcctcgcttatgtgttcacctgcttctcctggctttgcacattatgacagcctggtatactatcatgaaaggtgacaggatcccagaactgatttttgaagccttgagctgaaaggctgctgctttctgtaagcaattttacaaattatggataagactatatttacatatggaggctggtacttttggaaactgttccttgaggtgtttttttttgtttctgtttttgttttttttttttttttttttgagacagagtcttgctctcttgcccaggctggagtacagtggcgtgatcttggctcattgcaacctctgcgtccctggttcaagcaattcttgtgcctcagcctcccgagtagctgggactatagatgtacaccaccatacgcagctaatttttgagttttttagtagagacggggatcttgccatgttggccattctagtctcgaactcctgacctcaggtgattcacctgcctcagcctcccaaggtgctgggattacaggcgtgagccaccatgctgggccctgttccttgagttttaaataaacatttacaagtttctgtgaggaatgaactcttaaaacatttaaaggacaagaatggttttgatcaccttagcgttctttgcactgttatgtggagcataaaacaagtgagaccctccttaggctgacattctttcttctggaatacaaaagagt

SEQ ID NO: 3310 - DNA, 1035 bp, Homo sapiens
gaaggtggcttggtaagcagagttggagccagggagattacttgggtgtttttagtgtccagtgtaattaagctactatctaaccagatgcattaattgctttgataagaataggcttctttgtgcatcatatgccctgcccttaaatgtgtcacctggataatactggctacatctgattccttgggtctcttttgcttttgttggaccaattcctaattcctgttatcttcttttggaattgtcacatcatttaatcctcttactgctaagttattctttaaaacaaactctacatctctcttgtgatctgttacttttcgccttgtcaaaaaaactagtctttatttccagattcttgatggggtggataggaactatcttttcataggttggatgcatttacatttttggttattgtgtgttaagtgaagatttggcaactgctggtatttatgccagtgggttggcaaactaggatattttacccaacgctgtggatgatgttacctccagagagcttactgttgaatttgaaattgtacttggataacacattatcatttggttttataattcagtagtttctaactccttttaatatgatcagatttgaacagttaggtatcttttagctgactgttgaatataagtgattgctactaattctcagtaagctcaacatgtctaaattgatttgattttgccgagttaaaaaagccagtcttttactttttttcaattgaaaaggattttagtttcatcacttacatttaaatattagaaatggaacaagaagtgtttcttgaaaacagactcctaaagaagtgtttcaaatatacaaaaatacttccacatattcacaacagtgttattgctgcttaacaaatcaccctaaaatttagtggcttaaaacagcacagtgtgtgtgtgtgtgtgtgtgtgtgtgtgtgtgtgtgtgtattttaagagatagggtctcactctgttgcccaggcaggagtgcagtagtgtaatcgtagctcactgcagctt

SEQ ID NO: 3311 - DNA, 1040 bp, Homo sapiens
agatcgatggtactttctctgggccatctgttggagcatggaaatatatcctcattatatatacagtaaccagacataatgatgtttagaaaaatagaattacttttgttccattgctttctcaagctggtattaaactatgttgtgtgtaattccttcttggttactgtaaccttgctaataaggaaccataacatcaaagcaaatccattgtattttgattaattggtgcatgatgtggttctcattgaggtgaagcatgtagcaaaagtttattttctgtgttgtattccctatatacatagcaggcatatctatgaaatatttgtttcctataatgaaggaaaaggggaactcagggttgagatccttgtctttttcagatcaaaaatttaaaattccctgaggctaactgggtgtgggtttattagagtatttggtcccatcttgatgtggagtattctttgttatctcagtcgggctgtttgcttcctgctttgggggtgtgagggggtcatgaagcaatctagatgttttcatcattgtatttgtgaactttacagtatcctgaggggtctggagcttatcttttgtatactgggctcacaagtactgtaatatgtaattattaaagtgaatacctattataaaatgaatgtggttatgctatagatcaaaccatgtagtcaaaataaattgttataccaaaaagacacttgcgcttgcatgtttattgcagcactattcacaatagcacagacgtggaatcaacttaggtgcccagcaacagtgaattggataaggaacatgtggtacacctacacccataaaaaaagaatgaaattatgtcctttgcagcaacatgggtgcagctggagtccattatcctaagtgaattaatcactggaacagaaatccaaataccacatgttctcacttgtaagtgggaactaaacattgggtacacatagacataaagaagggaacagtagaccctgaggactccaaaaagggaaagggaaggagggaggcaagggttg

SEQ ID NO: 3312 - DNA, 1038 bp, Homo sapiens
aaggccacaaattatttaaaaattttgtctactttccttgttagcccctttcatttggcttaaagccctgagaagtttaaaggcacatactttagcagcttttatttatatatgaagagatcagtctgctaatcgatgattctagaaaaggatgtttgtagtagagaggaaggctcactgaccttgggcttctgggctctatttctaaattggtttggtttatgatcttgcataacctgtttgctccacctttaggttggcagcattgttactgttcatgacctagaaaaggatggatttttaaaaaagaagctgtagttggaaagtactttgagaggttgacagaaaggtactttgttcgcataattggttttttaacttttaaaaatcaaggacctttttttcccttaagattctttaatgttttatgtgtagtgaacttgacaacttccagggaagttaaaatagtagtgaatactagcttatttctacaacaaatggattgtatttagatatgtgactcttcacctttgtcttagaaagctgaagcatagaaaaacatacccttgattataacaagtttgtaaacctgacaaaggaaatctagaaagtgctcctatatacagagtgataacaaatcctaccttattcacaggaattaggataacctgagatatatttaaattgtagctttatattctcattagacattatatagtacttgatccataggtgtgggatagcagagtggcttatagagggaggaattggatagtgatttgggtgagctgttaatccaaagaaaggcaaaatttggtgggatagaggtagcattggattgggccagaactctgacgccacaacttcttagagcctaggttcaaacattcatcttctttgcacttacttttttctacccgtaagacaaagatgttggactagatagtttcctaggaccttttcaggtctaagattctgggagcttgcccttctttctctctttaaaaagatagaaaagaggaattgttctggcctttt

SEQ ID NO: 3313 - DNA, 1050 bp, Homo sapiens
cataagtgaagcatgttttgtgactgccttcttttacttagcataatgttttaagggttcatctatgttgtatgtagcatttatcagtacatcatttatttttattttttattttttagatggagtctcgctgtcgcccaggctggagtgcagtggcacgatctcagctcactgcaggctccgccccctggggttcccgccattctcttgcctcagcctcccgagtagctgggactacaggcgcccgccacctcgcctggctaattttttgtatttttagttgagacggggtttcacagtgttagccaggatggtctcgatctcctgacctcgtgatccacctgcctcggcctcccaaagtgctgggattacaggtgtgagccactgcgcccggccttctttttatttttgtataatatttcattgtatagatctgccacatttaatttatccatttatcagttgatgggcctttttttcttcttttttggctattatggataatgctgctatgaacatttgtgttcaagtttttttctgtagacatgctttcatttctcaggtttgagagtatataaatttgtaatgtataggtacaaaaataacaaatttcttcactaggggcaggtgctcattagaaatgggggatgggaggattagtttatctacaacttacactatggatttggaatttttccaagccacacattttactggggctaatgactactttcttttctctctgaaggaagtatttggaggctaacactgtaaataaacttgtttacaaacccgggaagaggagtgcttaaactgtagagaacaggtgttttcagtgagctccgtaaactctttagatgcaatgaatatgcagttgattgatctgctggtgacaatttttctttattaaagcaagttccctaagaattttaacaaggggacagttcattaacctagtcttggttattatatgtatttaaaatcaccaaattgggtgttaattattaagaaatgttctctgtaatcccagcaatttgggaggctgaggca

SEQ ID NO: 3314 - DNA, 1035 bp, Homo sapiens
acctctgcctcctttgtacaagcaatctggtgcctcagcctcctgagtagctgggattacaggggtgtaccaccatgcctggctaatttttgtatttttagtagagacagggtttcacaatgttgtccaggctggttttaaactcctggtctcaagcagtcctcgcaccttggcctcccaaagtactgagattaaaagtgtgagccacgtacctggcctgactataattttaacctagcctgattataactttaagaattaccttgttccagtgtaaacaaaagaagttcggctggttgcaattggctcacgcctgtaatcccagcactttgggaggctgaggtgggcggatcacctgaggtcaggagtttgagaccagcctggccaacatggtgaaaccccgtctctactaaaaaatacaaaaattagccaggtgtgttggcgggtgcctgtggtcccagctacttgggaggctgaggcaggagaatcacttgaacctgggaggcggagattgcagtgagctgagattgcaccactgcactccagcttgggcgacagagcaagactctgtctcaaaaaaaaaaaaaaaaaaaaaaaaggaagttcagtcagatgctcttctctaatgctgaatggtacttgattatatatgcctctgaaatggcaacttgtagagatatttatgatgtatctttaccttgtttaattttagaaggttttttaaatttaattttatttttttgagatggagtttcatcctttcacctaggctggagagaagtggcaggatctcagatcactgcaacctcttcctcctgggttcaagcagttctcctgcttcagcctcccaagcagttgggattatacgtgtccactaccatgcctggctaatttttttttttttttgagacggaatcttgctctgttgcccaggctggagtgcaatggcgcgatcttggctcactgcaacctctgcctcctgggttcaagcacttcttgtgccttaacttcctgagtagctgggattaccggcac

SEQ ID NO: 3315 - DNA, 1058 bp, Homo sapiens
tatgtatttgaaaatgttactcattttgggctgggcacggtggctcatgtctgtaatcccagcactttgggaggccgaggcaggcggatcacgagatcaggagatcgagaccatcctggctaacacggtgaaaccctgtctctactaaaaatatgaaaaattagccgggtgtggtggtgggcgcctgtagtcccagctactcgggagtctgaggcaggagaatggcatgaacccgggaggtggagcttgcagtgagccaagatcgcaccactgccctccagcctgggcgacagagcaagactccgtctccaaagaaaaaaaaaagttacttattttgacagtaatttttatacctttagatttttttctttcctgaataacattgaaaatttcattactaaaagcctaaggtcaagtctttgacttgagagtgttttattcttgtattgtgaaatctgttttctctgtaaactgctgtgggatagataaactggttgatgaaatagggcaaaaaaattaaagtcgattggttgaactgtagcctctgtactggattatgagggacagaggtagaagctttgccctgggggaagggaaatttggaggacagttccacagagcttacccactttgcttgcactcttttagcactaggatatatcagtatccatcatagattgacagcctataggagataattccagagaaccaggcaaaaaaaaaaaatcagtgggtgaggccaggtgcagtggctcatacctataatcccagcactttgggaggccaaggcaggcggatcacctgaggtcaggagttggagaccagcctgaccaacatggagaaaccccatctctacaaaaaatacaaaattagtggggcgtggtggcgcacgcctgtaatcccagctacttgggtggctgaggcaggagaattgcttgaacctgggaggcagagtttgcggtgagccgagattgtgccattgcactccactctgggcaacaagagcgaaatgccgtctcaaaaaaaaaaaaaaaaaattcagtggatgaatatatttt

SEQ ID NO: 3316 - DNA, 1056 bp, Homo sapiens
tcaggtaaaggagtgggtcttacagctcagtcatcctgctgggaaacacatggcaacaggtagaggccacttgataggcagctgtgctaagggtagcataattgaagagcaaaggggcacatctctaggtggagaatctctgcccttattagccactgttacggataggaggtgtaagagggtgcctgatctgtcatgtgggtcagagtgaaaaagaggttgagaaccactgatgataacggaaatatttatatgttctaggcattgggctattgtatttcctatatataatccttacagcaatcctatgaaggagataaatacccttttttgaaaagtgagaaactgaggctttgttaccaggtaatacctggtttttgaaatcagtctttgattccagtgtccacgttctagatctgtttctgcttccctaggcaagataaaccagacaaaactgtgcaaccaagtggcacattacagggccaaagaattgttttgccataattttgcttgaaatttagagactgtaaacttaataatgagatgaatacaaatgttgaccattctcctataattgcaggagtacttgcccccaactcccaaaagcagtaatggtaaagtccatttttcttcagttctgttttttattacatatgtgttctaagtggtaatgtggatggaaaattatctctgtagagacagaatgactcaatataaagtgatcctattgccagctcattctaccctaccactgggcctttttttttttttttttttttttagtggccctttggcataatggaacaaagtttgagatcgaattggcaggatgctttcactagtgaactagcgaagtaaagaatatcacaggctgtgatgccagtagcattggagggaggggaactctttgtcatgccaggtactttatttctctcgtaattactcccatttaagagcaattgcttttacacttttttctttttatttattgagacagggtttcactcctgttgccgaggctggagtgcaatgggcaccatctaggctcactgcaac

SEQ ID NO: 3317 - DNA, 1047 bp, Homo sapiens
gtatattggccaggctggtctggaattctgacctggagatgcgcctgcctccgcctcccaaagtgctgggattacaggcgtaagccaccgtgtccggacactttgtagcattttttaaaagcacccacaggctggcaagtgttctatcttaagtacagatgcagtttttggttttaaggaactttagtgtttcatagtaacatttgagggattctttgttggtcttccagaggagtagaggatacaaatgagacatattgttgagttactcctgcaaggggttagtagaaagaagtaagcttgggaacgattagggtttgaatcctttctctgctacttgctagttgaatggccttggaaacatcccattttcctcctgtaccttagtgttttcatttgtaaaatagaaataataatggctacctttcaatgcttttgtgatgagacaatgtctgcgatatattcattacactattaccgtgttgaagcttctgtttgtttgtttgtttttgagacaggaactcactctgtcgcccaagcgggtgtgcagcctcccgctcctgggctcaaatgatcctcccacctcagcctccctagtagctgggactataggcacatgccaccatgcctggctaattatttttagtagagataggtcttgctatgttgcccaggctggtcttgaactcctgggctcaagctgtctgcccacctcagcctcccaaagtgctgggattgtaggtatgagccaccacacccaactgaggcttctggtttgtatagtgaggctttcttttttttttataatttaaaaaaattattttatttatttatttattttgagacagagtctcgctctgtcgcccggctggagcacagtggtgcgacctctgcctccctggttcaagtgattctcctgcctcagcctcccaagtagctgggattacaggcgcgtgccaccaagcctggctaatttctgtgttttcagtagagtcggggtttcaccatgttagccaggatggtcttgatctcctgacctcatgatcc

SEQ ID NO: 3318 - DNA, 1043 bp, Homo sapiens
atgtgagccactgcgcccggccaagaatgatactttttaatatttagatataaatttcagcttaaaattttttggctggctaaaccaaataatttcagccttgaattaaaggagaaactgtaactttctccagggctaagtataacaagcagaagcacatttacaaaatgactggcacagccatagattcctctcttctagaatgactgggaaagtctttttcttggggtttgactgacaagggatgtcagtatttagtgtctgataatgtatttcccatagtacagtcatcctcatgatattagaggacttggattgaaaagccaggctacaatttcctgtggatggtgtttaggaggggaatttaagctaagtccaattgctcttttataccagaattggctcttgacacaagagcccttgagcaccaagtctccttgagccttcattatttctagttatctgttctttttacctcagttatctcagcatcgagtgacaagagactgtatatgggagagattcagtgaagatatggactggaagactccaaggccgcttgtctttgagacctcagactgcataagtgatgccaaatgttggatgtccaggctagcaccctcccttcagatgaccattgctagcaagaaacaggaggcggtggccatattccaaaaaccacttctgtcccatttcaccaggatgactaaggcaagctccctgtggcctctaaaaaccacctgccagatttcagggactgtttttttttttctttttcttttttcctgttttctaatgcaggcccaatgtgacaaatttgttggttgggattttttttttttttttgtaactggcttgtatgatattttctttctgtatttctctatatcattttgtattaaaagccaaatagatgcctttttacaagagccatgtggattggatttattgctgtcttttttttgaggcttgattgctataaatcagaatagagcatgatgtggccacagaatacaattcatttaaacttccaagaagctgct

SEQ ID NO: 3319 - DNA, 1050 bp, Homo sapiens
tatagtagcatgctcctgtagtcccagctactggggaggcttagatgggagaatcacctgagcccgggaagtcaaggctacagcgagccatgatagtgccactgcactgggcaacagagtgagacgctgtctcaaaaaaaaaatgaaaattaaaaaaaggtgtttttctctttgacagaaatcctgtgttttatagtagagtaatatcagtgtctctgggcaattgactcttgtctcttgtgtcattctctttctctgcttttattaatttgatttctgggggcacctttctgtttttgcaggtctgggacctgcgccagaacaagctaacctacaccatgagaggccatgcagattcagtgactggcctgagtttaagttctgaaggctcttatcttttgtccaatgcaatggacaatacaggtaactttggaaaggaaatctctcccaggatccaaggaaaaagtcaaagattgctcacagattccatcagacgattagaatgtgttgtaatggggaaagctttaggtgagatagtcaagaatctaggactgtagtctcagatctctgtcttgtccctgaacaactttgcacacagcatttcttctctctaggcatcagtttctacattgataagaagattggactttacctttaagacccatctcagctctggtatgctgtgtatccaacaggatattagaaactctaggtgatgagtttaatgaaaaagatgtgaatctagaagtctattcaaggcagttcttgtgcgttttcagagagcaccaagcttggatgatctcttctgctctttcctgccagtctgtcttccctccccactctgaaagcattggtgtgggaagaggtcttcattaaaacattctggatttacacgaacacactcttgctctttctctttacttgtttttgagttgtagggtgggaggatgggttactacagaaaaaaagtaaggtgacttgctggattatatgcttaatgttgagggagtttggaaatggccctggtatacaaaattataggcttgtcag

SEQ ID NO: 3320 - DNA, 1084 bp, Homo sapiens
tgcttgagcccgtgaggtggaggttgcagtgagccaagatcgcaccaccgcactccggcctgggtgacagagggagagtctgtccctagatagatagatagatagagattagatagatagatagacacatagatacatagatagatagatatagatgatagaaagatagatagatagatagatagatagatagatagatagatagatagatagatagatagcctaggcgacagagggagagtgtgtccccagattagatagatagatagatagatagatagatagatagatagatacatagatagatagatagccaggaatatgtcggtgcttttcgaagctcttattccccaaattgtctccttccccagcccttcctcccaaggtttttggtttgtatttttgccccaactgtttttccttgcccccaggaaccagaggctaataatgtcctttcctttaaatgttttcaagggaagttccaagttaggcaaaataaatgtaagtcctttgggctcatccttcagagagccaccagacaggtaaaaataaacaatttttattgtttattctttgacaataagaaataggccccctttgcttcctcagtactaggaaaccatactgggaatatgggttatcttcaaagctgttgctgagcaggagacagagccagcacaagttaaaacactacaaagcccttttactgggactcagggagttttttgtttcctttttcctcattaagggtttgccgggttactataaacttttgattagttttgagagttccaacagttgattctgacagattttgctggttaatttgctgctttcgtggagggacaagcttttgtcattgtttattatactattttcactgacataccctctatttttttaaatgtgggttgcagcctactaatgaattagtctctacggtttgaaaaaattgtctgatatccttgttgttctaaaaaatatatgaactaagtagttaggggaattccattctaagagtatgttgatttaactctgttcacttcaacaaagaagtctgaaaatataaccgaagttttgtttc

SEQ ID NO: 3321 - DNA, 1024 bp, Homo sapiens
tccacctcccgggttcaagtgattccccagcctcagcctcttgagtagctgggattacaggtgcacaccaccatacctgcctaatttttctatttttggtagagatggggtttcaccatgttgcccaggctggagtgcagtggcgcaatctcagctcactgcaacctctacctcctgggttcaagcagttcccctgcctcagcctccctagtagctgggactacagggacccataccacgcccagctagtttttgtattttcagtagaggcaggggttcatcatattggccaggctggtctcaaactcctgaccttgtgatccgcccccctcggcctcccaaagtgctgggattacaggcgtgagccaccacacttggctgagacgtttttctactgagtggttttcttatacctaatcacttggggccccttgatggttggatgggaggagagtctgttgtttaagattggtttctaaaccagagctctgacctagatgtcactgtagttggagagtcttaacagtagctgatttactaattgtcatttcagaagatagtaagaggtggaaatgccccagtgaattttgttaacattattattgagggcctgctgtaataaatatctaggaactatttaggtagtagaaaaagagtatatgtcctttctgtctgccttcttttggttttttgcttctcttctgccttaattaaacatgatttggaatagttatttttaccttattactcaagttaatactttttttaataagcagtatgtcacatcacctaaagatgactgctttttaaccagctcctatttttaatgtcagtatatttatatttaaggcatcattaaacagctttttgcaatgtacttttcagttacttgtgaagttggaatgctttgtgttcttgtatttttgttactaggttgcaagtacaggaattgaataacttcagtttaagaggaaaaaaagtcatgttgctttttacatgtcagagttcttaacagaaagcaaag

SEQ ID NO: 3322 - DNA, 1033 bp, Homo sapiens
tatcagccacgctggtctcgaactcctgacctcaagtgatccacccgtctcggcctcccaaagtgctgggattacaggtgtgagccaccgtgcctgacctgagaactgttgttctgataaatttataagtaccctttgcctagtaatgctcacagaacccatctccctaacagtactgtggaatgtctatggtgactgtgataactatgccacactgaagggacacagtggagcagtgatggaattgcattacaacacagatggcaggtgagtattctgcataatggaaggacagcttctcatactaattcttggcgtcctttcacctttcatcctttctcaggagaccctgctatcaaaaactactaattttgggtagctactttagtatccgatttatcactgtcaccccaagtgaggtgtttatagtctgtgtatgcaaatataaagatgttacatcggtcatttcaacaacccagacaaatttttctttttttaagacataaaataaatgtgatttttatatgtaggctggagtgcagtgacacaaacatggctcactgcagcctcaacctcttgctcgagggatcctcccacttcagcctcccaaatagctggggccacaagcccacgcctccatgcccagctaatttttaaaaatcatttgtggagacatggtcttgctatattgctcctgagctcaagcagtccacctgcctcagcctcccaaaaatgctgtgattacaataattaaccaccatgcctggcctgaaatcagctatttctattataaaaatcatttcttttgagaaaccaaaaaaagcagaaagatgaaaaaatagtctatatttctaccactccaaagataatcagtgttaattttttttttttgagacggaatttcactcttgttgcccaggctggagtgcaatggcacgatctcggctcactgcaacctccgcctcccaggttcacgtgtttctcttgcctcagcctccagaatagctgggattacagggatgcatcaccgtgc

SEQ ID NO: 3323 - DNA, 1077 bp, Homo sapiens
tccacactttcgaccgctaccgcagccagtccacggccaaggtgagggctcctcccgtggctgcccctgccctgaagctcagggcctgacctggtgcagtggcccctggggttggagcctgaccggtggcccccgttgcagagggagaagcggtggagtgtgtcctcgggtggggcagccgagcggagcgtgtgcaccgtgagtccccccgggctgggtggggtgaggtgggcctgagggacccgtgccctccctgccctcctgcccctcccaggcaaccccagcctgtctcaccaagggcctcccccacggcatgggcaacagtctggggccgcctgggggtggggaaggtgctgcagatggcgaacaggggtggaggtcctccaggattgggagggagagtggtcagcaggagacatgtcctgggggccactgagaacaggggtcaggagccccaccctggaaccaggcaggtctgtatttgaattctgcttgacacctgattgctccataactttgggcattaccagccctctctgggactcctcagtttgatcgtctgtacaatgggtaaggatattggcccatctccacggcccctcccgctccctccacaggataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaac

SEQ ID NO: 3324 - DNA, 1069 bp, Homo sapiens
gggtgactggttaggatgagtcctcatttcaggagactgtggctcaggcaatgtgtgagcctgggcctctgcgtcatgcaggtctgagttccagtctggactctgattggcagtgagatcagtgagccttcattttctcgtgtgtaaagtggggataccgtagcagtctctttgtggagtcgttttgaggattgagtgatgtaaaacatttatgtggagcaagtagaaagtgctagataattggggattgctgctgttagcacccctgaaatcagctgcagatgctgcccacaggcctgtggtaactgaccctctcttccggagaaaagcaaacccctccgggtccctgcctgtgtgtgttctgtgaatccttcaccttcacgctggcctcctcaggtctgctccctgcagaggatcactgagaacagacagtagtggcctgctgtggaactctagaacattctgcaactttattggagtcatgaaggggatgtggttaaggaaagggacaggagtcgtggcttagccacaattggctgttcctgctcggcctcagaaacccactccccatccgccacaagacgaaaattaagttagtagctacggggctcacaagtttagtttttctcccaaagtgtttctggaacatttggtgcctgcttctgccacagatggcaaaaacaggaaggcgtaacaaagacaaaatgcaacgccagtgtcggagaagggcgcgcttggcgtcatggcgggttttgttctgtggacacctgcctgccggccactgttgagggcggacatcaggctccttgtgtgggaggcagtagtaaatgcagcagcgctttgaggggtcaaggatgacatccagaattcgggcgtgggcaaccgtgatgggcggaggaacaggtctgggtagggaattacaagtgtattccattggtgtgagctgcatgtgcagtgcctgtggggcatcagacagggagaggtgccctgttgcccccagaaagagagatgtggctgggttggggaggatacacgtgtgtgtggtaaaggcaggagaaggtgccggggc

SEQ ID NO: 3325 - DNA, 1048 bp, Homo sapiens
actctgaggaaacagaacgatggcaacaacaactactgtttcttcagggctcacaagattccaggcactctcgcgagtcctttcccttacttatttcacccttgtaggaaacttgtgcgataggtcctatcattggtccattttacaggtaaggaaactgaggctcagagaggtcaagtcccttgtctaagttcacacaggtggacccaggtgacacttcaaagaccagggtcttaacttatgaggcccactcccgcagctcaccatagaaggttcagagcccatgctggctgtgctgggggcccgctgaccactgtctctctccacagggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccct

SEQ ID NO: 3326 - DNA, 1707 bp, Homo sapiens
caaaaggtcttatgtcatagccggcacagtgagggttacgcatgtccaggacgaaatcccagaatgagcgtgaaggtgtctgaaggagactgaggggaggaggggggttggattgggttaaaagtgactccattctggagaagccagcctgtggctctgaaggatgtggaccttgtgcttcttgatggggcggggctgtggagtagggagcagcagcctaggagcagggtaggggagggagatccagcttcagacatgcaaaggaagaccccgcagaggatcctgcctgacacttagctgtcatatgctgagcctcagagggccagatactcatgtgtgttctcagtcgagaatgcgtgtgcacctctgtgcatgtgtacaagtgtaagcctctacacccctgtgtgtgcgtgttaactcctgagtgtgtgtgacagcatgaatctgtgggtttcacctgtgtgcatgtccgtgtacatatgtatccattcatatgcagaactcctgtgaacatctgtgccctcatgctttggtgtgtgtgtcctcagggcacaagggtgttcaaacccatgtgtgttggtgtgtatgtgaggggaggttccctgagctgctgtaagtgggggaggggaggccggttataatgagcccctacctcccctccactgagccgcagccatggcctgaattttgcggcttaaaaataattgggggcagcagggggattggatgtcactcatcatcagccgctggcttggctagtgccgcagcaggtggggcgagctgagcagtgtgggacaggcatgatgtagggtgggaaagaccaggggtctgatccctttttcagctctgaggaggagggtgggtggttggggggagaggcacagcctgtctggcttccgccgaataactccatgtgggtcttgggaggagggtggggtggctcctctgcagtgagtaggtctgcctggagctactccaccatctcccccagcccctgtatggctgggaggggaagatgcttgcttgggcctggcttggaggtgcagcatgaagggatgtgggatctggagcagtggggagctccatggatgctgcacagggactggaaagttggggttctaaattctgtcccccctctgcctgctgtttagactcctgaagacccaaggggaagtctgttccctgggagcaactgtgtcttgggagaatctagtcatacctgtgaattgtcctgtgtttctgattcagtccccagagctaatagctggtccatctggcctgaagcctgagcagcaagcctagggaaggagcagaggctactggtggagggagacaggcctgggctgggcctcagatcctgggcttgcgtcctctgtggccacctttgtgtgatctggagcgggttgtctcccttttcctagccccatcttttctcctctgatgaggaccagctgggctctagggggcccatgcagtgctgtgagctatcctgtggcatgcaggagggaggccgcttggattacttggggggtaggattggaagtggggctgattcagaccacgcgctaggttccattttctgggcagttgggtagaggttgcgcaggctgtgggcagtgacacagccctggcctggtgggtgggagggcacctgcagctccccccatcctcagcccttacccactctggcctgactgctctgtgtgt

SEQ ID NO: 3327 - DNA, 1519 bp, Homo sapiens
taaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcc

SEQ ID NO: 3328 - DNA, 1035 bp, Homo sapiens
ttatttttggcttattcactgacattttggatccttatttgtgtagaattgaattgatacctctttatcaccttcctaggactgtagttattgtgggtaaggagggatattaatattaatattatattgtatataattatattatgctatatattatattattatatttatatattataatatataaatatatgttataatatatatttgttatatataatataatattaatttaaatctaagtttcaaggactagattattttagtttgataaatggaacagtagagggataaacaaaggtaggtagtgcagaggatagatagaactgttgttctatctacttgatttgggagtaggttataagagatgaataaattttcagtttgagaccagttaatcagaagatgcgtgtttactaattaaacgctttactaattaaaggtgaggttttttagtttacaagttttcagacacttttttcccccaagtggtcaaaatacaataggtacagtagcattttacagaggactttccctactactttgatggttgagaagattttacaatctattgtctgaatagcctctgaatattaagttggactccacaagttctgtagttactcagagccttgactgtttttcataaactctatatccagtctgtggacaaatcccacgtcaaagtgtatcttgaaactgaccccttcttatcttccctactgctgttaccctggtctaagctaccattatatctacttgtctccttgcttccacccttaccatttttgtaatgtttccacatagcagatagagtgatcctttgtaaaacctaagttatcactctttttttctctcctttttcagcttttatgttaggttcagtgtgtacatgtgcaggtttgttacgtgggtaaattgaatgtcgctcgggtttggcgtacaaatgattttgtcacctcgtcaccagttagcaagcatagtacctgataagtagtttttcaagccccactctcctctcaccctccaccctca

SEQ ID NO: 3329 - DNA, 1034 bp, Homo sapiens
ggtgcgtggcagaggcaggagtgtggtagggtgtgccggcgtgtgtccagtgtgtgagcaggcatcctagaggcccttccccttggtctttgtgtgtggcgatagtgaaccctggtgtgttgggttggggagttctttccgggagcatcttgtccgtgggtcttcaggttcaagtatgaggaaagggggtataagtctcctccagcggcactatgatcttctggctctgggattttaatttttttcccccagaaaggatgtgatgtgtttttttgttgttgttctatacatttttttctcccacgtttcatgacttcaaagtaaattttcaaatttgtcaatgatgccatcctatcctagtctggggcccctgagagctaacgaaaagaagtttgtctgttgcccaaaatcctacactctggcctgtagagtgttcaggagcataaacttttgtaaagtactgctagtttttcaggtgaagagtattttattgttaggtaaattgaactgtagtctggtttattatttcctggaatttgtcaagaaattagcagtgactagcaattctagtgtcactgtaggcattcagcaaatgtttgtctgtccggagtcgccaaactacattacactgctgagttggaatatggtacttgctgtcatgctctgtaagagagagtagtttcagagggaagtgagtgaagttatgccttgctgagtgtgcaaaaggagattaaggatacagaatgacacattatcagggcttcagaatcacttgccagcacaccattgtattggtgaagatggtgagaagttgtttgctggtattctgatcttggcatttttaagtttcataatgaatggactaattattatcatggacttttcccattcttgtgttgtaaaagtagggattcttgaagagtagtaccttgatagggattttacacattgatataatcttaaaaatgatgttatcttaaaaataatgtctcctagaagttggtagtctttcacttgatcttagccaaaaggcc

SEQ ID NO: 3330 - DNA, 1051 bp, Homo sapiens
tgtacacaaagcacctaggccatggtatgtgcttaataaatggtggctgtgcttggtgttacctgactctctactcatcctttgggatttgggtgcctgcctgtccgtccagatgtccttgagatctcacgagttctctttgagtgcaaagacctcattctcattatcaaaccaggctggtcccagacctcagagttcaggtcttcatgctggaatcctgggaagcactgaacgtggagtcaggagatgtgggtttgagtcctgagatttgctgtgacttcatctggaagatggggttttgataccttttttaaaggtatgaaatgatgatgatggaagtgttttgtgcctagaaaggcatttgttgcatctcaggcattcttttcattctgaccacccagatctgaccctggctgtgcccatctgtaactctctggctatcatcttcacactgattgttgggaaggcccttggagaagatattggtggaaaacgtaagttagactactgcgagtgcgggacgcagctctgtggatctcgacatacctgtgttagttccttcccagaacccatctccccagagtgggtgaggacacggccttttcccatcctgccctttcctctgcagctgttttgcttccttgtggccatcagagttcccttcccctggacagtctggagaaagacagaggctggggtttgggattgaagaccagaccccatctgagcccttcctccagccctgtaccagctcctactggcatggctgagctcagaccctcctgatttctgcctattatcccaggagcagttgctggcatggtgctcaccgtgataggaatttcactctgcatcacaagctcagtgagtaagacccaggggcaacagtctaccctttgagtgggccgaacccacttccagctctgctgcctccaggaagcccctgggccatgaagtgctggcagtgagcggatggacctagcacttcccctctctggccttagcttcctcctctcttatggggataacagctacctcatggatcacaata

SEQ ID NO: 3331 - DNA, 1032 bp, Homo sapiens
ttgcagtgagctgagatcatgccactgcactccagtccctgggcaacagagcgagactctgtctcaaaaacagaaagaaagaaataatatgcacttatttaaagagtttgaaaacctctggcctcatgcattcactgctgtggaagaatgctgaacccttgaccagctgactacaggtagccattcaccaagttttaatcaaattgcagttttaggttctttttatctcattaccctttctgcctgtatcctttaatatccatcctttctaataaccagaacagtaataactatttatgaagcatccacttcagccagggactatccatgcattatcacagttcatcttacgacaacccaacaaaagaaatggtatactgtgacccctattttacatgcggggaaacaggttgagtgtttgaatatcctaaccaagattgcaagggaaactcagatctgcctcactccaatgccctcactttccactgcaccgtgctgcatccttcttccatctactgttgcaaaccagaccttagcagccatgacactccttgtaaggtatgtaaacttaagaaggcagctctgggcagggcacagtggctcaggcctataattccagcacttttggaggctgaggtgggcagataacctgagcctagagatcaccctaggcaacaacaacaacaaaaatacgaaaattaactgggcttggtggtgtgtgcctgtagtcctagctgctcaggaggctgaggtgggaggatcgcttgagctcaggaggttgaggctgcagtgagccttgacctcaccactgcactccagcctgagcaacagagagagaccctgtctcaaaacaacaacaacaaaaacgaaaaacaaccaaaaaagaaagcagctctttgtaagtggggttgtatcaatttcttagatgggtaatgcctccatgctggggcctcccaggggatgaggagcaggacagtttgctcctttgcctcacacaggcgagccctgggagtgctgggaaagaatttgctg

SEQ ID NO: 3332 - DNA, 2023 bp, Homo sapiens
gctgggggagggggagcccctgccctcattgctattccctctgccctgcaggagaatggccacgtgaaaagcaatggagacttatcccccaagggtgaaggggagtcgccccctgtgaacggaacagatgaggcagccggggccactggcgatgccatcgagccagcaccccctagccagggtgctgaggccaagggggaggtcccccccaaggagacccccaagaagaagaagaaattctctttcaagaagcctttcaaattgagcggcctgtccttcaagagaaatcggaaggagggtgggggtgattcttctgcctcctcacccacagaggaagagcaggagcagggggagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtccctttagtggtgctttaatgagtggtcttctgggggtagggtgagaagattggtggaaagtagtttacctcaaacctcaagggaggagttaaggcaggcaggtaagtttatggggttttcttgttcagggggttgccccaatactcatggacaccagaacggcagggaagtagagttgaaaccaacccagggacacataggaaacaagctcaggaggatatagaaatgtaccattttattacaaagaggctcacaaaaatgaaaatagtatctcaaaaaggaaactagactagcaacctccacctgcagaattaggagaagacagacagagggcaggcagtgtttcttggctcacttgaggccagtgggaaggtacgaaaacagaaccaatctaaaaatggctgatgttactttaggagcctgaaaaaaacaggagatccttgaagacccagccaccccttctagaatgttcaataagggcacctttccaaagctactaagcaggcacttggcatttcaggagtttgtcttatggttgcataaaagtatccctttcacccagacctggcaccctttatggttcaaagttaagaacgggaagaatgggtggcaaggtggctcctggaagagctcacccagcacagctgccctgagctcggggccttggtttctgtccctggggatatttatatttaataaatttttatataaatacacag

SEQ ID NO: 3333 - DNA, 1030 bp, Homo sapiens
atccttcacctcatgccactttcatcttgcattctgggggggtgtaatgttcctggactcccagaacccctctgttccccactgacccactccagagctgccatcgggcttgcttggttccaggccagcgggagcagggaatgatcgaatgatcgttctaacaaacaggaggaagcacccacccacctcagccagtcctccctccttccctccaaaggggccccggctcaccttctggccctcccatcttgtctataactttaattgccacttttctttggtgttttttggaaaatgcttctttgacttttgagtaggtcccttccccaatggtcttgcccagctggtacccattggagagcagaaagtcctccatgctgtctagcgccgccttcctatcaccctctcagctcatgctgcctctgagaggcagctctactccaccatcgcccttggcctgctccttttctccccaaggacttcatccgcagccgcccccagcgttagaacattctctgtctggacacagcggcgggtggtggggagggacagggccagacatttttaaactccggtgcaattgtgatgtagatgctgtgtgacccttggccaaaatgggcagtgcccctacctgccctcactaccaccaccaaactcagcccggattaagtcaccgccgagcccgcccccgtgccaggcattgagttgtagtcccgcctgggagggcgctccgccgcgtctgtgtggaccgggaatgcgcggctcctcggcgtggacgccgcctcgcggcgggttgccctggcctgctgcgcccccctcgggtgtccggggtctgcgcgaccccgtctccaggcgccatggccagaggcctccagtccccgattctggcccgcgctgagtgccaggggcggcagggggcaccgttgggggttctccagtgggaggaacgtgctctgtgaggtcagcgcgccgcggcccgggtcacaatgctgccctcctcgacgcccgggcccgggcacgccacagagac

SEQ ID NO: 3334 - DNA, 1032 bp, Homo sapiens
aaggactgaggctgacttggttcctgtaggcagccatcaccttgtggtgtctggtgttggttgggggaagtgtttcctttaggtctgaggtaatcagagcatcaggcccacccctcaggcagagggcagctctgcccctcagacacattccttaagactaggggttcactctcagtgggacctcagagtatggcctggggtaggggatgggaggtggctctgctcagcaagtggaggttaggtctgggcctgactcaggagtaactatgtgtttgtgatttccattaccccctcccatttgcagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcggatgcacccaagtcc

SEQ ID NO: 3335 - DNA, 1039 bp, Homo sapiens
caagccctccagcctcaccccagagaggatcactgatgtcagcagcagcctgaggctgaatccaggttgaaagaagaataacttgaaaaaatatatttccacacacagaattttgtttttcttccaagttggttaagacatatattttgtttcttttttttttttttttttgagacggagtctcgctctgtagcccaggctgaagcgcagtggtgtgagctcggcttactgcaagctccacctcccgggttcacgccattctcctacctcagcctcccgagtagctgggactataggcacccgccaccatgcccggctaatttttgtatctttagtagagacggggtttcactgtgttagctaggatggtcttgatctcctgaccttgtgatccgcccaccttggcctcccaaggtactgcgattacaggcatgagctaccatgcccggccacaagacatagattttctatatgcacatcaagggaggtgctggtttaggttgctataggacagagctatcctgtattccagttggtttttgtagagaaacaattagacttctctagatagagccctgatttttctctcacgctttcagttttttaaaagcactaatgatatttcctgttttctcataagaaaaagtcaatactatgccttacaaagagacctttccttctaatatagaattttatttgaaagtgagtacatgtttataactagagaataaaaggagaatttttgaaaaatttctttattgttgtttttgtttaactacttaagctattcgtccttttttttgagacagggtcttgctctgtcccccaggctggaatgcagtggtgcaatcatagcttactgtggcctcgaactcctgggctcgagcagtccttccaactcagcttcccaaattgctggaactacaggaatgcaccaccatacctggctaatttttaaatttttttgtagagacagggtctcactatgttgtcttgaactggtcttgaactcctgggctcaagtgatccaccttggccc

SEQ ID NO: 3336 - DNA, 1889 bp, Homo sapiens
tacttatcaagtgcctccagtgtttcagacttttttttatgcactcgaggtagaaatgtaataggataagcgaagtctctgcccttactgagtttaaaatgtagtgggagaagtgagccagacaaacatgtaaacacataatataatttcagatagtgaacagtgccatcaggataaggtaagagtggttggaggaggggagggggtagtcagaaaatatatgtttattaacccattctcacgctgctgataaagacatacccgagactgggtaatttataaaggaaaggggcttaattgattcatagttcagcatggctggggagacctcaggaaacttacaatcatggtggagggggaagcaaacccttccttcttcacattgtggcaggaagagaagtgagtgctgagcgaagggggaagccccttagaaaaccatcagatctcctgaaaactcacgcactatcactagaacagcatggtggaaaccgcccccgtgattcaatgatctccacctgctccctccctcccacaacacgtggagattatgagcactacagttcaagatgagatttgggtggggacacagccaaaatatatcagtatgtttgagaaagtgatatttgagcagaggcaagagagatgaggagtgagcagaaataaggaagaactttctaggtgaagaaacaggtgtaaaggccctgaaatgaggtaagttcagggaacagcaagctggagctgagagtgaaggtgtaatagtaggagacaaggttgtagagatagggccacagcctctttggtaaaatttggtaaggggagtataggatcaagtactcacgtatgggagttggccttctgatgggagccagggacaagccattcattgcaatcaggctaaggtgagtacagatacagcatgatggtagatttggtggtaggaaaatgagtcagttcttactgagttgctcttactttctctaggaagcacagttgattgagagtgagaatgagggaggaatgatcactagaggagaagagaaagaattgtctcagagagtgaaaaagggaatttattggtaattgtaagattttactgcgagtactgaattcctgtttgagatgtgtggacatacactcagggtgataccagttagcatggtgtgtgctgccataagcagacagttgaacttgaattaggttgtggttttgccaggtgattgtggcagaggagaaaaagcagtggcagtgccacttatatccttctgtgaaatcttcctttttttgtgtggtgtagagctagcaaatgccatttacctattgcctggtacattttatggtgcacagaattattgtagattccttttggagctggaaagaacctaagagaacatctaattctgtggttttaaactggggcagggttgggcaatgtcatgtatcagagacgtgtggagagcttttgacctgggaaactatatcttattcttcagctagacttggaaagagaagagtcccaagaggtgaagtgagtgttgtcaactgaggaaaagagaataagttgaattcctagggcctaggtcagagtataaggaggtggttttgatttcagaaagagccctgagccaaatagtagaaaagcttgtgttctttgattcaacccattttctttttttttttttaatcatcctcaaaagttttttacttttttttctttccaacttttatttttaggttcatggggtacatatacgagtttgttacatgggtaaattgcatgttgtgggggtttagtgtacagataattttgtcacctaggtaatcagcataatacctgataggcagtttttcaatcctcaccctcccccaactctcaaatagacccggtgtct

SEQ ID NO: 3337 - DNA, 1049 bp, Homo sapiens
catgttttaatttgtattctcaaggtggggagaagaattttcattgtccaagcaccctcaggtatgttttaaaatccagccattaagaacatgaaaaatttccttaccataaagttcatatatgtgacaatcaacttcagttagttctaactggtgtaaagtgataagtttttctcaagcttctctgacctgtctggatatattttgttaaaatactgtgattatacacacctgatttagtggatgaggcgtcagcattgggttctagggtcaagtttgttcagattattgtggaatttgaaattctctttgcctttttgacctttatttcttctcctataataaagatgttggactagatgttctctattgtgccttctactttctgtgtgtctctagattctgtatttgccgacctgtatggcctcactctatggtaggaaaatctattggaacaggagttggcagtttttttctgtaaaatggacagataataaatgttttaagatttgtgggcccagaatgacagaagagcagctactcagtgcttctgttgtagcaccaaagtagccatagataatacttaaatgaatgagttcacttgtattctagtaaaacttatttatgcccattgaaatttgaatttcttatcattttcaaatgtaacaaaatgtcattgttttgatttttttccccaaccatttaaaaatgtaaaaatcagggcaggcatggtggctcagacctgtaatcccagcactttgggaggccaaggcaggcagatcgctttaggtcaggagtttgagaccagcctggccaacatagtgaaacctagcctctactaaaaatacaaaaattagctgggcgtggtggcacgcgcctgtaatcctagctgctcaggaggctgaggcaggagaatcactttaacctgggtggcagaggttgcagtgagccgagatcatgccactgcactccagcctgggtgacagagcgagactggtctcaaaaaaataaaataaaagtaaataaataaagatgtaaaaatcactctt

SEQ ID NO: 3338 - DNA, 1051 bp, Homo sapiens
tccttttgttccatgaaatttagtagccctgtcacattggcctaagttaaacaactgcagcttttagttttccttaacatgaaaaaaggaaaagccaaatggagattgcttgctgctgtcatcctttagaagggaacacatctgcaatgtcattgttatttaatagagatggcactctctgcttttataattcctccattctctgctttaccagcttcactacttatactcattctatcaactgagtcactcatcctacagaattcaagtgcctaccagtagtttattaggctcagagtgattgaaatcctatgtcgtcctcctccaccatatatctgttttcccccagcgttaaacaacagcttttattgaagtggcagtgtacagcagcggcagaggtactgcccctgtgtgcccagagtagttctctaccatatatcttgcagagaaattcttttgactcatatttttagatcttacatttttctagaatacctcccttgaatatgtaagaaaaaacttatttccttgaaatatatttaatactcagcttgggcaacatggcgaaactccctgtctcaaaaaaaacaaaaaaacaataattatctgggcgcagtggcacatgcctgtggtcccagctactccagaggctgaggtgggaggattgcttgagctcgggaggtgaaggttgcagtgagccaagatcatgccatggcactccagactgggcaacagagtgaaaccttgtctcaaacaaacaaacaaaaaaaactgcatacatatatatctcatttgttgtcctattttagctaacattttaattttctttgcttcacagaagttgtgtgctattgttttctagaaaaggttgtaaaggccaggcgcggtggcttacgcctgtaatcccagcactttgggaagccgaggcaggtggatcacctgaggtcaggagttcgagaccagtctgaccaataaggtgaaaccccgtctctactaaaaatacaaaaaaaattgattggccgggcgtggtggcaggcgcctgtagtcccag

SEQ ID NO: 3339 - DNA, 1024 bp, Homo sapiens
agcagtgggagtggagaaggaacaaagaaatgtataactggttatgatgaattaattgtaaacatcactgcacttggaccagcctagccacaattatttgaaaaagctattaaaatgctcctgtattttccttctgcatatttgtgaggttggattttatttatgcactccaagtaaatgactatattgccagacatttaaaatatttgaaaaaatgtaaaacagtgccagtcttcactaaattttttttaattaataacttttatttttttttagagttgggaccttactctgttgcccacactggaatgcagctcactgcactcttagctcactgcagcccaagctcctagggtcaggcagtcctccccatctcagcctcccaagtagctgggactacaggcatgcactaccacgcctggttttttaaaaactttttaagagatggagtcacactatgttgtccaggctagtcttgaactcctgacctcatgctgtcctcctgcctcagcctcttcagttgctggggttacaggaatgagccaccatgaccagttaaatcttttaacaatatagttactttttcataaaaatatgcaaggccaggatggtggtaagcacttgagcccaggaatactaggatatattgtactatggtcgtgcctgtgactagccactgcactccagcctgggcaacatagggaaactccatcttttttttttttattttttttgggggagtagagtcttgctctgttgcccaggctggagtgcagtggcatgatcttggctcactgcaacctctacctcccaggtccaagcagctcttctgcctcagcctcccgagtatctgggactacaggcacatgctaccacaccgggctaatttttgtatttttagtagagatggagtttcaccatgttggccaggctggtctcgaattcctgacctcaagtgatccacctacctcagcctcccaaagtattgggattacaggtgtaaaccaatgcgcctggccaggaa

SEQ ID NO: 3340 - DNA, 1055 bp, Homo sapiens
aaaaaaaaaaaaaaaaaaaaaaaacttgtgtaattgagttgtgagctgaactaggtccgtttttcatggaacactttttcttgaaagaatgaaagacatgcttttgttattcagacttcagtatttggcttgctctattgcccaggctggagagcagtggcacgatctcggcttactgcaacctccaccttctaggttcaagggattcttctgcctcggcctcccgattagctgggattacaggccccaccaccatgcccagctaatttttttttttttgtatttttagtagagacagggtttcaccgtgttggccaggctggtcttgaactcctgacctcaggtgatcggcccacctcggcctcccaaagtgttgggattacaggtgtgggcctccacacccttgaaagtgaacagtgatctgtcacatcaaggaaaatagctgacaatatttgttgataatggtaaaattcaagtccagttaaaattttcaggcctgatgagcttaatctcagcactttgggaggccaagggggacagatggcttgagcccataagttcgagaccagcctgggcaacgtggcaaaaccctgtctcttacaaaacattaactaggtgtggtggtgcgtgtctgtagtccttaccacttgggagacttgaggcagaagtatcacttggaccttggaggtctaagctgtagtgagctgtgattgtgccactgcacttcagcctggatgacggagtgagactccgtctcaaaaaagaaaacaaaaagattcattctaagtgcataatagatcaatggattttaattttacaatatggtaagttcattgtgatggttacagaatccacattgcaactaacgttgaaaaaactaccatgttttggccggtgcggtggctcatgcctgtaatcccagcactttgggaggccgagaggggtggattgcctgaggtcaggagttcgagaccagtctgactaacatggtgaaaccccgtctctactaaaaatacaaaaaaataattagccaggcgtggtggcgtgcgcctgta

SEQ ID NO: 3341 - DNA, 1077 bp, Homo sapiens
gcctccccgagccgacttccagcgattgcgcgcgccggcgttgacgggactgcgcccggtcagggtcacgtgagagaggtttggtccgcacactcccgcggcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtgtgagtaggtggcttacttctctctttacatgtaagcacacaggcatcccctctccttacccgcggcttcctgctgctctttctactgtgccccatgggtacttcaggcatgatcccatttgtgccggctgttgtagtcgcgttcgtacttctcctggggatgctgaaggaaaaagccacctggtttaatagtcgcgaaacctggcctccctcatttacagtctcttgaacttcttccacatgtgcctaatcacatttatcttcgtaaattctaaagataaccatattttcaggcgtttgcagggttgttacccccatgtatttcccaacggtgagattagagtgtgcgaggttagaggactcggaaagctaattaggggatttctaacttgatgtttcacctcgatcatattagcaaaaaacctggttttgccatttatgattgtgatttttaaaaatgattattt

SEQ ID NO: 3342 - DNA, 1013 bp, Homo sapiens
ttaaagtatgaatgatgttgggatgtaatttaattgtccatatattcgttaccaggctaggttctgagggaatactggagtgggcagaggtgttagaagtaagggtgggggcagacatgttgaactagaggaatacaacaaaatagatataagccacaagccttcccctgaagcagctgagatgctagctgggtatacaatagtgccactcatccaatttaagaataataccatacaataaagttcagaatatatggcaaaaactacaaatagtcatgcatgtgggctaggaatagtcatgcatgtgagctaggaatgctgtcaatgagtttgttgacatggatccttttccttatagagtttgtgatcctacgagatgagaaatggggtggaaacaaaacctacacagcttacgtggacctggaaaaggactttgctgctgaggtaacatgaaaggaaaaggaatcctttcatgaagatctgtattttgttattttttgctgactgttagaacttgtttagaacaacttgttctgtgtaaaagtgagctgcctgctatttttgctctacttttggtaatctcactagtgtccattttccttcaaaattgcagttttggttaaagtttcttgtcagttagcttttctgacttaggaattttgttaatacagatggatttctatccctcggggccctttccttacctggcagggactctgtctcacctcttctcaggaaacatttcttatcagtaaatgtctgtaatcttatacacacgagtggtccctttaggatgtacaaaagcagtactcattcagtagaaaccatacttcttcaagtacccatacaaccattctgtttttcactttctgtattcaataaattacatgagatactaaaaaaaaaaaaaaaaaagaaaatgggctgggtgcagcagctcacacctgtaatcccagcactttgggaggccgaggtgggtggatcacctgaggtcaggagttcgagaccagcct

SEQ ID NO: 3343 - DNA, 1023 bp, Homo sapiens
cccagctactagggaggctgaggcaggagaattgcttgaacccaggaggcagaggttgcagtgagccaagatcacactgttgcactccagcctgggcaacaagagcgagactccctctcaaaaaaaaaagggccaggcacagtggctcacacctgtaatcccagcactttgggaggccaaggcgggtggatcacctgaggtcaggagttccagaccagcctggccaacatggtgaaaccccttctctactaaatatataaaaattcagctgggtgtggtggcatgcacctgtaatcccagctactcgggaggctgagacaggagaattgcttgaacccaggagaaagaggttgcactgagtcaagattgcatcactgcactccagcctgggccacagagtgagactccgtcttaaaaaaaaaaaaaaaaaatgcctggcccaatcccaagagattttgattcattaggtttgggtggaacccagtaaaaggtgattcatatactgtcacatgtgagctagaatttggtaaccactgaactcaaatgaccatgaactcactctttccaaataagaaacaaagcctattacctaaaaaggaaaaatggctgtagataatatataatacttagtgtggctgattgctgtgaacaagtatcctcacacattgtcgacagcaatgttgattaggatacctttcaaaaaacaattttgaacctagcaattttcggcatcttaaggaaatgattctagagaagggaaaagactgcaaagatgtccaatgtagcattatatataatttgtaaaaattaggatagaatctaacagtttggagtttgctaaattatgtttccactaataattgggaatataatatggcataaaaactataagtaggccacacattgtggttcacacctgtaatcctagcactttgggaagccaaggtgggcagataggttgagtccaggagttcaagaccagccttggcaacatgataaaatcccatctctataaaaaatttt

SEQ ID NO: 3344 - DNA, 1027 bp, Homo sapiens
ctaaccttaggtgatccacccacctcagcctcccaaagtgctgggattacaggtgtgagccaccatgcccggcttgccctgttgttttatgtatttccagcttttattgttgtttatggtgacataagtccaatagcctcacaatgtaatactgatagaaaagcagtagggaaaaaaacttcgcttgaattacagtcactgtcaaagctacatatttagtataaaaagattggaagcaatataacaactactcagttgctggccaagtcagatgagatcagggcactgaggaggaacttagactaatatcggcttttgtgtgtttctctaatctctcagtacctccctgcacttggctattcaaaacgggtccatctgatgaatcctatggttccaggattaacaggcagcaaaatgagctcttcagaagaggtaagttgccagctgagacttgaatttagaaatcttcagcctcaatggagagattgaggactgaaaagaacagtgacctggctaactagaattctccaatatttgagttagaaggagccttacaccattcaattagtttagtggttcttgagtatcaaaggatccagagcagtcctgatgagatctaatcataacttaatggtttttgctgctgataaaaaaataaaagcaaaagtaatgtctttgttcatacgactgtgatgaaattcagccttattaatgagagcactatggttgcatttcactaattagcattttgattcctagggtaatacttgatatcactaatattatgatatcttttaatatttaagagtccctcttgagctcgtgtacttgagggaaagttcactttggttctgatcattagaacgtggaaatccaaagatgtgaaaggttgagttctgggttcccaaacatggcttaccttcagaatcatctagggaatttaaaaaaaaaaaaaaaagtgttgattagaccttgtccatagagattctgataaagtagttctgggaggaacttaggaatctgtatt

SEQ ID NO: 3345 - DNA, 2908 bp, Homo sapiens
ccatgttggccaggttggtctccatctcctgacctcgtaacccacctgcctcggcctcccaaagtgctgggattacaggcatgagtcaccgcacccagcctcaaaactcatttttgacataaattttaaatcccttggctgggcgcaatgggtcactcctgtaatcccagcactttgggaggccaagacaggcagatcacctgaggtcagaagcttgagaccagcctggccaacatgatgaaaccccgtctctagtaaaaatacaaaaattagccagacgcagtggtgtgcacctataatcccagctattcaagaggctgacacaggagaattgtttgagcctgggaggcagagattgcagtaaactgagatcgcaccattgcactccaggctgggcaacagagagagaccttgtctcaaaaataaaataaaataaatcttaaagactttactaccattttttttttaatttttctgagactgagtctccctctatcacccaggctgaagggcagcggcatgatctcggctcactgcaacatccgtctccctggttcaagggattctcgtgccccagcctactgagtagctgggattacaggtgcccgccaccacgcccggctaatttttgtatttttagtagagatggggtttcaccatgttggccaggctggtcttgaactcctgacctcaagctgtccacccaccttggcctcccaaagttctgggattacaggcgtaagccactgcgcccagcctgtaattgttttttaagtcacttttcatctatatctacccctacttcccctttctgatactcttgattcttgtctgcagttctttgcttctgtgtgagttcattttccttcaacctaaagagcccccacttagtatgtgtttgtagtgcagttctttcagtaatgagttctttcagctttcttttatctgaaaacatctttcaatttctttcactgggtatgaaattggaagtttgcaattatttttcttttggcacttttaaaggatcattgcattgccttctggcttccatagtttcgactgaaaagtcacctctaagtttattgtttctcctttacagataatatgtcttttctctgcttttaagattttttcttgtttctgattttcagcaattttactatgatgtttttgttgttgttttctttgagacagggtcttgcttgcattgcccaggctggagtgattgatcttggctcactgcagccttgacttcctgggctcagatgatcctcccacctcagcctcccaagtagctgggactatgggcatgtgccaccacacctggctaatttttgtatttttttttggagatggaatttcaccatgttggccaagctagtctcaaactcctgagctcaaacgctttgcctgccttggcctcccaaattgctaggattacaggtgtgaactgctgtgcctgaccagctatgatgttttcagctatagttttctttgtatttatcctgcttagattttgctgagcttcttgaatcagtggatttgttttcatcaaatttgggaaattgtctgccataatttcctcaaatactgcttctctcttattctctttctcctctagggactttataaaactcatgtctcatattctgttctgctgttttcctttctttgttccctctgtgctttactttggatatgttctattgaactttcttcaagtttatcaatcgtgtcttctgttaaatccagtattgtattgtgacattttagaacttccatttgattctttttatagattccaattgtcttttacaattctctttcatccattttgtctgccttttcttatttcctttttggtttgtttttcctgcctattctgcctatgtactcttattttcttttatttatttatttatttatttttatttttatttttttttgagatggagtctcgctttgtcacccaggctagagtgcagtggcgcaatctcagctcactgcaagctccgcctcctgggttcatgccattctcctgcctcagcctcccgagtaactgggactacaggcacccaccaccacgcccagctaattttttatatttttagtagagacggggtttcaccgtgttagccaggatggtctcgatctcctgacgcctgcctcggcctcccaaagtgctgggattacaggcatgagccaccatgccctgcttattttctttaacctaccaatcacagttattttggcatcatggtctatttattgcaatatctggattgtttctgaatctgcttctattggctattttaactgtcagccacttttctctgcttcccatttctagtatttttttgtatgtgtgtatcaaagggattatagatgcattgtagaccctccggattgtgtttgtaggatgctatgttttctgtagattgctaaattactgacttatcacctgggttctgtcaggggttggttttaggctttgttagaacgtctacttcagcttagcctttactcctgtggtgtggtccttgttcctagagcatggcctttctagagactcaaactgaaatatcatggtgttcacaaagccttctctactttgattggagctaaacttccatctctgtctccccaatactgtgcagcctccaaaatctctgcccaggtctccagcctcccagaacctgttctctgccagacttcctggtatctcactatgtgcatacacagctatgagtcagccaagaaatcagtggggaattttgacataggctgaggaacccatcccaatccctagcctcctccagccctgaactccaatagctgtttcctctgcttagtctttcgctgtctgcttggtctctttttatcagcacctggtttgcaaagaaatacc

SEQ ID NO: 3346 - DNA, 1095 bp, Homo sapiens
ggtctttacctacttttctaacctcatcagtcactacttcccacctcccttgaagttcgtacttttgcagactgaatcactcaaaatttccctaaacacttcacacctctgtgccttctcacattctatttcctctgcatggtgaaaaacatctatatgttgttcaaaaccaagcttagcccacaatctgattctaggaagacttctccacacccatcttactaaatagagataatttcttcttttatgtcaacactgttccttatatgaacatctgggttaacccttagcacgctgagttgaaatgatctgtttacatgtctctccccagctggataattgggcttcttgaagggagagtctgggtctgatttatctcaccatccacggagctggcagcaggcctggcatgtcataagtgacagtcactgttttatttatttattttaatttaattttattttttgagacagggcttcactctgtctcccaggctcgggtgcagtggcacgatcatggctcaccgcagccacgacctctctgggcttaggtgatcctcctacctcagcctcctgagtagctgggactatagatgcgcaccatcacacttggctaatttctttttgtttgtttgtttgttttttatttttggagagacacccgggctcaagtgatctttccacctcagcctcccaaagtgctgggattacaggcgtgagccatcgcacccagacagtcactgttttctagttcagtcttacctttttcccgaattctcacaggacttctttatgctacttatatttcatttgtcacaggccaccttattcagtagaatacctttggcatgactatggtttgttttcttcttctctccctccctgcaggattctgcatatcctgagggcagagactactcttatttttttatcccatgacatccacatagagtaatgttcaccgcaaacactcagcaactgtctttgcagcttttgaggccaagagggaagctgactgctgtttattttcttcttggctttaccttctgaaaaatctagtaatttcctaaagtttctgatttctcagacccatata

SEQ ID NO: 3347 - DNA, 1045 bp, Homo sapiens
catctgcactgagaacatggctggacctccttgatggctctgagcctggatctccactgacacatgctgttgttttccttgtcacatggtaaaggatgagcaaggtgaggcactgacattaaactaactcttctgcttccacaataggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaagaactaatgctataagcccttggggaatgacccaagggagacccaagagagacttaacaaggacagggtggggctggaggagacaggttggaggtaattggacaaattcacattttggtggccccttatctcttgtccaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaagtaagtgcttgatcatccaccctccttgtggctctggtgcttctagctaattacaggcctgtggagtccaggcattctttacatttagattagaagctgtctggcgtgacctattaagaaccatttaaaactttgtccattaaaacctcattgtccttgtaattcatccatcagaagtgtactgactagtaaatgccttaatactgtcctatttgctggaaatataaacgtaaccaaaacaaagtccttggccttgcagaactcacagcatatgggagagtgatggtgaacaattcagcctccctttctcttccagcctcagcaaataataataaaagaaatgtgaaagaaaaatatttcacttatttctcaccgccccaacaattgttattgctttttatctttgtgagttttgttcatatttggaatgt

SEQ ID NO: 3348 - DNA, 1466 bp, Homo sapiens
agtgattctcctgcctcagcctcctgagtagctgggattacagacgtgcaccaccacgccgggctaatttttgtatttttagtagagacggggtttcaccatgctggccaggctggtctcaaattcctgacctcaagttatccgccaaattcggcgtcccaaagtgctgggattacagagtgagccacagtgcccggcctcactcaggttttaaaggctaagtaatgtgacatcttcttggatggtgagaaccctccaagtgtccacgttgtcaggggtgctcttgagcatgcgggatcagctgccaaaagacttggagcacaggagtttaacaagtcctggtaaaacatgattcaaaccagcagtctatcatggtttctgacagcctcccaaaaccgtaacttgaggaaacactacaacctcttatcggggtacactggcctgttagaatttttccaatactgtcataggacaaaaagaaatcattaaaggtttgtaaaaaggaaaatgagttttaaagaagtttttgagttttaaaagactgtctctggctaccttttagaacatggattggaggggccaagcgcagtggctcatgccggtaatcccaacactttgggaggcccacacgggcagatcacttgaggttgggagttcaagaccagcctggccaacatagtgaaaccccatctctactaaaaatacaaaaatttctctggcctggtggcgggcacctgtaattccagctatttgggagactgaagcaggagaatcgtttgaacccgggagcagaggttgcagtgactcaggattgcatcactgcactccagcttgggtgacagagcaagactccgtctcaaaaaaataaaaaagaacttggattggagggagtaagagtagatttgggagacctgttaggagaatgttacggtaatcctggtgtgatctgatagggcctggatttgggtggtgatgtagaggcagagagaaataggagggttgaagagcagttttggagtccttgaacaactctaaatgatggtaccatttactgtagtaggagtgaaactatcagtgaaaaagatggttggggagtgaagtaagaagtcaagagcatgagttttattttgaacacgttgagtttgaatgattgggttgataacaagaacacggttctgtgtatgggcgtaagcaggagatttgggagttactggctcatagtagtaattgaagcaactgaaggggatcagttaaggagactgtagagtaagaagacaaaagaccagagccccaaagattgctaatatttaatgactaggaaaaataagaacagttgcaaagaaagctaagcaggcagagacgaggaaaactaagaataaaataaaggagaccaaaagaggagaatgcttctgggagggagtgaggactaaaaaatactcactgaatttagcaacgtgaaggtcttc

SEQ ID NO: 3349 - DNA, 1022 bp, Homo sapiens
gcatgattttggcacactgcaacctcagcctcccgggttcaagtgattctcaagtctcagactcccaagtagctgggattacaggtgcatgccaccacacccggctaatttttgtatttttagtagagatggggttttgccattttggccaggctggtctagaactcctgactcaagtgattccccccacctcagcctcctaaagtgctgggattacaggcatgagccacctcgcccggccctcagattgcatttaaagagcttccagtgtcagacctctctcaccttagtcctgggcccagaggaaaaattgaaatcctcctttccctgaagaccagatgactttctgtttcctttcacagatgcacttttgtcttcctggccagtgttttactacaatgaggatggcaagtctggacaacagccagcttagaagattcttatctcttgggcactgcagccagacttcacacatttccctgcacctaggacaggaaatgctgttagtggactttggatttctggaagaatgttccctgaagggggcgtgtacttgtgtgaaaaagagaacttgttggaaaaagaggcagacagcctggagatctctgaaacgcaaattatcaactcaaaacttggaattctcttgaagcctcgagagaacaattcacttctttgataaaatcaaagaagtctgttggaggggcagtagtttatggctaaacctatatttcttatctgggttccacttactacagctgtgagatttgggcagtttactctgagtctgttttcacttagccaaaatggagatgatgatcctagttaaggggttgtgaagactgagatggtatactgaaaatgtttttggtaaaggcccatgttttttcctcctgcaggaagaagaagaaatgagttaaaggagattttagatatcatataagaaaggaagcctagacctctaggccagaggctatgaaaaatttaaatttattctaatccttagcgacactttagtagatgaa

SEQ ID NO: 3350 - DNA, 1108 bp, Homo sapiens
gcacctgaagctggagcagcaaagcaaaggctcaggcagtaggatggaagctgcttgaatgtgcagctgcaggctgctactgacccgtctgtgcatctcatgactctggttgtctcttatcaggggatcccgcccccacatgctggcatattcactgctgtgctttcttaaaaccaacacccctgtaaataagcagacagacataattggagactgacttgctgaaactgcagcttagccagtccagctgttctagttctgtgaaagcctttattttataggaagtgaatgagtcagatgggtttgactgtgaaacccattataaggaaatacttaactgtgcaacaaagtgatgttggagccaagaaaggcaatagttatgggctctgagacactattgggaaagtttgctgctccaagaggagggaagaggttggctcctgtatgtccttcagtctcattccctggaggtaatttgattgttaaatgtttgatttcctattatgtgcaaggcagggaaggtaaagtgtgtatgagttgtggtctctccttttgtggagttaacagacaagtgagagatgcataataataagtaggcagggcctgcgcacgcctgtaatcccagcaccttttttaggtgggtgatcacctgaggtttagagttcaagaccagcctggccaacatggtaaaaccccatctctactaaaaatacaaaaattagctgggtgtggtggtgggaacccataatcccagctacttgggaggctgaggcaggagaatcgcttgaacctgggaggcagaagttgcagtgagccaagatcgtgccactgcactccagcctgggtgacagagtgagactccctctaaaaacaaataataataaataagtaggcaggtgctgtgggagtacttagcaagaagtgaatggtttgctgggataatgaggggaagtgatagttcctttgttgttaaggactgagtataagtttgtctggtagagaaaggaaatttctagagagacagaatagcatgtgcaaagtcatggaagtataaaatgtataggtatttaaagaaagaaagaattcagagtgactatgatttcggatc

SEQ ID NO: 3351 - DNA, 1103 bp, Homo sapiens
cccggctaatttctttgtatttttagtagagatggggtttcaccatgttggctaggctggtctcgaactcctgacctcaggtgatcctcctgcctcggcctcccaaagtgctgggattacaggcgtgagccaccgctcccggccaaggtggggagtatctcttaatgagagtggggaggggatatttggccaaggagggaatgagaatattctgagggggcagcgcgtcggaggggtgtgtccacttggctagggacagacttagcattgcagaagaaggcgtgttctccctgacaaccaccgctgaaagttgggatggaggtgactggggaataggctctcgggtaccctgagcactatgtgttctgtgccacgctatcgggaggcactctgtcgttcttaccttgctgccttgggtagggtgaggggtagacagatatgttctttgtccagagtctcaatgggggcactgagaagaatgcccagaggttggtgtgataggagaaattgtgtttctgaacccctttgatcttgagttcttgatgacagtctttttaatgcaccatgtaggctgaattttaaagggcagtaaattaaaatatgcaatatctgcagagacataatacaccagattttgctatctgaagcattcagtggagaccttcctcgccctccccgcctttagaagtctaattgttactgtcagtatatcccatgaaggggttgcacgcaggaagaggggctcatttaagtagttgggagtcagacagccattacctgttctgtgaccttgggcagataattttattcttgtgtgtcatgttttggcgacaaaaagatgctggggagtccttgcagtgtgtaaacgtaatgctagtaaaaagttgtgtgatctttagcttcaaaggagttaaggacttttaattgtagcctatatatcaaggtggttttgaaatctccatgatgctgctggttgtctcctttcaaaaggagctgtcttagagtgtctaggagagtaagaagagttaacttctgtttttaattctgccaaacttgtttagaaatgggtgtgctatttaacctcactgagatggggtttctaa

SEQ ID NO: 3352 - DNA, 1030 bp, Homo sapiens
catttgttgaactcatattccatactgtgctttgctctgtgggcttcagattattacctcaggtttaaccaggttctaatcaagttggcaagaaggacactgtccacctgggggaccagcctcagagcccacagtccaatagagacactgctccaggtcttgctgtgtctgagggaagtggcctggccaccttcccaaattgctgaaggcctgacctttggcaggggcagccagagcctcgtgctgcctttggctgagagccgggccagaggggctgagccagagtggagtgatcagctgcatgggctgggcccctggggtctccagacaccctggctcaatgcctggacactgttcaaagctgctacagctagagctggggaccaagcaccaggacccctgagttccaggcccaactcggtggctgatgtgctgcgggagcttgggcaaatccctacccctccattggcctcagtttcctggaaggcagttgaataagattgctcctgtccgtgaccttcctccataatatcatctgtgacaggctggacatttgggataccacaaagtagtccctcctgcatggaacccaggccccaggttatttaggatctctccttggtaccaagcgctgctgggcactggggccacagagaggagctgagctgatccctgccttcaaatagctcccagttggttgtcagggggtgatgggggtggagggggggtgtggagcgagacagacaggaaaaccagccatcaacctagtgtgataagtgctgcactgcatagagagaaggaagtactgcactgcatagcgagaaggatgcccaaggagctgcagggctccatggagagagcaactgactgcctgcagtgtcctggatggcttccctataggaaggacgtggagctactacatcttccaggtagagaaggggatgtgcattcctattgagggaacaacctccacagtggtcgggagacagaaaagaccaggtgttgagaaaagggtgagctccatgtggca

SEQ ID NO: 3353 - DNA, 1026 bp, Homo sapiens
cctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactgggtgagctattgtttgtttgcttctttgggcctgggtttcctcatctaatctgcaaaccaagaatgcagactagtcctaccactcccggaagactgacgttgtgccaggtattatgcaaaggcttcatgtaaccctcgacttcacgtaaccctcacacagcaccctgtggagtcagaactgtccttcacttttataggtgaggaaaccagactcagagaggtgaagtggcattcctgaggtcatgcataagaggcagtcaggactgaaacacagtctctaacacttatccgtccccttgatcttgttgctgaagtgatttaattacttgcgtagctctgcacacaggaagggctgctctgaataagagctct

SEQ ID NO: 3354 - DNA, 1001 bp, Homo sapiens
tgttctctcttgtttcctctctatttcagcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattct

SEQ ID NO: 3355 - DNA, 1039 bp, Homo sapiens
tggaataagaaaaccttgctaacagtcccagcctttcattgctgtcttcctgttctcagatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgtaaagacttggttatgtttatctaatgttgggtccaagaaggaatttctttccatccctgtgaggcaatgggtgggaatgataggacaggcaaagagaagcttcctcaggctagcaaaaatatcatttgatgtattgattaaaaaagcacttgcttgatgtatctttggcgtgtgtgctactctcatctgtgtgtatgtgtgttgtgtgtgtgtgtgtgtgcatgcacatatgtgttcactctgctactttgtaagttttaggctaggttgctttaccagctgtttacttcttttttgttgttgttttgagacaaggtttcgctctgccaccctggctggagtgcagtggcgtgatcttggctcacggcaacctctgcctcctggggctcaagcaattatcccacctcagcctcctgagcagctgggactacaggtgcatgccacaacacctggctgatatttgtattttttgtagagacaggattttgccaagttgcccaggctggtcttgaactcctaggcttaagcaatccacccaccttggcctcctgaagtgccaggatcacagacgtgagccactacacccagcccagctgtttacttctttaaccatacttttgattttattttttgaccaaaatgaactaacccaggtaatcttccagggaccgcaattccagaacctcatagtatttcttccatttccagcagctgattagaagtccaggatcatgtgaagtcaggcagggtcacagttcctgatggcacattatggacagaga

SEQ ID NO: 3356 - DNA, 1028 bp, Homo sapiens
cctgtttatgatccacatgatgtggtggagatttctaactgaggttgggtgggagagaacagagagattctgaagaacaaacagcaggattgctgtaaagggtgaaagagagaagattcattccctccatttggaagtaggtggttagtgtgacttcctcacagagagaaggacccccgtcctcacagagcatgtcactgctgaaggtgtttttccaagtttacccaacagatgagtggcagggttagccctggaagcctgctttctgcctcgtagtccaaaatgttgatggttagaagaaaatgaggcaggaaccagtcagtttaatatggatctttttcttttctgtttttttttgttgttgtcattgttgttgtttttgagacagagtctcactctgttgcccaggttggtcacagatgtcggctgtttgaagatgctggggaatgcaccccggacctcacacaggatctttttcaagtctgagatgatatggacccattgtaacaatcttctgaattagctctgacctcacttctagtaattttgagtcattgttctgtttcttgaatatgaatagttggtggttgtggtttttgtttttaacttattcaatattggctctctcaaatcctaattatcctaccagttggctctccggtattatcttaatacctggtaccatcccaattttgtggatgagaaaacaagtgtttaaagtgtcgcactgaatgttgggcgcagtggttcatgcctgtgatcccagcatttggtagggacctaaacaggaggattacttgaggccaggagtttcagaccagcttgagcaacatagcaagacctcgtctctactataaagcaaaaaaaaagttagccaggtgtggcagtgtgcacctgcggtggtggtcccagctacttgggagtctgaggtgggaggcctgcttgagctagggaggtcgaggctgcactgagccatgattaggccactggactccagcctgggtgacaaagcaaaaccctatctcaaa

SEQ ID NO: 3357 - DNA, 1042 bp, Homo sapiens
agtgtttaagtcatgagggctccaccaccataaatggattaatgcccattataaaagggctcaaggctgtgagttcaacctcttgctctctcttgccctctccaccaccttccaccatgaaattatgcagcaagaaggcctccactagatgcagctcctcagtcttggacttcccagcctccagagccatgagccaattttctgttcattataacttacacagactcaggtattctgttgcagcagcacaaaatggactaagacaccagttcagaatgattatggaatttattccatagggagaagtagacagagaagtaaacaaacattatttgagcacctgttgtgtggcagacatcatactgaatgtttacaaacacatgattgcatttaatctttagataaccctgtaagacaggcattattagccccattttacaggtgagaaaattgggattaaatcctttgtctaaggttacccagctagtgagtatcagaacggaaacttcactctggtctgtctgactatgccagtgagatgggctctgagaataaggcatgaagctcagaacaaagaatgccaacaccaggccaagagcaaacagcaggagacctgagcagtggctggaacccaggttcagacaccagataaattggcagaaagggcaccaacccaaagtcaccactgcaaactctttgaaggcatcagtgaaatggagaccctgaagtaactagaaaccagaaacaaaaaagcagccttaggactttgcaaggtcagagctacttgcaaattaaggatggaaatgaatcgtaacagtggccacaatctattgtgcatccactatgctctaggcactaacagctaagaaccctagagaggttactatcatgcagccttgtattaagatttatataactctgggccaggcgcagtggctcatgcttgtaatcccagcactttgggaggctgaggcaggtggatcacctgaggtcaggaagttgagaccatcctggccaacatggtgaaaccctgtctctacta

SEQ ID NO: 3358 - DNA, 1024 bp, Homo sapiens
ctcacctctgcagcctcatccctccctcctcatctgctactacactccaccctgcagttccacagacattccaggagtgaggcttcctcacttttgcatactgttgtttcttttccatggacctctcttccccctccatgccttcttcacctgaagaacttctattaataattttttaggtcctaccttagaagtcaactcctcctccaggaggccccaactacctcctcatctacgaaggctcaggtgctactctccaatttgcctcatagcatctgatactgttcccaatcacagcattcattgtgccgtgttccacacatctgttttcagtgtgtcatgtgacccataccctcaccactgcccccccgcccaactacacccacatcttcctgactccgcaccctgaagacagggtctgtgtctcattcacctctgaatccctgacttagcacagtgcttgacgctgagcttgtgtccaataaatatacgttgaatgcacgacttaacagaaactgatgaacatcttgatgcataaacttttctcattctgaagattatctcctttgaacagattcccagaagcttggaattattgaatcaaagtggatgaatattgaacactttcaattcccatagctaagtagctttccaaatggctgtagcaatttacactcccaccagcaagtgtaagagcaccaatctcactgcattcttgcagcttggctattctcattatgccttttatttttaaaatcaagacagggtctacctctgccacccaggctggagtccagtggcatgatcatagcttactgtaacctgtaactcctgggctcaagcgatcctcctgcctcagcctcctgaatagctggaactacaggtgcataccatctggctaattttttttttttttttttttgagacagagtcttgctctgtcaccaggctggagtacagtggtgtgatctcagctcactgcaacctccgcctcccaagttcaagtgattctcctgcctcagcc

SEQ ID NO: 3359 - DNA, 1010 bp, Homo sapiens
cagaatggtgagaataaaccaccacaggccattgtgaaaccccaaatcctgacgcatgttatcgaagggtttgtgatccaggagggggcggagcctttcccggtacggactacttcttttccccttttttttttaagtatattttggatgtgtcttagaatatttttacatttccatgtaaaatttctgaaaatgtgaacaatttgctctttccttgctaacttcctcccccaaagaatatagagccatttctttctaggattatctttccaaggtccagaagaggggggtcagtgatcaggaataattgacaagacccttggttagaagtttcccacacaaactcaggtgtgtccctgcctgttgatgtgtgaacccttggttaaaagggagttcactgtgggatatttggtgagagatgatgggttttgggaaattagatttcattgagttttgaatgccaaaacctctgaatggcaaaacttcggccagttaggaacaaaaggaattgcacagaacagaattctccagatacgtgtatcagaaatgaatgtgaggaaacagggtcacaacctgaagcttgttttctggggacagagccttgaaaggggagttaatgagattgaggggcactcagaaaggtcacgatggaagcctaagactaacaagaaatatccacgagccacgaagatgggttattgaccaaagcacccagagctgcttctgtgcagtgtgcactggagacagtggtgctgccctgtgggtgtggaggagcccagagccagcggcacaccagcctctgttctgatgaaaagtatctggctgttggagaagacacctttctgggataccatctgccttttcctcattctttggttccatgagtggtttgattagtctgcagaagacgcggagcttgattaactgagatgggtgaactgctcctgtaaaatgccaaaagacacatagcttcttgtcttctttcccactggaggttgtccaaggccagt

SEQ ID NO: 3360 - DNA, 1028 bp, Homo sapiens
gattcagggatcctgcttagtcatccaggaatcccaatttgggaatcactcatctagatcatcctgtgcttcccaacccaaatgctccagcccacatgtgatatctggcctctgcctcagaaggtcccagaatacagtttacatgtcttgtcctcttttcccaagtgccctcgtgctatccacggctaatcagcgcagccctccctccacctgtgtggcccacccggaaaagtctaaagcactgggttctagtgtgggttctgccactgcctgtgtccaagctcagcctagtccagtgtgttgtgcctgcattacattatttaatcctcaccacagctatatgtaagacagatataagtaccccatttcatagatgaggaaacaggcctagagtaacttgcccagcattacaggatgggatttaagcctagagtctttttttgtgaccttttgtgaccttgggcaaatcacctcacctctgaggccaagttgcttcatctaggacatttaagatgttaaactcagggcctttctaactttaatcctctgggatctagtgccccgtgatccaaaacaatcactacccaccccctcccccaccccatccctaaattgggaggaaagcaatctgtttatctgagtcgagtaattcacagtaaagtgtgaatgactgtaagatgtatacttgcattttaaagaaattgttaaccaaatgaatctctaattgatggactctgtcagggtcccagatagagctcagcctgcctgttcccctccctcctccccgcaactccctctcagtcactttcctacccttcacttaccccgccctgggggaaggtgtcaacaaacaggtgtttgtgaaatctcttgccttcctcactttcagtggcattaatttctttgggggcccaaatataaccaaagaaattgtaaagcgtggccccagatctttccatgaggactgggcactctgtcctcagcttaccgcactgcagtacggcctgttgcttggaccaggtatgtgc

SEQ ID NO: 3361 - DNA, 1043 bp, Homo sapiens
gtggttctgatttgcagctggaggagagagtcactgaaggtttaacatttaactttagtttaaagaccttttggtgcctatgataagtgcaaaaagttgactttttttttactttgaaaactggctttctgttgctgttcccctttttcctttacttttttttttcttttgctgctataaagacttgatggtgttcttggattatttggacatcagagttcacttgagtcaaaagatctgctttttaatcccagttttgccactttgtaactgtataagtttgagcaagttactcatcagtgtccttttctgtaaaatatggtttctgttatgtattccaaggctatgaggataaaagtgcctgactcaaaaattttctgaaatttattataggacaggagtggaaatagagttatccattgccctccccaacccccaggatacatgagattccttaactctgcctttctgaacaaaggcagattgacagttcttttctttggttctataatatggctctggatgtgaggctgtgaatgtcagaggttggagagctgtcaccacttcctttaatgattcgagtataattacctcttgtcttacaagtatgtaaaactccaaatcagtaggatagggattttgaattggttttccattcctgatggtgatgtgggctgatccatctcttcgttgtccccatgtaacccacaacacatctttgcaagactgctgggtagagtttattcttgccttcattggctctggattactgagcatcaagtcaataacaacaatgacagcaaaatcaacctaccttctgaagcctagcctgctcactctgaggagacaggcttggagactatctcctgagtccacttcatatggttctggtccacacagactgcactggtccctgagcacagaaagttggtgtgtgtggctcctgacaagatttacatcaaatgctcagtacttgttggaagaaaaaaaaaaaaaaaaaaacctcttgaaaaggtcttataagtgatgtggcttctctcatt

SEQ ID NO: 3362 - DNA, 1032 bp, Homo sapiens
tgtatttatccaacaaatgcattctattcaccaccatttgttgtgtacctgacagatgccaaggccagttagacacgctattaaccatgagagtgtagtatcacagaagtcaagagaagaaaaagttttgagctgcagaaattcgtcagcagtttgaaattgtacagaaagagtgggaaacattcattatacttagtaaacagaaggtcattggtaactttttgaaaatgatagcttcagtagagtggcgggggtggccatggggatatgaaaagccacatgagagagaactgtggcatgagatgccgataagaagtggagacagcatgcggatcaccttttgtatgtttggcaatgaaaggaagaaaagaaatagaaaagtgattagtgaaggcagcacagtcaagcggaagattaattttccctgtctgcttcattattttcgttgacctaaaatattattctttttatttcatatccttaatagcaagtcagcagttcatttcttaaacttactgctttgataactacctgaatgtttcactgaacagtaatagtgtagctgtcgtttattgagtgctcactatgtgctaggcatcgtgctaagctctttgtatacattctgttcattatcccatttaatcttcccagcaccagattataaccacacaacctcttggcagcacggaaagactaagtaaattgccagaggtcacatagctaatgagtggcacagatgggatttggatccagctcagactctaaagctttcctgaaggatcatgctatactgtctctgaagtcagggccagctttgtgggtatgcagcctgtgcagtctcccagggccctgtgtttagaggggccccatgcttggtttaatactctcttgttgctgtcttgaaattcttaatgatttttaacaagggggttctacattttcattttgcaccaggccccacaaattatatacccagttctgcctgaaggtatctgtactacctcctgagggtatctgtactacctcctgaag

SEQ ID NO: 3363 - DNA, 1047 bp, Homo sapiens
tccagctccattggttacaccctttgtgacctcgggccagtcactgaacctctctaagcctcagcttccatgtttataaaatgagactaacaatagaacttaccttacagagttactgttaaaaggacataacaggagaatgcaggtaaactatgtggcacattttaaatgctcgtagatgatggattatccttataatccagtatggtagagggttgtggatgataactcccttacaggccctgcttcctggaggtggcaccactgtggctgagtcttacaggaagagggtcagtgaactaagggaaggatgaagaagtggagaggaagggattccagacagaaagaggaaagactgagcaaagactggaggccaaggcccacatagagtggtggaaagctgcatgtgattcagtctctgggaatagtatcagaaggcaaggaaggctctacagcagacagacctgtatgaatattaaggatctgaacattgtcctgtagacaatggagagccactgaagggctcttagaagcaaggaggtgacacaattagacatttcaaaagatcactctggctgctgaagggagaatggattgcaaggatgcaagactggaggctgggagcccacttaggaaaacattgccttggtccagataagagatgatgagacgtgagctaggataatggccatgggaatgggatgtaggggagagactagggttgagtcacataggagtgaaatcagcaggagttaatattttattaaatgtgggggagtgggggtaggaggaagcaataaggcaaaggaatgtgcagaatgtccaagaagtcagcagtttttggaaagaaactcctgatggatttaggagttaagcgctactatatgctagttaaccctccaggagggtgtgagatcactcagggagaggcagtttcagtggggagggcagtggttagcgagggagtcttgggagagacccagggcaggcagaggaagaggcttacatggagggaccatcactgaggtcccaggagagctgggagta

SEQ ID NO: 3364 - DNA, 1060 bp, Homo sapiens
ttctgtcacccaggctggagtgcagtggcgccatctcggttcactgcaacctccgcctcctgggttcacccgattctcctgcctcagcctcccgagtagctgggattacaggcgcacaccaccacgcccggctaattttttgtgtatttttagtagagacggggtttcactatgttggccagactggtcttgaactcctgacctcgtgatccgcccgccttggcctcccaaagtgctgagattacaggcatgagccaccgtgcctggctcatatatgtcttcttttggaaagtgtctgttcatgtcctttgcccactttttaatggagttgtttatttttttcttgtaaatttgtttaagttccttacagatgctgaatattagacctttgtcagatgcatagtttgcagatattttctccccttctttaggttgtctgtttactctgttgatagtttcttttgctgtgcagaagctctaaaagacttaaatgtaaaaccaaaaactgtaaaaactctgggggacaacgtaggcaataccattctggattggcaaaagtttcatgatgaagatgccaaatgtccattgaatgatgagcccctgctggcatctagactggtctgagctgagccagggccatactgaccccatcactaatttgcttgagcagagggagctgatttgagctctcccttttgataggaacaactttcaaatcaccatcagtgctcatacaattcaaacgtgtagttgggggcatcaaaacacaaaaccctttcctttatatgtaaaatgagcaacacgtctgctgaagattgggaaagcaaagtgaaattgcagatgacctttgaatgccttaatttaaagaatgatctggattgatcttgccctggatctgctgccactgtcttcatgagtgaaccttctggattcccagtagatgtccagtctgaagctgtcagaggaatgagggggttgggctgctatggagaaacaagaggatgcatccaacagctggtgaccacatgtcatgccctccttgatgctggccctcatgctt

SEQ ID NO: 3365 - DNA, 1032 bp, Homo sapiens
gcctgacagagtcctcatctgggctcaaagtggaccgaggtaaatgtgtgggattgatgttatgcgggagagttgggaaatgcctttcgcaggagggtaggtaggggctccataaacctatagatctgattctgtagacgagagccagacaatgcccaggagtaaatgctaagctagagcctggactcttccctgcaagaatcactaagcaagagttagggatcaatttcacgaggttgtatgcatgtgtgtgcctgtgtgcattttactggaggcatttccatcacttttattaataacagtatttactcagaacttactatgtgccaggcactgctctaagcactgatgcatttacatatattaactcatttaattcacatcacaccctatgagatagagactattgttatcctcactttattcttgaagaaagtaaggcacagggagattgagtaatatgaccaagatcacacagccagtaactttgaggcaggcggatcacgaggtcagaagatcgagacatcctggctaacacggtgaaaccccgtctctactaaaaatacagaaaaaattagccaggtatggtcgcaggcacctgtagtcccagctactctggaggctgaggcaggagaatggagtgaaccccggaggcagagcttgcagtgagctgagatcgtgccactgcactccagcctgggcgacagagtgagactccttctcaaaataaaaaataaataaataaaaataaaaagtagaaccagtatttcagcccagatctttgtgaatccacatctattctttgaacctctagttttgttattaaaatctcagagacatgtgtgacccaataaaggctgagagcgttcacacaaagagaggaagcttaaaaagtagaaaagaaccttcactgggtcaaacccggagcgagggagcattaaagaagtcagcctggactccgggactgtggtattgtagccacattctgctgtccaggcttgtgtaagctatttcatttcttccttctgagtg

SEQ ID NO: 3366 - DNA, 1063 bp, Homo sapiens
acggacgttgatgaggccatgaatgaggtgggctagggacaggggaccgggagactcacagaagggagaagggtagccatttggatggaccttcgccttacttgcgctcccattcctggactgcgctctagtgactgtcagggctaattcttccgccttctcaggcctcctgtgtccttgttagtagttcttgaatttgggactacggcttctggcctcgttgggcctccgggccctcgcactggggcaggtttcccagcagcccagttgacctttaccggatgcttttggcagacgtcctccatgccgggctggaaatatgcgtcacagtgtttttcagacacttttgcctctttcattgtgataccctgcctggggacgactatgatggagtctttaggtttttgtaatcagcaaaggcatctgttatgctcctgccaccttttgggggagagtgggtggaggatgttgtgattttacactagggagtttgggctgtcattcattcgttcagcagaccttttttgggcactctgccaggcagggtaggagaggtgcctggatggatagggcataattgggccagacagacacggttcttagccttttggagcttaaagtgtcttgagaaacgcagacagggtaagccagcatcgtgcctgacacagagtaagtggttataagtgtcgaataaaggaatgaattgacttatttgggaatgattagaatgtgagcaggacggtagcgagagactttatgctgcatgtgagagatagttgtgaactcatgcgcgatatgttttaagacaggtttggaaatctgaacggacagttgctatttagggaagcatttacttatacagaggacttgctttaaaggtggaagtaaaatggagaagtattaggtttgggattcttcagaggtgcctcttttaactattactatgtctctgaatttcataaatccctgagtacaatctcagagtttgggaaaaggaaagctcttctaggtaatgaaatgccaggctgatgggaaaaaactgtaggaagctctccctaagtcc

SEQ ID NO: 3367 - DNA, 1088 bp, Homo sapiens
atatggaataatgaaatcaagtgaattgacatacccatcacctcaaatacttaagtgatcttaggacactttaatttccttgacttcttcccttcttatgtggacttattgcccagtattttagttctaccttttaacctgtcaaattagtctctattattattgttactttttatattattagctcttgattgtatgtactcacatctctaccttttttactcctcactttacctccttacatctcattgtttcctcctaaagtatattctttagtaattttttcagtgaatatctgttagtagcaaacttggactttaacaaaaaatatattttacccatactgtttgatacagtttagcttattgtgggaattctagcttaacatttattttctctaagtgttttgaagatattcttttgtcatctgtctgttgttgccgttaaggagtctgctatcatcctgattgtctttgtaggtagttttaatttctctcaggttgctgttgagatcttgctttgattttattgttctgcagttttgctatgatatattcatgtgtgtgctccataggtctgtggattcatgtttttcatcaattctggaaaattctctcatggtatagtttgcatagtatatcttttccccattcttttactttcaactgtttgtgtttcagatttaaggtatgtctcctgtagacagcatctaatggttttttttttttttttgctttatcttatcactatgccttttgaatgagtgtttttgtccattcatgttttattttatttatttaatttgtttttgaggaagggtcttgctctgtcattaagctacaaggtagtggtgtgaacatggctcactgcagccttgacctcccaggctcaatcaatcctcccacctcagttccccaagtagctggaactagagacacataccaccatgcctggctaatttttgtatttcttgtagagatggggcttcactatgttgcccaggctggtctcaaaacttctgagctcaagtgatccacccaccttggcctcccaaagttctgggattacaggcatgagccaccatgcca

SEQ ID NO: 3368 - DNA, 1042 bp, Homo sapiens
tcgttttactcaattggtcccctactgatgggcatttgttgccattattttactgttataaacaatgcttcagtgaatgctcttgttaacaaatgtttgcatacttgtaaatctgtagaataaattcctggcaacgaaactgctgtcaaagaatatctgtgtgccaatgtttaatgacagcaaattgccttcaagaacgctgcaccaggccaggcacggtggctcatgcctgtaatcccagcactttgggaggccgaggtgggtagattacgaggtcaggagttcaagaccagcctggccaagatggtgaaacctcatctctactaaaagtacaaaaaaattacccgggcacggtggtaggcacctgtaatcccagctactcgggaggctggggtcgcttgaacccaggaggcagaggttgcagtgagccaagatcgtgtcactgcactctaacccgggcgacagagcaagactccgtctcaaaataaacaaacaaacaacaacaatagcaaaaaaaacactgcaccaaattatacacatcaaaagcatgtaatcgtccctcaccagcactgggcattatcacctgccccttcttgagtctggacttctgttggtgccctagttcctctagatgtatctgaatatatctgcattctaattgtgagcatggtcaatttgtttctttttcctagaagacttctcagtttcctccatagctatttgaaacctgactgggtcaaactaagatatcataccagccaaatcttagctgtcttgcttgttgaagggattaaatgaaaacccaaatgcaaactggtaggtccttaataattaattccctccccttcattgggaattaggctggctcatgccatgcagcactgaccagcatctcagcccaaggccaggaggcagcctgggcccacatcatgaattcatttgctgtggtggaatgagtcgctcagccccaggggccatgcaaggttgggtctttgagaaataacctggcatccacactagagccagctgaatctcctgaggc

SEQ ID NO: 3369 - DNA, 1030 bp, Homo sapiens
tggactgtagggcttggttcagtgaaagcctctctatccatgcaagtatctgaattttcaaacacctttcacatttcattgtcagccgagataaattagagggaaaagatatctcaggcaaagagacttatttaataattaatggttattgatttattacaattttataaattaatttactaatttacaaataactttctgagctcttacatgtgcaggcactgtgctaggcctgttacaaactctggagaactgagttatccccatatacagatgcagatactgaggccctttggggtgggtgacagctcagatcccacagctagtgtggcacaggcaggaacgaagcccggggtcttttgatggtagctgaaccgcacccagacacccacccgtgtctgccagcactccgtattggctgggaaacactccctgaatccaaaggtgcctgtttagtcagttaccagccagtggtcctcaagtgtccccacctgtaagatgggggcgccctgccccagtactgcagcctcgcgaccccctggagggtgggggacggtagctcaggcgagagtcttccggctgccccggggagggaggaaatgagccggcggcaggggcgggttttcggcggggccaacccacggtggggggagcgcggccatggcgctcctgctttcggtgctgcgtgtactgctgggcggcttcttcgcgctcgtggggttggccaagctctcggaggagatctcggctccagtttcggagcggatggtgagcggcgcgggcgggcggcaggggatcgggcccgcggcggcgtgtgctccgccctgccgctcctcgcccccggcccggcaggccgccttcgggcttccgaggctcagctggagctgggggaaagcgcctggctttcgactgaggcgcaggtcctgcctggggagttcctcgagttctctggatcttccctagacggaaggggacagaacctccccttcctgcagaatattggtggccccaggcaaatctagagccttag

SEQ ID NO: 3370 - DNA, 1024 bp, Homo sapiens
tatatatacacacatatatacatgtgtgtataggcttcggtatgatccatggtttcaggcaaccactgggggtcttggaacatattcccggcagataagggggaacaactgtataagaaactgggaacagtggttgtgttcaaggttgagtctgggtggacggcagtcattcatgtgtatattactttaattgcaaaaaccacaattatttttgtaccaacgcaatacttctgtacattttgaattttgcactgagttcatgtattacttttgtttaaattaaatttaaatataacctccaatggcttcccatcacatttaaaatacaatcctaattttgtttttgactgagaccttccagatcctatacaatttagtttctgcctacctctccaaatgtatcattctccccttgcttactgtctttcagccttgttcttgttgatgttcctaaagcatgccaagctttctcccacttcagggtttttgcacctatagtctgcctgcctggactcttcagaccttagacctttgcatggcttactcttttgaataattcaaaaggtctctgctcagatgtttacttcagaattgcccctcctccatgccatcactctccattcctgtacgctgctttattttcttcatcgcacttatcactacctagaattatatattatttgttttacttgtttattttttgtgtcttcctctagaatgtaaggctcatatgagcagaactttgtcttgttttctgcggtatctccacggcttagaacagtgcctggcttgtagtaaacattcaggaaataaatattgagtgaatacacatgttttaagtacattcctccactctgttgtttgccctataactttgttttataaagacctttgtttacagaagttttttttttttttggattaaaaaactttactttttggccgggcacggtggcttacgcctgtagtcccagcactttgggaggccaaggtgggtggatcacgaggtcaggagattgagacc

SEQ ID NO: 3371 - DNA, 1030 bp, Homo sapiens
gatccgcccacctcggcctcctaaaatgctgggattacaggcgtgatcccacaattaccgtgcctggccacagtttttatattatcttgatttagggcatctatataaaacaaataattaaataaaatcagtattttaaggtaagaaccttacattttgtagtctcaactgactcatatatcctgttttcgtagtccctctttttatgattaatgttatcttttcattattttatagttttaagcctatcttgtctaacatttctttttcagatggccaagtgtgatggttgtaaacgacagggtaaactaagcgagtccataaagtggcgaggcaacattaaacatttctgtaacctattttgtgtcttggagttttgtcatcagcaaattatgaatgactgtcttccacaaaataaaggtaaaattaaacttagctaatgggatttttatgtcagtgctaggacactatcagcatatacagttataaataatataataaaaacaaaatttcattggattcaaatagcctgaatttccttaaatttttctttaagaagtctttaagatttccccttgagggaaaagtaattctaatactttttgctctgatagtcaagcacaccaaaaggccaataatgtatatgcactaatttttataggaaacttagatttgattgctttttgattgaatgtatctgtacataaataacttaaactagggatatatactatttagttaataaaccagaaataaaaacagaaaatcagggcaaacaaagggagagtatagttaatatagttgctgtgactagtgtaaaatttgtttcagagcttgcttataggcaaggagaaaagaacaacacgttaattatctcagaaaatataaaatggaacagttcttcatgggtagcaaagtttatcctagctaagaataaaataattttgcaagtaggacagctaatatggtcagaatatccaggtgagtagatagatccatgatatattcataaagtagctctcctaagtat

SEQ ID NO: 3372 - DNA, 1359 bp, Homo sapiens
caagcaatcctcccacctcagcatcctgagtaactgagaccatgggcatgagccagcatgccctgctaattaaaaaattttttttatagagatcgggtcttgctctgttgcccaggctggagtgcagtggcatgatcatggctcactggagtcttgaactccctgggctcaagcaatccttctgccttggccttccaaagtgctaggattatgggggtgagccactgcactccatcatttttgtggtatttaaattgggtaatttgagtaaagagaataatgcttggcacatagtaattactcaacacacttattgtagtatatattattgccattattatttactttgtggcctgcactagtgtttataattagtgactatttcctttagtttttatacttgtcagaagaatggcaatacttaacctctgttttaccagggtattgctatttgtgcttattgcaataattagctcttacaaattggctctaggagtctcacagaaccacccaattatttttgttcttcctgtctcgttcttgtttccatctgtcctctgatacaaagccttaacagcccttttgtcatatatcatgcttattttttgtcttctgttagctcatttgtttctcaaaatcttgcacttttaatttttaaacattcatttattgtcttggctggacacggtggcttatgcctgtaatcccaacactttgggaggctgacgcaggcggatcgcgaggtcaggaatttgagaccagcgtggccaatatggcgaaaccccgtctgtactaaaaatacaaaaattagcctggcatggtggcacgtgctggtgtcccagctactcgaaccggaggctgagacaggaggatcgcttgaacccaggaggtggagattgcagtgagccgagatcgtgacactgcactccagcctgggcagcagagcgagactccgtctcacaaaaaaaaaaaaaaaaaagaaagaaaaaattcatttattgtctcatttcagttctactttgggcagcctctggctaatgagagaaccagtgtcttgtggtctggagttgtgggatggacactggtcccattggctatagcagatgaaacttggttggggctggaagccttcctatttttgtcttcagcatctggctggccacatatatatatatatatatttttttttttttttttttttgagatggagtctagctctgttgccaaggctggggtgcagtggcacaatctcggctcactgcaacctccacctcccgggttcaagtgattctcctgcctcagcctcccgagtagctgggattacaggcgcccaccaccacgcccatctagtttttgtat

SEQ ID NO: 3373 - DNA, 1050 bp, Homo sapiens
tactatggaaagaaataacaaatgacatgtgggaattgcaggactatcctgtaattgtagacacccaccatttaaatttatttaacagttatcttgaaagctattgggtatagcataaaataatatcactcttttaatagtatacaaaagctatttaattctttaaaaagtaaaaactctacatggtcgcaaaaatgtgtttatttctaatgtccttgtggggtcattgttgctttacaataatgcttagatgcagagagaggaaaaaacagcaacaaagtcacataaatctttccctgacttagtacatttgaaggatttggcatattttgcctatttctgtggtagtgtaatttgaggaatacagtgtgttgttaatagtcactacaggcaaaaaacagtaagagcttgcttttaaattgtggctctgtcatttatctctgtgacttcgggctagatgtttaactttctaagcctccatttctcatcagtaaataatagttgcttcctaggactttaatgagacagtgttagcaaatggcctagcacatagcaagtacttaaaaaatggaatcctgttattattaataataaaaattatatcgtgcgattatttataattaacataaataaatataataaatatatgtgtatataatacatattactatgtatacttaacatatcacttgtaggcccctattttgtctttggctgtgtttatctgctttgtgtcttgacttaaactatttaaaagtagatcctgctatatggaaatttccaagtaaagaggagagaggatttttttttttctttgttgcccatggtagagtgatcacagctcactgcagccttgaactccccgggctcagatgatcctcccacctcagcctttcaaatagctgggaccacaggcgcataccaccatgcccgactaatttttgtatttttttgtagagatggttttgctatgttgcccaggctggtctcaaactcctgggctcaagcaattagcctgcctcagcctcctaaagtgctgggactattggt

SEQ ID NO: 3374 - DNA, 2211 bp, Homo sapiens
acatgggcttcatgaaaacaccattgttactaacttgggcttagatgggaatctaatgtgaatagttcaagttatgggacttgtctaaatgtgtctatactctaaacctgggggaaggtggtgtggaacattgacttgactacagtcgaatacatgttgggaatcattcccaatcataagacatcgtcgtttctgtaggatgactgcatatgttcagagtagctttttgaatttggttcccttagctttagggatgtgatgttatagtccaaaatgtttacaagaaaacctaagtcttcaaaagcacaacttttgttgcttaggactttgcatcaactgttgttccagacctcacttcaacttcttggtctctgaactggttttagctagcatgcatgagagacagttttcatgtataatgtttctgctctgtaactggaaagtggtttactttgcataaatgctgatgaaaacttcatgactatgagacttttcttctgtgtatcaagaaaaagcttgctcgttggcaagcaattcacaaggtggggacagacttgtactttaacatgtagtccattcaagcaaacaactttggactctactgatagatgaaagagcaaatgatgactagtttagcctctgcatatcaacaatataatgcagatcaagtataatgctcaatattagtgacatgagtatcactaaattacatagaaccctgatggggtttcctgtgtcgtaatccattaaatcggtggccagtgcttgctgccgtggtttagtgattgggtgttagaaataaaaactcaggtctatttcttaccagtcagtaacaatttttagagaatgtacttggtatataatatatggacttcaggaactttattggggtggggggttaattttgccttaccctgttcactttcagatgattaggcttttgcactttagaatgagaaacttgtgacgttagtgtgttcttactagctttaatttgtatgtagcaatgaattgtgaatcttagtgcagtgggtttttttaaaaaactcaaaaagctgggaattaagtggtttcagtaataatgctataccgaggtgcttgcattgtatttcataattttgttacaaaccaaaattatttttaatgagaacagtcttgggttcagaggtgtgatgccagaatgtattttcgtactgttaggcccttggaacagataccggtgctttctgaaagatgaaagaaatgcaatgggtgctcttcatgcaaggttgcaaacctaccaagaatgcataatagtctcacttttccccaataaagagatgcgtgtgactagttttggacttttaaccttaatgggggttgcatgtctcctattgttaatcattgtcagctgcagtgacatgatccacagtcctgcatttactgcctttcacttaatgattttggacaggttttagagagccaggatgttggtctgggcctttatttggttttggctttagctgataatgttttagtgatgtcagctagtgcagttctcaaatggctgcctattagggaaagaattcagaggatttgactgctcctaatcatctgtcattgctgctagataatgattggcaatttttaagactcaactggaaatctcaacagttgctggtaaaccattaaccataaaaacgttgcttttgaacaccagtgctgaaaaaaatatttttttttttttttttgagagtgaaaagggcttggacttaagataggacaatgtggagaatggggggaagaatgcaaaacgatatagtatcccttatggatggtacatgtgcaacagggaactcttacttcatataccctttgcagtaatcattcagggaggaagaaaaacctggaacttgaatgaaggctgatctttgttttgtgcactgtggccctgccaggcatatagtgaaggtgaatgtcttctccctcagaaaaaaattggttccttgctgtcccagtaaggcatagcttttccagccctaactttaaaactcagtgaggacttagatgggaaagaatgaggtaaatacaaaggattgcaggacaacaactacagcgttgtgtactgtgggaaggggagttgggcactcttggaggactcctgctgaaggtggtcagcctgcctgacaatggaagacatacttgaatggggagcagggtatgtgctttcat

SEQ ID NO: 3375 - DNA, 6140 bp, Homo sapiens
ctaacttagttttcagaatattgatttcaaaaataattcacatgatgaacttttgaactttaccatgttttttatttaactcttgaaaatttctcagttcttaagaatgcttgctgtgggtatagtgcaggtatattgaaaggaatttttttcttgcagcgggaaagagacatgcgaatgggtggcggaggagcaatgaacatgggaggtaagtgtgaaatttaaattaatgatataagtagagagtagtatcctggtggagttgtaaccactatttttgttttctagatccctatggttcaggaggccagaaatttccacctctaggaggtggtggtggcataggttatgaagctaatcctggcgttccaccagcaaccatgagtggttccatgatgggaagtgacatggtaatgtatcctgtgggacgtagtaccaaggaaattctcattttcacaacttaggtgtgtttgttttgttttgttttgtttttttaagtaggtgactggacctcttttagtttcccctaccaatttcatacataaatatgtaatattgaggaatactttggcaacatagaagaactcggtgtgtggtaacctaaacagataacggttgccaacaaggagtcaatgctgttagtattatgtggaattacctttggcaataagtagatttaggtgcttttgaactctagtgcatggcaaatccaaattctagatgctagataatgtatctgattattctacatccaagtgagaataatcaaatggcaaactcattctttaagctggtatttgccataagtaggaatcagacttgtagtttgaagctttaggcacgttttagtgatgtgtaggactttgacctatatttggtgtggcttctatcctatgaaaagggaattgagtgttttgactcgtcgtttcccacctgttgggcctgtctgtaggtataccttctaaaatcaactgacatctccattttgctacagagtagcaaaaatcaacaatttttaagcatactaatggtgtgcatttgatctgaaccttcttgatgctatcatgtttcagctgtgaatatagcctgtcagatgcttagaacaatcagttgaactggtatgagtggctgcattagggctttacaaatcgttaggactgaattttggtgggtttagagagtgcatttttatagctgagttgaatgtgatgagttcactacaggcttttggcaaaggaggggagctgcagtgagtagctcataagattcattttataaatagaaacataaggattttgtataaggcctcacctgtttataatctacctaagactttttgggaattaaagttagaattataaatggctggttgggtaaaatgtaatactatgggctttctttagatttttcagagtatgtgggtaacattttggtttatattcttcctaaagacagattgttaggtaatgtgtaaaatctaatttgaccttatgttctcacaattaaaggtttatattctagataacaggtagctgatagctcctgggttctcagctggtgtaattaacataattatgaaagccccaactttttcttttttttaagttcttagaggtagaacacagaacaatgagccaaaaaccctgtaatttataagattttgaaaaacaaaggataaaagtttagtcatgttgagtagctcaatagtattttgtttaaaagaatgttgaaattgtgtataggaacagttaaaccctgatgcccttttagttttttatttggagtaatactcttagtaactggtctattataaatggaatgagaaaaagtgtaggctgctgtgtttgcatacctgaggggtctgctatttaggcacatatgtttctattgaaaacttctatctccagaattacctaaaactagatgggaatagtgaagtcactcactgctttattgcagttactttagcttcgtgtttcactgttcgggaagtgtctaaaacatggaattacagcaaagtgtctgcacttttcaaagacctaagggaaaagatggactgatgaaggtgggtggggtttgttcatttagtttgcaacaatatagaatagtactgagaacgtaattgtctctggttatatagtgatggctcggaaggtagtgtgcctgtgagaatttggcaacataagtttttttgatcaagttactgtgccggttaagtgactaaatctatagtcttatgctttttctttttgtagtctggtagcattttattaaaactttcaaccttttaagatttctgcaacttagcagatgtgtcttaagatcttgaaaagcacaaggtttcttaagcagcacatgccactaactggtgagtaggtctttgtcacttcattgagtgaattgaatctctggttgggcttgttaggcttacttggaaattaaatttccgttcagacgttgaaagtgagagtttgcaagtttttcagtgggttaatctgatgtgaaatttcttagaactcattttggaatggattttcacatctgcactaattcttaaattttttagcactacagggaagatctgttctttgaaacaggtgtatgagaatggctcaagtgggaacataccacaaggcatgtattaccgtaaactaattttcaaattacccttttttcctttctatgttcccggtacctgtggatcgactcattggtgattgtatcgacgaacgttgactacggaaccttctaaaatatttacttaacacacatggacatcaactacttataatgaactgttaattactgttccaatagcgtactgagcgctttgggcagggaggtgcggggcctgtgggtggacagggtcctagaggaatggggcctggaactccagcaggatatggtagagggagagaagagtacgaaggcccaaacaaaaaaccccgattttagatgtgatatttaggctttcattccagtttgttttgtttttttgtttagataccaatcttttaaattcttgcattttagtaagaaagctatctttttatggatgttagcagtttattgacctaatatttgtaaatggtctgtttgggcaggtaaaattatgtaatgcagtgtttggaacaggagaatttttttttcctttttatttctttattttttcttttttactgtataatgtccctcaagtttatggcagtgtaccttgtgccactgaatttccaaagtgtaccaatttttttttttttactgtgcttcaaataaatagaaaaatagttataatattgatcttcaactttgccattcatgcttctatgcatattaggctacgtattccacattgaaagcatgagagtgtctaggcctttgaatggcatatgccatttctgggaaatgcatctggaggctaagtattgctttctacaaataattgccccctttgttttaaaaagaagaaatgcatattgaagtagtttgatgatttgtttggcatataggaagcacgctggtgctaagtattttttaaatggttatgtaagcaaagctgaactgtaaatcttcaggaatatgtattaagattgtggaatgggtgtaagacaattggtagggggtgaaagtgggtttgattaaatggatcttttatggccctatgatctatcctttacttgaaagcttttgaaaagtggaaaggtcattttgttgcatttccccatttcttgtttttaaaagaccaacaaatctcaagccctataaatggcttgtattgaacttttacatttgaattaaagatgttaaacatgaagtcttttcatgtattcaagtgatttataaagatggggtgtagtctaaaaaacaaaacttgaaagtaagaaggtttagtaactgggccgggcgcggtggctcacgcctgtaatcccagcactttgggaggctgaggtgggcaaatcatgagatcaggagttcaagaccagcctggccaacatggtgaaaccccgtctctactaaaaatacaaaaaattagctgggcgtggtggcaggcgcctgtaatcccagctactcgggaggctgagccaggagaattgcttgaacctggagatggaggttgcagtgagctgagactgccactgcactccagcctggacaacagagcgagactctgtctcaaaaaaaaaaaaaggtttagtactgaagtaggtttagttatatatacatttgtactctgtaacttttacatctccttgtgctacttctgttgggcaaaatctataggactataaaaatctattggttctcttctaagagctagtggtgattgttaacaaatagggttgcagataatcattcttattgtaaatttaacttgttttcacatagtttcgttttcatgtagcactaaatctggagaaagttgctcatgctacacagtacaaatatcccttcctcccaccataaaggcttggaatgtttccatggtgttgtcagttaattgtcaacttcattgaacccccttccattagaacaagagactttgactattaaagtagattgtttattgttgcctgttagtataatgggagcctgatttcccagtgtaaatatgttagaggaacagcttcctaacagtaggtaaagtaattgaatggtttggctttgttctgagttacgttccattcaaatctgtacattgtagaattcttactatggaatgtgtcttcctccttttcacctcttttcttggtgctaattggcaaaagaaaaattctaagtcaaacctttattaacatgctgaagtttagtattgtgcctgtgtacaaaaggagacctattgttggaacaatctgagcactttctgcataggaaacaggataatgctgaaagtaaacactagtgtataaaagcatctcaccaaatactggttgtatgactgacaggtacatggtgtgctaagggagagaatctcattagaaagtaatgctcattatatcattcaccagcacactcggaaatatgagtagttttaccatgattatatcagtgaggaagttttgtccccaaacaggttattaattggtgatacataagagattttctgtacggaaacaagggtcttgattagaaaggaatccattacagtttggttgaattatatagtagggactctactaaagacaagaaaataaggggtgttccatgggacacccacagagggtgaactttgaatgtgtgtgggtgggggctggtcgggaaatgggaaaatctgcctataaaattaatgtttcagtttatttttcagattacatgcctttctttataagggatgctggcacagaccccctaaaataagcttttggtagtactgtacctttgaagagtggtgaaggatgctaatggataatctcctgaaagttgtggcttttgatacccttactgtggactgtagagttgctaaacgttgtttagcaaataatgttgcttagtttcaaatgacatttgactttcatcactaaaacagcaatgtactcagggttgtaagcttactcaaatagactttcaataagtcttcaatgtatatatgatagtttttagcctaatgtgaatttaaataatcttaatagtttcctaaaagtcgatctgaaacttggggtgggaaaggggaggtagcaatttttgaagtattttagccatttttttcatttaaagaaaccacttgtccccatttcctcttctccactttctcataattttgttttaagaggaacactggttgttttttatacttctcctaatctttaaaaactgcatattgttaagaccccagtgtatttaataggtattttataagcatagcccattggctcatgttagtgaaaccataatcctctttgcttagaacattaaactcataagaagtactacaaaccccaccactctttatagatgtattgtaccactaatataaacagctaaaaaatggggaaattgtaatgttacgcctgtgcaatttttaagtggcatattatggcagattaaaatttagatacttggcttttcttgggcaagccactaagttgtggcggaatgttttctggtgttcttggactgcaattatgcactattaaagtagtggcctg

SEQ ID NO: 3376 - DNA, 2007 bp, Homo sapiens
ctccagtgcctgcattcttttactgagtgttctgagtatttttgctgtgaagatatttatagatgaatcaggaaaatttttgccttttgtactctttacaagaaatagaacaggaaaaagatcagtactagggcaagtattttctggtatgcattcacaaatcggttcatgttaaaattttgtgtattgttagggagagagaaacccctcctcgttttgcccagcatggcacgtttgagtacgaatattctcagcgatggaagtctttggatgaaatggaaaaacagcaaagggaacaagttgaaaaaaacatgaaagatgcaaaagacaaattggaaagtgaaatggaagatgcctatcatgaacatcaggcaaatcttttgcgccaaggtaaaaagacctgtgcgtgaacatcattgctaaggtcaattgtttttcaccttattagaaccttgttaatgtgaatccaaatattttccaatgttcagatctgatgagacgacaggaagaattaagacgcatggaagaacttcacaatcaagaaatgcagaaacgtaaagaaatgcaattgaggtaaaattgtgtttaaggtttaagccttcatttatttttttctttgaaacgtatcattctgttgcccgggctggagtgcagtggtgcagtctcagctcaccacaacctccgcttcctgggttcaagcgattctcttgcctcagcctcccgatcagctgggattacaggcatgcgccacgacacctggctaattcttcctgtatttgtagtagataacggggtttcgccatgttggccaggctggccttgaactcctgagctcaagtgatccacctgtctctgcctcccaaagtgctaggattacaggcatgagccgccacgcttggccattttttttcttccttttttgagatgggcccaggctgaagtgcagtggcatgatcatagctcactgcagtctcaaactcctcagctctagcagtcctcctgagtagctgggactagaggcacaggccaccacccccagctaattttttaattttttttgtatttgtggagatggagtcttcctatattgcctaggctggtgtcaaactcctggcctcctaaagtactgagattacaggcatgaactaccaaccctggccttaatccttgacttatgcactaacatttatattctgacatttagggaaaagatgtacttagtttttcaggtcagtcaggcaaaatacaaaggttaaatatgtcagtgttggtttaacacttaaaatcgaatacagtgtaagattatccttaataaagcctacattatttgccagaatgtctttagtactatgcccctaggctcactctaagcctttgtgttttttagtgctaacctagttcttaggtcaactgctaggtttcttcacattgaattctaaaagatgtggataacacttcagttatgtacctgatgggtatttctaggcaagaggaggaacgacgtagaagagaggaagagatgatgattcgtcaacgtgagatggaagaacaaatgaggcgccaaagagaggaaagttacagccgaatgggctacatggatccagtaagtcagcctttactgccttccaattggagttgtctatagaacttgcaggtacctagaaggaattacaggaaattttaatatcaaattacagttattttctgctttttttctaacaaagtatattatgtttgatttccttgtatgggtcagaggatttaattgaataggaagtttttttgtgttttgtttcttggtttttttgttttgttttgtttttttgtttgtttggttttttttttggagagagttttgctcttgtcacccaggctggagtgcagtggcttgatcttggctcactgcagcatctgccttctgggttcaagtgattctcctgcctcagcctcttgagtaggtgggattacaagtgcctgccatcaggctcggctaatttttgtattttt

SEQ ID NO: 3377 - DNA, 1026 bp, Homo sapiens
gccgccgcatcgaggcggcggggagccccgcgggggccgccagcaccacccgccctaccaccagcagcatcaccaggggcccccgcccggcgggcccggcggccgcagcgaggagaagatctcggactcggaggtgagtgtctatgggagcgacgcgtcggctcccctaagatggcggcggccccctcctcgcccccgcccccgcgctgggcttccattttgtcggctgccggaaggggcgcttgcgcgcgccgctgcgggggcggggcggcctgcggggccgtcggtcggcgggggattggccgccgccgggccttgctctcccggcgggcggaaggctaggggaggtttcctttcggaaggaagcgcggggccgcggtggtcggccctgcagaaggtatcctgtccctgggactggcgtaatgcagagcatgcggcgtaggtttggagagaaccgggaagttccataaaagcgcaggcgcagatcgtgtaggttacagtggcatttggatttgtgttattttcctattttaattttcatactatttagatttttttagggacactcaacatatgtgggtgacagttgctgatggacgtctactctttggggaagtgtgtctattctcgaacattctggatgatggggctcctttttcaatgttaagatagtgctcatgttagaaatctcacatagtaaaaccttgattttgaccaaacggaacagaaaggcaactgataggtttcagataagcaaatactatcttggggattttcacttgcagaggtctctggtgtttgaaaacttctttcctttttcattaggggtttaaagccaatttgtctctcttgaggaggcctggagagaaaacttacacacagcgatgtcggttgtttgttgggaatctacctgctgatatcacggaggatgaattcaaaagactatttgctaaatatggagaaccaggagaagtttttatcaacaaaggcaaaggattcggatttattaagcttgtgagtgtaatt

SEQ ID NO: 3378 - DNA, 1032 bp, Homo sapiens
ctaataccatatgagtatcattattattattattattattttttgagacagagtctcactctgtcatcgagctagagtgcagtggcgcgatctgggctcactgcaagctccgcctcccgggttcacaccattcttctgcctcagcctcccgagtagctggaactacaggcacccgccaccatgcccggctaactttttgtatttttagtacagactgggtttcactgtgttagccaggagggtcttgatcccctgaccttgtgatccgcctgcctcggcctcccaaagtgctgggattacaggcgtgagccaccgcgcccggccattatcttttttttaaaaaaaaaaagttaaatcatatatcaacattttaaatgggatatttcacctacaagttcagtgctctgacttgtttcaaaaaaaaaaaaaaaaaaaaactagactataatggggctagtatcttgcaaatatcaaacagatttcttttaactttcttaagtcatcttctgtcatagactcttgcttgaaatgtagccttgagacttattttcccaatcaggagagaacagaatggagagaaaaagaatttgctaaattttcttagttccatttaatctatgaagctcagcacataataatttcatagagtttttacatactccacaggaaatgccttccacccaaatatccttccatccaggacagctaagccatgaggctgcatatagggaaataaaagaaaagtctgactcttttaataaaagggtagagagaagaagaacaaagagaaaagtaagagaggcatcattgagagacatgtgctcctgtcttcccattccagctcttcaaggcagagaggattcttactctgctcctgtttaagattccaagtagagatgacttgcagactatgcccataccaacaagcagacagccacatatgagcaaaagtcatgccctgatgtagttgggaaaaaagagcaggtctgcatttagctcctcagagtgtctctcagccagagatgaatccag

SEQ ID NO: 3379 - DNA, 1031 bp, Homo sapiens
aataagggcccacacccagagaaggggcattttagtgggtttctacaaacatttcaagacacttggggtctgataggctccacagattttctgtgtgcataattagtttgtggaatatcatcccctttaccttagtttacccacatccagacccaccgctgagaaggcttgatccagaaaatgaaagggacacattactgttaacagcagtgaaggtcattttccctgatgtgaggggcccatggcaaaagcttctgtccttcacatgattggcttggcagtgaaaatcaaaatcaatcaagaccacttcactatcttttttaaaaagttgagtatttttattgggtcttcaaatctgggtcccacagtcctcatttgatgtcactcttagctctgtactgatctctcctctgacttttacggagggcttgccaaagtagcctattgcagccaaagtttcactccaaagctacctctctaaggtctaaggttactatggtaaagttttatacaacagttttccttaaaaatattccacgatttgttactcccaaacaaaataagattatgcaccactcggagaaattagtcattctgaagatgtctaagaactatatcactgccaaagaacatttctcagttcatattctttccttcaattttcatttgcacatccacactgtggggttcacaagtcatctgttttccatgatcttatggtcaagtcaagaggacttagacttatacatcattttccaacagctggatgcattcacagtttggtgcataccaatatgtatgaaaataagaacctcacttccgttttaatctgataattcaacatcagagtcttcagatttggctttggcaagttcttcatgtacctccctcaccatgagaatacgtgttaacatggtgtccagggttccagggtctatcgggaatgtggagtaccacatggggctattcgggacacaggagcgctcaggttgaaggtaaaacacatcattcctttgcttcacactttcaga

SEQ ID NO: 3380 - DNA, 1007 bp, Homo sapiens
ctgaggcaggaggactgcttgagcccaggagttatagaggctgcagtgagccatgattatgccactgagctccagcctaggtgacagagcaacaccttgtctcaaaaaaaaaaaattctcagggacacaaggcttcagtaactttttcacaaaagggcccatttagaacatattcttgcaagaagtggtcaaatatagaaaaattaatctagacatgggaagagagatgggaagtgatggtgagcaaatacgctggcaaagtttgtagtctgaaacaggactaacaaaaaggaaaaaaaacctgtaagtatataataaaataatttacatagtaagtaagagtgggcaagaccaaaggaacataaaagtctaacaaagtcttactaggagaagatttagatggtaagttaaagaaaccaacaggggtaaacaaacatgattagtattaagagtaatatgttggtctgagtgttgtgggttattgttaagctgatttaccattgtctccccccacaaccacgcttgactagctttgcattttggcctggcgcagtggctcaggcttgtaatcccagcactttgaaaggatgaggcaggtgggtcacgatgtcaggagtttgagaccagtgtgaccaatatggtgaaaccccgtctctactaaaaatacaaaaattatccgggcatggtggcatgcgcctgtagtcccagctacttggcaggctgaggcaagagaatcgtttgaacccgggaggcggaggttgcagtgagctgagaccgcaccattgcactccagcctggtggacagagcgagactcttgtctcaaattaaaaaaaaagtaatatcaataaaagtagaaagtattactttcttaaacaagtagaagaaaatttgttactcagtgggaagcaaggggataaaccgaaaagttcagtaaacagaaattgtgaaaaaaaaaaaaaacccacaaaactaaacagcagaaataagttctattagccgtaattaa

SEQ ID NO: 3381 - DNA, 1029 bp, Homo sapiens
tttcctttgaaattcattcgggcttcttgtcatacattcgttcctcagagaggtatttggcaccttccacgtggaaggactgggctgggtccttagtcagcattagagagttctgacccacctaaggcatgcacgggcagctttgctcaccctgagactctcctgagggcagaggcacactccttcagtgagtggcagccactgcagtgatttggaacctgggaaacatggctgggcgggagcagggcaaggtgggggagtgagcgtgagggccaggggtacagacccggatcacatctgtaaggtgtgttttctttaatgcaccacactgtagcctcaccagcatagcccgcgagtttttaattctgccttctttctagttgggattcatgagtgtgcatgtttccacacatgcactttaggctagccaggctcaggcgtcctgtgttttttcatttgagtcttcctattgagtcttctaagatggaatggttacatttattttatgttttcattattaataatattatttctgtgtatactgtgtgccataatatttttataggtaatatcatttttaagacacataaccttttcccattttacagataaaaaaacttaggctcaggaaaggtacatcactgtctgaggaccagttgatagtgacagagctgagattcaactttcagtataacctcttataaaacttagaactaaaggaatttttaaaaattcccaccagtctaagacaaccaccattaccaactttgttagtgtaatgcctgtctcctcccacacccttcaagcagaggattttgttttctttacgtttttaaccaatctgtccttcattgcccctgtgggatggtgagtccgtgccaaggtggtcatagctcccttgcccttctccagaattgctgaggaacatttgaggaacaaatcacagttgccacctttcctggctgagaagtgaggagaggacacccctctcagtaggtgccccaccaaaatagggccctgcatgcacat

SEQ ID NO: 3382 - DNA, 1034 bp, Homo sapiens
ttgagatggtaagaaactgaaactatgcatgtaattagcatgattttagttgaaactcactggttttcagatttgcttagttggagttgcctttttcattcatggaaccaaagttccttccaatcatagcaaggtaagtaactgggaggcctgactgaggagcttttacccagccatcacttgcctaacgagattctcatcagccgcctcctggagacactcacagaatgcactccacaccctggtctgggcttcttaacattttactcttcagagtagtgtcatccagtgagtgacatgagaggattttgggtctttgcccttaattgtggctgtatggtgcaagaggtttcagacctatcctctcaccagtatttgcttggtttttggttttgttttgttttgttttgttttgattttttgagaccggttaaggtcctttaccctgactgtcttggcaccagcgatggtttttgggagaggcagtcacagctttagcagaggaccctctaacaaggttaagcgtttgatgttgatggtgctggcaagaagaggaggctaggaggatgatagtaggccaggagggaagagagggaacaggaagaagcccttgtgatagagagtggtagaaagggctcacgttgtactgttttattttacagttttgaataggtgaaagttaaataaatatgcaaatgtatacagtgaaaagaatcatactatccgtgtgtcctaagtgtccggttttcctccagacagtcaatggtgttattattttatgaatccttttagagatattttatacatatataagaaaatatatatatagtccttctgtcttgtgtttacacaaatgaaagcacattatatgtgctgttatgtgtgatgcttgtttttgtatgttggagaatttttcttttttttttgagacagagtttcgctcttcttgcccaggctggagtgcaatggcacaatcttggctcactgcaacctccacctcctgggttcaagcaattctcctgcctcagccacct

SEQ ID NO: 3383 - DNA, 1121 bp, Homo sapiens
tttaaaggaaaatgagatgacagttacttaacaaatagggaagtggctctaaccacatttggtcaatattgtagtagaggtcctagccaattataatgcaagaaaaagaaatgaaagaaatagagattggaaatgaagaagcaaaactgcctttattcacagatgattggattatttctagaaaattctaaagaatctgcataaaagccactggaactattaagtaaagttagcaagattgcaggatataagggcaatacacagaaatcacttgtgtttctatattagcaatgaataattgggaattgaagttttattatttatttattttagagataggggtcccactatgttgcctaggctggccttgaacttctgggttcaagcaatcctccttcagcctctcaagtagctggaactccaggtgtgcaccaccatacctagcttgaagttttaaaaaatgtgtaacacccaaagacatgaaacacttaggcataaacttaacaaaatatgtgcaaaaactgtatactgaaaactacaaaactctgctgagaggaatatgagaaataagtaatgatgtcctcccctccccgcattcatgtccatctggaacctcagcatgtgaccttatttgggaatagggtcttggcagatgtaattagttgagaatctccaggtgaaatcatcctgtatttagggtgggcccttaatataatgactggtgtctttatacgagagaaaggaaagggagctttggatccatctacacagacacggaagaaggccacgtgaagagtagagttaggttgccgcaagccaaggaatgctaagagcctccaggagctagaagaggcaaagaaagattctcctctagggccttcagaggcagtatggccctgccaacaccttgatttcagacttctggcctccagaactgtgagagaatgaatttctattgttttaagccacaaagtttatagtaattcattatggcagctctaggaaacaaatataaccatgttatacagattgggatctagaatgatcaaaatgattttgaaaaagaacaatagagttggaggacttaaactatctagctagaagacttactgtatagccac

SEQ ID NO: 3384 - DNA, 1058 bp, Homo sapiens
tttgaaagacagaatctacacaaggtgaacttcgtaagtttgctgctttttaaaattgaatgcattctccaaccatggggaaccaggtggcagatatatgaagtcttatggacttgaggtgtcagtggacgtaatcttaaggctgaaaagttagggaggaatccccagaaacaaagacagtacaatgagaacaggccccaaatctgagtaaaatctctggccaaattcttggtcaattatcagttacacaggcagacctgtagtggccaggctgggcgtggtgccttacgccagcactttgggaggccaaggcaggtggatcacttgaggccaggagttagagaccagcctggccaacatggcgaaaccccgtctctactaaaaatacaaaaattagctcggtgtggtggtgcatgcctttaattccagctactagggaggctgaggcacgagaatcacttgaagccaggaggcagaggttgcagtgagctgagaagatcacactgttgtactccagcctgagcaacagagcaagactgtcttaaaaaaaaaaaaaagttgtgagaactacacagagatatcagttgttgaacactgtaaggagcaaagtctacagttcagtccagggaggttatttgtctactaggaaaacctcccccagtaatcccaaggaaaatatagtagaatccagagtcactacatgtatcagaatgtccaacgttaaaccaaaaattaccagacatgcacaggaacaggaaagggtgatccatacgcagggaaaaaaaggcagtcaatagaaggtggctccaagttgactcagatgttggagatagtagtcagacttcaaagtagctatcatatgtatgttcagataattaaaggaaaatgtttgttttgtttttgtttttttgggtctcattctgttgcccaggctggagtgcagtagtgctatcttggcttactgcagcctcaaactcgtgggctcaagcgatcctgccaacccagcttcctatgtagctaggcctacaggggtgtgccaccactcccagctaattata

SEQ ID NO: 3385 - DNA, 1038 bp, Homo sapiens
cagacatgattatccatatcttcagtgttttgattctattgcatattttttctatgtaattctaacatatattttatgttataagcccagggccaggactagggtaaggagagaggtgcccagaacacagaatttaaagagacactcactatgaaggtcctgtgagccaaccctttgctggaatgactctgaaagtgagcacctccttaaattttgtgcctgaggcacctctcttgcctcaccctagttctgtttctatataaccctgacaatagctggtaatagacacctatagagccagtaccttaaaatgaactcacataatcacttccatttagaacaagttttgacttcatctaagaaaacagaggtgagatactatttcagaaaaatcaatgccatacctgaaataattaaaacagtccaaagtttatccatcagcaacattagccagaattttggatcatattatttaggttacccatagcatgtcactgttgtacttaggttccattatttcttatcatgacatgacttgtcattaggaagttctttctagcagaattgctctcgtggttaaaatttttggtaatcttgactaccactctggctgatactatgatatgcaaaaccatttgactttggcaaatgattggttaaagaatgaatgtgcctattaactgcatgaggttcagagtactcagtctgtgttgctgccagtttgctggggaaactgttcttctggtcccacagttctcacattgctacctgttcttctggtcccacagttctcacattgtccctgagaaataccttggaggtgagtgggaggtcatcaggtattgggactctgccctcttcctcccaacttgccacttccctgcatatgcttccaccagaatacctctttttttgtttttgtttttgtttttgttttcctgtttatgaagtgacattctgtgtaaaaggtctccatggcaggaactcattgagaaggagaacaattaatgaatgtggagcagtatttctagaacctaa

SEQ ID NO: 3386 - DNA, 1882 bp, Homo sapiens
tgggattacaggcgtgagccactgtgcctggccaattttttaacttttattttaggttcgggggcacatctgaaggtttgttatataagtaaactcgtgtcacaggggtttgttttacagattatttcatcacctaggtattaagcctagtacccaatagttatttttttctgctcctcttcctcctctcacctctaccctcaagtagattccagtgtctgttgttcccttctttgtgttcatgcgttctcatcatttagctcccatttataagtgagaatttggttttctgttcctgcgttagtttgctaaagataatagcctccaggtctatccatgttcctgcaaaagacatgatctctttttttatggctgcatagtattccgtggtatatatgtaccacattttctttatccagtctgtcactgatgaacatttaggttgattccatgtctttgctgttgtgaatagtgctgtaatgaacactcacatgcatgtgtcttatggtagaatgatttatttccctctgggtatatacccagtaataggattgttgaagtgatggtagttctgcttttagctctttgaggaattgccatactgctttccgcaatggttgaactaatttatactcccaccagcagtgtataaatgttccttttctccgcaatcttgccagcatctgttattttttggctttttgataatagccattctgactggtatgagatagtatctcattgtggttttgatttgcatttctctaatgatcagtgatattgaactttttaaaatatgcttattggttgcctgtatgtcttcttttgaaaagtgtgtgttaatgtcctttgcccactttttattgaggttgtttttctcttgtaaatttgtttagcttccttataaatgctggatattagacttttgtcagatgcatagtttgcaagtattttctcccattctgtagattgtctctttactctgttgatagtttcttttgctgtgcagaagctcttaagtttaattagatcccatttgtcaattttggcttttgttgtgattgcttttggtgtctttatcatgaaatctttgtctgtttctatgttcctaggatggtattgcctaggttgtcgttgtcttccagggtttttatagttttgggttttacatttaggtctttaatccatcttgatttgatttttgtatatggtataaggaaggggtccagctttaatcttctgcatatggctagccagttatcccagcaccatttattgagtaaggtgtcttttcctcattgcttgtttttgtcagctttgtcaaaactcagatgttcgtaggtgtgtggctttgtttctgggctctctattctgttccgttggtctatgtgccaatttttgtaccattaccatgctgttttggttgctgtagccctgtagtatagttagaagtcgggtaacgtggtaccaccagctttggtcttttggcttagcattgtatgggctatttgggctcttttttagttccataatgaattttaaaatagttttttttctagttctgtgaagaatgtcattggtagtttgataggtatagcattgagtctgtaaattgatttgggtagtatgaccattttaatgatattgattcttcctattcatgagcatggcatgtttttccatttatttgtgtcttctctgatttttttcagcagtgttttataattctcattgtagagctctttcacttctctctggaatacctgtattcctaggtattttattctttttgtggcaattgcaaatgggattgccttcctgatttggctcttggcttgggtggtgttggtgtgtaggaatgctagtgatttttgtacattga

SEQ ID NO: 3387 - DNA, 1060 bp, Homo sapiens
gaacatgaactatacatgaacaaacaggaaaacctagaggaaattgatgaatccgtggacacataaaacctaccaagattgaataaggaagaaatggaaaacctgaacagaccaataacaagtcacaagattgaatcaataataaaaagtctctcaaccaaaaaagcctaggacctgatggctttactgtcaaattctaccggactaataagcaggaactaatactggttcttctcaaactagtccaagaaatagaagacgcagaaactctctctaattcatagaattcttcataattctatgaagccagcattaccctgataccaaaactaggcagagacataacaaaaaaagaaaactacaggtcaatatccccagtgaacatagatgcagaaatcctcaacataatattagcaaaacaaattcaacagcacatcaagaagatacttcatgatcaagtgggatttatcccagggatgcaaggatggttcaacaaatgcaaatcaataaaatgatacatcatgtcaacagaatggaggacaaaaaccgtgtgattatctcaataggcagagaaaaagcaacttataaaattcaacaacctttgtttccacaaatgcttttggaatataaaattcagtatcccttcatgataaaaatgcccaacaagttaggcatagaaggaacagcctcaacctcctgggcttaagcagttctcccacctcagcctgctgagtagctgggactataggtgcatgctgccatgcctgaataattctttaaattttttgcagagacaggatcttgctatattgcccaggctggtctttaactcctggcctcatgtgaccctcctgcaatccttccgtcttgacctcccaaagtgttgagattacaggcatgatccactgtaccccacctctaaaatttttatggaaccacaaagactccaataaccaaagcaatttgaacaaaaagaataaagcaggaggcatcacacttcctgacttcaaaatatatgatagtctggacacagtggctcatgcctgagcaacttagtgag

SEQ ID NO: 3388 - DNA, 1027 bp, Homo sapiens
aagtgaccaaaaatctgagtcttgggtatcccagaaggtgaagagaagtttaatggcatagaaaactgattaaacaaaataatagctttaaacttcccaaatttaagaagagatttagacatacagatacaggaagctcagagattcccaaacagatacaacccacaaagatctccttggcacatgatagtcaaactgtcagaagtaaagacaaaaagaattctaaacacagcaagagaaaagcatctgttcacatctaaaggaatcctgatcagactaacagcagatttctcagcagaaaccttgcaagccaggagagaatgagatgatatattcaaagtgctgaagggaaaaaacaaacctgccagttaaggatactgtacctagtgaagttatctttcataaataaaggagaaatgaagactttcccagacagggaaaaacagataattcataaccactaaaccagtcctacaataaaagattaagggagtcctacattcggaagtgaaaggataatatctaccatcatgaaaactcgtgaaagtatacaactaactaatagagcaagcacacagatgagaaagagtaaggactcactcattttatcatcaaaccataacaataagaaaggaacaaaagatatgaaaataaccagaaggcagttaacaaaatgacagtagtaagttctcacatatcaataataaccttgaatgtaaacagattaaattttccacttaaaggatatggactggtccagtcatgtggacgcattcttttagtcccagtacttcaggaggccaaggtgggaaggattgcttgagcctgggagtttgagaccagcctgggcaacatagtgagacctcatctctaccaaataacaacaacaataacagactgtcagaatagataagaaaacttgacccaactatatgctgcctacaagaaactcactttacttgtaaagataactatagactgaaagtaaagggatggaaaaaaatactccgtgcaaatggaaaccaaa

SEQ ID NO: 3389 - DNA, 1027 bp, Homo sapiens
gtgagaccctgtaacaaaaaaataataaaaagttagctgtgcttgatagtgtgcatctgtggtcccagctacttgagagactgaggtaagaggatcgctcgagcccaggaagtcgaggcttcagtgagccatgatcacgctgttgcactccagcccgggccacagagtgagactgtctcaagaaaaaaaaaagggaaaattaatacattggtgagcaagacagatacggtttctgccctcatgaagcttgcagtctgttaatacctttgccattcttagggaacagaaattccctttgagagggatggcattgctgacatcaagattcccttcaaggagtttgaggcttccctagggtcccaaggtaatgccatgacaatagagacctagtcttctttgcagaatcctgggaatgtaggagactagacaatttgatgtctcaagctggtcttaatagaataaccttctgccaagaattatgtaagtgaagttcctgtccacaagatggtatatctccagttttcctttctatccagtgctctgtctctctcacctttaataatccacatttcctgaataagcagttagagtggttatttggaaatgtggaaagagtgctatagctgcagcctttgcccccaagttggaagtgtgttcctgtggtgatttcatgggcgttagatacacccagcccatcagcacttgaaagtcttctgcattagggtgctcctgcccttttggcatcaggtttgttactcaggatcttaggtgaaccattccaatgcttagcatgaagcaagcaccaattatataaatcttgaacttccctggccaatcacaaaaggaaactataaaatgccctaagaagagaaagaattatgaatgtccctgaatggtgagttagccatcacagacgctgtccaaagggaaacagaagcagggaggaatgccagccaaggcctatctggaactctacccactgcagactctgccctaaagatgggtgcccagtgcatctcacttcagt

SEQ ID NO: 3390 - DNA, 1050 bp, Homo sapiens
ctgacatttccctacctctgggaaggagattatacagttagttaatacgtattttgagtacagagataaattattcaattcagaaccattttttgagaacttactaggagtctgcttctagactaggcaccaggataataaagattagtacaatacaatcctttctctggaataactaccagtagcaagtgaaaaggtagaggccaggtgcattggcttatcctagcactttgagaggctgaggcaggaggatcacccgaggccaggagttcaagaccagcctggacaacatagtgaaacctcatctctacaaaaataaaaaaaattagctggtggtggtgggcacctgtagtcctagctactcgaaaggctgagatgagaggatcacctgagcccgggagttcaagactgcagtgaactgtgatcatgtcgctgtactccagtgtgggtgacagagggagaccctgtctcttaaaaaaaaaaaaaaaagatgcaacgcacagagtgctactggaaccgtaggagaagcatttagcttggaggcaaagagggtgctctaaggagttctttctagagaagcatcttctagagaagctgatgcctgaacagagttgtgaaggttgaatttgaaggattcaaagggtattcccatgcaatgggaatgcaagagcaaaggcacaaaagtgaaacagcctggtatatagaagaaactccacaagcagtttagcactactggaatataaagagcaaagctggtatggcagctccagaagaggtaggtggtggctaggtcacaaaggatcttgtatgctatgctaagaagcttcaattttaaactttttaggtagatggtctataaatttttttcatgatgcactttaatccattgaaaaattgagaatgtacccctgtatataaatttatacattataacacgtaattttatactaatgtcttatatatgtgtaagagatgccaaaaacaaaatgttaaagggattgacagaagcaaatatgaagagttctaatattttcttttcatgcccgaggg

SEQ ID NO: 3391 - DNA, 1779 bp, Homo sapiens
tggttgtaaaattcacatttattgggcacctactacttagcaagtcttcttccaggaactttaacacgagtgagcacttgaattcctcacagctctgtcaagcaagcagtactgtcctccacattacagatggggcactcaagactccaagtggcctatctcaagtaacacaactgtaaggtgataaagccacattcgattttcattgctttgtcacagaagtacatgcctatcttatatgacttatggcatttaaaagcagagtttatccaagtagtaatttaaaggatgtttttcttttaaagtttaaaatattggttgtaaatgcagcaacattcctgagcttaagttcaagaactcaaccgttatatgagtttttaccagtgtattaagcaaaaacatttgaacatgagctaattgttattaaaggaaaacaaagacaatttttatatttttattttggatctgccagcatcaaacaggtataccaaatatactttcggagaatgacctaaggcaaggaaaagaaaaaggaaaaaattgtttagacagtctcattttcagagcagtgtttcttttattttgtcttggtcctctggaagtgaaaggtttgctttgtttgaggcacacttgcctccttatttcccagtatagtatgagaatttataaacgtgggccagtttgttttttagtgctacaaaaaataaatgcatttggaacaggaaagaacaagaaagtcaggtgtttaactttttgtttgtgaagctcattatagtattctgattttgatcagtttacatttgtactttttttccgtcacaagattaagagaaaattgttttcaacttccaattccataccttctccactctgagtggcaactgtagataacaggaccctaaccggccctgggttctctctcgcacctctgcttttgtcattccagcactttgctagtcttcccccttgaatgcaccaacatcctaacgtggctcgctcttcagttccagttaaactcagcgtttatcagggaagttttttctgtatttgctcccccaccccccaccacatatgtcaccctcaatttcttatggcaacttaggtatacctttgccatagtgtcccgttgtaatcattttctttactttcttccatgtgcgagtgtgagactgtatgtgttcatatgaatgaaactcttcactggctggctcttcattcagtctcatgacctgggttatacactattttctcttcccatctgtctttggacaactgtgcttaagctcattaggtccaaattgagctcttttcagttggactgccactgtcccccttattgagagtcctcactcttctttctccctcacctcttctactgttatgaagttccatcatttctaccttctaaatatatctcatatttcatacctctctctccgccccctctactttttccttagtttggtcctcatcgtctgtctagagtagactattgtagatcctctaaccatccgcccttcctctcagtcctaatcccggtctatctttcatgtaactgtcaattaccatcctaaaatggcaatctgttttgtatttcctttctaaaagtcttctatttaagagaagcagggaaaatggctgggacatcagggttccttggcaccaattaaccaatgtgctatgtcatgaaaaaaggcttggatcagcagagggatggaagtggcaaatgttcactggttgctgtatggtttacatactaatgtaaatattctttaggag

SEQ ID NO: 3392 - DNA, 1036 bp, Homo sapiens
gattgaaatatcactaacaagggtaatttcacatgatttttggcaaacgtggttagcaggatgtgacatgacgcagcactgccttcttcctccatgtgccatctcccttgaggcctcatcttctctacttgcccccgtctcacccatgccgaggcttgccttcagctcacctgctccagatgggcagcacagtgggaggacactggcaaaggcagatgtgtttattttccggagacaaaatgttgtgctgctgcagatggcagtgccttggagcaagaggcagcctttgacactgctgccacacagcctgggcatcttgacagacagagccagcttacttttggtgatgcggaaattcaaaaataaaaaacgaaaaccaagatgttcattatgcagctcttggactgtcagtgcaagcagcagcccttttagacctggggagcagttttcttccctaccaaaccttagtcagctagtgagctaactgtggattgtcactgtaggccaagagttacgtgtctgttcattacttttgtctcccagccttaacaggacataaagtaaaaactggaaacaaatggctacatttagatggatactcagtttggttctgcaaaacatatgtgtatcccaggtcccatctcacaggagtctcttaggattgggggtggctcatgttggccccattggagataccgctgttctgtttttagtggtcattttgattatccaaagacccagagacagatgtgccttgaagttgaggtgtctcaattaatatgacaacactttgtgcttatagtgtttttctactaggaggagtaagcattctgacagctgcccttttaagcagtatgcgtatgcattagttaaagcttgactaagtccattaggaagacaaagactggctgttgaatcattacacttactaggatcctaaaaaaaataacttgggaagattatttgaaagttactggctttatcaggaaatttttttttctttttctttctttttttttttttttaaatgtgctgt

SEQ ID NO: 3393 - DNA, 1049 bp, Homo sapiens
gaactcctgggctcaagcaatcctcccgcttctgcttcccaaagtgctaggattacaggcatgagccaccatgcccagcccacttgtgtttttatgctgcgattgctgtttggtcaaagaagcaatttaatggctataagttagtttttcgtgagggatcatttgttgtgcttttttttttttttttttttttttgagatagggtctcgctctgtcacctaagaggtggcacagtcacagctcactgcagcctcaacctcccgggctcaaacaatactcccacttcagcctcccaaatagctggaactacaggcgccaagccaccatgctggtattgatagggaaaatagaagtaaaataacattgaacatatattatgtgctaggatttttctagatctacacagtccagtatggtagccaactagccacatggggctatttaaatttaagttaattaaaattaaataaaacttaaaattcagtttctggtggaaaatctcctggtagactttgcctgaatgctaaatcaacttttgttcttaaaaaaaaaaattctgttcctcagtcacagccacatttcaggtacccaatagccacaactattgtattagacatcacagatctggaacatatccatcatcatagaagttctcttggacagtgctattctaaatacttacatatgtatctgttattaagtatccttattatgacaccataagatgtgtgttatccccattttacttacaaggatgttaagtatttctcttagatatgtttccaaagcacatatatactatgttaaaggttaagattccagcttcaaatatcaaactctttcatggtgtcttctttattaattagtggactaatgtacaagtgtatttgtgcatttagggaaacatgaaatgttcagttttgttaaaatgtcgaaattgcacatagtattatatagataagtttgaatatatgtccattgtaggttttcaataagtgtttgctgaaaaagtgtcatccagctaggtctatatattctgctgagaatat

SEQ ID NO: 3394 - DNA, 1157 bp, Homo sapiens
tctctctctctctctgaacggggtggtttgccccattccccttctctctctctcaacatttactccatccagcctcacctgggccactgtgccttctcaccctcggcccagatttcctcacccttggccctctgctgcctgacttgtacccactccatgttggcccagggtcgtgggagggattcccacggcctttctgctgtcaaagggagactctctctcctcttttccacctcagctgctaaagaccttccccactctccctcctcaagcctctatctattctgctcttcctcatcccttcaaccaggtctattccctggctctaccaactccacagagccaggaatgtgaacttcctcatttgcacccccctactctaagtcaaatgatgtccgtgctcttctcatccttcttcttttcccctggattctgatttctccttctgggaaaggccagcaactcctttggggttgacccttgccatccctaggttttgcaggacatctcttcctttctgcatcttctgactcttcctgcatcttccctgcccgcagcccacagacacctccctgacccctgtcctgctgccaccagctcagcctcctttctacacagccacctgtcagaaggaggacctcccacctgtctctgtccatcacctcctttccactcttcagttaggcttctgtctcccaccactccacgaagcagctctcaccaaggtaatcgatgccctccacatcttcaaatttaacgatgtccattcagttcttttttgtttgtttgttggagtctcactctttccttcaggctggagtgcagcggcatgattttggctcactgcaacctctggctcccaggttcaagcgaatctcctgcctcagcttcccaagtagctgggactaccggtgtgcaccaccatgcctggctaattttttgtattttcagtagagatggagtttcatcatgttggtcaggctggtctcgaattcctgatgtcaagtgatccgcccgcttcttggccttccaaagtgctgggattataggcgtgagccactgcacctggtccacaatgcaatttttgatataattcagttgattccttttcttttttaaacaaaaaattttttttttagagacagcatgtctgtatt

SEQ ID NO: 3395 - DNA, 1037 bp, Homo sapiens
aaacaccttgatcttacccacccctttcttcctgagaatactgatattgagaaattatccacctatgaataacccttaggcctgtcctatttcctggatgagaaattcctctcatcttctctggtctccttgcctgacaccccaggccctgggacctggatctggctactcactgctagcctctcttggctctgacatctgtttgccaagaggcttacccgctgtccatcattgggtcttgatggcatggccttttgcaaagccctgttcaggctgatactggccatctctggaggtttctgtgtccttgccacttaagttcctggcatatatgtgggtaggtgaacccagccacagataccctttcacttgggggtgaattattctctggtgtcctcactggaaaagcctctggcaaatgaataacaggcatctctatagctgcttttttgtcttcctgtggacatggacatccctgcatttggagcttttttttcttcaggttttgagctctgaaaattatggagtgaccaggactgctgtgtgagcactgactgtattaattatacagtgctagaatattccatacaacactgcccttgattaacaaaactggctacaggctgggtgtggtggttcacgcctgtaatcccaacactttgggaggccgaggtgggcagatcacttgaggccaggaatttgagaccagcctgggcaacatagtgaaaccctgtctctattagaaatacaaaaattagccggtgcagtggcacacgcctgtagtctcagctactcaggaggctgaggcatgagaatcgcttgatcctgggaggcggacgttgcaatgaatggagattgcaccactgtactccagcctgggcaacagagtaagactccgtctcagggaaaaaaaaaagaaagagagagactacaatctgatttcctttaaatgaattcacttgacttagcaggtattgtattatttaggaataactagctttaggccaggtgtggtggctcacgcctgaaatcctagc

SEQ ID NO: 3396 - DNA, 1028 bp, Homo sapiens
attaggttctgggggcccagcaggaaaggcgtgtgtgtgtgtgtgtgtgtgtgtgtgtgtgtgtgtgtgtgtgtgtgtgtgtgtgtgtgtttgaggggagggtgaggttgagtgaatgtctctgtagttagacccagaaattgttccatgacttccaagcatactccctccttcattttccttcaagttctttatgattagaatctaaatgagaaaattaaaatcttcatgttggttgctggatgtcttaattgaccaaggattagaacccatcagggctatagaagaacagcagctgacagttttctctatctttccagccctcagtcccttacacagagtgggcaggttagtgagaggtgcagggtactgagagttttctgaaacagaaacctgtgcttcttgtcccttcaatgttattgttccaaagagttgcagcaaatatggaggttagacattagggaagaacttatcatcaactttctgatgatcaaatggctaaaagaacactgaggatccagggctgtctctccattgactatccagggaaggagctagcccagttttcttttgggcaatggtggcttgctctgtagctacaaccaggaatttgtaaaacttgtggttttgggccaggcatggtggcacatgcctgtaatcccagcactttgggaggttgaggtggggggtttgcttgaactcaggggtttgagaccagcctgggcaaaatggcgaaaccccatctctacaaaaaatacaaaaattagctgtgcatggtggcatgcacctgtggttccaactacttgggaggctgaggtaggaaatcacttgagcctggaggttgtggctgcaatgagccaaaactgcagcattgcattccagtctgggtgacagagtgagactgcctcaaaagaaaaaaaaaaaaaaaaaaaaagcttgtggttttgttaccttgagcagcaacatttttaggaaggaattaaagcaggaggctattgaggcatagctcttggctgccatagaggaaa

SEQ ID NO: 3397 - DNA, 1114 bp, Homo sapiens
ttttactcgagtcgtttctctttttctttaatataggtaaatttatcaatgtttttcttcatggcttttgagccacagacttgaagctctactccctacccaccttttctctcttttgaacaattattttataatccctgagtagtatactatctagggtgcagaagttctctttgatacttcaattcataataatactcttgtgttcaaataacaaaaaagcccagaatactagagtctcagattttccttttgggatgtgactagaatatttctggagttgcctaaaatgcatacctaattattgtattatgtctaaagcatttctacatatttctgttcaggtgaaaagcttcaggtgttaaaagctaaactgcaagaagcaatgaaactccgaaggtttgaggagcgccagaagcgccaagcactgtttaaattagataatgaagatgggtttgaggaagaggaggaggaagaggaagaaatgacagatgagtctgaggaagatggagaagagaaggtagagaaagaagagaaagaggaagaactagaggaagaggaggagaaagaagaggaggaggaagaagaaggaaatcaggaggtttctggcaattacgttgttttgttaccttgtcatggtgaatatgagagaaaaagtcagacttgaaaaagagtataataagcatgttcaattgtataagaggttttaggggcatgatgagggtaactacctcatatatccctaaatcttaggaacttcagttctgtcagtaccactgaatatctgtagatcatcattatatatctgaatacagatattcagtggtactgacagaataccattgcctgggcttccacctgtttatatattttaatataataatgctaatattaaaaatggctttgtattcgtaggaaattttatctttgttgtttatttaggtttctctagcagattaaaaagcagtcctaaccttggctagattgaggcctggagtaaattcttagggaggtagaggcctttctgagttattttcgttctttgtagaagaaggcatttgtagaagggcctcttgcccttgttccgtagtactgttttctgcctagggaaaac

SEQ ID NO: 3398 - DNA, 1237 bp, Homo sapiens
gcaattcttctgcctcaggctctcaagtagctgggattacaggtacccgccaccacacccagctaatttttgtatttttagtagagacagggtttcaccatgttggccaggctggtctcaaactcctgaccttaggtgatctgcctgcctcagcctcccaaagtgctgggattacaggtgtgagccactacactcagccaagactctttcattaaaccaagcatagtcagtggcttatgcctgtaattctagcactttaggaggctgaggtgggaggattgcttgagcccaggaggtcaaagctgcagtgagttgtgagctgaaattgcactcctgcactccagtctgggagacagaacgagaccctgtctcataaaaaaaaaaaaaacacaaaaaaattatctttcattaaacatcttattgttggcaggtgctatgtcagtgactatatctggtgtgtaaaatatgctcagtgagtctgttaattgaatgggttgactttggagatggagaggatagaaagagcaccttgtctcattaaaacaaaaagaaaaacaaaacacacacaaaaaagattctgtttcattaaacagcttattgttggcaagtgctatgtcagccactgtatctggtgtgtaaaatatgcttagtgagtctgataattgaatgggttgactttggagatggagagaaggacagaaagaactctgcatggtggtgcgtattgggaagatgtgaaagtcactttgaccagggctggaggttcaggtggcagagttgtataacagaactagcatagctccattagcaaagaagcatgagaataagctgttgtccggaacactgagggaaagtttttgttatatgggactaaaagttacctaaacagtcctagactgataggaaagggagaaacattttttgagtaccaactatattagacactggtacattctttgttagttgtctttcttaattctcacagtgccaggtattattttgcaaaatgaagagactgaggctcagagaggttaggtaatttttccagcattatacttggcttataaagggacctacacagtggctggcatataatgagcacttattttttaacttggaacatgttttcctttagaaataattgacacgaaatttgggtttccagaccagccataatatacatgaagttagaatcaacattcattcattcattcatgcaataaacttttatttagca

SEQ ID NO: 3399 - DNA, 1020 bp, Homo sapiens
cagcctgggtgagagagcgagactctgtctcaaaaaaaaaaaaaaaaaaaaaaggttgttgatagttaatataaaaaagaggtacattgctactgtgttatggtatttaggaatttattatttctgcctttccaatctgaaattaagttttttctgtaatcctgagtcaaatcttaagacattgatgaaaacatcatttagttttttactgctaaagagaaacattttggttcacttaaattatctgtgaaaccgaatttcttttgttttcactcattcaacaaatattaaagtatctactatgagtaagttgctgtggggcataccaagataaatctgacatttaaggtatacttaagatgcttttactctaatgggcgagataagaagtatgcaaataagaagtacaaaggagaaaatggtaaatgatgtctttgataatgaatatgtcattgataattggaaaataaataacatgaagaaaaaggaaaagtattttcttaaagaacatttagaataaagtactgtgggaattcagagaagcataaatttcttccaatgaatagttaaaagacagcctgaagaataggtggattaattacttgttcactgccttccctttatactgtgagttggtatcttctgccttgttccctactctatccctagtgcttcctcagtggacgacacattgtaggcacttgtatttatcaaatgaatgaatgatccctcaacactgaactcaagtattaccacattgaataaatttcctgactcttagatagagctggatgctccccactctgccttgaggcagtatggaatggtggttaagagcttagactttgtagcaagaccaggatttgaatctgaactagcatagtaattgtttaacattgtatacgccatttgacctcttcaagcatcttttgtttaaaaaagagaagaaagccagacacagtggtgcacacctgtagttccagctactcgggaggctgaggcacaagagggtcacttgaa

SEQ ID NO: 3400 - DNA, 1048 bp, Homo sapiens
tattagatgcaccaaaaaactattctgttattgtgatgcttactgctgctctccacgcgttcagttcatgtgtcatgtgcaaaggtgctgctgaagaatttcagatcttggcaaattcctatcaacgccctggtgcattcaccacaaaggtattttttgcaatggtggattatgatgaaagccctgaggtctttgaagcgctccaggtaacgtcagttccgagtttcttccacttttctgcccaatggaaatttacaacagatgacatttataatttgagaggaagggatattgttgctgaccaaatggctgaatgggtagcagaaagaacacatgtcagcgtcagaatcagacagcctacaaataaattatcatggtctcctcaagccagggatacttctggctctcattggtggacttgggtatttcttgaaatggaataggaaatctatttcttgcagaattttgtgcgaagttttaactctgtgctttgtgattgtgatgacgtctggtcaaatgtggacttatataagaggagaaccatatgtccaaagggaccctcacacaggacataaacattatatcagtaaatttagtcaggctcagtttgcagcagaaacattcattatttccctgtttaatatgtgtgttagcctgggaatggtgctgttagacaaggctgccacctctacgatgaacatcagaaagagaaagatgatgtgtctggctggtatgtgtcttgttgccatattcttcagtcggctgctttccctctttagatttaaagtacctgactatccatacagctttgtctgggattaaaaaggatcctacagacatagacaatgaagcaagaaatttgaaaaaaaaaatgtgaagcagaaaaatgcaaactcatagctttttaaagtaattgagatttcaccaaaagagaccataagtgctttaagtgctttcaaaatctgtcaagtattatggtatgtatcttctctgttcttaatttttctccccgagtgttatagattacctcaagtccaattattaaaat

SEQ ID NO: 3401 - DNA, 1021 bp, Homo sapiens
ttctgattggcagaaattaatcagctcccaatgggagcccacggaactaagtagggtcccaagaaaaaaaacgggagctatttcacagagctgagcttctgccaaatttcattcctcaaacctttcaggaggggtggttggcgtttctaaaatgtttatgggatttgagttgcaggtgtccacttaactgactagctttgataaacaatgtcagattttaactatgaaaacgacattaccttgtgcatttttatattgattcctattttttttttaagattaaagtttaaatgttttccactagtcatttcacttctaacttggtataggaagcttagctctctacatacctatcatgtgccctgtatcacagaagattcaggaaaaatgcacttgggaatcaaagaaaatggaacttctttttgaaaagacaagcaaccatgttaactgtattgacacatcctcaataaaacctgttgtataaaacagcactgtgctgaaactgatactgacacagaggtatctcaagcctctgggttctgtaaggtgtccaggaagctctctggggcttgtgtgcctgctcttaaggatcatgcactcctcaccagctccctaacctggatttctgtcaccaccacatcacaaatgcctgatgctcgtaagctgctgaggccatgcgccaggcaaatgccaggaggcattttaagaaaccaaaggcaggtagtggctggagctgggggcgatggctcaatctttactggaatattcctgcaagctctcagggctagtggagcatgacagctggctcagtagtccgagggccaagtttcaacatctgatacaaattatgaatgaaatcatgaatctttgctcctaagggctgggctagtgtcaggcccagtgctgaagacaggctgggggagctgtcctgggcggaaagcacctgctcacagcctgccatgctcagccacgaaagatctgtccctggcgctgggggtctgggtggcagacctgaagcaat

SEQ ID NO: 3402 - DNA, 1033 bp, Homo sapiens
tgtcatcagtgcaatgaacttggtctgggacttccttccttccccatggactgggcccctgggtcctctgttgcttctgggaggggccttgggagtacagtttactctaggccaggacattctaagacatgtggaaaccattggtcacacctgccagcaacagagattagtttgtaaatgtctgtttcaggtgtttcacagcatctagtgaatgaccgttgctcccataccagattctggtgacctgatcttaggcttgacagctgtggtggagacttgggttggcagaagcctaccttggtgtgttggaagagtgattgcttagtgcatgaggtgccttttacagcccattttgcagtagttctggctgcagccctgctgctttgaccttgcaggccaaatttcctggctcctccaaaggggatgatgttctttccctccagacacagttagagggaatcctgacagttgcatcaaggctggtccagactctcaccacgctttctcttttgtgctgcttggtcctgactgccttttgaatctcttttagagctctgagctcttcaccctgacctatggtgccctggtcacccagctatgtaaggactatgaaaatgatgaagatgtgaataaacagctggacaaaatgtgagtgagctccttcataggagagacagaaatggggcctcccagcacactgagtctacattgtcctttagagcttaaaacagggttctctctctttcttagccaacattttgggtacatttctcactaaactcatttactgggatgtttttgagattatccccattttccctttaccaccaacaaccttatgttcaaacataagacatttagactccatcatagtctcttctctaacttccttcccaggggctttaacattggagtccggctgattgaagatttcttggctcggtcaaatgttgggaggtgccatgactttcgggaaactgcggatgtcattgccaaggtcattattctgggccacctgtccatgctgaagaat

SEQ ID NO: 3403 - DNA, 1057 bp, Homo sapiens
gggtgtggtgcctggaagggtgactgcaggagccaggctgccagcactcttgcctgccctcctgtctgctgcgctgccttcatctgggtttatctttgtctccttcccaccctccccgcctcaaaggcgaaggtgacggaggagtgctcccagtacgagtttgagaactacatgcgtcagcagctgctgctggccgaggagaagagctccatccatgacgcccggagctgggtacccaagcggcagttcggcagcgcaccaccggtgcgacggctgggccacgacgcacagcccatgacctccttggacacggccatcctggcgcagcgctacctgcggaaataacagcctcagccggggccaccagcactgctgccacttcttccagccccagccaaaggcgtggctgtcagggctgggccctgtagtgctggactctcccgggccacaatagggacagggcagggacagggacagcccaggtcacacgtggggtcagcagaggtaccacgaagctaccttttgggatgattgctcgattgtttggtttttaaatctgagaagcctagataactaatctgcttttaatcacgatgttttaatctacctctgtctctttaaccatgctgtctctggactgagcaagagggaggagggagcctgctcaccccactccagggccttccccagcggccaccaactgacctggggcgctgctccccacagtccaaataagctgaaagtgcagctcgctgcaggccccagagcgagcttcccctcctccctgctctcccaggcccctgccacagcctctttccgtccctctctttctgatccaggcccctcagtccaagctttggaaaaccttcacctcatcttaaaccgaactcaaatatatttatttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcc

SEQ ID NO: 3404 - DNA, 1086 bp, Homo sapiens
cccaaggcccccatggagctctccttcctgttgtcctcccagcttctccccctagcttctccacccagccagccgacacaggagcagggcagttgggtagagaggcatccttcctcactgcctgccccagtgggccaggaaacctttcccaggcctcttagacagggcctgcccaccctcccagcccccagtgtggtgtaaggtgtaagggtcctctcggggcacttccttttgtccacatgtgagttttctccaaaggatcagagcccaaagctgccctgccccacgcctttcagagggagggtctgtgatgttctagccagggcagagtcacaagtacgaggtaagggatgagtcagctttgatggaacagaaggaaaagtcattcggggcctggggccctgcccagggacacatctgggcatgaggcagctgtcagttgtgtgtgcagctctggggccctgcagacctggtcttggatcctgctcttctgctcaccagctgcatgaccttggccaagtcctttcacttccctgtgcctttgttgtatcatctgaaacaggaccgtgagaaaatccccctcattggccactgtcagtttcttcctctgcagtggttgtggggccaagtgagaactgacatattccgtggttcggaggtggctcggggccagcccttgggtcaccttccaaggtggagtcactcacctctgctggacttccttttcctcatgtgtgaatgaggaaattgaactaaatctcaggtcactcccagtctagaatattacgtgaggctgtttttgagaaatctctgaaagttgttctaagccctaagctgtaccccgagattcagcccgggcagcaggtccagggatggcctgtgcaacactcagatacctgggagagaagccgatccctgctgggacagctcggctggtggccagaaaagtctggggcctgattcctctgctctgctccctggagagggggtcggggcagctgcttcaccctctgacgagaagcctacctcctactgttcaggattgggtgttggcccagtgaggtgtgtcctgcctgcgtgtcttgt

SEQ ID NO: 3405 - DNA, 1058 bp, Homo sapiens
ggagggcaggtctcactttgggaacagttgctcacctcagggctggggttcagctggatggggctggctctcctctctgtctctgtggtagtctcttggggctctgtttggcattagcatctgcacaaagcccagttttctcctctctgaatttaactggccacttggtggtggtgtgttggctccccgcctctgtaccctgtatatgctgccttaaaggatgtccacctttagcatctaattaatcccaagtaaaggagctgtggttctttgtcacttggagccttggatgctcccctggtagcaggaggagttggaggcagcagcggcagctgtgtgatgcatcccaagtcaaaggcctgcaggctgggttagcataaggaaactcgctgacttactcagtgagaaggggtctttctgtcttgtctagagctgagaatgaagcggagagcatcagacagaggagctggggaaacgtcggccagggccaaggctctaggaagtgggatttctggaaataatgcaaagagagctggaccattcatccttggtaagcctctgacctttgggaaaaatgggtgggctgggaggcaggggcagggcacattggctcgcatgatctgacctacagacatcagagtgaggtggcccacccacagcagtgtgtggtcctgccctgccccaggcttggtccctagcttcactacttgaaacagaatatgtttatatcagtggaagacccaagccttgggtcactctgtaccaggggctgtcagtgttttagccataccagccttagatcagccttagccaatagctaggctccgactctccccccagagaatcctatgtgtgcccctagaatggtgacgtgctcacaggaagcacacccattagaagtcattagctgcattagaacccaagctctggccaggtgcaatagctcacttatgtaatcccagcacttttcgaggctgaggtgagaggatcacttgtggctaagagttcaagactttgcaagcttgggcaacatagtgagatcccatctctactagaaa

SEQ ID NO: 3406 - DNA, 1035 bp, Homo sapiens
aagaatatgggattcagcattgaaaaagctgtgtttatatcccacctcttccaacagctagccaggtgacttcaggcagctctgagtctcaatttcttttttctttttctttctttctttttttttttttttttttttttttgagacaaggtctcactctgtcccccaggctagagtggtgctgtcatggctcacgcagcctcaaactcctgcgctcaagcagtcctccaaactaagcaagctaaaactcccaagtagctgggtctaccagctgtgccagctttgaactcctgggctcaagtgatcctcccacctcagcctcccaaaatgctggggtaacaggcatgagccaccgtgcccgggctcaatttctttttctagaaaattttgtgttgtgtgtgtgtgttgtggggaggtgatcagttatcattatgtaccagccctccacatccgtgggttctacgtctgtggattcaaccaactgcggatcaaaaatgttcaggaacaaagaaggatgcttgtgtctggactaaacatgtacagacatttttttctttctttctttttttgagacggagtcttgctctgtcacccaggctggagtgcagtggcgtgatctcggctcactgcaaccttcacctccaggttcaagcaattctcctgcctcagcctcccaagtagctgggactacaggcaaacactgccacgccctgctaatttttttgtatttttggtagagatggggtttcaccatgttggccaggctggtctcgaactcctgacctcaggtgatttgcccgcctcggcctcctaaagtgctgggattacaggtttgagccaccgcacgcagtcctttttttttttttttttttttttttttggagacagggtcttgctctgtcacgcaggctggagtacagtggcaggatcacatgatctgtgattacacaggcatgacccatggcacccagccagactgttttttcttgtcattatttcttttttttgagatggagtctcgctctgtcacccagg

SEQ ID NO: 3407 - DNA, 1025 bp, Homo sapiens
cgtgagctggcggggctgaggtggcagtgaggcaagatcgtgccactgcactccagcctgggtgacaaagtgagtccctatctcaaaaaaaaaaatagttctgtttgttaaaatacagttaactctgcaagtgtaattttttctcccttcttttttttatttttttatttttttgagatgaagtcttactctgtcgcccaggctggagtgcaatggcacgatcttggctcactgcaacctctgccttccaggttcaagcaattctcctgcctcagcctcctgagtagctgagactgcaggtgcccaccaccacgcccggctaattttttgtatttttagtagagacagggtttcaccgtgttagccaggatagtctctatctcctgacctcatgatccgcctgcctcagcctctcaaagtgctgggattacaggcatgatccactgcgcccagcctctcccttcttattgttataaactcataggtcatgttcccaaaccattacgcactttccaccctcagaatattgatgtctatgaaaatataccaagaaaaatgacaataaatgtatttttttccaggtatccatgtttctaaaggacaaagttcagaataataacggtcgctttgtgttgccggtgtccgggcctgttccttggggaactgaagttccaggactcatcaggtgaattcccaacaatgatcagagctatgtttggggtgctaggaaatcagcacatgggccgcacacggaatgccgcactgccaagccactcacagtctgcccagcccttctctttcttcagtaaaacagctattgaaaaagtcaggttctaatccccaccttgtcacttagtagagggacttgaggcaagttacccagttccccaggactaatttcctcatctgttaaatggttactgtgtggatgaataagataatagtgctctaacgtgcttacaaagcaattggcacatacatatgctcaataaatattattattgtattattattattattattac

SEQ ID NO: 3408 - DNA, 1046 bp, Homo sapiens
gttcatcttggcccagtgcagtggctcacacctgtaatccctgcactttggaatggagaggtgggaggattgcttgagcccacaagttcaagttcaagaccagcctagtcaacaaagcaagactctgtctctacaaaaaattaaaaaattagccaggcttggtggcatatgcctgtagtcccagctattagagaggctgaggtgagaggatcactttagcccaggaagttgaggctgcaatgagccatgatcgtgtcactgctccagcctgggtgacaaagtgagaccatgccaaaaaaaaaaaaaaaaaaaaaaaaaagaaatgctcatcctgtaaataggatgtacctgtatgttcttaagtataaaatggaaaatagtgctatttactctgtaaacgaattatatcttattttttatacataagccatacagtctaatttccagggatgggttatagatttgtgcatttatctttctgagtcagactcagtgtaaccatattggatgttctctctgtgtatttcatcaccttgaaatacgacctgttctcggtattactgtgtacttctttcagaaggtatatcttgttgttggatctagttcttttgttggcattggtacaatgatatgaggaaaagggattttagtagtttgggaattagaagtatttaattattatctctatgtacagatttctaaatttgtttctctgcccttaacctctttcctggctttacttctgcatttcgtctttttttttttttttaagacggagtctcgctctgttgcctaggctggagtgcagtggcacgattttgactcactgcaacctccgctttctaggggcctcccaaagtgctgggattacaggcatgagccactgcgcccggcctgaatcctgcatttccttctagacatttccactcataatcactcaaatatttgatctaaaacagaattgttctgtttccttcagaatttgtcttcacagattttttgtgatggtacttcacttctcccttattcagaactctgtagacgtc

SEQ ID NO: 3409 - DNA, 1105 bp, Homo sapiens
gggatcggtatctgaccaaccaaaagtgagtgtcgaaagcctgtagtgttcctattgtgccctagtaacgtttgtttttaggactgtatgctcttagtggcaactttgctggaggcagtagtaaagtagtggtgtgatctggacttgaactcttggactctggctcaggcactgcctcaccgaataatcttagacaaggctcacatctgtaaaatagcgaaagttgggcctatggcacagggttgtgtgaggcttaaatacagtatctttatacaatagcattctattaaattttttacacattttaatcagtcatgagttctaccctcacagtatttttcttttctttttttctttttcctcctgagtagctgggattacaggtgcgtgccaccatgcctggctaatttttttatttttagtagagacgaggtttctccatgttggcctggctggtctcgaactcctgacctcaggtgatctgctgccttggcctcccaaagtgttgggattacaggtgtgagccaccacgcctggccacttttcttttttctaagagacagggtctcacgctgttgtccaggctggagtgcagtagcacgaacttagctcactgcagcctcagactcctgggctgaagtgatcctcccacctcagcctcccaattagctgggactacaggcacaccatactgtacctgactaattaaaaacttttttttgtagaagtgggatctcactttgttgctcaggcaggcctggaactcctggtttcaagcagtcctcctgcctcagcttctcaaagtgttggaattaaaggggtgagccaccacgcccaactgaccctcacaatttttgccatacctgtgtgccagctgtaccactgcttacttagtaatattatttttaaaaaatttctaaacttttagaaaatcttcaaattataggaaaatgggaagaatagtatatgaacacttgataccctcctacctatattcacaaattgttaatgtgttgtgacatttgctttctcttactttctataatatatattaatataagcacacatctatatttacatttcacatttttaaattgtgaaataa

SEQ ID NO: 3410 - DNA, 1027 bp, Homo sapiens
tttttttttaactatggaagtaggatttaaaaacttactattatattttcacttttggcatgagagaaagctagtttctttctttacatatcttgtacctgactacttaactcttagttctattttctgtatattcttccctgtaagtttgcccatagttacctttgttctgaaaaggagggaattatttttccttctcctttctggactaaatagtctcttgtttttagggctgtggacctggacttgtgctattagggctatagttgaatagcagcatgggatatcatctttgtggccttgcgagggaacataaccaccagacataatcttatttctgtgggaaatgttgttctaaatgccaaagtccaaattacaagactttttgcatgcacttcgttcaaaaagaacaagatttgggctgcctttagattgtgcactgcgtttaaattacagaatctgtttgaattttaggagcgtgaggatcatccccggagaggacgggaggatcggcagcacagggaaccatcagaacaggaacacaggagagctaggaacagtgaccgggacagacaccggggccattcccaccaaaggagaacgtctaacgagaggcctgggagtgggcagggtcagggacgggatcgagacactcagaacctgcaggctcaggaagaagagcgggagttttataatgccaggcgacgggagcatcgccagaggaatgacgttggtggtggcggcagtgagtctcaggagttggttcctcggcctggtggcaacaacaaagaaaaagaggtgcccgctaaagaaaaaccaagctttgaactttctggggcacttcttgaggacaccaacactttccggggtgtagtcattaaatatagtgagcccccagaagcacgtatccccaaaaaacggtggcgtctctacccatttaaaaatgatgaggtgcttccagtcatgtacatacatcgacagagtgcgtacctactgggtcgacaccgccgcattgcagacattccaa

SEQ ID NO: 3411 - DNA, 1557 bp, Homo sapiens
aaaaatttgccatgagtaccagagccatatttttacatggggttattgccatttgtttgttcggttgggttttttgtttgtttgttttttgagacggcgtctcgctatgttgcctagactggcctcactctcctgggttcaagcaatgctgtcatctcagcctcctaagtagctgtgactacaggtgtgcaccaccacacttggctgttattgccatttttaaaaagtgaactgtaaattttgtaaaattcagctgcctgcagtatgagaagctttagaaacacccagggaggtacaaacatgttggatgttgacttcttccactggtgataactacttggataggagtggggtttctttagtctgtgagtttgtcgcaggtctccaggtcagtatgtgattcgggcgagtgagaggaggaatgttactttgcttttctgtttcagaatatccaagggactgagtgaaaagatatttgcaaaacctgaagaacaaagaaaaacactggaagaagatgtagatgacagaggtgaagttaaattatttcaatcatttagatgtaatttgcatatttagagttttgagaaacctaagttcagtctccaaattatctcagtcatccacataaatgtttgtcatatctggcagattactttaaatttacatagtgttatgcaaattgaattatctgcttttcattctgcacattttttaggattaaattggcaattcaggaaacttcctagaaagggttcattattaacctagaatccaagggtgggtccacagacaaagaggggggtgtgtttcctgcatttatccattcctccatttgaccatcagctttcacactgagagcatggcttagggcatccttttacctggcagcctccccttggcctgctttactcaccactgtgctcacctgctctgtccacattgggtgtcctcctcctgatacatcaagcttgttcccaccgttgggtttatagacaaattttcaatagaaaattcctgtttgtgtattgtttgtatccagcaccttccaaaaagggaaagaagcggaaggcacaaagggaagaggaacaggaacattcaaataaagctcccagggcgcttacatcaaaagaagtaagtgtcataggttttaagtatggcccaagtagagtaactagaactccagttgtcaagacccactgaaacaaatggtccagagctgaatcccaagaaccccagtcctcgttgacctagttgaggtcagataaatagggtcgggtctggcccactagatgcaggtccttgagtccatgtcatacgttttaggagtttctaatcaacgtctccacacgagtggactatcctctagaggagtcagtttctagtcccaagggaaacgacccaatgagcagatctgctttgggcagatcactgacttctgtgaaggacagctttggagctgagctgttcagagctagagtgggccctctggggaggggagtggttagcagcactcagccttgctgcaggggacttgtcaggagtgatgcagaacagatt

SEQ ID NO: 3412 - DNA, 1169 bp, Homo sapiens
tacaggtggatgcctccatgcctggctaattttttgtattttagtagagacaaggtttcaccgtgttgcccaggctagtcttgaactcgtgagctcaggcaatccacactccttggcctcccaaaatgctaggattacaggtgtgagccactgcacccggtcgaggtacagttttgaagttcatgcaaatctcatcatttgctcttctgcaacaaaacattttctttcaacttattttgcctgtgtgaagctcagtgctttaactcatatatggagttatcttcttccctcagactggagacgttggtgaaattggggctagactgaagatgtctaaggtggcttgattgacaaaggtctctcctcatccccaaaataaataacattttttcatttataatagtaatacaccagtcatagacaaattaggaaatatagttaagttggaaaatacaacaaaaagaacataactcatgatcccattgctgatattaagcattgttaatgcctctgtgaatatcggggcttccttaactggaggtctctgagttaatggatggcctgtaaggtttctttgactctttgaagaaaatgtggaaaatttgtgagcttacataaaggcagtagggttttgtgttttttgtttttgttttggggaggaggaggaggagaggaagtatctataattttaatcatattctcgtagggatccatactcaaaaggagaatcagtcaccggctggctgcagtggcttacctgtaatactagttttttgggaggctgaggcaggaagatcgcttgagcacaggagtttgagaccagcctgggcaacatagtgagaccttgtctctacaaaaaataaaaaattggctgggcatagagtcccagctactcagaaggctgaggtgggaggatcactggagcccaggaatttgaggctgcagtaagctgtgattattaggaatatatttctatgtcagtacataatcaacaataatataatatttattgtcagagtagtattttgtttgttatggccagtctcattgttggacatttatactgtgtatagtttttccttatggtgaacaacacaaggatgaagcatcaatgtgaccgcatctttttcatccttaattattccccaaagataagttcttacggagca

SEQ ID NO: 3413 - DNA, 1048 bp, Homo sapiens
ctaaaaatacaaaaaaaaattagccgggcgtggtggcgggcacctgtagtcccagctactcaggaggctgaggcaggagaatgatatgaacccgggaggcagagcttgcagtgagccgagattgcgccactgcgtgccagcccaggcgacagagcaagactccgtctcaaataaataaataaaaataaaatagttcaaagaaaactgtttacttgcagaacaaaataaaaaccaaggcctggttattgcctcaggttttgtcagttatgttttgttttatgatgcactagaagaatggcacctattagtagaatgactgttttctttcaggggaacacatgagtgtaattcatgaaccacagacaagttgctcatttcccttgttctctttgtctgttctccctaaagccatcttttaagcaactattgaatcctgtttatgagaagaacagagaggttctgtgatggatttattgcttcgttgcctgtacttgttgtcagtgcttctaaaattcagtgtttaaatatctggtatgtagaatgaagggtctgcagttgcaccagtcagcttctttgttgatgcagaaagctgctcagagtaattgatgagttttctgctttggccttgaaaaaccttaactattttattttagtgtaatatctattacttataaaatctaattctgagattattttgcacagtggagttagatcagatacgcatattcatctatatgtgttttagaactactgtatttctgtagcaatacagtaagagtactgtaactttgcatatgtgctttatatactgtatattactgtgttatacttactaatgtgtgttatacttactaatgtgtaggtttatagacataaagccttgggtactgtaacttacaggttaagagattttgaaggataattttggtcacacttgattttacccagtgacattagaccctatttcccatgtaaaatgagctgcttctgtttggagatgctcccgagtggaacgtagtgactaaaactaaactgagttgtgggttag

SEQ ID NO: 3414 - DNA, 1042 bp, Homo sapiens
ttgataagtacggcttgtgtggagtggggaagtttctggggaggaagtgatattaaaaacctaatggttgaaaagatgtaaacagagtcaagacgtgggtatgagtagtgtgcatagagaatagtatgactggcccggcacggtggcttatggctgtaatcccagcactttgggaggcagatcacttgaggtcaggagttcgagaccagcctggccaacatggtgaaacaccatctctactaaaaataaaaaaagttaactggctgtcgtggcacacacctgtagtcccagctaaaggggaggctgaggcaggagaatctcttggacctgggaggcagaggttgcagtgagccaagactgtcccactgcactccagcctgggtgacagagcaagactctgtctcaaaaaaagagagaaaagtatgacaggagcagaggcctggtaagagatgagatcagctgggtatggcagctcagcctgtaatcccagcacttagggaggctgaggcaggaggatcgcttgagcctagaagtttgagaccagcctgggcaacatagtgagatcccattctccatgaaaaggaaagcaaaacaaaaaaaagatgaggccaggtacggtgcctcactcctgtaatcccagcactttgagaggctaaggacaagaggatcatttgaacccaggagtgctgtgagtacctatgagtgctttacttaatattttgtcttttatttatttttattttatttttagagacagtctcaccctgttgcccaggctgaagtgcagcggtatgatcatagcttactgtagcctctaactcctcctgccagcctcctgagtagctgggattccaagagcatgccaccatacctagctaatttttaaaattttttgtggagatagtcttgccatattgcccaggctggtctcaaattcctggcttcaagctgtcctctggccttgccctcccaaactactgggattacaggcatgccactgcacctgtttttttttttaaatgttttaattaaaaaaaaatat

SEQ ID NO: 3415 - DNA, 1049 bp, Homo sapiens
agcttatagtagttaaaaatgttggtatagtttgtccttgaggaacttaaagtctagtactgtaagacataaccagaattctagtttctggactttctcaaatcctatctatatgacctggcttggtcttttcctttttcattttaattttatttatttattttttttctgtgcaatggggagagaaaaatttcccttctttaggtttattagctttttgaagaaaacctcttacacatatagaggcctctatctgctaaaggacaagcccactttatcttaatctgattgctttgattcaagctgttaggaaatttgactgccattcccatggctccatgatgcaacttacaaaccaatgcattgagtctgagcttatgcagcctcctccatgttgaacatgagagttttatagtattgctaacactaattttgagtttgggttttttgttgtcgtttttcctggtaaataaatatagcataggctagattttctgtgattatgtgcataatgaataaatatgatgggaagtatttgaacagagactgaatgattcaggaatgctgtgaaagagtggttagtggagtcaattacagcacttctgaagttgtaggttcttgggcctccccccaagcctgctgagtcagcttgtctgaccgtggcatctgaacctgcatttttatgtaagcacgacaaggcctaattctccttctggtagtggcagagttgctcttatgagaccaactctcccgcagaaaacagctaaaaattctagacaaaatataaaaaacaactgtggaaaggcactggtgagcaaccaatagcaagcagaggtaaccttggaagaagggattgcttggaagatggtaaaggcactgggtaggcttgcaagttttatggcttatccaccttgggcaagccccagttggcacccaacgaggcagccaaacttataaaaactcaatcttactggcttgaataaccagaggacagagttcagggtggccacagcacctggaaagtgaaggcaggtagcctggaaaggaaa

SEQ ID NO: 3416 - DNA, 1723 bp, Homo sapiens
tggtctcgaacttctgggctcaagtgagcctcccacctcagcctcccaaagtgctaggtgagcacttacaggcatgagccacctcactggcccatacaacagtgttttaaaatgagaacctgtctgtagtcccctgcaggcgttctgtggataccagctcttgccactcctctctcttatacttggcttcctttgacttagtatcaggccactgaaaattatttccatggtgggcatttggggcaccaggcagagctaagggctctcaaagaatgaggacttctattatgctggcaatggtggtggagagaggaagatggctggctgttgaatacctgatatgtaccgatcactatgttatgggctttaatatagttttgtatttaattttcttagcaatcctataacatagatactattagcccccattttacagatgacagactgacacttagaaacacacaactagcaactggtagaaccgagatttgaactgaggactttctggatgccaaagcctatgctttctaccatcacacaccacttttgcaaagatacaagaatcaggtattgagacctgttggctgtgaaaagggctaagaaatgaagggacagcagtacttgttctgtaagggtaaaggtttgaggtgtggggaacagctggatgaagtcagctctcatggtgggggatgggaggcctgtcgaaatgagatcttcagggttcttatatttctgagctttttggttgtccattatggagaagaaatgataccagtgccggtgtggggaatggagtcggacacagagagggaagggaagtcactagtgatggggaggaaaaggcagtttctatagccataacagccaggccagtcatttatttatgagaatgttcatgtgctaggtgcccagaagcaggaactctcttgtggaatagggggctgtaaatgtgtgtaaaatctgcttctcactttcactttcttttcctccaggaaaaacccagccttttttcttttttctttctttccacaggtgttgacttttttctttttctaatttttttaaatttttgccttctggggtcacagtgttttattttctcacttttgcttatcccattcacctttcttctctgattctgttatcttaacaaggcagtcatctttgttaaatatttctgtattctagaactgctcagaacactttgtaaatcagcatcaattctctgaaagctcctactttgtgcccattactagcatgagatgttatcctcagtgcacctaacctgtgctccctccatgttccctaacagggtaatcgacagctgtttgaggccactcaggaagattaaagttatgcttagagcctgaagctcttttggaggaaagcttttttttttttttttttttaaatggggtctcactccatcacccagctgctcatgtctttaaattcaggttggggatcaccaccttcaagaagcctttctaaggtcactgaagtctgttacatgtttctttggtatattcccatagtatgctgaatatctgttatcagtaaaacttctcaaaccatgttgttcttgtctgattttccttttgactttgagctctttgagagtagggacaatttttatatgtattcctagcacccaggacagtataatttctggaacataatttttaggatgtatgaatgataaaccttagttgtattgaaatgt

SEQ ID NO: 3417 - DNA, 1035 bp, Homo sapiens
agcaggagaaggtttttccaagagagaggaacagcatgaaacaaggaatgcaggtgggaaacaggccattttcagggaatagccagttgtcctgttacaacagagtcagcacacttttttctgcttagggctaaatagtaaatattctgggctttgcaggctataaggtctctgttggagctactccattcttccattgtagcacaaaagcagccatagacaatacataaagaatgaacatggccaagttctgataagactttacaaaaacaggcagtggggtggatttggttcactggctgtagtgtgctgacccttagactagaacatagtagtagaaggagataaggatggaaagatagcaaagatccaaacatggaaggcagtggtaaccttctatgggttttgaactgtactctcctagaaatggtgggaaaccattggaggtgtctaagccaaggctagagtggttagatagagaatgtggttagagtagcattttagaaggattggtctggcagcagaggtagcttggaggcagaggaaaactggagacttcttgcctagttaggagacagttgtagtttatgtttggggtttcatttaaatctgaagaaaggatagtggccttgttcatgggaagaatcaaggacttttgtagaagtacgagagaacttcgtacgtgttattggagtttgatgaatgagccatgagttgggcatgattcaaaggttttgaataggccaggcacagtggctcatgcctgtaatcccagcactttcggaggcagaggcaggtggatcagttgaggtctggagctctagaccagcctggccaacatggtgaaaccctgtctctactaaaaatacaaaaattagccggttgtggtggtgcatgcctgtagtcccagccacttgggaggctgaggcaggagaatcacttgaacccagagggcggagggtgcagtgagccatgattgtgccactgcattccagcctgggcaacaaaatgagaatctggttggaaaaaaaaaaa

SEQ ID NO: 3418 - DNA, 1060 bp, Homo sapiens
ctcgtgatccacccgcctctgcctcccaaagttctgggattacaggcataagccaacacgcctgatggctgccataattttatttgcccaaagcattgaggtgccttgttagcgttctcttatgctcttatgcactgtatattttcttcattttttttcccctgggtaatccctctataccactgcaggacacatagctgcttttacattttctccaatgttggatcttcttgtgtgatgtgtgccctacccatagttttataatagatgcctgaagacctattgtagaaacatgccagggaaggcctgcaagatgaattcgccacatcagcctaaatcagatcatctgtcaggtgattcagaggcctcaccacactgctcctttttgcattctgctattgatattgccaggtcaggaaatcattgatgattttctgagaaaataattattttgttactgtcttcccttttgcaggaagatctgtttcagcaaccaggcctgaggtcagaatttgaacatatcagggactgcttggatactggaatgattgataacctctgtatccttcagacattcagctctgtgtgtgtgtgtgtgtgtgtgtgtgtgtgagagagagagagagagagagaatatgagtgagaggggtgagaaaaagtaaagtattttatggctcaaaatctgatattgtatcctcagctaccatgttttacttaaagtttgcatagagaagactttacaactttatttatttattttttgagacagggtccatctctatcacccaggctggagcctgtggagcctcccacctcagcctcccgagtagctgggaccacaggtgcatactaccacacttggctaatttttgaacttttcgtagaggcagggtttcgccatgttgcccaggctaagaatttacaactttaagcaaccaatagagcaggaactcaggagggcctggctcacctgacaaacagtgtggtcccttcgagaagttaggctggcatcctagccctgagcagagagcctgacagggcaggcagcacttctggcatg

SEQ ID NO: 3419 - DNA, 1832 bp, Homo sapiens
caggttcaagcgattttcttgcctcaccttcctgagtagctgggattacaggcatgtgctaccacggctggctattttgtattttaagtagagacggggtttctccatgttggtcaggctggtctcgaactcccaacctcaggtgatttgcccacctcggcctcccaaagtggtgttgggattacaggtgtgagccactgcgtctggcctcagaattgttaatcaggacccccatggaacaccattatcaactagagtacaatgcttctgtacagttccacttgcctttagtctttttttttttttttttgacagtttcactcttgttgcccaggctggagtgcaatggcgcgatctcggctcactgcaacctccgcctctcgggttcaagcgattctcttgcctcagcctcccaagtagctgggattacaggcatgcgccaccacacctggctaattttgcatttttggtagagatggggtttctccatgttggtcaggttagtctcgacctcccgacctcaggggatccgcctgcctcagccttccagagtactgggattacagacgtgagccactgctcctggtgcctttagtcttatagataccactcatttctaaagttacttaggtaaacactttttcccctactcccttcaatgaggtggtttcatacctttgtgatataggttagacacttttgtcattttctgcattttactccagaatctcctgacgtcctaaatgattttttaaaattttgtatacattaaggttcattctttttttttttttgagacagagtctcacctttcgcccaggccagagtgcagtggcgcgatctcggctcactgcaagctccacctcctgggttcacaccattctcctgcctcagcctcccgagtagctgggactacaggtgcctgccaccgctcccggctaaatatttgtatttttagtagagatggggtttcaccgtgttagtcaggatagtctcgatttcctgacctcgtgatccacccgcctcggcctcccaaagtgctgggattacaggcgtgcgccaccgtgcccagcccagtttcattctttgtgttgtaaaaatctgtgggttttgaaagctatagatactaccatgtatcaccattatagtttcttttgagtatagttttgctgtcctaaaaagtcccctgttcttcatttatttgaccccaccctcacccccaaaacccctggcaaccattgatctgtttaccgtctctatagttttgtcttatccagaatgttgtgtaattggaatcatataataaatagccttttcagatggacttccttcactcagcaatatgcatttaagattcattcatgtattttcatggcttgataactaatttttctaattgcttaatattttattatatggatgtatcacagtttattcatctgttgaaatatatcttggttgcttccagtttttggtgattttaacgctgctataaacttttctgtgcaggtttttatgtgtacaaaaattatttttcttgccatattttttagaggtgggatctccctctgtcacccaggctggagtgcagtgacaagatcacacctcactgcagccttgaactcctgggctcaagtaaccatccctccccagcctcccaagtagctaggactatgggcatgtgccactacttttatcttattttatttttatttttatttaattttattttattattattattatcattatttttaattgatcattcttgggtgtttctcgcagagggggatttggcagggtcacaggacaatagtggagggaaggtcagc

SEQ ID NO: 3420 - DNA, 1058 bp, Homo sapiens
aaactgagaggaaacgaggtgagcagaggacttcctcggtgcttgtttctccttcattgcagccatcacaaggtgcgatcgaagcgcctgatggtgctgatagtttgcatcttccttgggcttatctcagagttcactatcactagagtttccatgacattctgggctatggtgctgggacgggtgagagtttaagagcacctcatctccttgccccttcacaagagactgccagaatccagacaattggcggaggacaaggccaatggcagcagaaagaggtgggtgctgtgttctcagccagtacaccagagccaggccatgcaggcacttcattcccttagtcttctatgacaagtcaggccagctagctctgaagccagttagctgccccgactgagaaatgtgcagggatctcaatctttcatttcctttcaaaaaacagagactagccatatgctggtgaggaattattgttacggtttcggttttatttttattttaaaataatttgaaagctgaacatggtggcgcgtacctgtagtcccagccacttgagaggctgaggtggaaggcttgagcccaggagtttgagggtgatgtgcactatgattgatcctgtgaattagttgctgcactccagcctaggcaacatagtgagactgtctctaaaataaataaataaatagttttaaaaattttgtcagccaggcgtggtgactcatgcctgtaatcccagcactgtgggaagctgaggcgggcggatcacctgaggtcaggagttcgagaccagcctggccaacatggcgaaactccgtcactactaaaaatacaaaaattagatgggcgtggtggcaggtgcctgtaatcccatgtactctggaggctgaggtaggagaattgcttgaacccaggaggcagaggttgcagtgagccgagatcgtgccattgcattccagcctgggagacggagcaagactccatctcgaaaaaaaaaaaaatttttctcttaaaatacctacagtaagtggggtgacactattaattgctaagttgct

SEQ ID NO: 3421 - DNA, 1082 bp, Homo sapiens
tttgtgtgttttagtagaggtggggtttcactttgttgcccgggctggtctccacctcctgagctcaggcaatccacccacctcagcttcccaaagtgctaggattacaggcgtgagccaccgcacccggccgcagtgattttttttttttttttaacttagagggttttacttataaatttattatgttagttattccattggtttagatttatgatttttttttaactgtacaaaagctaagaaagagccctctgaaattgccaccggaaatcgccatttaggtgattggtcgcactttattaatattctttttttttttttttttttttgagatggagtttcgctcttgttgcccagactggagtgcaatagcacgatctcggcccactgcaacctccacctcccgggttcaagcgattctcctgcctcagcctcccaagtagcagggattacaggcatgcaccaccatgcccagttaattttgcatttttattagagatggggtttctccatgttggtcaggttggtctcgaactcccaacctcaggtgatctgcccaccttagcctcccaaagtgttgggattacaggcgtgagccaccgcgcccagccttttttttttttttttttttttttttttttttttttgacagtctcgctctgtcacccaggctgaattcttggttagattcttgaagggctttggcaaagaacatgacagggtactgccctgtcacatagtaagcacataacttctccagtccttcctgatgtgcatattacctgggcttgaagacttcagctaatgtttttttttgtttgttttgttttgttttgttttgtttttttgagacggagtttcgctcttgttgcccaggctggagtgcagcggtgcgatctcggctcacccaacctccacctcctgggttcaagtgattctcctgcctcagcctcctgagtagcagggattacaggcatgcaccaccacacctggctaattttgtatttgtagtagagatggggtttctccatgttggtcaggctggtctcgaactcccaacctcaggtgatctgcccgcc

SEQ ID NO: 3422 - DNA, 2040 bp, Homo sapiens
ccattattattgtgtgggagtctaagtctctttgtaggtctctgaggacttgctttatgaatctgggtgctcctgtattgtgtgcatattttttttttttttttttgagaaggagtctcactctgtcgcccaggctggagtgcagtggcgggatcagagctcactgcatcctcaaactcctgggctcaagcagtcctcctaactcagcctcctaaagagctgggatcacaggtgcacacctccatgcctagccaatttgtaaatgttttgtagagatgagatcccattgtgttgcccaggctgatgtcaaactcctggcctcaagtgattctcccaccccagcctccaaaagtgatgggattacaggcgtgagccaccacacccagccaggaaatattttagagtcagaatagatgagactgttttctgttgttctataatagcctcagatgagtaattaggcaagtgatgtaaaacctttgactcttttctttgggatcaggtagagcctgctgataaggagttctgatatgaaggcaagattttcctttattctgtaagaaagaaccttatccttggaagtaaggggtcagcaaaagttacaggaaaacaggaaatttcccttcttattctgcactacttttttctgacttttcatttatggacctgctttaggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaagtaagtctcagcactaccactttctccccattccccattttggaaacagatacagagtttagtaggctaacacttcttggttttgttttgtttttttcttttttagcctattccctactggctgtataagcttcatggcctaaatatcaactacaactgtgagatttgtggaaactacacctaccgagggcccaaagccttccagcgacactttgctgtaaggaattcagagccatttttcctgggaattgaagtaaaaacatgagacttttagagaaaagagtaggagcagcctatgtggaccactggtgtccagagctgaagggaatcagagaaggatggttttaaaatcaagcccatggcatttgacttttggcaccaatgttagtcttaaatacctgagatagtttctggaggaattctaccgcaccactctttgaaccttatttggttttctcttgcctgctcttaaacttctctgtttttgtctttctgctagcattttagaccaatttctgacttcttggttatttctctaccccattgctaatactcaagataaaaaatagggctgactgatctctttcagatcttaaatggatctttgcctcttgagaaaataaaaaatgaaggggctgatatttatcaagccattcttgagacagggtattgtccggatgatactgctgtaagtgggctcacctctaagtgggctctacttagagttcttagattttggaaggaaattttacagaaaggaaaacatttatgctagaccaaggatgacaaatttatatgaactcctctccccctctctgagtcatacatattactaattgataatgggtcttttttgctgagcccatgagtgagttctgaatccttctcagcacctcctacaatgattggagttggcatccaggataaagcccatgccatttaccatcccttagttaaaactgccatcatgtcagtgtataatctccctgctctctcctcaccacatcattgtgcctaataaaagtcttctcctttacctacaaagatgatgctgacctgccattagtaacccctattcatgcaggtgtttggagttgctggggctttggtaagttctcctgcaatatgggagatgtagtgagagttgtgatgtttttctgtgatcttgacccagaggttttatgtataagactactgggt

SEQ ID NO: 3423 - DNA, 1017 bp, Homo sapiens
cttctctgggtttggacagattgaaatctgctctcttagctttaggcttgaaatgtggcgggtaaggaatagtttttctatcaaaactatcgatttactgtgtgtttgcacagtcttctaagtagctctgattccattttttttgttgctccacactgcaaaaataagccagcctgtgtggtaaagtaaccctaaaatcctttgccgtcctgtctccttaggaccctagaagagcgagcccagagactattcagtaccaaaggaaagtccctggagtcacttgatacctctttgtttgccaaaaatcccaagtcaaagggcaccaagcggtgagtggctggggtagcactgctgcttgtggcttttaaatgttattcccatgcagaatttttaaccacagtggagactttaaagcctgctttatctccgttattggttgacagagatccagtctgctctttatctctgctaatagcagagagtactatcactgttaatataaaccaaggaccgtctgtattcatctgattgagagcacatcaagtttctaaatttgaaaccatattcatggcacctttaataggttatggaggctaaaaggctaaataggttcaaaacctatttttctaagcttatttttggtaaagttgaatctaattcttgagctacatacttatacaaggtattttcttttttctttttttttttttttgagacagtctcactctgttgcccaagctggagtgcagtggtgcaatctcagctcactggaacgtccacctcctgggttcaaaagattttcctgcctcagcctcctgagtagctgggactacaggcacgcaccaccacacatggctgattttttgtatttttagtagagatggggtttcatcatgttagccaggctggtctgcaactcctgagcttaagtgatccacctgccttggcctcccaaagtgctgcgattataggcgcgagccaccgtgcccgacccagggttgttttttttgtttgttt

SEQ ID NO: 3424 - DNA, 1034 bp, Homo sapiens
ctgaggcaggagaatcgcttgaacccatgaggtggaggttgtggtgagccgagatcatgccattgcactccagcctgggcaacaagagccaaactccgtctcaaaaaaaaaaaaaatagcttatcacaagagatgaggtttaatatgacaatctcaaaaggatcacaaggaaatccatgattagattcctcatggaattgtgaagaaatgtcccagagttgtagtgaccaaacttcaagttccatgcaggcaagtcagatcccttgtctgttttgttgttttctgtaccccgtacttggtacaaagatgcttaataagtagttacttgcgtgaacaaatggcacctttgagcaccttgttttagggtgtcagagtctttaaccaagaccctagcatgaggtaataatcgacaaacgtttcttttagtttaatgttcattaacttgatctttattttgtaaagttattatgtctgatattttccttcagtccagtgaaattaacactccagttgtagtaggattgaatgataggcaagcaaaaaaaaccaaaattagccagcccttgttacttctttagaaaacactcaattttgatctcacttattggagattatattgtaacttgttacagtataaatacctaactgaatttcttgtcatttctttcctcttttcagaagctggattatatcacatacctgtccatctttgaccaattatttgacattcctaaagaaaggaagaatgcagagtataagaggtaggcattaatagtttctaggcctctcctggatttgattagaagataatgtgaagtttttgagggtgaagttctgaatttgttgcctggaaggcatacatgaaggcatacttccaggtttattggaggatggggttatgaatgatgtggttttaaaacctttgcgatagtctggacgtggacaaaggtgtgtctgtgggcacatcttccatcttatgcccatagtgttcttaattttgtctcattatagaaggaactctcccactctgggat

SEQ ID NO: 3425 - DNA, 1028 bp, Homo sapiens
tgtagctcatgtggctcttggggcatggtggccaaggctcccccaggtctctgaacaaggactagctgatgtgcctgagaattgtccacctcaagacctaaagattatctaattgaactgccaagcccttgctacaatgccttagttatatgatcttttgtcttctgcttgaacatctagcagatattttttaagccccttatatgtgttgggtactgcaccagttatagggatgccatggtgacaagacaggtgtttcctgccttttctcagctcatgctctagtgtggaagacagacaatgaaacaagtaattacagtattgtggagagtatacaacaatgggggcaagtacagactactcagggacacacagcaaagcattgaaactagcctggatgggggccatcagggaaggcttcctggaggaggtgaggttggagatgatttctaaagaaagaataggtgtgtgttaggcaaagaaggggtagaggactgttctaggcaaaacctgaagtgagagacaatggagagctcctttcaagacagcccattctatctttgcatacacttgacttgcctaaggtcatacacctaggaagtaaggtggtctggttccatagatgatgctcctagcttccactctgttccctttcttctcttggacattatggctggatgtgatgcttggaactgctgccactgtcttggcaccatgagaacagccagcctgagggcagagctaatttcctgaggatgcagagtggagagacagaaagagtctgagttcttgatgacattgtgcagcttctgaatcagccagccctagagtcaagtgcacctctacttcttttttttttgagacggagtctcactctgtcgcccaggctggagtgcagtggtgcaatctcggctcactgcaaattctgcttcctgggttcatgccattctcctgcctcagcctcctgagtagctgggactacaggcgcccaccaccacgcctggctaattttttgtattttttagtag

SEQ ID NO: 3426 - DNA, 1019 bp, Homo sapiens
aacactgcctctcagatttcagttttggacattgcacaactaagaccttttaaatgcatttgcttgctaactcggaagacacatagtctgcagcaagacattcctatattgaagaaatgagagaaaattttatgctgcatcaggtggagagcaaggctcaacggtggttgcattagttccctcggaagtattgaaaaaactttgaaatggaagaaaatttttgcacctatgttctgagtaccagatgtctgggttctttcttctgcattagataaatgatcatgctcagtgtaacaaagggaattaaaagttttcccacagtccccttctaggggagaaactcattgtgtcactgaaatgtttagcttactttaatcttgatatcagcctctacagaccttttattctaagctatcgagcttcttgattgcatttggttgaccacgagtgaccctaaggcattgggggactgtccactgggagttggagtgagcacgtggtgctgcaacaggcattgttttacatactttgtctctagtattctgacaccaagtgtcaactgtggtactttctttgcctaggatatgaattcataattgttgcttttgttgatggttgataccctttccattgatttaaacctaacacattatttctattccacatgcccagtagacatatattccaaagccactggaccacttgagtacataagtgccactgtttaatgcaatatgtatattcaggtctgtaaagctaacagtgtgacttggagtgcttcctgcaggtgattctgacttgagtatttacatggaccatggtgatatccaaaagaaaaatgctttttatatttatagattatttcattgaactatatatgaaatgggtatcaataaatgtatttactccaaaatcagcgtttctccttgcctgaggtatggagggtggtggcggaacgttgggttgtcccactttgccgttttctcatccatttctttttcttttgctgcttcctgtgg

SEQ ID NO: 3427 - DNA, 1058 bp, Homo sapiens
aaaaaaaagacttttatttagtactagcagtcctatggatgaagctccttttcatttccagtttctagaaactcagtttactaaaatgccctgtgacttgcaggttctccctgtccccatttacctcaagcctcaaaggtgcgggacattctttctttgctcaccttttggcctacaggaaacactaaaatattcctttctccctagtatctatggggtcatcttggccttacctgttccagtgctcttacatctagattagacccctgtcttgctagattaggttcttaggtcagctccttgaaagtatttttttttttttttttgagatggagtttcactcttgttgcccaggctggagtgcaatgatgccatctcggctcaccgcaacctctgcctccctggttcaagcgattctcctgcctgagcctcccaagtagctgggattacaggcatgcgccaccacgcctggctaattttttgtatttttagtagacatggggtttctccatgttggtccggctgatctcgaactcccgacctcaagtggtccacctgccttggcctcccaaagtgctgggattacaggcgtgagccatcgcgcccagctgaaagtatctttaaattacctataaagttctgtgtctctgatgttatatatacgtataaatgtgtggtggatgcgactatataatgaagattgtactccctgagttataaagcagatagaattgttgacagtgtttaaattgttaaaggcttccctctcaaatacgtgttttattgaatctacatgtgttacttctccaccgtaagtccttttaggcctccagactcctgtagattcctccattctctgtagagtcccgactcccatcctgtttaatatgctctttacataaattgtaaacaccaattgtattcatttgtttattcagcagatacttatgagcactgttcagggaagtgggcttgctgctaggagcgagactgacaaagtctctttcccctggaacttaacattttcagtgacacagctcagaagcacctaaatgaat

SEQ ID NO: 3428 - DNA, 1060 bp, Homo sapiens
ggtttctataaaaaatttaaaaattagctgggtatggtggcgtgtgcctgtcatcccagcaactcgggctgaagtgggaggattgcttgagcccagcaggttgaggctgcagtgagccatgacactgccactgcactccagcctgggcgacaaagcaagaccatgtatgtctttaaaaaaaaaaaaaaaaaggcagccaggacctgatgccaggtcgacttggctccaaaacctgccctctccttttcacagcctcctttcctgtgaaataatagggaatttctctaaagcgcatcgcccggtccctatgtaaagacaaagaaacaggactttgcacgctcacctggcattagggccagcactgtgctgcagttgtgaagatggccactgggttgggggttgttctgcaccaaatggccccagactccctgtcagtggctacttgttgcagccagtgggcctgagctgaccacccttatttatgctcctgatgtgcagccttgaatgcatcctgggctgtgggaggcaaccaggccagaagatgaccttgatagctgagcactgacccttcatcagctgtgtgtccttacgacctcctccctttctgaggccttctgtatgtgatgtcatttggtgggtggctaaagttgctagaagtctggccaccaggaaggccacgactgtcacactttgtgctttgctgcataaaaagggagtctcatcatgatcctcaggcctgctgtgcacacctgatgggcatagcagcgtttgcgtcttgaaaacattcatttcacaaactcctagcacacccaaaccatgccaggttacacactgggcactgaagagaccacacatttgtcagtttccgaaactctactgcccagtattggaagaagagagctgttaaatcaggtcctgcaatggcagataggccccaagtcctatggcagcagggggctcaggccatgtctcaagctctgggagaaggtcatgggggcagatgggttctctgggttggaagagcctttggaattaaagagtcctatgtcctcatgttgca

SEQ ID NO: 3429 - DNA, 1131 bp, Homo sapiens
tgtagagatggggctctcacttcgttccccaggctggtcccaaactcctagcctcaagtgatccacccgcctcagcctcccaaagtactgggattacaggcgtgagccactgcgcccggccttttctttcattctataggttgtcttttcacttttttgatggcgtcgtttgaagcacaaaatattttaattttgataaagtctaatttatctttttttgtcacttgtacttttggtgtagtgattatgaagatttactcctacactttctattaagtattttatggttttctctcttacactgaagtctttactccatttgaagttaatttttgtgtatagtgtgaggaaagtggtccagcgttactcttttacatgtggattttcagtcgtcctagcaccatttgttgaaaaggctagtttttttcctgtttaattgtcttggtatccttggtgaatatagttgaccataaatgtaagggtttcttctggattctaaattatattttgttgatctgtatgtctgttattaggccattactactgtgtcttaaattccatagctttgtagtaaatttttaattctggaaatgcgagtcctccaactttgtttttcctttcaagattgttttggttatcctgagtctcttacatttcttaagaattttgggataagcttatcaactcgtatgaaaaaagccagctaggattttaatacagattgcactgaatgtgaagaatttaggagtatcatcatcttaacaatattaagtcttctgatccatgaacacaggatatcttttcatttgtttaggtcttcttcagtgtttttcagtaatgttctttggttttcttttttttttttttttaattgggatggggtcttgctatgttatctaggctggtctcgaactccagggctcaagcaatcctgccaccttgtcctcccaaaatgctgggattatagatgtaagccaccatgcctagcgagtcagaattctttaaatattttagatacaggtctcttatcagatgtataatttgcaaatagtttctctcattcttttttttttttttttagacagggtctcactgtattgcccaggctggagtgcagtggtgcaatcacag

SEQ ID NO: 3430 - DNA, 1083 bp, Homo sapiens
ggtcacagctactcgagaggctgaggtgggagaatcgcttgagcctgggaggttgaggctgcagtgagctatgattgggccacagcactccagcctggatgacagagtgagatcatgtctcaaaaaacaaacaaaaagagtagaataggacatggtcctcatatgaagggcgtacccagtctagaggcccagccatgaagaggggggtttcttattgccacaacgagatgtagctccttatcctacgccccctagtcccctggcaaacccaggctttttatttgtttgttttgttgttgttgaggcagagtcttgctctgtctcccaagctggagtgctgtgacatgatcttggctcacttgcagcctcaacctcctgggctcaagcaatcctcctgcctcagcctcccaagtagctgggacttatagatacatgccaccacacctggctagttttaaattttttgtagagatgggatttttctctgttgcccaggctggtcttgtattcctggactcaagtgatcctcctgccttggcctgccaaagtgctgggattacaggcgtgagccacggtgcctggccccaggccttttagactgaactcagacatcacctccttcagaaagccttcatgatgagtgtttgtgtgagtatctgtttctctttttcacaaacacttaggtgactctagtgctcccattctatgcacaaatgtctctgtcactgggctttgccattttgtagtgtaattatcttttttttttaacggctttagtaggatattatttacataccatccagtttgcccacttaaagtacacattttaatggtttttaatgtattcacagagttgtgcaaccatcaccacaaataattttagaacattttatcccccaaaaggaaacttcataccctttagcagttgctacttatcctgttggtcccctgccctgggaaacccgaatttactttctgtctttatggattttcccattctaggcatttaatataagtggaatcatacaatatgtaggcttttgtgagtgtcttctttcacttagcataatgttttcaaggttc

SEQ ID NO: 3431 - DNA, 1066 bp, Homo sapiens
tcagaccctgcagcttcagttctcagcttgggaagactgggggcaaacttggatgcccaggtgcagcagaaagtgggatctgctgcccccaggacccctctcgtcatgccttgactgtgactggaggctgcagtgggtatttgggaaagtagttagcaccagaagcctagggatcatctgtacagttggctttggtccaccactaggtctgggcactggggaggggtggagtagctctcctagattcactgaccacctgaagatttctcgcaggtggatgaagctgtagcagttctacaggctcatcatgccaagaaagaagctgcccagaaggtgggcgctgttgctgctgctacctcttagacaaggaaaaaccgtatgtgtggctattttcatttttgttcctatgagcattgttcctatgagcattgtctttgtggtttgacctgaggttgtatatatgctcactgcttagctctgggaatacaataagtacagttagttacacggagtgtgttgcaggtgacttcttatcatgaggactgtggactttgtctgcaggagcttgagtgaataataaaactagtactggttgatggttgtaggtgtctccagatagggaaagaagagacagtaaaataagctaaggaaaaagcacatggtaaggaccagagctggtgtgttgggagggttgacttggcatagtcatgaccctcttgtcaagggcctcaggagccttgtcatctagtggtaaagaccagagatgctgctaaatgttgtacagtacacaggaggacagacccaacagaatgtccaaagtgtcaatagcactgaggttgagaaactctcttctagaataccttcctttatccactatatgttaatgaatctaaattatttgattatgcatttatttgtgttggtgcttttctttacaggattcaaaagccaaataaccccttatggaattcaactcaaggtttgaagacttcctagcttgtcctatggacctcaacaccaaggattacaaattgcaaatttaataggtcattttgtatcaaaaggt

SEQ ID NO: 3432 - DNA, 1028 bp, Homo sapiens
tgttgctgctgctgctccccgggctgttgccccctacaaatacgcctccagtgtccgcagccctcatcctgccatacagcctctgcaggtgaggttcaccagacagaatgcttaaaaggatttcccccatttccacttgatgtaaaagaagctgtgcttttgattccttcaacaggtattaaatgcctgctctgtgttatgacgctatgttctgattcactgtccctgcccttcaggggctcactagtgggaaagaaggggcttaaaagtgctctgcctgatgccagttcactcagaaatgcctcagagcgggcagccagtgcttcctcttctgtttgtacgaaataatgtgctcattcagctgtttgagcctccaggtcacttccgcatccaatgacctattggatccttggctgctctgcaagatgattggtacattaatgcaggaaataacttcaacttacagatcggatgttcagcttcaaagatgtaaagtgtgtgtaggaggtgaaggggttgaacctagagcttagattttctaagctgtaacttgctgtctctagacctgtgctctagatgcaactagtttgtttcagagcctaatagcaatttgctgtggaggtgtcaccctaagccttcaggcccataagctgcttaggagattactctttaactgtcctgtctcatactctctaagttggggatttcctagaacttgatgctatgtaaaataccttttctttgcaaggctttgactagcattgacgttgcatgttgaccgtttttaagcatttgatacaaaaacatttggtagaattaaggtgatgtggaatgtaattataaatgtgttgatatttactccctttgatccaatctgcactgagatttaccctaaaggaaaactaattttcaggaaaaggttatatacaagtgtttacccttatttatatcaaggcttttcattcttgagtaactttgggtgtattaaggaaatgtcagaaaatgcttgcctagcactataggtttgt

SEQ ID NO: 3433 - DNA, 1895 bp, Homo sapiens
gtttggggtctggcctaagaatttcatttctttcttttttttttttttttcttgagacagtctcgctctgtcgcccaggttggagtgcagtggcacaatctcggctcactgcaaactccgcctcccgggttcgcaccattctcctgccttagcctcctgagtagctgggactacaggcacccgccaccatgcctggctaattttttgtatttttagtagagacggggtttcactgtgttagccaggatggtctcgatctcctgaccttgtgattcgcccgcctcggcctcccaaagtgctgggattacaggcgtgagccaccgcgtccggccgagaatttcatttctaacaagttcccaaagatgctggtgctcctggtctggggccacccttggggaaccactttcttagggaatatttgtgatatagaagtgtagttaacagtgatctttttccttcagggggtgaatctctacattaagaacttggatgacactattgatgatgagaaattaaggaaagaattttctccttttggatcaattaccagtgctaaggtattatactgcgatctggggattgaaagcagtggtattccattataggcttattggcatttgtcccattgaaggaatagcatttaaattatgttcatttctgaaagtagctactacgtttttctagcaaaatttctggatgcattctggagaatgacatttcattaggttaacattacactgtttcccaagcactggagtctggagaggaatttgacccagcccctccttgccaactcagagcacctgaatctttcccattccttgctgcctcgtgccggtgtggggacagatggtgctacagaatgagcagaggaaatccagacaggttgttttccatttgtcttggggcctgtctctacagctctgccacattttctccttgagaatgaaggtattttgaagattttggaggtgggcttgggaacttctaccctggtcttaaaaagagaggaaaggggagtggaaggtttttctatgtttcgtagtgtgcatcatttgcttgattttctttgataatcatatcaactaagttagcagggtaagtaggaacctcattttaaagataaggaattttagtccttgaacaagagaatgctgactacatggggatggtgtactgcttgtccttggcactttgggagcaggatggaaactggtgccatctgaacattttgagttatggccggatgcagacgccggtcttgctaaacaggtgtaccagatgccacaaaatcctttagttgatgagaagggaagccacgtgggctggtaagggcttagtggccctgccctggctcttagtggactttgctcccaacctgggaatgtggaaagcaatgttatcagttgtagtagggagttggccagaggccaactgtgggtttgcccagttcttaccctttcgtttttgctatgaccccccccttgactggccctcatcagtgtaaggagtgatcttctatccttgcttatctgcctagtagtcaagttggcatttgttaagagagcagaagagccataccttgaattgtccccattttcattatgatggtgtggcatttttattcacataccttactggcccatctcattggtagagagttatggagtgatgcacttctttacttccctatcctccacttcaggaggctctctgggccattaactaagacataaaacaatgacagtcacaccagagaagacagtgaataaccttgtctattaggaagaatgccatttgtgaatgatgaacttaatgtgggaaaagactgcctgaaccagtagacctgtggttttgtagctgtttggagtatttcttggaaattgagcctcagg

SEQ ID NO: 3434 - DNA, 1217 bp, Homo sapiens
ccctaaacataagtttgttcattttgtaaaatgtataatttcagctgtcccacctgagtcatggtgggtggtagtctgcaaagtctcttctaagtggtaaagcttagtcaaatgtgaggtattatcactggatcttggtgtcattaaggccatttagattatctttacttgtggcccctttatccaacaagggcacagacccagaagggtgtttagacttctgtcatgaagtagagtcattagctggaacttatgcttcccttactaacagtgcaggctggaggaatctgatgcccttttattttaatagagttgccttttatcaagagtgattaccttgaaaagtcctggagtaatctgttcttaggctgttggcctgtgggagctgacgttttctctccttattgaaatgtgtttctctcttacagctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtaaacattgattaaatgattttagcagaataattaattgattcttgaaaacaagataaataccaaacagagaactatcttggaattggggaacaagatatgggaattttcaaaatgctggacatggaatcctaaaagttcccataggtaatctcagggccatacccagcgtaaccagcacacgctttcatacccttgttctttactcagcctgaaatatccttcctattctttagctttggaaagcccacgtttttcttttgggatgggggaaagtagaggaccagagaagtgtctctagtcttgaggaaacttaatcactttagaagcataaattcactctattccttctacgtatctgttctatgctgagcactttaaaacttaaacggtggtggtgtatatgtttaatgccatactacactgaaaatctgttgtggccttggaaaatgttttgttttctgcatcaccgtggtttgcacccagatctcttaaaatgtgttgttgtgttttaaagagacagagtcttgctctgtctgtcacccagggtggagtgcagtggtctagtaatagctcattgtagcttcgacctcct

SEQ ID NO: 3435 - DNA, 1050 bp, Homo sapiens
gggctccccagggagtcacaggacagagctgcaagtggagccaggagggctgccctgggccccaggctgtccccatgggtcagccagtctgcagagtgacactccagtgcccgggctggtgaccaccaccaccccactcaggctgctctgttctctctccgttgtgacctcacttgtcttttcctctgtgccccagctctgttccttgtatttctgctgcttccccataaccttgactcaccgtgaaccaagccctgcccagtggattctctctgggcctccttcccatgttagcatctgcagctcacagcctccctgtctcagcagctcttgtccatgctcgtgagagggagggagcctctcctgccagtgcatttgtttgtggcggatgatgtcacgggtcaaaggttggtctctggattcactggttgttcagtcaagtggccaagggacaccagggctgaggcacagctgcttaagggctgacctttgagtgggactgagggtggggcaggcagtgtccttggcctgtagggtgtactggagaactacgtaggaataaatacatctgtgtgtgtgatgtctgtctgagcgtatgtgcatctgtgtgtttatgcaaacatatgcctgtgtgtacatacgtgtgtacatctgtgcttataacatggaggtgaaatgtactttcgtgtaaactgaacaactggcactgtttaaagagacatgaaaatgagctggtaatcatgcttctgccattcagtatcaggaaatttcacccatgcacggagtgaagaggctccattgcactcccatctttatcatgaaagccgggaaataacctacatgtctatgatgagccaatatcaagtcaattacggtatactgctccaagggattttataaatttgaaatgtttattgtggagacttatttaaacaaccagaaaaagttttgtgttttgttttttttttcttgaaacacactctcattctgtcgcccagctggagtgtggtgacacaatcacacctcactgcagcctcaacctcccaggct

SEQ ID NO: 3436 - DNA, 1021 bp, Homo sapiens
ctcactctgtcgccaggctggagtgcagtggcgtgatctcggctcactgcaactttcgcctcccaggttcaagggattcttctgcctcagcctcctgagtagcggggactacaggcacgcaccaccatgctcagctaatttttttatttttagtagagacggggtttcaccacgttggcctggatggtctcgatctcttgacctcgtgatccgcctgcctcggcctctcaaagtgctgggattacaggcgtgagtcacggcgcccagccaaaaggatagacttctaatcattgtctctagagcatggtatcctgttgataaggagcataactcatagtattatagggaaccaggagtccatgtatacactcgctgggactgtcctcttcacccagggaccaagcaagggaaacatgatccaagaggcagtgtcattgtcaataattatagaagattataggtgagccagaaagcaaccctcttccctaataaaaagatattccggtagggtgtagtggctcacgcctgtaatcccagcactgtgggaagctaaggcgggcagatcacttgaggtcaggagttcgagaccagcctggccaacatggtgaatccctgtctctactataaatacaaaaaaattagccgggtgtggtggcgcatgcctgtaatcccagctactcggaaggctgaggcaggaggcagggatgcctccaagtcccttgaacctgggaggcagaggttgcagtgaaccaagatttagccattgcacccagcctgggcaagagagcaagactccatctcaaaaaaaaaaaaaagaattggtgggggccgggcgcagtggctcacacctgtaatcccagcactttgggaggccgaggcaggtggaccacttggggtcaggagtttgagaccagcctgaccaacaaggtgaaaccccgtctctactaaaaatacaaaaattagctgggcataatggcctgtagtcccagctactcgggaggctgagacaggagaattgctt

SEQ ID NO: 3437 - DNA, 1074 bp, Homo sapiens
tgcttatcctgaggcccatcagccagtctggagatggattcctgaaaggacaggacagttcccatggaaaggatggagtggaggtggagtgattcccagaggagaagggtgagcgggttggtaggaggggagggcacctgggcagacaagcatttgtgtccactgtggagttgctgtctgctagtcagtaagacacttggttttctagcagcagggctgagcttaactaagtccatatgccttctgggtggtacttgccattatcttcatcatgagatatctgtagtagtcattccttagaaatttatggcccagtatggttttaacaaaactacatatcttgttagtatttgccaaaaacatttgaggtcgtttctacaaatgaagaaacagactcacagtatttcagtgacttaacacagggttggtgttagttcagttgtaagggattgaaagccagtttaaactaatttaggtataaaagacgatttgttggcttatggaatctaaaagtcaaacaactgagcttctcctgaaaggacaggcaaggtgcagctgggcctcaggaacaattgctcccaaggactcagacactaccagcactgcctcatctcttctcagcgtgccgatttcacgtttctctccatgcaaaccagctttcttcacgtggtcgtggtcattggaagctgccacacctcacatcttacagcttttcttcactgaaaagaagtggaccaaatcccaagtttaaaagccccaggaaaagacgcaattgagtagagctgaattctgttgtctacccttggattaagaaggacagcgtaccatctaagaacatggccctccctgtagaacagtatgatagaatgaagccagggaacacgagagttttcaggaagagggcagggatgggattggtgctgagtagaccaaataataggtgtccatagcagtgacacagagtaggtggcagatgagagaactccaggtcctctgactacaaccctgactagcgcaccgtaactaccgagtacttcccatgcaaaaggaaggccctatctctgcaagaaccgt

SEQ ID NO: 3438 - DNA, 1031 bp, Homo sapiens
aggttcatctgcttctgtcagtaaaaatcttgattaggctttagatacttctcacagttcaggcagtgctgttgtaagtgggtagaaagtactttgattctgaagagagatctagacttgaaaatactttgcttgattcttagggctaagcaagagaacagctcatctgtattccaggaatatggcttgatccttcctaactctcagtaattttttgtcctctcttagctctctttagttccaaagaggatttttttgcttaaaacaaaacaaaacacccagtataacattaaaaaataacagtccgggagtggtggctcacgcctgtaatcccaacgctttgggtaactgaggcagaaggatcactcaagcctaggagtttgagaccagcctaggcaacatggtgagacccagtcagcacaaatatatacatacatacatacttacatatatatatatgtatgcatgccgggtatggtgggtcatgcctatagtcccagctacgtggaaggctcaggtaggaggatggcttgggcctgggagattgaggcttcagtgaaacatgatcatgccactgcattccagcctgggtggcagagcaagaccatgttgctcaaaaagaaaataaaactaacaaccccctcccccaaacacacatgcatgaaatcaaccttttatgaatgcagtgacttgtcaatatccctagcacctagacacagtcaaatatttgttgaatcaattgcatgaaagcataaaaactaagtaggtctctacataagtgatctgcttcaattgttaaatactttttaaccaggatgaagaaattttgggatagccaccagcaggaatttctgtatttgattatcacctacttgggcagttaaggctgttttctaaaatgatggctaactggttatttgtaaagctactctgaatgcttacaaaggaagctgcatgtttgtattagttcaggtaaaaggctaagttgctataacaaagagactcaacaatacagtggcttaaagaacaaa

SEQ ID NO: 3439 - DNA, 1599 bp, Homo sapiens
tgaagaaccaggccttcttttccatagaataaagcagaagggctggctgctttttaatacctggagactgcttttctacttttacattcagaaaggttgttgctaaaatctgtatacagcccatctgctctctgggttgagaaaaaggaattttaggaaaatcccatttcccttaatagagaattatatccagatctctttgaattgaatactcccttccacccttgttcttttagggccacaagcctacagccactccaataaagatgccatacaatgaagctgagaacaagagaagttatcacctgtgtgacctctgtgatcgaatcatcattggggatcgcgaatgggcaggtagagtatggggaggggcatgaagaaatctataagggtgggttcacattgacttcatgaaatttagagtctttggcagattgaacctggagtctatttatttgtaaagggacagctagattcctctaagagcctgtgctcaaattccttggaggcttctgggaatttgtctctgtattctgagattcagaggaagatcagatgctctccatcttcagctggaattaatattttatactaagagatctgcagttaactttctagagctcctttgactttgtggtcctggcttggaggagtttcttggcctttcatgtttataattcagtgggggtgggatcaggaagtaagggtgtaagggaagccaggcagctcatccaggagactggaagaagcagaagcatagctgggagggggcaggaagtagagttactactcctgagtgtggtttttaaaagtggtatctcttcagtaacttttgaggtaattgttggcatagtggtagttgctaaaactgtgataaaaagaagttaagagaaactgtgtgaaagtaagcctgtcacacatgtataaagaaggttagttccccaccacctcagggccagccccaccctaaggctctatccctgcattagagcctggatctgcctctgccacagagtcacactgcacacacatcattggattttcagatttctgtagtcatccagtcaaagcccaggacttcttccccaagccttgagtttacatggtatttagaaataggtgtaaggtttgctgctttcaggcacagtggggcttgtcgtttactcagcagctgggatccttctgttcagagtactgttttgcatgggattctcagagaagtagatttttctccccaaagcaaccaataggatgattaggtctattaactggtaactggcaaaatgaactccattgtcagagactggggacggctgtgattgcccaaccagcagaagaagcctcgattgtcattggtttataatgatgaaaggggaagagaaagagagtgtctgattgtttttttctaaaggaaacttagtggttcgatttgttgaatgttcttcagggatagccttagagaagcaacatgtgtgagcctttgtgagcttagcttgtgtaagcccttctgtagtgccatctgtcaagtccttactcccatctcctgctgccatggagagccagcccagaagcccgttttttgccttaggctctagctgg

SEQ ID NO: 3440 - DNA, 1068 bp, Homo sapiens
ctgatttttagcttcagttttgtacctgaagagcagtcagatttctgtagggaagatttcctaattacagtgtttttggggggccagatgagttgtataaaaagacaccttcaccatttctcccagcgtctccacatggtgcttcagattgcttcaaatgaaactttagttgaacagcatttttgagggaaaagaaaggaaattctcattgatttggccctgtactgtgtctttggcactaaatttggtgttatacatatattattgagtcttcaaggtaggtgttattcttttatttttacagataagaaaatgaaggcctagtgaagttaaataacttgccaaaaatcacccagctagtcggcagtagataactgaatgcaggcctgacacagagtccacactcctttatactactcttacttcctttagctgtaactttagcaagacagcattagtattggaccatgggtaaaaactatgtggttatgagctaaaggagattaatttaagcataagtgaaacttcagttttatcttgtggacatgttttaaatatgcttctgaatcatcttgtgtttaccttttgctggtagacttctgctctcaattacagacagggccagctgaagcctctgccccactcggtgcctctgaaaatacataccttgatccctgctgttgaccactaaactgctaacattctttctcccagctcccactctctgcctgagctctccagtggagttctggtgtgaagaggcttgttgtgctttcctctacttatcctgttttctctgcatgtcctggtagatagaagtcttagtgtcatctgaagttgaagctcagtgctgtattacaaatttctaatgcagcttctcttatccccatgtctgacaataagcctttaacagaagacttttgggtaataatttagaacttcttcctgtagtaaaaccacaataattcctccatctctgtggtaggaggagttgatggcacagtgtgtcatatgcctgttcctcattcgtgtgtatgccggcatcgtcctggtgctggagtgaaaggc

SEQ ID NO: 3441 - DNA, 1053 bp, Homo sapiens
aatactccaaaatctgaaacttttggagtgctgagatgatgctcaaaggaaatgctcattggagcatttcagttttcagattttcaggtttgggatgctcaaccagtaagtataatgcaaataattcaaaatctgaaacatttccttggtcccaagtattttggataagggatatttaacttgtgtataattgacattttatcttactgtggaaattgtatgctccctatacttaatttaaagggggaaatagagaatttgttttctctttttaaagcaaacagtgttttttctttatgatccttgattggtaacatctttcttcccaccctgccttagccgcttaagggttagtgggattctagtagaaaagaggtggtctgtctctatgcctgcagattggctggcaaggagaaatgtgtaaatgattatttacctggatattgaaagtcttttaaaaaaagttattttcggccaggcacgatggctatcgcctgtaacctcagcactttgggatgctgcagtggatggattgcttgagctcaggagttcaagatcagcctgggcaagtaacatcgtgaaaccttacctctacaaaaaatacaaaaattagccagatgtggtggcatgtgcttgtagtcccagctacttggtggcgggagctgaggtgggaggatgactcgagccctgggaggttgaggctgcagtgaactgttttcgcgccactacactccagtcttggtgacagagtgagaccctgtctcaaaaaaaaaaattattctcaggagcaaaggccgccttaaagcagataattatctgttcaacggagattctaaagagaaaaatttaaagtagcagagatgaaaaaacaatagtggctatagtaaattgagtgcttactattttttaggcattgtgataggggatttctatgaattgtcacatttaaggctcatggggatttttacaggtgagaaaactgaaactcagacaggctgagtaattgtccaagagctgaacctggaaattgaagtctatttatcttcagaacct

SEQ ID NO: 3442 - DNA, 1026 bp, Homo sapiens
aggcacaaattaaatgagttaaaaaggcagagttgatgctttccttatggctcttatttacattattttttatttatatgctgttttactgtttaccgattttatttcattgaagatagcttatatccttgcttggtaaatgacctcagtcactaagagcatagagccttctgagtattaaacagtaacactaaaattatttccctttctcctttagttattgtgatagtagtagtgataatgatagcaattaggtaatagtgaccctcaatgtggcccttaaaatgtgccaggcaaaaactaagtgctttttagtagtaactcatttaatccccacaacaaccctatgaggtagatattattattttcattttactgatgagagattgaggcccagagaggttagtaactgacttcttcaactacgaataactagtaagtggtagagctaggaaatgagctgaggcagcctggcgccagggtctttcctcctaaccattacactgtactgtacttatttgacacccgtgtaagtaaagggaaacgtgagataaaaatgcttttaacatctttgtgggctctacggaacttattatttgttcattcagtgctccctgtagaatcagtgattacagagaacatttaatctcaaagtattcatccctattttcaaactggtattttcagatctgttcttggagaccttgcatttagaaaaagtacacttgaactttttagtcgaattggcagatcaagagctcacagacaggatattgcctttgagtatttagattgtccttgctgacccctgaagcagtaattttgatagatcacaatgtttccactagagtacagcagtattaggggttctgacttcaaagtgtgtatgtgtatgttttatatgtatttttgtagactccttctccacaaatggaaccaatcttacacaaattctgaaaaccttttagagctatttaaatccaagaaatacctaagcattttgaagtagaactatgagcaatgaat

SEQ ID NO: 3443 - DNA, 1088 bp, Homo sapiens
tgtggcatttagagcatggatgtgacctaaacctctggaccaaatgtgatacttacaaaattgattaatttctaagtttgtttagatatttatgcctggtacaaatgtgaaaaatgttgtgtttttgcttcttaactgtgcagtatgattttatttgataaataaaggatacccataaaaacacataattaataactgtacagctcaatacaataataaaaagttaaaatatctgtgtaaccacaactcaactgaatttcaattcaagaaacggaatatcacaagaaatagaacattaccagctcttaataattttgaaaattttatttcattgctgctattcactagtttcttattgtgcctaaaagctatcatccaagtctttttttttttttttttaaattgtgatataacattgaccattaaccatttcggtggccattttagccatttcagtatttcagtggcattaagtacaatagcattgttctgcaaccattactaccttccatctcaataggtttttattttcttaaaatgaaactctgtaccagttaaacaataaatccctattttcccctctccccagctcctcgtaactaatattctactttgtgtctctatgaatttgactactctaggtacttcatatacatgagatcgtacagtgtttgtccttttgtgattggcttatttaacttagcatagtatgttcaaggttatccatgttgtaggatgtgtgataatttcatgcctttctttttttctttttcttttttttttttttttgagacagagccttgctctcttgcccaggctggagcgcagtggtgcgatctcagctcactgcaacctctgcctcctaggttcaagcaattcttctgtctcagcctcctgagtagctgggattacaggtgcctgctaccacgcctggctaatttttatatttttagtagagatagggtttcaccatattggtcaggctggtctcgaactcctgacctcaggtgatccatccacctcagtctcccaaagtgctgggattataggcacgacccaccgcccggccaacttcctgcctttcttaa

SEQ ID NO: 3444 - DNA, 1065 bp, Homo sapiens
ctatcctgggttcccagatattctggttattttaaaaaatttgcatacagtggccagctgcagtggttcacacctctaatccaagcactttgggatgccaaggagggaagattgcttgagcctagaagtttgagatcagcttgggtaacatagtgagagcccatctctacaaaaaaaaaaaaaaaaaaaaaaattagtcaggcctggtagcacatacctgtagtcccaatttctcctggctcaagcaggaggatggcttgagccagggaggtcaaggctgcagtgagtcatgatggtgccactgcactctagcctggacaacaaagcaagactctgtcccaaaaaaacatttttaaaaattttttgcatacatatagtaaagtgtactctttatgatgtttagttctatgggttttgacagatgcatagagtcagatatataccccacagtaccatactgaacagttctatcaccctaaaaaatcccttatagtggcccctttgtagtcaacccctctatctccttcaatctctggcaacaacttacctgttttccatccctattgttttgccttttccagaatgtcttaaaatgtaatcatacaatatgtagcctttgaggtttggcttttttcacttagcaaaatacatttttttaaaaggtagattgattgattgattggagacagggtctcattctgttgcccagggtggggtgcagtggcgccatctcggctcactgcagcctcaacttcctgggctcaagcaatcctcctacctcagcaccccaagtagctgggactataggcctgtgccaccacacctggctcatttttgtattttttgtagagacggtttcaccacgttgcccaggctggtctggaactcctgagctcaagcaatccacctgcctcaggctccgattataggcgtgagccactgcacctggccagcaaaatacgtttaaaattcttccatgttgttgcatgcgtccaatgctctttattgctgagtagtattccactgtttggatgtaccatagtttgtctagtcaccttttttttt

SEQ ID NO: 3445 - DNA, 1053 bp, Homo sapiens
ctgggattacaggtgtgagccaccatgcctgaccttttttttttttttttttttttgagatggagtttcgctattgtggcccaggctggagtgcaatgacaccatcttggctcactgcaacctccacttcccaggttaagtgattctcctgcctcagcctccctagtagctgggactacaggcatgtaccactgcacctggctaattttgtattattagtagagtcggggtttcaccatgttggccaggctggtctggaattcctgacctcaggtgatccgcctgccttggcctcccaaaatgctggaattacaggtgtgagacactgcgcctggcactgctgtaactttgaactcctgagttcaagcagtcctcctgtctcaagtagctgggactataggcatggaacactgtgctggtgataaatatatatatatatatatttaaaatcctcacaatagtctcataaaatggatattatcacttcacagttaagaaaataggcctaaggtcttagaataagtagcagacctggagtctgaacatgaaagtgtctgctttccatccccagtggcatatctgctacacaaagccatttcctttaagatgaccaggggctgtggggttcaatcagtagggagttttttgtttgtttgtttgtttgtttgttttaagatggagtctcgctctgtcacccaggctcatgatcttggctcactgcaacctctgcctcccatgttcaagcgattctcctgcctcagcctcccgagtagctgggactataagcgtgtgccaccacgcctggctaattttttgtatttttaatagagacggggtttcactgtgttagctaggatggtctcgatctcttgacctcgggatccgccagcctcggcctcccaaaatgctgagattacaggcatgagccactgcgccaggccaggagtttttaacttgtatgccagttatccttcttaggagtgtgcaacattttgatcaggaaaaagatgtattttaggattcatattgtaaatcacagtgttaattcatagt

SEQ ID NO: 3446 - DNA, 1380 bp, Homo sapiens
tgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctcagtacgttgccctctgtgctatcatcttatcatcaattattagacaaatcccactggcctacagtcttgcttctgcagcacccactttgtctcctcaggtagtgatgaattagttgctgtcacaaaaggagggaagtagcacccaaattaagttgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttatccttggtgttttcagtattttttgcat

SEQ ID NO: 3447 - DNA, 1029 bp, Homo sapiens
aaggttcttgcattcatgaaatatatatatatacacacacacatgtgcacatatatgcacatacatacatagacatatatatacacatatgcacctatatacacacatacatagacatatatagacatatatatacacacatatgcacttatatacacatatatacacacacacatatatatatatacacgataaaatggaggatagctgggcacatggtggtgtacacctgtagtccctgctacttgggaggctgaggctggaggatcatttgaagccaggagttcaagacactgtggtgtgctgtaattgtgcctgtgaatagccattgcactttagtctaggcaacatagcaagacccaatctcttggaaaaaaacaacaggatactgttcgaaggacacactagtggttgtagtgcttaaaggagtgggctctggggccaaactgcctgtgtctgaatcctggcttataccttattgtctaaccttggacaaggtatttaacctcatttttacagttttctatctgtgatatagggcaaataatgaaatctactccacagggtggttgtgaggattaaattaattattgccaatattttgcttagaactatttgtgttactcaaaacaatgttattgatgaggatgctaaggatgaagtataactgggggaggggaaggaaatgggggtgggtactatttgagataaggtggtcagatgtgacttgtgtaggaccaagacctgagagctgaaaatgcgtccagccatgtgatgcaacacatcctccagggatgagcaggtaaaaagatccttaggcaggaaagagtgtagcagcaccaggaggaagctggtgatagtattagttctctgcgctttattttcatgaggaataagtgaatgaaatcagagtttggtcctgttcattttgtttctcacagtgccttgtgcatagtgggtattcgatacatcattattgaaggagtggatatttgtcatctaccactgtaggtgtttttggactccctc

SEQ ID NO: 3448 - DNA, 1027 bp, Homo sapiens
aaacattttcacaactttatgacagacaataatttctgagaatataaaaagcactgaccctaaaataaaattaaaaagatatattggatatcataaatattaattttattccctttttgaaatataccatttaagactcataacaagatgacaataacaagacaactgaagtaaaaagatttgaacagacaatcacaagaggagatatacataagcacatgaaaggatactcatcatcattagccatcaggaaactgcatatccacagaatgcctaaaattaatgactggcaatattaagtgttggcaagtatatggagcagcatttttgatggaaatataaaattgtgcaacaattttgggaaaggattgacaatttcttataatggtaaacatgtacttgtcacatgacccagaagttccactcctaggtgtttattagaaaaatgaaaacatatttctgcacaaagacaagaatgtttatggcagcttctttataaatcatatagtcaagatttataaagaactcatacaactcaatagcaagaaaacatataacccttcattcacaatagccccaaattggaaacaatacaaatgtctaatacatctgttagggttcaatcagaatatagaaaccacacagtaatttgaagaaaattttaatataaaaattattaacaggattttcacaagcaatagaatgaaactggacctttatcttacaccaggcaaaaaattcaactcaaaatgagtaaaagccctaaatgtaagatctgaaaccgtaaaactcctagaagaaaacataagagaaagtctccttgacattagtcttggcagtgatttcttggatgtcacaccaaaagctcaggctacaaaagcaaaaacaaataaatgggactatttaaaactgaaagccttctgcacagcaaagtaaacaatcaacaaaaggaaatgacaacctacagattgagaaaaatatttggaaaccacatatcatataaagggttaatatccaagctttataa

SEQ ID NO: 3449 - DNA, 1024 bp, Homo sapiens
cctagattggcttggggcaggtgcttgttgaaaagcatgagtgtttctgctttgggaaacccttccagggctctggttggaaacttggccagtaaggacagggccttgggcctcccaaggagttcacaatgatgccaggaagggtccctgagcctgggttccagtcagcttggctaacagaatggggcttgggaattccaggggcaactgagcatccaccccattagccagtgatctggacagggacagctggctacagggaatcaaaggctgttctgtacagttttaccagaaactgtgaccttgggtaaggctcctcacttttctgggcctcaacttcctcatctgcaaaatcagagcattagctgctctccccatgattccctcccagttttaattaaaagtctctgatctggagcacatgagggttgcgagcctggtgcacctggttcctgtctccgtgggctggtttccttcagcccctgatgcccaggctgggtgcaggctctcatctggtccatgcccagatgctgcctcagacaagaactctgggaatcctaacagactctgctttcctctcttcgtggtttgtcctccctcttttattcttgtgtaatgatgagacataattaagggtcatctacaatggacaattttcaaggtgctgatgtgatgtcacaacctccgctacatcctgagtaagtcagtgtccccaacagcagatgaggctgggtctttcctcatttctgcttctgggatgacatcagtgggagagttgaagatctgagaattctaaaggaaatgttctctgatgggaggagagagggaacttatttcccttcaaagtagtttgcttcttaagaccactcctccctccagaatgtctttaaccagacatcatttcagaaggtggggcagctgcttccttaggaagagtgggcctgatagctcaaccaactcctttagcatgtaaactcacagaaggcaagaacccctttttttagactttccaaatgcatcctgc

SEQ ID NO: 3450 - DNA, 1045 bp, Homo sapiens
gttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagataccagtgtctttttaatcagttaacagccaaatcactacgcattcat

SEQ ID NO: 3451 - DNA, 1033 bp, Homo sapiens
tatctgggagccagcactctggcagtccttctaagctctaactctggttttactgtttttcaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccaggggtaagcttaccagagtcctggccctccttccctccctcactctttccttcacttccttcctgagctctgggaggccagagaggacctagctctgttgccctctgcctggtggtgggactagggactggacttactcttgtgcctggccttgcacctgggaggtaattggagctccaggattggcttgagcataacagaaactaagagccaaagacctagacccaaaagggacagggaaggattcattcactcattcatccattaactatttatttgaactccatttgtgtttggcatggggaagcaaaaatcagtcactttttatcttcaaggtattatggtgagagagacacgtaaacagataattattaaacaatgtcttgagtgcagtgacagacatatgctttgggtaatatgaaaattacaagaaggaatacctaacccaagcttggtgttcaagggacactttcttaagggaatgatgccttgcctgagactgtataaatggccatatcagggctggtagaggagggagagctttccaggaagaggggcaacatgaataagggcaaaagaataagaaatagcactgattataccaggaactgcatgcaatttggaattgctcaaccataaaatgtaatactgagactcaaagagaaaagcctggaaaggtcaaggcatatatcatagaagaccttaaatgggcgtttaattagaggcaagacaggtttttgttttgaatagattattgactactgtgttgagcatggatttgaggagggacaaa

SEQ ID NO: 3452 - DNA, 1025 bp, Homo sapiens
tcgcttgagcctaggagtccgaggctgcaacgagttatgattgagccactgcacaccaggctaggtgacagagtcagaccctatccctaaaaaaataaaatatagttgagtttatttgttcctgtttgcattcagtttaaggttcagtttttgtccttatctttatggatttaattttattttttgaatatatagaaaattaacttgcttccaagagtcaaaagtcatacaaaacatttactaagagaagtatcgtccaccctttctcttctaccttattccttccaccaccactaccctctttaagcaatcactttcactattttctggtttatcctccaatgtttcattttacaaaagtaagcaaatttatgtgtgttttcctacccttcttacacaaaagttagcatgctctatattctcttttgtactttgctttcttcttttacttaacagtataccctgggagtcactcctttgcaagttcacaaagatctcccttattctaagctgtagactactccattgtgtatgtgtgtgtgtatacaatcaatatagtttctggtattttacaattacaaataatgctaccattgcataaataaatacacacacacacacacacacacacacaccagaaactatatatagtgtatagattattatatatagtatattgtacaataatatgtaatactgtatatgtattgcttaataaacttgtacacatgtattttcatatttggaggtgtatcttcagggtaaatgaccagaagcggtattcttgggtccaagggtaaaggcaaatatagttttgttagatactgccaaattcccttccacagagatgctaccagttttcattctcaccagcaatgtgcttgttttcccgtagcctcaccaacagagtatattatcaagcttttgacttttttgccaatctgatgggtgagaactggtttctcaatataattttaatttgcatttctctttttatgagtgaagtttaacatcttttcatatgt

SEQ ID NO: 3453 - DNA, 1217 bp, Homo sapiens
gtctcaaaaaaaaaaaaaaaaaaaaaagagacaacatggttagagtggaataatcaagggagagtggtaggaagtaggtcagaaaaataatgaggaatcagatcatatagggctccaaagttcagcataaggaccttggctttagttctgagtgaaaggggaagctattgaaggttttgagcaaaggaatggtgagatctgaagcatgttttaacaggctcactctggtagctgtgttcaaattagagtagaggagcagagacaaaccattcaaaaggcttattgtaaaaacccaggttagagatgatggtggcttaggccaaagaagtatgaaggggacttatgaaaaacgatcagattgttaatacattttcaagttatagctcatggactgctaataggacaggaatataagaagaagagaggggtcaaggacaactccaaggtttttagcttgtgccatttgaaaggagatagagaagtcttgggaagaacaagtctatggactgagataggtgagtcagaacttcagttgcagatatactatgcttagaatgtctaatagattttcaagtgggaaattgtattaaaaacaagaagtttaagggaaatttctaagctggtaatataaacttggaagttttaattataggtagaatttaaagccatgaggctagaggagatcctagggttgtgttctgaaaatgtggtccccagaccagcagcatcagcactgcccagaaaagcaaattcccagacctactaaagcagaaactcagaggctggggctcagcaatctgaattttaacaagccatgcagactaaagtttaagaaccacttacctaaggactagagtgtagacagagaagagaaatctgttcaatgacactcctgggacatgcccatcatttacaggttggtaaatattttacatctcccctttttctacagtatgaatcttagtttccgccaacatcctataatacacataaaataagtttcagaattctatatgcataccactatggaaaaactcttagaagagttcaagatttgtttacgtttttttcctccttagatggttaaagtacttaaagtactctgttcaaaaattacttgaattactttttttccttcagtgtaattatgttattcatttaaaacacagttgtgaattagccaggcatggggacacacatctgtagtcccagctagc

SEQ ID NO: 3454 - DNA, 1035 bp, Homo sapiens
aatttgattagctagctgtggtggcacatgcctgtagtcccaactacttgggagactgaggcaggaggattgcttgagcccaggagtttgaggctacagtgaactatgatcgtgccactgcactccagcctgggtgacagagtgacaccctgtttctaaaaaagaaaagaaatgaatttgagacattcgggagacagtttctctggaaaagacattcttttttgagccgcattcctttaagctttcagtactagaggatcctaaaactagaagcagactaagatcaaatgctagggaaaccgtggacttgatgccaaactaagcaaaaagaataaatgctgagttggaggtagaccgtgtcattagcagaatatgctagatctaaacatgaacaaccagaaagctaagtctgaaatcagtcagcagagttgcaaattaagaagactagttgtccagatgagtttccagtaaaagataacaatttctcctaaccttaaaggccaatactctgagccagtatctgacaaactaacttgatttctagatatacattttacttcaagaacactaaactaattatccatttattattttaggtaaagtatttttgcccttttgtatacttagacatattgcacattgccaaaactggagcagaactgaagggccccagagtgattaaaaactagcatgttctttgaactagtttgaaagactggaaattgctgctaatgtgtgtaatccctttagcagctggtcccatctaatagcccagttactgcctgtgaagtggtaagcattaggattgtttcatactaattattagcatgagaagaatgagaaaaaaggtagggaaaggagaaagaaaaagatactagcctgtctgcactttgtgtagtcatgttggtccactatggccatagaacaggattccctttgactgtatcctctacaggagcagagtttcagggtcccagaacaattagggtcaagagtatcattttgccgtagttgcctgatgagtgttttatttct

SEQ ID NO: 3455 - DNA, 1068 bp, Homo sapiens
taggtttccatctgtgattttggaaatgcatagtgagacctacaggaaattccagggcccttttttaaaccagcagctgggagtttggatgcgtttgaaatgtgtgttgggagtagaatgagaaggattaggagtggaagagagatccttcaaagcactaatgtaatataagatagaaagaactgttgctgatttgattttattctgcatcctgtttagatttgctatatttttatggtgaaaatatatacatttagaattagccagctggactcactttagataatcccagttttgttggcaacatccagagcatcataatcaggagccagtcaaacatctgccttcttctctccctcaggcctgatcagggtgttgaccacatcagtgtcatagagcttctttacaacctgtttgatctggtacttgttgattttgacatccacaagtgtgttgttgtcttctatcttcttcatggctgacccagtggtcaggagggacttaataatggcatagcggtcacgcttatttctttctcctgtgggtgcccttccaaggatatttgggctgcctccagagctgtagtgtcttgggctgccaggttggtgacatgtacatttgtgggctggcggggggtgggggtcggggggaggaagggggagggagggagtgcctgtggtcacttttcagtactgtctttttggccctcaaaggccttgctttggctttggctttgggagggacaggagcttccttctttgtcttcagtgccatcttgtgaaaaaagagctacatctgtatattttttcagaaccataaaattctcacagaattttcaaaatgacctttttagcaatttactgtcacttcacttaacctcccttagcaaattatttaacttccattagtctttgtttcttcatctataaattgaggcagtaacagtacctactcacagggttgttgtaaggagttaagaatttacatattagaacacctggcacatattaagcattcaaaaaatgtgagttattttctattttaatgctgttattttgtgaataagga

SEQ ID NO: 3456 - DNA, 1036 bp, Homo sapiens
acagattttcattttatcttctggtaactctgaacaaggtataattattttcagatacattttatttatgagaaaactgaagctcagataattaaatgacttggctctgttgatatctgagtctagagagtgaaaccatggagatcttttagtagagccacctgtcaggaccaatatatcactgaggcatattgttttcacacttgtctccctgatactcttcccattctcctttggcccttcttcaaagcttcatttgagaccctggattttggcttccaaatcctgataaaaaataggaaagaaaaagtatggtgtagtatcagagcactgaactgggttctagtcccagccaggccacaaacttggttacgtcattgagcaagtcattcttacatgtgagaggctgaactacatgatccctagtgggcacttttacctctgtaatactatctagtttaatgatcttgggaataggtagcaggtgactcctgtgcctctgtctcctacatgattttaggttcatcagctcacctatcacctatctctgcctttttgaagtaattcctgtgtgccagctgtctgctgcctctctttttctccttttctaagccaagtagtatcccttttagttgctaaactcctgtggccaagccaactctgatgggtagtaactaccaagcgtccaactaatccagagtacttggttataaaaggcagaagctttttacttttagcttattttttgtgacttaaaataaaactgaaacagatacatgctttagtttttaaatgtaaaaagcaaaatgaagaattcagtacatatggcatgactatgatgctaatcatacctttagccatcatgataatccacttgacttccccttgctctgatttcaggctgggaaagccagtttcagattataccttagctccctatgtggattgatagcagcgagacaacatgagacccaagctactttatatttttattataaattaatatattgctattctggattagtacattcgtctc

SEQ ID NO: 3457 - DNA, 2035 bp, Homo sapiens
gtaacacgcctgtaatctcagctactcaggaggctgagggaggagaattgcttgaacctgagaggcagaggttgcagtgagccaagatcgcaccaatacactgcagcctgggcgacagagcgagactctgtctcaaacaaaaacaagcagtgcaagatgatgttggagaagtggacaggtgccaaatcatgtaggaccttgtaaaccagagtgggaatattggattttattctaaacatattagggaaccattagaaggtactaagccagggaagtgacaagatttgatttactttaaaaaaatcacttggacttgtatccagaatataaaagaacacctataactcaataataaaaaagacaacccaatttaaaaataaggaaaggatttggatagatatttctccagataacatacacagatagccaataagcacttaagatgctcaatatcattcatcattagggaaatgcaaatcaaagccacagtgaaatacaacttcacacccatggatacagctataagcaaaagacagataataacaaatgttgctgagaatgtggaaaaactggaattctcgatcattgctggtgagattggaaaatgctgcaaccactttagaaaacagtttggatgttactcaaaatgttaaagagttaccatgtgacccagtaagtccactcatagatatatacccaaaagaatagaaacatatgttcacacaaaaacacataatgaacattcatggcagcattatttatagtagccaaaaagataaaacaacccaaatgttcatcatctgataaatggataaataaaatgtggtatagctagaggacaaaatactaattggcaataaaaaaggaataaagtactaatacatgctacagtatagatgcatcttaataacattatgctaaatgaaaagccagtcacaaaagataatcattgatgattacatttatatgaaatgtccagaattggcaaatacacatagacagaagtagattcgtggttgccagtgactaggggagggaaaatgggaaatgactgctattggggtttcttttgaggataatgaaaatgttttaaaattagggatgatgtttgcacaactctgaatatcttagaaaacacaaatgtagggtgaatttgtggtatgtaacttatgtcaataaagctattatctaaaaaaaattacttgagctggtctgtggagaatgagttgtacagtggtaattgtggacaaggaagaaatgaggttgcttggattaggatagttgcactgaggtggagagatcctcgggcagaatgaaagggaaacacacttcttggctcaggaaagtgccactcctctctgtgatgcaagaaacaagtaccctggggtcagtatggtaaatgcattgtgaggaagcactgtgaggtaatagctctgtggaagcagcaagaagcgaggtaccttggaactgatagcagagtcatttttgttacttgaggctaaaacaggataagccttggtgctctgggctttattcagttaataggttgattttctcattttcatgcctagggaattcactgttcttttgactgataaatctagagcagttaggcagttctccagagccaacagagctgacggtctttgtgtccaggttgctggatatgcattcctttttggctgcaaaccttgctgataagaaatatgactcactctgtggctgatgcttccagagaagtttgctgactgttttcctctcttctgtgtctctggagtccttagattttcaacagaagatggtcagaggaccaggctcagaaggtagagagagaccttccaggtgacatttccagaccaggtgcttcagtcatcattccagcagttaggttgttccctctaacaactgtctcctcccacactttacaccctcagtaagtcctacaaaagcgctttctataacagcagaagtttggccagcagtctccatgtcctggctaaggagcaagtgatgcaatgtggaaaaaatgtggtta

SEQ ID NO: 3458 - DNA, 1073 bp, Homo sapiens
agtgtggtggtgtgtgcctgtaatcccagctacttgggaggctgaggtaggaggatcacttgaccctgggaggcagaggttgcagtgagccaggattacaccactgcactccagcctgggtgacagaaccagaccctttctccaaaaaagaaagagagagagagagagagagagaaaggaaatcttaacaagtggaaaagactatcatgtttatggatgggaaggcttgatagtatataataaaggttatttccacccaaatttatctataaattcgttgtaattccagtcaaaatcctaatagggtttatatatggaactcgaaaaaactgattgaaatttatatgaaagacagagaatgaatagcaaaaacaatattgaagaatgacaaagtagggggacttttcctatcagatatccatttaataagactatgttattggtacaggatcagatagtaagattaagggaacagaatagaatgtacaacacattttttgaaacttgatctatgtaactgcattacaaattagcacccaggaactctctacacttccggtgaaagtatacaatgttacaaccactttggagtacaagttaaaaatatttgataaagcagaagatgtatatatctaccctataacccaggaattcaggaattctacacctagatgtataacctaaagaaaccttcctacacatatacaaagaagtgcaaggatggtggttaaaactcttttaaaatagtaaacaattggaaagatctttaagtgtccaaaggagaatgaataaatttcgatatatatatacaatgaaatactattacaagttaaaatgaatcagagctaaatttatcaacatgggcagatttcaaaaacatactgctaaacaaaaagcaaattgtacaatgatatatacagtataataccatttatataaaatttaaaagcaggcaaatgggtatgtatgtatatagtaaaatataaaacatgcatgggtagctgttacctccgtggtaggtagagggggaatggaatatgggaagggcagaaagggagattcaactttatctg

SEQ ID NO: 3459 - DNA, 1029 bp, Homo sapiens
aggagaaaaaagaactttggaaattcaaattaaatagaaacatagacaataaggtagttgtaataaattcagatacatcaattatcacaagaaatgagcttaagctcattataatcatacatagatcagatttttaaaaatctagctatatgctatgtataagagacactaaacataatgacaaaaatgttgaaagtaaaagaaatctacagagggtgggaatgatggaaaacaaattttttaatttttaaaaaagaaaataaaagaatatgaaagatgtgccagatgaacttttatcaaaataaagctggcataaactatacggaaatcacgcaagactttgatactaaaagtctaaatgatgctaaaagcactgagtccaggaatttgagaccagcctgggccacctgtagcaagaccccgtctctagaaaaaatttaaaaattagctaagagtggtggcacgtgcctgtagtcgcagctacttgggagaccgaggtggaagaatcgcttaagcccaggagattgaggctgcagggagctgtgtttgcaccattgcacaccagcctgggtgacagagcaagaccctgattctagaaataaataaataaaatgcattaaagaggtcactatctaattatcataaagtacagttcaccaggaagataaaacagtcataaatgtacatgctcctagaaaatgtaatctcaaagtataatagagcaaaatttgacaaaattacatggtaaaattggaaaatccacaaatcactagggaatatttgaagacttatctcttaacaattgataaatcaagcacacaagaattggtatgtcaatcagcataagctaataatcagtatcgaataagttggtcaatttttaaaaatcactttatttgcatttaacaacagttaaatttaaatgatttgaaaataaattttttaaatgccacttatgatagcaatggaattgtaatttgcctagaaaaaaagttagtaaaaaagcatgagatatttatagaggaaatt

SEQ ID NO: 3460 - DNA, 1050 bp, Homo sapiens
gaaattataacacatgctacaacataggtgaacctcgacgacatgctaagtgaaataagccagttataaaagcacaaatattgtatgatttcacttagatgagacatctagagaagtcaaatgtatagagacagaaagtacaatagtagttgccaggagctgagggaggaggaggtgaagaggttgataataggtacagagtttcagttggggaaaatgaaaatgtcctggagatggatggtggtgatagttgcctaataatgtgaatggacttaatgtcacagaactgtacactttaaaatgattaaaactgtaaatttgatatatattttaccacaaaaaaaattaccaggcatgcaaacaagcaagagaaaaactcacccattataattagaatccagaaataacacagattatagaattaatagacaaggacattaaagcagttgtttatattgcatatgttcaagaagatagaggaaatcatgagcgtcatgagtagagaaatgtaggatttagatttaaaagaaccaaattgaactttagaggtagaacatacaagataatatctcaagtgaagaataaactgaatggatccacaacatattactgttggaattgcttcaggaggaagatgagcagacttaaaaacagcagtataaactatccaaatgaaacacagagagaaaaagaactgaaaaagaaagcatcagtgagccatggaacaacttcacgtagcctataacatatataactggagtcctgaaggagagataaggagcacataagaaattattagaaaaataatgcttgaaaaatttttgaatactatgaaaactataacttcacaaatcagagaagctcaatgaaccccaagcaggagaaatatgaaataaaccacacaaggcacatcatcatcaaattgctgaaaacccacgataaagagaaaagtcttaagagcagccagagaaaaacaagcacatgatatatagaagaacaaagaatgacagcaacttctcgtcagaaacagtgcaagccagaatacagtgg

SEQ ID NO: 3461 - DNA, 1041 bp, Homo sapiens
caaaataagaaaaaattaaccctcaatagtctgtgtggtagatatacacaccaatatactgaaatattccacaaagagacactaagaatatggtagtttaataggacgtagtagtcctaaaaagactaaaaagggattaaaagtccctacctggaagggtagggagttagagaattatagaatgagaaaacatttaattaactggcctatataagacattcttgtcctttttttaactggtatgggtctatttgatgcttcgttggaaagtaattttttccccttcatcttatctttcattgtttcttttgcatgaaaccattcttaattattagggaataattcagttggttgtccctggcccagctataaccaatctgaatccaaaacatgaattttggggttttactcttaatctgtctatacctcatgccttgtttttcccagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggtgagtaagtaaacccaaactctttctagccaattattaatagttagcgtccaaaaactgaacatcctattatgggaaagcctagggtacccagcttatcccttatttttcatatagtctcctaaaaaggcccacccaaaatgaaacaagctgcacaatttggacatctccatctctacattagcttatgatatccaggcttcttccaaattctttctaacaagaaatcacaccctttgttcttcttggccagtgcccatttacctgagagagagaatggaaggaggtcttgccgtttaacctatctcaaaaagcataaagctttcaccaaatcctatcataatgacaagaaatgagag

SEQ ID NO: 3462 - DNA, 1035 bp, Homo sapiens
gctggttatccacataaaaaaaagtgaagttggactctacctctatgccatatacaaaaattaacttcaagtggatcatggacctaaatgtaagagttaaaactgcaaaactctttaaagaaaacatagaaggaaatcttcatgaccttggattagatattataacaccaaaaacataaacaacaaaagaaaaaatagataatttaaacttcatcaaaattaaaagatttttgtttccacaccatcaggaaagtgaaaagaacaacccacacaatgggagaaaatatttgagaattatatatctggtaaaggacttgtatccagaatatagaaagaactcttaaaactcggaaattaaaagacaacatgattttaaaatggacaaagaatttgaatagatatttctccaaatatatacaaatgaccagttaggcacattaaagatactcagtagtcattagagaaatgctaatcaaaactgcaatgagatatacatcacattgactagatgactctaacatcaaaaagacaaacaatggcaagtgttggtgagaatgtgtagaaattggaacccttgtacattggtggtaaaattatgaaatcctatagctacttgagaagacagttcagaggttacccaaagtgttaaacagagttaccacatgacccagcagtttcactcataagtatatacgtaagagaatagaaaacatgtccacagaaaaatataccataaatgtttatcacatcattattcataatagccaaaaagaggaaacaacccaaatgtccatcagctgatgaatgagtaagcaaaatgtatatccatacaatggaatattgttcatcaatgaaaaggaatgaagtactgatacactcattgacatgggtgaaccttgaatccattttgctaaatgaaagaaactattcacatattggccacacattatataattccatctatatgaaatgtccagaataggtaaatccatggaaacagaaagtagattaatggtttctagggactgggctgag

SEQ ID NO: 3463 - DNA, 1033 bp, Homo sapiens
caaagaatatcttacttaatggtgaaagactaaatgctttccccttaagatcaggaacaagacaaggatatctgctcttgccacttttattcagtattgtattaccaatgcaaatgggccagaaaaagaaataaaagggatctgggtcgaaagatttagaacaaacaccaaggaaaatgtatacagggcaaataagtacatgaatagagatgctcaataccattatttcattagggaaatacaaaataaaagtgattagtgagctatcactatacatttatttaaatggctctgattttcaaaagactgaccatattaaatagtggcaaagatgtagaacaaatggaactttcatatgctgctggtgaaaatgcagaatggttcaactactttgggtggggtgggggaggaactaacaaatacgaaaaatttatataaagaaaaccttagaagatgcctgaccaaaattttgattcattaaaaaaatagagtggactttgtcaaaattaagaacttctgctcttcaaaagatactggtaagagaacaaaaatacaggtcacagactatgagagaatagttttgcattgcttaacgatagggatatgctctgagaaatgaattgttaagcaatttcatcgtcgtgtgaacatagaatatacttgcacaaacctggatgctatagcctactacacacctagaccatagcctattcttcctaggctacaaaactgtccagcatattactatactgaatactgtaggtagttgtaacacaatggtattcgtctatgtaaacatatctaaacatggaaaaggtacagtaaaaaaaaaaatatggtataaaaggtatattaaaacttgtacacccgtatcaggcacttaccttgaatggagcttggaggactggaaattgctctgggtgagtcagtgagtaagtggtgaactgcgtaccactgtcaacgttataaacgctgtacacccaggctacactaaatttatttaaaaatttttcattcttcagtaaagagttaa

SEQ ID NO: 3464 - DNA, 2741 bp, Homo sapiens
aatatatatgttgtatcaaaatctaaactatgcatgctctttgtccactaatcccacccttaggacaaatcccaaatctgtgtctcatgcctgtaatcccagcactttgggaggccgaggcagttagatcacttgagctcaggagttcgagaacagcctgggcaatttggcatagccctgtctctacaaaaaatacaaaaattagctaggaatggtggcacacacctgtagtcccagctactagggaggctgagatgagaggatcgcttgagcccgggaggtcaaggctgcaattagctgtgttcacaccactgtactccagcctgacactgactcaaagcaagaccccgtctcaaaaaaaataaaataaagacacttaaattaccatcagtggcgtttaacaaatatattgttatttaaattttggtacatggaacactatttatacggtaatagtggagtggaatttctgatctaaagatgttgattatgcttaattgtttttaagaatttgggttcacatttaggttgaacaaagtagagttcttgtaaaggaatgtggccagaacagtagccagacatgagtagccagcctgtcaaattaggagcagttgagggatttgggacatagagattagatatatctaggaccagtagaggttagaaggcagatgttggctgactataaagagcggtctgtccatttgtactgttgagtaatagctaaatagctaaataatgagtgtcccatgactggaagtatttcagcagaggctggaaggaccattcaaatctcagctttttttttttttttttttttttgagacggagtcttactctgtcacctaggctagagtgcagtggtgcgatcttagctcattgcaacctccacctcccgggttcaagcagttctcctgccttagcctcccaagtagctgggattataggtgcctgccaccacgcccagctaatttttgtatttcttttagtagagacgaggtttcatcatgttggccaggctggtcttgaactcctgacctcaggtgatctgcccgcctcagcctcccaaagtgctgggattacaggagtgaactactgcgcccggcccaaatgtcaacttttgtatcaccttatcaagatgtcttttttgactgccctggctaaaatagcacaccttctttacctcttacttttatttttttaaatttcaaaatagccaggaattgtataattaatctggtgtctctgttaccctctggaccagctgacgtatttgtttgtttgtttgtttgtttgtttttgctccatgtggagcaaaatattgtttgtttgtttgtttgtttgtttttgctccatgtggagcaaaacattgtttgtttgtttgttgtaagctccatgtgggcaaactttggctgtattgtattttgctatatatcaccagtgcctagaaccaggcttaacatatactaggtatttagtaaatatttgctgaatgaatgaatattagagaaggtgattcatgcatttaactaggtgacctcttatgcccatattttatgggccaaggtactttaatgccatttttaagtctcttcagggcaggtacctttttttcttttttaataataaatgtaactatcacgtggtatgcatcagagtttataaaaacacttttataagcattatttactaaatgagatggctttttctcatctgtaaagtcttagcttagacatttcctctgaagagtatctgtccatgactttactaagatagctcccagtctctatcacatcacctcattttattcccttcaagttcttttcacttactgccttgtttatttattgtttatgtgttagttgtgtctcatcatataccagcatgtaaatgagggcagggacccctgtcatattgcctggcacatagaggatagttaataagtatctgttgaatgaataattgaaaacattcaaattatactgtttgaatattttgaattataatgttggaataattgaaaacactcacattatatatgtttaaattataaaacattatacctatgttagttaataatattaatcttcgtaataatctctgagcccaaggatgaatgagattttcatgttctgcaatctcaagacaacctgtactacctcgtaaactttatcattatcataacagattatttgtgttatgtttattaatgtctctgtttatctctagactgaaagctccatgaattgagaaatcatgtcttaccttgttcccctaacatttaacacagttctttgtacttggagaagtttaaatatttattgaatgaagaatctatatacaatcttgtaagacagatattgtcttcatctttcacatgagtaaacttaggcttggaaggattaagtaatttacccaagatagttagctgtagaaacaagacttttaccaacatcttcagactcccaatattacattatttaaactacaccagtagtagttcttagtcacagatgttaatccaaattacctagggagccttggaaaatacatattctcaggccacacttggagcctactgaataagaacttctgaaggtgaggcccagaactttgtttaaagaaatgagactataagtatcacttgagagtcaatgatttataccagaggtctggcaaactactattgggaggtcaaatccagccctctgcctgtttgtgtaaataaagtttgagtggaa

SEQ ID NO: 3465 - DNA, 1070 bp, Homo sapiens
aataccatcttaatttactgaatccagaactaaaacaaacccctgccatccataaatcagtgtttggtgggatttttcccccaaaaaaattacttgtaagataaattgaactgaaactaaacctaaacattttctaactttattgacaaataaaaactgaaatattaaaatattatcaagtaagaagtcagaccaataattgcatttggttttcctccctggttagtgtatttcaggactaagatttgagtaataaaactagttctaatacttctcaatcagagttcctgcataaacatcagtcttaacattttagaatcctttaaaatccttttatatgttacatagattttgatatccagatacctgtatcaatttttgttcaagtattttgatatattttgttacaacttgatatttatttagctctattattatcattgtctatttgcctcctcttgcctttctttcctgcaacatattactttccattgcccagtgacacagaagataacatgaagtagtagaacactagactaggagtcagaactcctaggctttttgagagccagttctgccacttagtaactttgtgactctgatccttagttttcttatttgtaaaatggggataataatcccattctgcctacttcacagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcaggtaaaggtgcctggcacttgataaatgatagttattttttattattctttaaaactttcctcaagctttttaaggtactgatgtgtggtagaaaaaacatggacataggagtcagacaatttgaaccaaggttcaaattcctattcccacttaccagttttgtgacttcaggcaaattacttaatctttctaagcctattt

SEQ ID NO: 3466 - DNA, 1058 bp, Homo sapiens
ttacaaagctatagcaatcaaaaaagcatgatgctggcataaaaacagacaagtctaccaatgaaataggacagagagcccagaaataaacccatgcatctacagtcaattgctttttgacaggaacacacattgaggaaaggacaatctgttcaaaaggtggtattgggaaaactggatatccacatatagaagaatgaaagtggatctttatttcacccctcatatgagaatcaactcaaaatggaataaagacttgaaactatgaaactgaaactataaaactgctagaggtctggacagagatttctttgatatgaacccaaaagcataagcaataaaagcaaaaatagacaaatggaattgcattaaagtgaaaagctactgcatagaaaaggaaacaatgaaggaaagagacaacacacagattgggagaaaatatttgcaaatgatacactggagaagggactaatatccgaaatatactaggaactcaaactactcagcaacaagaaaacagccctgttaaaaataagcaaaggacttgaatagacatttttcaaaagaaaacatataaatgggccacagatatattaaaaaagtccaacatctctaatcatcagagaaatgcaaatgaaaaccacagtgagataccctatagccaacaccttttaggttggctcttatcaaaaagatgaaagataaatgttggcaaggattacaagaaaaaggaacctttatacactgttacggatatcacaaattagtacagccattttgaaaaacaggatggaggttcctcaaaatactgaaaatagaattaccatatgatgcatcaatcccactactggctatatccccaaaggaaatgaaatcagtatgttgaagggtagcttcatctgcatgcccgtattcattgcagcactattcacagtagccaagatatgggaataacttaagtgtccatcaatatatgaatggatttaaaaatgtggtatatatacacaatggaatacattctgccttaaaaaagaggaaattctgtcatttttgacaac

SEQ ID NO: 3467 - DNA, 1886 bp, Homo sapiens
atgcattattgatatgtcagaaaaagaagaaataaaatatattcaaagaaattatgtcagaaaacttcccaagccttatgtcagaaaacttcccaagcctggggaaggagatagaaagccaaatccaggaagcccaaagaacaccaaataagatgaacccgaaaagatccacaccaaagcaagttataatcaaattctaagttagagagagttgaaaacagcaagggaaaagtgaattgtcatatgtaagggaaccaccctaaggccagcagtggatttcacagcagaaaccttacagatcagaagagagtaggatgatacattcaaaaccctgaaaggaaaaaaaaaaaaaaaacaaaacactgccagcaaagcatactatacccagcaatcctgtctttcaaaaaacaaagggatgatcaagactttctcaaataaaaacagaatttatccccactagaccagccttacaagaaatgctaaagggaattcggaagagaacgttaatcagcaacgtgaaaacatgaaagtataaaactcactgaaagaggagatattacaactgacaacatagaaatacaaaggatcatgaaagactactatgaacagttataagccaacaaattggacaaccagaagaaatgaatacattgctagaaatatgtagcttaccaagactgaatcacaaagcagttggaaatctgaatagtccagttatgagtaatgagattcaatcagtaattaaaagtctccaatcaaaataaagcctaggacctaatggcatcatagccaaattgtaccagacacttaaagaagaaccaataccagtccttttcaaactcttccagaaagttgaagaggagggaattcttcaaaatttattttatgaggccagcagtaccttgataccaaagccagacaaagatacaacaagagaagaagactacatctcccttcatctgaatggtaagaagaaaaagaagactgcagaccaatctcactgatgaacatggatgcaaaaatcttcaacaaaatactaagaaaccatattccgtagtatattaaaaggatcattcaccatgattaagtgggatttgcccttgggatgtgatggaaatgaataaatgtgagtcaccatgtaacagaataaaggacaaaaatcacatgatcatctaaatagatggagaaaatgcatttgacaaaattcaacatcctttcatgatgaaaactctcaatatattagatatggaaggaatgttcctcaacacaataaaggccatatatgacaagctcatagctaacattgtactcagtggtaagaagttgaaggcttttcctataagacctagaacaagacaaggatgcccgctcttaccacttctgttcaacatagtaccagaagtcctagcccgagcaattaggcaagaaaaagaaataaaagacatccaaataggaaagagtgaaatgaaattgtctctgtttgctgacaacatgatcttacatattgaaaatctcaaagactgtaccaaaacaccatttgaattagacaaatccaggaaagttgcaggatacaaaatcaacttacaaaagtcagtagcatttctatacactaacagtgaactttctgaaaaagaaattaagaaaacaatcccatttacaataccacttacttctaagtaaaatacttagaagaaaatttaaccaaggaagtgaaagatctatacactgagaactgtaagacactgatgaaggaaattaaggacatcacaaataagtggaaagatacccagtgtttatggatggaaagaattaatattgtgaaaatatttataccaccagaagaaatctacagatctaatgcaactgccatcaaaattctaatgtca

SEQ ID NO: 3468 - DNA, 1259 bp, Homo sapiens
cagcagatttatacgggtgcagaagcacatcgctggactttattccccaggagaagtgcagagaaggggcttaaaatgtagccccctgtttttccccagaagggatttatgacatactcttctggtgactacttgccagcctggcttccaactaacttgcattgaggaattaaaggggtagacaaatattaacctgacaccaccctgataggcgtatgtccacacaacgagtgtcccaacttttacagctgtctcccaaaggattatatcctaaacatcttagctctgggagccaaggggactaggcatagatgagtttttctagatcacagaacaatgggggtggctttaaataggtatacaaataccttcagaggttatacctcctctgagcagtgagcagtgcagaaaggaagtaggaacatgtaggtcccatttgttctccagaaggggcttatagcacacacttccagcagctacttggcagcctggcttctaatgaacttacattcgggagctgatgggaaaacaaacagtagccctctagctaatctcagtgataaatccaaggctactcattcttcctggaaggagtttcgtcatgtctcaagtgccacaacttctataacttccacccaagggacaagctttgggagtcagtggagctttgcattcatgagtagccttagaccacagcaaacaaaaaggtggacgtacagtaggaccacttctacgagcttctcctcaggatcagagggtgcaacctgaatttgagtacaggtttttgccacagatcttctccttagcttagagcagacagagagtgggacataaatgctcaggctcagctgtgaagatagaaggaaatggaaaacccattcagcacctcaacatctccagctacatctagagattctggctcctactctacggtattgtgggggtattgatggaatgtggtacatcctaagctcgaggggaccatcaaaaaagagacagcagtctgaataaacacagagattagagagcaccttaaaatttttggctggatggattggtgagatccttctcctacatgaggccagtctgacaagtctgggagaggttatattcttatgtaatgcatagaagctaacacaaaaatcaaagaacagagaatctattcccaaaaaaaaaaaaaaaaaaagacaaatctccacaagtgaaatagagatatgtgatttacctgacagagaatctaagataatggttataaagat

SEQ ID NO: 3469 - DNA, 1922 bp, Homo sapiens
ggttcagtgctactgatttttatatgttgattttatgtcctgcagctttcctgaatttgtttatcagttctaagaattttttggtacagcgtttttttttttttttttgagatggagtctcgctctgtcgcccaggctggagtgcagtagtatgaacatggctcactgcagccttaacctctcaaaagatcctcccacctcagcctccaagtagttgggaccacaggcatgtgcctccatcctggctaactttttgtattttttgtagagatggggtcttgccatgttgcccaggttggtcttgaagtcctgggctcaagtgatacttctgtctcaccctcccaaagtgctgggattacaggcgtgagccaccgcgcccagccatctttcctcttaatattgcttttgctgtatcccataggtttgggtatgttacgtttctattttcatttgtttcaagaaactttaaaattttctccttaatttcttcattgacccattggttattcagaaacatgtttaatttgtttctttttctacaattttgaaagttcctcttgttattggtttctatttttattccattgtggtctgaaatgatacttgatatgatttcagttctcttaaatttggtgagatttacttatggtctaatttggagaatgcttcatgtgcttatgaaaataatgtatattatacagctgttggatgacagtaaaagtactgtcacctagctggcactgtaactgcatcttttttttttttaatttttaatgtagacagggttttaccacaaggccattccatagttctgtcaagccagctgcttcaggatgatgcatgttaagatcattaattccatgagcataagcttattgccacacttctttgtgtggcttcttggtcagaagcagtgctgtctgtaatggtggataagggattttgtgagtctgcagttggtagttttgacagtagaattgcatgcagggaaggcaaatcaatatccagagtaaatgtctattccagctggacaaaatgctgtcccttccatgaaggaagcagtccattgtaatcaaccagccactgggtagctggctgatcaccctgggaaatagtgccatatcaggggctcaatgttgatctctgctactggcagattgggcactcagcagtggccatcgccagattggccttggtaagtggaagtctatgctgctgaacttatgcataatttctatgcaaataagtgatggaggtgccatttactgggttggggaagacaaaaagtaacaagatgacagaggatggccttctgttttagtcatgttaagtttttaatatctgattgataaccatgtagtgatggcctataggtagttgtttatgtgaatgtgtgtgggattctaagaatccagttctggaaatgtgaatttggaagtaatcttaatggtgtggtgagcagacacaccctatttgaatgaggagatagtatggggtagtgaggaggcaataactgtgaggtagcaataactgtgaagtagtgaggaggcaataactgcagataactcttaaattttcctgtgaaggagagcaaagaaatagagggatataataggagggatatgtgtgggattaagagaaggatatgaggttttgtttattttaggttttcattgataggaaataatagagcaataagaatgctggtggcaaatgacctattagaaaggaggtacttgatagtagggtcagcaatgtggcagaataggaaactcctgactctccctccacccatgaatgcaccaaataaatatctattcatggatcagttctctctcagagaaagtcagagactagttgaaagattcctacccatggggcaactgaggaaacatcctcatcgaatgggtaggaaaaactga

SEQ ID NO: 3470 - DNA, 1033 bp, Homo sapiens
gaattgctggatcatatggtagtattcttttcagatttttgaggaaccttcatcctgttttccataatagctgtactaatttacaataccaccaacagtgaataagagttctcctttctccacatttttgtcagcatttatttttgtctttttactagtagccactgtaactagggtaagatgatatttcattgtggttttgatttgcatttccctgatgattagtgatgttgagcatttttcatatacctgttagccatttctatgtcttcttttgagagatacttattcagctcattttgtttatgtttaaatcagattatttgttgttttgtgttttgggggggagttttttgttttttgctgttgtttgagctccctgcatgttctggatattaatcccttattggattaatagcttacatatatttctcccattctgtactcttttccctctgttgattgtttcctttgctgtgcagaagctttttagtttgatataatctcgtgatgtctaattgtgtaattttgcttttgttgcctatgcttttgaagtcttctccataaaatctttgtgcagatcaatgtcttgaagcatttctcctacattttttttctagtagttttatagtttcaggccttcatttaagtcttgatctgtttttagttgatttttgtacatgatgagaggtagggatctagttttatttttctgcatatggatatccagttttcccagcactatttattgaggagactgtcccttccccagtgaatgctcttgatgcctttctcaaaaatcagttggctgtaaatacatggatttatttgtgggttctctattctgggttccattggtatatatgtgtgttcttatgccagtactgtggtgttttgtttaccttatctttgtaatatattttgaaatccagtaatgtgatgcctccagctttgttcttttttgctcaggtttgctttggctattcagagactttaatggttccgtacaaattttagggtttttttttctatt

SEQ ID NO: 3471 - DNA, 1040 bp, Homo sapiens
cagctttgttccattgctggtggggagctgtgttcctttggaggaggagaggcgctctgatttttagagtttccagtttttctgctctgttttttccccatctttgtggttttatctacctttagtctttgatgatggtgacgtacagatggggttttggtgtggatgtcctttctgtttgttagttttccttctaacagtcaggaccctcagctgcaggtctatcggagtttgctggaggtccactccagaccctgtttgcctgggtatcagcagcggaggctgcagaacagcggatattggtgaacagcaaatgttgctgcctgatcgttcctctggaagttttgtctcagagggccgtgtgaggtgtcagtctgcccctactggggggtgcctcccagttaggctacttgggggtcagggacccacttgaggaggcagtctgtccattctcagatttccatctgtgagctgggagaaccactactctcttcaaagctgtcagacggacatttaagtctgcagaggattctgctgccttttgtttggctatgccctgccctgagaggtggagtctacagaggcaggcaggcctccttgagctgcggtaggctccacccagttcgagcttcctggccactttttttacttactcaagcctcagcaatggcgggcgcccctcccccagcctcgctgccaccttgcagtttgatctcagactgctgtgctagcaatgagcgaggctccgtgggcataggaccctccgagccaggcgcgggatataatctcctggtgtgccgtttgctaagaccattggaaaagcgcagtattaggatgggagtgacccgattttccaggtgccgtctgtcacccctttctttgactaggaaagggaattccctgaccccttgcacttcccaggtgaggcgatgcctcgccctgcttcggctcatgctcagtgcgctgcacccactgtcttgcacccactgtccgacactcccctgtgagatgaacccggtacctcagttggaaatgcagaa

SEQ ID NO: 3472 - DNA, 1936 bp, Homo sapiens
atttttgtataaggtgtaaggaagggatccagtttcagctttctacatatggctagccagttttcccagcaccatttattaaatagggaatcgtttccccatttcttatttttgtcagatttgccaaagatcagatggttgtagatatgcggcgttatttctgagggctctattctgttccattggtctatacctctgttttggtatcactaccatgctgttttggttactgtagccttgtagtatagtttgaagtcaggtagcgtgatgcctctagctttgttcttttggcttaggattgacttggcaatgtgggctcttttttggttccatgtgaactttaaagtagttttttccaattctgtggagaaagtcattggtagcttgttggggatggcattgaatctataaattaccttgggcagtatggccattttcatgatattgattcttcctacccatgagcatggaatgttcttccatttgtttgtgtcctcttttatttccttgagcagtggtttgtagttctccttaaagagctccttcacgtcccttgtaagttggattcctaggtattttattctctttgaagcaattgtgaatgggagttcactcatgatttggctctctgtttgtctgttattggtgtataagaatgcttttgatttttgcacatcgattttctatcctgagactttgctgaagttgcctatcagcttaacgatggggttttctagatatacaatcatgtcctctgcaaacagggacaatttgacttcctcttttcctaattgaataccctttatttccttctcctgtctgattgccctggccagaacttccaacactatgttgaataggagtggtaagagagggcatccctgtcttgtgccagttttcaaagggaatgcttccagtgttggcccattcagtatgatattggctgtgggtttgtcatagatagctcttactattttgagatatgtcccatcaatacctaatttattgagagtttttagcatgaagtgttgttgaattttgtcaaaggccttttctgcatctattgagataatcatatggtttttgtcgttggttctgtttatatgctggattacatttattgatttgcatatgttgaaccagccttgcatcccagggatgaagcccacttgatcatggtggataagctttttgatgtgctgctggattcggtttgccagtgttttattgaggatttttgcatcaatgttcatcaaggatattggtctaaaattctctttttttgttgtgtctctgccagactttggtatcaggatgatgctggcctcataaaatgagttagggaggattccttctttttctgttgattggaatagtttcagaaggaatggtaccaggtcctccttgtacatctggtagaattcggctgtgaatccatctggtccaggactttttttcgttggtaagctattaattatcgcctcaatttcagagcctgttattggtctattcagagattcaacttcttcctggtttagtcttgggagggtgtatgtgtcgaggaatttatccatttcttctagatatcctagtttatttgcgtagaggtgtttatagtattctctgatggtagtttgtgtttctgcaggattggtggtgatatcccctttatcattttttattgcatctatttgattcttctctcttttcttattagtcttgctagcggtctgtcaattttgttgatcttttcaaaaaaccagctcctggattcattgattttttggaagggttttttgtgtctctatttccttcagttctgctctgatgttagttatttcttgccttctgctaacttttgaatgtgtttgctcttgctttctctagttcttttaattttggatctttcctgctttctcttgtgagcatttagtgc

SEQ ID NO: 3473 - DNA, 1077 bp, Homo sapiens
tattataatatactctgaaacatggccattattcttagaacactttgaaaaaatgataggtgactagctccttttttaatgtgtagaattctatcagatgctgtattctctttattttgggacagttgcctgattcagggacagttacctgattcactgagtagtttatggcagtacttaaaaattacacattttgtaatgcatttgtttctttttctttagtgctgctttccatgtttcagtagtttgtaccaagagtctatttcttcctagaagttcctttttcattgttttttttgtttttgtctttttttgtttttaagacagagtcttgctctgttccccaggctggagtgcaatgacgtaatcctggctcactgcagcttggacttcctgggctcaagcaatcctcccatcgcagccccttgagtagctgaaatcacaggttccacacctagctaattttttaatttttttgtagagacgaggtctcactgtgttgctgagactgttctcgaactcctgggctcaatgaatcttcctgccttggcctcccaaagtactgggataacaggcatgggccaccgaactttttgaactatttgatgcctttctgcccttaactgttattttgttcattttgctgcataattgagtatggattttgttttcttttttattattatactttaagttttagggtgtatgtgcacaacgtgcaggttagttacatatgtatacatgtgccatgttggtgtgctgcacccattaactcgtcattcaacattaggtatatctcctaatgctatccctcccctctccccgcatcccacaacaggccccggtgtgtgatgttccccttcctgtgtccatgtgttctcattgttcaattcccacctatgagtgagaacatgcggtgtttggttttttgtccttgcgatagtttgttgaggatgatggtttccagcttcatccatgtccctacaaaggacatgaactcatcattttttatgactgcatagtattccatggtgtatatgtgccacattttcttaatccagtctatcattgatggac

SEQ ID NO: 3474 - DNA, 1029 bp, Homo sapiens
ctgctatgaacattggtgtacaggtgtgtttgaatccctgctttcagttcttttaggtatataactaggggtagaattgctggatcatatgataattccacatttgactttttgaagaactgccaaccattttccacagcagctataccattttacattcccaccagcaatgcatgatggttgcaattttcccatatcctcaccagcatttgttatttttcttttttcataacagccatactaataagtgtgaagtagtatatcattgtaggtattttttgcatttctttagtgattattgatgctgagcatcttttcatgtggttattggccatctgtatatcttctttggagaattgtcttttgcccatttttgaattgggttgtttaggtttttagttcttcttgttgttgaattataggggttccgtgtatattttggatatcgacagactacaaacatgatttgcaagtattgtctccgattctgtggactgtcttttcactctgatgataggatcttttgatgcacaacagtttttcattttggtgaagtccagtttatctgttttctgttttgttgcctgtgttttatctgtcatatcctatagtcattgccaaatctaaaatgttaaagattttcccctatgttttcttctaagagttttatagttttagctcttacatttatttaggtcattgataaattttgagttaatttttttgtatatggtataaggtaagtattcaacttcattctcctgcatctggatattcagttttcccagacctgtttgttgaagagtgtccttttcccattaaatggtcttgggacttttattgaaaattaactatttttgagctctctgttctattacattggtctgcttatctatccttatgccaatactgtactattttgattactgtagctttgtagtacattctggaattagaaagtgtaagttttctaactttgttctttttttcaagattgtttgagctatttggaatcctttaagattcttt

SEQ ID NO: 3475 - DNA, 1133 bp, Homo sapiens
aatgcaatccaattatagtgtggtgggctttgaaatggtcactgtcacaccctgtagcaccttacagtttttccttgggttcttgttgctaaaagagaaccatgcttattgtttttatcttaactatttttgtactacaagggtagaagtagacttatatactagaaaatttatgaaagctcctgttataaaaaacaattcttgaaaattcaaattttaaaaactgaggaagttacttcttctgctaagcactgctagacaatgtgtaggatataaaataagcctatgacaatctctgccctcacagagggtggactcctgctataaagacaggcttctgctttgtgggggtagatagaaaatgagtttgtccacacttactttttgtcttttggatattggctttgagagaaagtctctgatggagatgctagcaagcccctctaaaccccagagaactgtggtgatgatcatatggattcagttggagccaagagacaaagaatggactgtgacttcatcagcgatcagtaatatgacaaagtgttggggggctgaggcagcaccctctatatatcagacacttacttacattaattcatgaaaatagatcatgacattgaacgtttcctaaccttggggtaggcactattacttccattttaaagatgtagaaattgaggtccagagacacttagtaacctgtccaagtttacatagctagtgacaaagttagtattcaagcccaaagcccatctgtactgcatgctatgtatagatagtaacattatccagaaaaggaatatgtttattagaagatgaacagtttggaaacatgttaaacaggaagtcataaagaaagttgatagaggactacatctaggactacccaggaaaaggaattctgtggctcaagattggatttcttgaaagtccccatgaagctctttgtgttccttttgcaagacagttgaatgaggctttcaaacactgatgcacatccacctgttgcctgtttttttttaattgtggcaaaatatacataaacttaaagtttaccatcttaagacattaagtacatttatagtgtgtgtagcctgcaccattatccatccctagaattttttttaatc

SEQ ID NO: 3476 - DNA, 1032 bp, Homo sapiens
aagttttatgtgacacagagggcttcataaagaaatgaaaacctgaagaaacagttaaacttgtatatttttatgctagatgtgataatgaagtagataattggggagcaatagaattggacaaagcgggtatgatctaatggtaataaatggggggtaatttagacttgtttgttcagattcttcttggtctctctgtgtctttggctcctttcctctaggaacctgtcacatgagggtcttatgacttgcttctggaagagttcagaaaacccataaaacctgggaaggttttatgtcctgctacagaggaggagatggaggaaggtgaaggttaccttcctgcttctgttgttttcccacattccttcagcttaaaatatttggggattaccatgtcctgaagcccatcacaaacatacaacaaaagtgaaagggtttataatgaaaaacattatagccacaagctaaattttaccaatacttgtaaatatcacatatctatgtgtcttccctttacccaccagctgtattcaaatttctctattgattctttgggacttttctgtaaaaggtttgtaactaatttggaggctgggaatgcaagtatgtttcaaatatttgtaattaaattgtactttaacaacttacattgctttttacctctgatgaattttatttaccaagttatttattatttggatctatctgtactattcgtgttcctacactcttatttgtagcatggattcatttactggcatacagatcatccattgcattttccagagaatacctttagttaatcttttttaatgtcaaatttatagtaggttctttatattagtccttgtctttttctcctgttaaaatatgtatctttttttttccctccagacagagtctcactttgttgcccaagctggaataaagtatgtatttttaaaaattaatttaaaaaaatgatgctgcatattttgtgcctagtggcaaacactgcagctaaaaagctctgtgtgtacagagtgggtt

SEQ ID NO: 3477 - DNA, 1953 bp, Homo sapiens
atattaaggtattaactaggccatgctccctcagagactctgggtagaatcttttcttgccttttcctagctcagtccttggtgttcctgggcttgcagttgtattactccagtctctggctttgatgtcatattgtgttctccctgtgtatctctgttttcatatggtctttaactcttaaggacaccatcacattggatcatggcctaccctaatgacgtcatcttaacttgtttatatctgcaaagaccctatttccaagtaagggcaattcacaggtaccaggggtacacaattttagggacacaatttaacacagttcacaattctggccccctaaaatttatgttcttctcatgtgcaaaatatatccaccccatcccaacatctccaaaagtttcaactccttccagcatcaactctaagtccaaaatcccatctaaatataatcaactcaaaaagttcctaatttcattttttatataatctaaatcagatatgagtgagcctctgggtatagtccttcctgaaacaaaatttattcccatctgctttgaagcctagaaaacaagttgctatttgcttccaagatacaatggtaagataggcataggaaagacattgccattatgaaagggagaaaatggaaagaataaaggagtcactggtctaaagtaagttcacaacccagcagggaaaactgcattagatttcagagcctgagaataattctctctggcttgattctctgtcctctggactgctggggtggccctaccactttagcctgagaatgtctcattggcccagacctctccatctgtggctttgccctcagagccagtcgtcctgcatatcattccatctctgtccatttcagttatggctggtagtacttttgctggtatgaaattctcaaaaaccttgtcagtctcctgtgcaatgcaggtccaatccatctaacaagaatgttctccacatatctttgctacataactgtatctctattcctggcttttgcagagatgattgactgggtttgtgaatcacatgcaaatgctatacccttgccctggccctgtttccagagcacactatctggataggcagagaattttctaaattaccaagtgctgttccttttttgcttaatattaatagttcattcctcaatttatttctttcctctcacattttactgtaagcaccaaggagaacccaggccatacttccacactttgcttagaaatcgcctcagctaaatgtccaagtttatcacttgtaagttctacttttcacctagtggctcaacataattcggacaagttttctgctgctacataacaaggattgcctttccccaggtgtccaataacatattgatcatttcctttgaaggctctaccagaagcatctttagtgctcatatttctaccaactatctcttcaaggaaatttagactttttctatcaagcatctcaaaattctttcagtccctacccgttaccccattccaaagccacttatttatttttaagtatttgttagagtagtgcaccactcttggtaccaaaatctgtattagtttcctggcagctactagaagatagaagagacagggaaggatcttcagagagagcatgactctaccaacaccttgattttggacttctggcctccacaactatgagagaataaatttctgttgttttaagatactcagtttagagtactttgttacagcagccctgggaaactgaaatagagatgtttcctggaggtactatagtcatcggtgcaaaacagtgagtacaaagtatcttcctccatcctcagattttcctgccatttgtctttctctcatttagagcatatttgtgtctagttgtactgtaaagtttacttttgctatgttaacagcttatgatttggctttatctcaagagatcag

SEQ ID NO: 3478 - DNA, 1027 bp, Homo sapiens
ccatgttggccaggctggtcttgaactcctggcctcaagtggtccgcccagcttggcttcccaaagtgctgggattataggcatgagccaccgcgcctgggccctagccttttttttttttgctatgagcgtttggccatgccctattgaattttgtgtctgtgtgttatatatatataacaaaatttattatttcatcctcttttttttttgtttttgtagaaatggtatcttgctatgttgcctaggctagtcttgaactcctgggccaaagtgatcttcttacctcagccacccaaagtgctgggcctattttaaccatttttaaatgtacagttctgtggcattaagtacattcacattgttatgcaaccatcaccaccatccacttccaggatgctttcatcttccccaattaaaactgtacccactaaacaataactcctcattttccacttcctccagcccctgcaaccactactcttactttgtatctctgaatttgactacactaggaacctcatataagaggaattatataacattcgtcattttgtgactgcatgcactcttgaaatttgaaatacggtattgatgatgatggtggtaataatagtgataatggttaccatttagtattgttcttttggccaggcatgctatttgtttaatcttttcaatctatgccaataaatgactttattcatcctcatttgacaattaaaaaagatgagactaaagagattaagtaattaatccaggataaaggatataatctgtgttctctctaagatttctgctttccattacaccaaaagttgatggtattagtcctggttccaacctgtgtcaagatggcattggaaaaggactgagtatgcttcatggttttcttctcctcttatacaccagtttaccttgttcagatttcaaaaacatagcacaagatatgttccattaaaaagatatgaactttattttcagactcctttagattatgcgcttttgtcaaaaacaaggaccacgt

SEQ ID NO: 3479 - DNA, 1096 bp, Homo sapiens
ttcgtctgtgttatagcgtgtgtcagaatttcctttcttttaaaattaaaggctcaataatataatttttacattaaatttaaacagagtgactatggaagggcagttgtttagtgctctacgaggaggtgattttttagctgagaaagaataaaccaaaagtcagaggaagacactcccaggcagagcaaacagcatgtgctaagtctcagagacaggaaagactgtcatatattcaagactcagaaagggagccaatgtgactggaacttagctaggggattatggcaccatatgaggctcagaaggtaggctccatgtcatgtagaccacaagggaaaatgtcatttgtatatcagtgcaatggaaagccactgaaggattttaaatcagcagagctaacatgatccgtggtgagagtgttggtgggggatggggatgcagaactatctgctttctatgcaccaccctttcttctgtgggctagtcatggcccatcccacctcagggttttttcttatgattgttccctctgcctagaatgctctctccccttccttgtctattcattgtttagatttcaacggagacataacttccttagggaatccttccttgatctcccagaatctattcaaaataatctccatgttgcacatttcatagtaccttgtgactttgctttgtagtacttataatagttttttaaatgaagccatatttgtattttttggttgattaatatatgtcagaatagcagggaccatgtcttctgttcaatattgtatcctgagcacctagtatttaagtaggtatttcagtaaataatgtaacatatataataaataatattaatatttgttgactaaatgaatttaggtctggaccttgatggcttaatgtctttctaaaaatctacttccatatctaagcctttcttgactactttcgcctttttctgtgaacttaaaagtctttattcattgtttgccggatgctaaacatttacaaaagtaatccttatgtcatctgaaattttctatttttttcatattgcttatgctttatatttgctagttggtcttttccctctaaa

SEQ ID NO: 3480 - DNA, 1034 bp, Homo sapiens
gtcttgccatcttgcccaagctagtcttgaactcctgggctccagtgatcctcccgcctcagcctcctgaagtgctgggatggtgcctggctgggaatcatttgttaaattatcttttctccatttttagttcattgctgataccccttaggactacatcctaaatatctaaagaatctttctacccctccctcaccacttccttcattctagtctaagccaccatagttcttcttttggaccattatatcaaccccctatatggctttcgtgtgtctacttttgtaccctatcctccaccaatgcggtcaccacagatcagatcatatctctgcctaaaatccttcagtggctttccattgcattggatatacaaatgatattttcccttgtggtctacatgatatggagactaccttcttagcctcacatagtgccaccatcccctagctaagttctagttacattggctcccatttcatttcttgaagatgtgaagctctttcctgtctctcagacttggcacatactgtttcatctgcctgggagagtcttcccctgactcttgattcattcttaaacattacctcctcatagaggccatactgactgcccttccacagtcactctgttaattctgttatagcacttaatcacaacatgtaattatttatttgcttacttgttaagttccatgaggacatgagggcaggggtcttgccaatcttattttttttttaattatactttaatttctagggtacatgtgcacaatgtgcaggtttgttacataggtatacatgtgccatgttggtttgctgcacctattaacttgtcatttacattaggtatttctcctaatgctatccctcccccagccctctaccctccgacaggccctggtgtgtgctgttcccctccctgtgtccaagtgttctcattgttcacttcccacctgtgagtgagaacatgcagtgtttggttttctgtccttgtgatagtttgctcagaatgatggtttccagcttcatcca

SEQ ID NO: 3481 - DNA, 2728 bp, Homo sapiens
tgtcacttactagctttatgactgtaaacaaattatttagcctctgtgagcttcagtgtccttatctgtaaaaaatttatacttcataggatatcacaaatattacatgaaaaaatatatacacacataccacataaaatcacaagcgattggtgattcatagatacaaagtaaatattagttcctttcttccttcatttaaggggcttatgctctgctagctgaaatgaaccttttacatgcttacctaagttataaaatagaacatagtgagtactctaagggaggtagtagcaaagtggtaaagcagttcagaggagggagctgtcatttctaagcatttggaaacaaggttgggcttcatttcaaaatgaattttacttgggccatgaacaaatttcaatagagtaaataatttaggtagatatataaaatagggaaagcatagggtatggtatctttgttaaaaatagctaccacaggtttgagtattgtatttgtaaaagctaatagtaggaaatatggctagagagatgggctggggcattggtattaaagatccgaaactgtgatgcagtttggagttgattctggatacattagggagccacacattggatgtcttctttctctacctcagtttactatctgtaaaatgtataggcatcaattcagaaacttcaaatttttgtttgcaataaacgaaataagaaattccacacttgaaaagaagttcctgtgtaggccaattttaggttaaaaaaatctaagatttgttttgtagttgtaggttaatctttgcagtaatcttatttgattgataggcttcgtgaggttaagaaacatacaagatctcactggtagaaagtgaccgaagaagctctaatttcaaattctgtcttttttattccgccatactgattaggattttaaaggaaacctgagttcctcaatgtcactaaaaattaaccgcacaacccctggcagatcacttttactttgtcatttataaaatgaaggaagatgtagctgtaaggtttaactaagataaagtgcaaagtactttagataatgttggtcacatatcaggcactcaaatgttgggtctttctctccccatctgtgaatgagggaatttaaccacagcattccaagaccttagtgttaactctctagccaccgtaaactgctagaactaattacatttggccttctgtatccatgggttctgcatctgtgtattcaaccaattatggattgaaaatatggaaaaaggatggttgcatctgtactgaacatgtacagacttttttcttgtcattattccctaaacaatagtataacaactatttacatagcacttgtattgtgttaggttttataatctagagatgttaaaatacataggaggatgtgtgtagatcatatgcaaatatgattttatgtagggatccgatcatccctggaatttggtatccaaagggcagaggggggccctgaaaccttttgataaccttatcgccagataaacccagcaagacttatcacctgttatctttgtcccagaatcaaacggtctgtcttccatactgttattcttattttgacctggcttccttttactctcttccagccctgcttttttgctccttccacttgctctctcaaactcctgtttcctacattgttaaccattttattggatgtctttttgtgtgtcctggccttaagtggaagccaggctatctcctgagtcatggagaacatactacttcctctgtagctcttttaaatggatgcagcacattctcctgcacccctcccatcccaaagaagagaggtgaagataactgtatttttttattctccactatatctggaccattacttcttcatcttcttaaaacccctgtgctctttggctatacacacccttggtttctgatataatatattcttatacaatatctattaagatgaaaatacacataaactacaatctagcaattccactcctaggtatataccctttggaaactctccaatgtatgcataaagggatgttcaaaaatattcatgcaacactgctacagcaaaaaatttgaactagtctaaatgcctgtcagtaaaagaatgaaaatattgtggtatatttacttaatagaattccatacaatagtgaaatgagtgatctagatctatatagtaacatgagcaaatctcacaaataacaggttgaatgaaaaaggtgaattgcagaacacatttatataaagcttgacatgcacgtattatttagggaggcatacttatgtaataaagaaatacatgataattataaataccaaattaaggatagtaggtatctccaaagggtaagctggggagaaaagaccaagaataatgcaaagaagggcacacacagagcttaaattgaataagtaaatatttttcaactgagttgtggatatataggtatctattaattattctttatgccttttatatatctgaacttttctttttttttttttttttttttttttttagacggagtctcattctgactcccaggctggagtgcagtggtgcgatctcggctcactgcaacctgcacttcctgggttcaagcgattctcctgcctcagccttctgagtagctgggattacagacatgcaccaccacgcctggctaaattttgtatttttagtagagacggggtttcac

SEQ ID NO: 3482 - DNA, 1085 bp, Homo sapiens
gtgagggcacttagactagcctaggagttaaaggaaggctttgggaagagatgatatctgacccaaatcttaaatggtaggtaggagtaagtgaggcaaacatgagcagaaagcgtccttcaaacagagaaaacagcttgagcaaaggcatcaatgtgagaaaaggaatggcttgcgtagagaaccacaaacagtttgggactgctaggaatataacaataagtgatgagttgtaaggctggaaatacagtcagaggccatgtcgtggtggaccttgtatgcataagtatcctaaaatcaattcagtaggtgttttttttttatttttatttaatcactggaaggtgtctatcagacatggttgaagtaacatttttaaaatgtggtcatagggatgaagagaaagaaatgaatctgagaaaatgtataaggctttaatgattgattgtatgtgcaggtgagagggtgaggagtcccgtgtgatgctcaggtttttgccttggatgactaaggaggatatgttggtaattttaactgagacaggaaacgatgatgagttcaattctggacttgaagattttcaatttcttgagttagatcagtgagcaaatatagtggaagtaagctgagaaaaaaaagaggtgtggtcagaaagtggaatatcggagttaagttgtctgatattgggactgttctaggtgacagcgaggtctctgtgtatgggtagctaaaatacagcagaggcgaaggtcagtaaagctgagtatgacaaggaatttggaggctagtgtattgaatgagtcatctgtgtagagagtgaagtgattgaggatgatgggatgtggggaagagagaaagatgtgacccaggtgcagtaaagataggggattaatcaggagggtggtagatgacagatgaggaggtggggtagagagttatatagccagatggtgcaaaccttgaaggaggaggggtttttaaacacaagagtgagaaggtaatagtttttttacttttccttcctggaagcagagttctgatctctatctttattcaggactcatattaatcattctgtttgctct

SEQ ID NO: 3483 - DNA, 1059 bp, Homo sapiens
ttgaagaatgaatctgactgtaatgagtgctatcaaggcagagtgccagatacagcaaatactgattgagccccactcggtgctaggcactcttccaagcacataacctatattaactaagtaaaatgtgcaacacctcttggagcatatgctattattttgtagtaattttctaattgaaacagatcatacatacaaaaaacaatccaagtcataagtatacaaccatgagttattacagagtgaacatacctatggaattgtgcccagttacccacaggtcaagaaataggacattatccctattttacagatgaagaaactgaggcacagagaggttaagtaacctgcccaaggtcacacagctaataagggacagaggctggtttccgcctcaggagttctgtctggtaagcccagctctgttttctactgcccatagaaaaggtggacctggagagcatgacccatctcagggtcaggggaagcttctgagaagctggggttggatctgagctcaggggagaactggagcttcatcagaaagagggaaggagagcattccaggcagggtgatctgctgagaggcctgcagatctgctgtggggattcaggagggaggcgatgtggacagcctgtcacggccacaacacacagactcaccagtcactggagggcagccatggggctcacaaagggattcttccttccacaaaaggactcacaacaggcatccctaaatagctcgctgcaaggaaaacccactttgagttgggaaagtcacatttccatagagtggattagagaaatagggctttcattggaagaggtggctcagtctgagaataacagctgggaggtgtaatagtaaaaccatcccacagccacagccatagctggtctcctctgggcagcatcagcacaccctccatgggcgggtgcttgctcaggatcacacagctggtcggaggaggcaggatttgaactcggcagtctgatgcatcaacaccccatgcctaaccactgcactcgcagcgtcctaatcagacaggccacctc

SEQ ID NO: 3484 - DNA, 1034 bp, Homo sapiens
tccagatttagaattatgtctttgggaatatgtgttacctctgtgtatttattggggaacaaattgattaaactatgaattaaataagtggtaataagttggagccttttggataggtgtgtaaaaaataaagtcagtaagccactctaagaacctaaacagtagcaaaaccacataccacaggagggttggtggcgtggaggttgggaaatgtataacataggtagacaaactgtgcccattacccacacttgctttatatctctttaaagtcttttaagtggtcaaagatgggtatagtagtcagttcttgcattgctataaagaaatactgaagactgggaaatttataaagaaaagaggtttaattggctcatggttctgcaggctatacaggaagcatgctcctggcatctgctcggcttctggggaggcctcaggaaactttcaatcatggcaggaggtgaaggggaagcaggtgcttcttacatggctggagcaggagcaagagcgggagggatgtgtcacacaagttttaaacaaccagatctcagaactcactatagtgacgacagtatgaagaggggatggtgttaaaccataagacactgcccccatgatccagtcacctcccaccaggccccatctccattactggggattacaatttgacatgagatttgggcagggacacagatccaaaccatatcagtggggaaaggcatcttctgaaggagagcggcaaagtcactcattcagttaagcaagatggacattctgcataggcagtttcatttttctagatgcttggaccgaaagccactctgtcttacatcattagcaaatcctggcagcttggccctgaaaccgtatctagaatctgcccatttttcccaacctctgggtcaggccactggtagctcacacctgggtgatcacagtgtcctacagtcacctgctcccaccttccccactgtggtccgttctcagcccaacaagagtgatcctgttaaggtccacacaccctgccgctc

SEQ ID NO: 3485 - DNA, 1031 bp, Homo sapiens
tgtggtcccagcgatgcctttcagcagacatcaccttcctgggactctcaggcccctctgtttaagaatgccgtggggcttcttggtggggatgggtgatgctgggtatttgttgaggatctggagaggtctgggtctttctccagcccctcattttctcagatcctggccaggtttctagttcctgcattggagttgccatcccagtatcccagcaaatgtccagacttctgtctctcttgacatgtattctccaaaagtcatctctgtactgcccaatggccatcttggcatgtctggtttcccatggggcacttgggctcagccgactaggctgtttgcagggctgactgcacactgtatgcaccaggtgtttccactggtccctatcctgactggctggggcccagggctcaatggttggtgaatattttgaatctcattcatagttattcacctttgatgcttgactttgggaaacgaatggtctaaacgtttcagagctcacagcttcagggactgtctgggctctggaagggtgccgtgtttcagacgtgctttgtggaagttttgtgccagctgtgttttgtgtggccacatgtttgcttcctgggatttgggtgtctgtgagcaggtcccatggcgttctgtctcagggtcctgtgtctgtgtccctggtgtgatcagggtggcctggtcctgcacagccctgaaggacaacaacgtagaggaaaatgcgcttcctgtgcaggacagtccccatgagctggggccaacatggctgtcactgggggcctctgatcctctagcacctgcaagcgcctaactcacagggtcagcgtgggaggcacgggagtcctccataaggttgggggacaacagagactgccaccctccccagggccaccagttggcatcttctggtggcactgaccagcaggggctctcaggagagagggtgcttggaaatgtgggcagcagggtagtcaatgatgggaagggggccaggggtagcaaatgcccctgaaacc

SEQ ID NO: 3486 - DNA, 1049 bp, Homo sapiens
ctgtgctgcaaaccatgtctaccatgtctgatttttagaaggctcagcacttctgcccgccttagcttaggtaagcaagacctggggtaaggctgccaggacgagttccccgacctttgctgggctcccctttcttctgtccagcagctgcagtgtggttaggacataggttgaaagggcaactctattgttcagatgctagacaattccttactccctcttgccgtggatacagcgatgtcccctggggccatgccggtgcttccataggactaggggccatagactgcagtgcgcatcatgccacagaagccacagagaacttctattaattgaggtgggagacagtcctggctggggggtcaagaggcacaggatggtccagtcctgccaccattcccgtgtgattttcagggaaaatcatatcacctttctagccttcagtctcttctgtcaagtgagaggaatggactagacagtcagtctctaagaatctatcagaagatcacggtgtaactttagtctccatagaagagatcaaaagtatgtatgagacacccagagacagttggcacttatgcctagttttggccgtaaggcaaatattaattgtaagggtaaccattttgtcctggtttgcctgggactgtctttgtttattcctgttgttcctcgatgactgttagtagttcccatttcattctccaagtgtcccagtttggatggtatcttatatggccaccctgttgactgagatgtaatctaatgaaatgagatttgtctgtcttccccacactcagcctgctttggtacaagtcacaggaggcctttgactgctcataggagaatctctgctgatacacagtctttcattgacaaatatcaatcactgtatttgcaccatatccaatgactagagggatgtcattgaatccgtcactgtattcaatgaccagaggggtgtcattgaagacataaatgatctcctgcatcattcactgctcctgactgaagtgctacatgaaaaagttttgcaagaaacttagatg

SEQ ID NO: 3487 - DNA, 1034 bp, Homo sapiens
agatctggaggtcagatcaggacctagagtgcgaatgcctcacaagaaattgcgctcggaattcagtaagtatttattgaattaaaccgggctccctgggtggagctggagaagctggacaggtggtaccatggcctgtggggtcctctcctcaccagagctgaagaaggctgtgggccactgccccaccagtgactgatattcaggagcagtgctgttagcctgctttgcaggaaccgtccctctctggcctgtcttaccagatgcctttcaagaggctcaatgggaatgcccctcccaccatccagtaggattcccctaggccatcagcctcagtactctcttgttctcacaaattcacccacctagggatgtaatggtgaatgagactggctccttggcctaaaagaaccctgtcctgtaggaggagaaaagcttgtaaacaaatacattaccacaaggtgtaagacatgtgatagcagcaaagtgtctaaggtacagaggtgactggctgagtgtaagggggccatagaaagctcgctgaaggatttgatgtctgaagttgtgtattagggttctccagagaaacagaaccaattgtgtatgtgtgtggtgtgtgtgtgtatacagagagagagattttaaggaattggctcatgcagttgtggaggcttttcaagtccaaaatctgcaggatgggccagcaggctggagatccaggaaggaggagccaaggctaaaggtagtctgcagacatcattcccctgtcctctggggagggcactctttttctgttaaggcgttcaaccgagtggatgaggctcactcatattgtggaaagcggtctgctttactcagagtttaccaattcaaatgttaatcttgtctaaaaaatgccttcacagaaacatctagaataatgtttgaccaagcgtcttggcctatggcatagccaacttgacacaaaattaaccatcactggtgggtttaaaggacattgaggagtttgccacatgtctaggagggaaagggca

SEQ ID NO: 3488 - DNA, 1024 bp, Homo sapiens
tggggagagttaacctcctggcccggcattgcataaccgcagagtctgctgagcgcaaggagactcttctgtgtggcagccagagtggcaagcctggtggctccgggctctggcaccatcccgcagcggaacaaacagccctcccttcccagataatggccctcattgagcattgtgtccatggccagcacccagcacagggcagctcagcctgggtaagtttcctctcttggctgcttagcaaaatatttacactacgcctttctagtaagatggttcctaggaaccagcaggcagagagagctggggaaatgcacccaccagtgaccctggtctcagcttagggaaatgctgccacacacccaatgacatgtgagcctggtgcggtcattgccctccagggctcttttgtaaaagaagacactgaactaaaagatgcttagaagcctgtccagttccaaagccattggcatcttctctaattaaagagtgaactccagtttcttatgatgtgggagtagaatttggctggtctttaatatctcacaaagggtctctttctcaggaaggcatgtgtgtgatttgggagaggtgaagatgagaagtctgaatcctacctacttggttctctcccgtgcatcatggatgtcaggaaacactgttgatatctcctgtgcactgtcaatgtccctctctgtgtgtctttgaatggggagcaaggggcataagccagatcaccccaggcggtgccgcactttaagaggtatctggaccagccctcaggagcatgcagcccttgtcagaggaacttttgaagaaactgggtaacagaatacttgagagacagacttgctgtcctcaaccaccccaggggttgtctggagaaaaagggtcagagatgttctgtgtggtcctcgggacagaatcaaaaccagtgagtgaaaatgacatggctcattattaggacgatggcccaaacaataggccccataggtattttaaccaaaaacacacacattgatcc

SEQ ID NO: 3489 - DNA, 1047 bp, Homo sapiens
gaggttgcagtgagccgagatcgcgccactgcactccagcctgggcgacagagtaagactccatctcaaaaaaacaaaaaaacaaaaacacaaacaaacaaacaaaaaacactccttccatcctcttagagccttgaggtgatctgaaagaagaatgcaaggctgtttttggcaactcaggagttttgtttagattctgaagccaacagctctgctagaaagaacagcatagtgtctgaagtccctcttaagggagtatattgccattcaaatttatatgctccgcagaaatgtcttcttccacaaagactaagaggagagacttttgatgtttgtcttgtatccagaatatgatggacgaatggatggagggagggagggagtttgtttcaaaatattcatgtttcaacaccagaaaacagaatgtgatgtggctattcagtttaccaaaaatagtaaataaggatacttgtggctgggtgcggtgggtcacgcctgtaattccagcactttgggagaccgaggagggaggattgcttgagcccaggatttcaagaccagcctgggcaacatcgtgaaaccccatctcaacaaaaaatacaaaaagaaaaaattagccagttgtggtggcacatgcctgtagtcccagctacttaggaagctgaggtgggaggatcacttgagtccaggagatcgaggctgcagtgagccaaggtcatgccactgcactccagcctagtgacagagtgaggcccagtctcaaaaaataaataaataaataaataaataaataaataaataaaataaaagatgcttgtgaaaacttaagtgaaaattcacacatgactttaattagaagcagtgatcctaagatctcatcttactctaaaatgtattatttaatcatcctgtgaattgagcaactccttttattgggaaagatgtgatttattttctatttctgagtaatctgcacagatagccctaggagttccataatatgtatggcccaggatttattgattacaagcctttctgaaatatgtg

SEQ ID NO: 3490 - DNA, 1030 bp, Homo sapiens
tgaaccgagatcctgccactgtactccagcttgtgcaacagagtgagaccccatctcaaaaaaaaaaaaaaagaaagaaaattacatgtgtagcttatattatacattttttggacagtgttggcctagaacaggggtcggcaagctttcctggtaagagaccaggtagtagtaaatatttcaggctttgctggctatacagtctcacaactacttaatgcagccgctgtagggctgaagcagccagggacagtacataaatgaatgggtgtatctgcgttgccataaaactttatttacagaaacaggcagcatctcagatttggcttgtgggctgtagtttgcagactcttagtctagagtaatggcagccaaccagtaatggactgtaaaatcagaagtgatgaggaagagatgagcagcctcagggctaggctgagaagtggggcaggccctgagcagaggatagggtaagaaaggccctctagaaagatcacaagacaagaaactcatctctactgagtgcctggtgtgtgccaggcatttttcacatgcttcacctctgttgactcctgtcatcgtcaacaagcctgtattagggtggatgcaagtatcattaatgttcccattttttagatgagaacattgaggcaatgtggggccaggtgacctgcctaggaccacagtgtaagctgagccaggatccatgcccaggcagccggctgtgactctgcatgcagtgccacctctcgcatgctgtctttttttccctcactacatctcccaacacccttatgaggtggggtttagtaacctaattttttttttgagacagagtttcactcttgttgcccaggctggagtgcaatggcacggtcttggctcgctgcaacctccctgcctcccgggttgaagcgattcttcttcctcagcctcctgagtaactgggattacaggcacctgccaccatgcccagctaattttgtatttttagtagagatgggatttcaccgtgttggccaggctggtc

SEQ ID NO: 3491 - DNA, 1090 bp, Homo sapiens
gcaagatcagtctatacaccaatgtggggaagaaaatggtacaggggttgggagtcagtatggatgcatcttgtccatggggccatgagggagcatgggatatgctaggacaagtgttagggaccaaggagataaagttggcttgatgggaaggggccacattgttgaggcctgcagatttgcagtggtaagaaacagggagtggctgaaggttttgtagtcagagagtgatgggtgaactcacagatagataaagagcttcctacgtaaggattctcccatatctttggcgggaggtacttgctcttgctcttagaggaagaagaaaggaaactcacatttaatcctcacattctgtgcactagatttaccacctcttatctcagtttgtacatctgaaaacagaagcacagagagattaagcaacatttccaaggttacatggtgtgttaatctgtttgtattgctataaagtaatatgcgaggctgggtaatttatacagaaaagcggtttatttggctcatggttctgcaggctatacaagaaacatggtactagcactggctactggtgagggcttcaggctgcttccactcatggtagagggcaaagaggagctggcatgttcagagatcccatggtgtgagagggagcaagagagagaggggaggtgccaagctccttttgacaaccagctcttgagggataggttaccaagccattcatgagggatccaccccatgatccaaacacctcccactaggccttacctccaccactgggatccaatttcagcatgagatttgggggaatgaacatccaaatcatagcacgcagttaagaagtggcagagccagagaagccagttccaccagcctctctgaccctggagtcagaaagtagcacctgaccctgttttgtaaaggagttgcttttactccatgggattatcttgtttgacatggcagaggatttgacctgggtgttacgtgtgatcctgtctgatgacaagctgtctatgcataagctgcttttgtgtgtacttatttaaatgtgaccttgatgagtctgttgagggggcagaatgac

SEQ ID NO: 3492 - DNA, 1050 bp, Homo sapiens
aattattgaaagggtggagggagatgaagctgaagagaagggcaaggcccaatcctataggctcttgtaggctttggtaaggattggtattgggaagctcctagaaggttctaagtagggacatgatctgctgtgtaggggatggattttagagcagcaacagtggaaaaaagaccatgatgtgccacttcaatagttcatgcaagaagatagttgtatgatttgagttttggcaatgggatggagagagttgttgggttatagggatgctttggaagtagagccactgcagactcactaggggtttagacatgggtgggtgaaatgagaaaagccaggatgcctcttaggtttgccagtcgcatcctaccacaactaactccaaaggactggttgcattcttgtgaatttccttcaaggggaaaacatgagaaataaatgagaattgagctgagacccagtaagtttggagtagtgtgggaatccacatgaccagtttcattgatctgcttcttagctcttgctgtgggaactgagaacatgctcagattgtcttgttgatgggattactcgtaaggagatcaaggagatgaggacgttctgaaacatcctggaagttgccctgtgacgcccaaggagaactgcagcatgtcccttgtcaccctcagcagctctggagaccaggcatcttcccatgccagccactaacccaggctgaacctgacccagctgtgctctctgcctgtccttctcctgcagccatgcctcccttgttcttctctctctgggtctcacactcccagctgctcagcagggacagtctgcttggattggctggttcaccagagggcaagtctgcggggcagagggctcagccaggccccgactgaggcagctggagtccttgacgtctctcctgaaggtcattgtctttggcatgtgcacatattcttggcctagtcatggccagaggatcatgggactcaaaacatgcacgaaagctcaggtgctgagagctgcctgtaatctctgaagacatagcagccacag

SEQ ID NO: 3493 - DNA, 1050 bp, Homo sapiens
gaccccatttttgtttaaaatattgaagacatgacattacttttataattagaaaaaattgtttacgaaaatctattttttaatatttagccaaattctgattttccttagccattacccatttttaaaacccattcatttaccaaattttcattgagttctttctataggctgggcatggtgccagctactctggttcggcagggtagaaaactggccaggcccagcttccatgccacaggggagactaatgataaataagtaaacagaccctaggggcagtcatttgttgatgccaactgtgtgctgggcattcttctaactgatgttgatgtttcatagatttactctttcaatcctttacataattcctttaataaccctgggcagcatatagcattaatacccaaggccacccagccagtaagcagtggggtcaggactctccagcctgagctgccaacctctccagcttctccagcctctcttcttactgatgtattataatccagccacaatggccttctttcctgcctcggaagctttgcacttgacattctgtctgcccaggcaccccctctcccactagaccccctcctcatgcaggtcacagaggcctttgctgagctgctggtctggtccatcgtgacttccctcttacccctgtagacattctccatcacttaacatcacatcatcttgttttactttcttgtggctgttttctctctctgacattatctgacactgtttcacccgctggattgtaagctctatggaaaacatgatccttgtccatgtggttcacccactatccccagcacctagcatagtacccagcatagggtaggtgttactggagacagtgggaaatgaataaatgagggatgatgagcacatatcctaggagagtggtctccaaagtgggatgtcggtgttggagaccatggaaggtgagatggtccattgtggggcaggaagaaattatgattgagaagtagatagacacataggaagatgacccacacacatctcatcctttttcccatt

SEQ ID NO: 3494 - DNA, 1033 bp, Homo sapiens
tggaggaggtgtgcatttgagactgttcaagtccatttcaccttaagcattgctcttgtgtgtgtgtgcattcattgtttccttccctcccgctgccattcagaataactgcagctgtgagccactgcacttggggttaccatctgaaagggaacctgcttatcttccgtctatatctgccaagtgagaaaacttgtctctacgtcagtaaagctgggcagtgatgatatcccttgttttcagggatctttatctgattcccttgcctgactcctaaaacctaagtctctgacctgccctccaattctcttttcacaacaagctgcctgtctttgtcaagatctgtggtccacagtcctgttgaatctgtagttcatttcttagactcccagtgtgtctaaagaaataggaggcaggaggcaagcttggagggaatgggaaatgttgacagccatgcagaaatggatggggagagatgcatgccaggatgtttgcagtggcttgggggtggaggcagaggaggtgctgggtggcaaagaggagggaaagagaggggagaggggaggagaaaagaaaacaatgactcagttcttacacactgaagcatatgcataagtgtgaaaataactaagccctacagtatttcagcagaaggaaggattagagttctggatttctgaggatttctatcttgttctcatgactgctcttagcttatggtcagataaatgttaggggagcatcaacggaaggagcaagagaggtggagaggagtgcagagcccacacttgttgcttatttgtttggacagacagccatttcattggtggataaaacttcacttaacttgttaactcccctttgaaatgaggaagcattgtccgtagcctcgtgcttccagtcagtgccacctttgggtggtctggcctttttaagttcttgtaaagctgctcgaacctgtgtctttatgtctgacgatgccacctccacctcacatcccccaagttttaaaattcagaactgcccctgactc

SEQ ID NO: 3495 - DNA, 1030 bp, Homo sapiens
caaaaattctaaaacctgttgatgcaaaatactctacccccaagggaggattgctccctcctcttccctccactggatgtgagaataacttttgggagtctaccaagtaatagcagcaataactgtcatttactgaccacccagtaccaggcactttgttagctatgttaggattctcatcacattaaatccttatagcagccctgtaggacagggcttgtgggacccactttaaaggtgaggaaactgagattaaagagtaaagccggcacaggcacatcttgaattgctggccaggaaaccctgcccatgggcagctattcttaagcagggagctggctgcattggcctgggcagagaaggctttctgagatatatatatgtattttatttttttttcccttcagaataactctcacaagcactggacttccaataaatctgctttagggcagggctttgtaattcaacatgaaccctgagatgctccagattctgctgacaggggagaagatcatggcctgagaatgttttggttcagggacaataatgtagatttggagaaagatcaggctgggcttgaattctagacctactacttacaggatcttgggcagattattctcagagcctcagtttcctatcttataagctggggggtaataatagtacttcatagagctactaggagagttaaatgattcaatgaaggtgacactttcatgagcgtgctcattaggtgattagactctataatgcttattaagctcatggcagattaaatgatgtataatggatgagtgacaatcagctgacatcaggagttcaagaccagcccggccaacgtggtgaaaccccgtctctactaaaaacacaaaaaattagctggacctagtggcgggcacttgtaatcccagctactcgggaggctgaggcaggagaattgcttaaacccgggcagcagaggctgcagtgagccgagattgcaccattgcactccagcctgggcaacaagaacgaaactccatct

SEQ ID NO: 3496 - DNA, 1038 bp, Homo sapiens
tggcagtggatcaagatgtgctcaactggcactattgttgagctgtctccgcccattgtgtttagtggcagccaccctccttggagtggagaagtgtgtgctgcctttgggtccttgccaagtgagctgttgagacatttagtgtgtgaaaggtacaggcaagaagaagatgcatttagtctgaagtcctggcaggttctaggacatgatttgatgaaagataacattaagaaagctgtgtgacaactggatagcatttaacttgtctctcactccctactctgtgaattccctaatgtctttaaggctcttttttgccctccatcctgcccatcaaggagtccctgacatgctgttctccatcctgtttcctgtggagtcaaagtgtatttacaaatctgcagatgcactaggcgggcagggctggaaaacactggctgtatcaacaggcagcactagcattctgggtcagacttggccaaagcccgtgaccaattttcttccttatctgtaaagtaggtgtaaccatcataaccttaccaagaccactgaactatcttgagaagaaaaatgagatacgtttagtaacatgctatgtagttgataggtattaggataataccacaacaatctggaactcacatttacataatttcacttatccagttgggacctagatggcaaatcaagagaaaggtcataagtccatgagctacagtttatgaattttgatcattggaggaaattttataccctctttcaggcctctgcatttacttcaagttttaagaggcttggttattagtttgtcaaatgcacctagcaaattggaagcaactgatactgtactgtgcaaggattattaaagctcttttatcaagtatcagtaagaagtaagagtaaaaaacagaaaaactaaaaaaaaatttaaaaggcacaagaattcaaggcatggaattctaaagctgatatgagcatttaatgtaagcaattcagtgaaattttatgtattttgatggatctttggtactctgtttt

SEQ ID NO: 3497 - DNA, 1049 bp, Homo sapiens
tgtcctttgggtggaaaaggactggcttcctggcagtgccaaaatgaagatctttctctgctgaaaacaaaacaaaacccctttatctgtgaaacttcctgtttcctccactgaaagccgtgcttctccaacatggggcattatgccaggggcacatgaaatcataggacagactgggtgcatcttcccggatgctgcttgaaactttggggggaaatagttttgactttttcttcctcgtaaaagctgttgccatacatgggtagaggaatattatggagggcaatgtaaaattcatgtggcatttaaggattaaacaggagatgtaaaaatttcttgtttctggtaagctgctttgggttatgtcttcaaaattcctggggtgtctttctgcttctctgctgttgggaaggactaaaatggagacttctgagcagcacctaaagtattccttgtaagtggaagactgctatgggtttgacccagcacatttggcagcttgggctgatttaatgaagttgtacaaaattttgaaatattaatagagatgtcttccttccccagcccttaaaatttccccatggccctccccttattctgttattaattcattgctggaagcatttggactgttataataggaatgtaaagataaataaacaggtagggctcctgttgagattttaaatatctgtattttcaaattcatagcagagacaaagcaagacttttcatatggaagagtttgggcttgaacatcaaaagcaaatctttgaagaaactgaggtgttatgggttgaattgtgtctccccaaaaatcagatgttgaaatcttaacttctagtatctcagaatgtgactgtattaaggagagaaggtctattacagtggtaatcaaactaaaatgaggtcattagtgtgggctctaatccaatatgactgatatgcttataaaaagtagaaatttggacacagagccatgcatacagagaagatagtatgaagagacatagggagaagacagccacctacaagccaaggagagaggc

SEQ ID NO: 3498 - DNA, 1021 bp, Homo sapiens
taaaataaggatcataagagccactttttgaaggcttatggttgaattagtgagataatgtgtgcctggcatataggaagtacacagtaggggttagtttatttcttactttcttctctacccaagtcgctgctattattgcctctttccttccaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccgaaggggcatgttgctcctgagcagcatgaagaactgaccaaattggttttgatgcttgggggatcatagagtatttatgtctgcttttctaaatctgcattataatagctctaaaatttgttgattggtaagaaattg

SEQ ID NO: 3499 - DNA, 1075 bp, Homo sapiens
ggtaagaagtacaggtgggcataattgaagaccgtttaaattattgtgaagaacttaggctggagtgtggatatttagataaggggtggacagatttggttagataaactaaagttatgagatcaggacttttactttgatttgacagcccatagtgttgagaagtgaatcaaaacagttaaggtacatagtcttcacataacccattgcaagaggaagatgctgagtagatacagatggtgttgcaatagtaatggcctgagctagggatatatacataaatgaggttctctggaaaactagcatgctttctgaatgctgtatatacctgtaattatatgtagtgtcattttatcagtttgacagatctttattctgtagatactgtgtgccaggcattgtactagggtactgtggtgcataccaagaagaataagacgtaagacacataattttaggacaagggtaaagtatagaaggtattttaagaaagataaactattgtgtgcagaggaaggagagattatttcttactagtactgtctgagaaggcttcataggttatgtggcttagctttcaggtggtgataggcagagcaaagtagagagaataccattcagggtatatgtctaataaatgagggttaagtgtctatcattaaaaggtattgttctagatcctgaggaaacagcaatgaacaaaacacaaaacctacttcctgtcctcatgaagtttatgttctgattgaggggagggaatttagagtgagaaaggtaggagtaaacacaagataagaggtctttattaaaggtattgggtagaaaagtattaggatttgagtgggaacacagtagttaattttgtctggataagattttcctttttgaagttaatttgcattataaaaattcatgcttatcagaccacaccttttgtattctaagcactaagtgttgagggaacagttggtaaacaagacagtcataccctctcctcactcaagcagggaagataaactgataaggtaggatgaatgtacattcctggtgttgcttattgtctcagcataactac

SEQ ID NO: 3500 - DNA, 1033 bp, Homo sapiens
agtttgtctttaaaaatgtttcactaaccatgtagatttgtgaggtcctgggctatagaaactacagtatctttatacattaaattcttttattgtcatataattatcatctgttcaattgagaattactataaaaaatgtgttttgttgatcattttctttctaaattttggtgtggcagaagttcttggatttggattcttcagtttatgaaagttttcttttaataatgtaattataagtggatatattttcttatataatctttttctcagttcaaaacaagtgtttcttgtgctatttttccattgtatttgcagaatgtttgcttttgatgcaaaggattataaaaatccattttaatatcataggtttgctgtaatatactgttaatataatttctttacctctaggggtcctactgggcaatagacaccaatccgaaggaagatgtgctgcctactcggccaaagaagagggcacgatctgtagaacgggtaaaggctctttatcataaatttagtgtaatgcattgaatatgtctgaaatacagattttgaaagttcttttccagtctagcacatgtaactataatgatggtaagattttatttgtgtagcattttacatttttcagaacacttttcagactcattttatttgatcttaactctgagggacagtttaggaattaagtaaaaggttttgtcataattagggcgcaggtgtcgtttgagacttgaatccagctctcttgagttttaatttggtattcttttctctacaacatttaggaatagttttatgtaacacaactattcccttctattatagaggatcagtttggttgcattgaattttccccattgtcctcaaaataccttttcctggttctgtccatttaatagtcactttgtacacaacatttctaagttgggtgcgtgtgtattgcttgtaagataattcttacttgtgaattaatggttaaaattaatttgcaagagtgaaagtaaaaaggaactatagttaatatc

SEQ ID NO: 3501 - DNA, 1030 bp, Homo sapiens
aggatgtactttttaagtatctttaacatttaggggaattgtttactataccacagtcaatatgccaattacatattttaatccattaagagtaaatttcttaacactctaggcttaatttgatgatcaatgtatttaaaagtaataaaaacttgtatttgttcaaaaagggtatttcaaggacctaagcaggcattggaatagttgttatccacatgttcattcggtcaactagccagacaagcagactgcctttgagtacttactgtgtgttgtggtctcagtagctatttaacctattgtccaagctagaaacttctgagaatgaaagtggtgctattcttaactatgtttggggaacagttataaagcaggattgaaactccaagtatggttgctctagatctgtggtgcatgcaaatgctgtgcctgagcagttaccaggaacagcatcctaagaagttgggagaaaacaaggcaaacaaatcttttgaagttggattgccaaaataaactgggagaggttaaaaaaataaaagatgaaggcatggtataaagccaaagaagtcagggacaagaggaatccagctcctgagatgaatatgcattgaaagctaaggaagagcagagaattgtctatgatgattccctttaccaacgggcatatacttggcaatagtaatagatttcaccatttggaatgtttagctatttatgacagggactgctctccccaggagtctgaaattaatattagcatttttggtttatttgtacttaatcaggtaatggcttttttgttaggctattttcaacctaagataaatatgcagggtactttgtgttgacataaaattttagctagaaataaagttttggaatagttaaaatgcactttatttgaagtaataaatactttttaatgatgggaataacaacatttaagtttattgttgatctttgacacatcttcatttctgatgcattttcttttctttctttttttttttttgagacagagtctcactcc

SEQ ID NO: 3502 - DNA, 1040 bp, Homo sapiens
tttctcagttacttctctgacctcttgcctccaccttactttttggtaatttgtttttatgactctcctaaaatttgtgtaaaagaaatgccagaggtacattttaagcttttaacggcttgtggtggtggtgagtaaaagagttgggctgcagctgggtttttcttaccaagatcctgttgccctcttaaagaaacaggcagtgatttttagaaagattggcatcggaaccactttgtttgtctatattctgtattttaaacaattttaaaaccaagtttgttatgttttggtgaggaaaaaattaagaaaaaagattggaatgttgatcccttaaatatttggtttgctcattaacatactcaatctttttcctccagatgtaactcaggctttccctcactttggaactcctagatttgtgaatattggatattttgagaagcaggggttctttccttgatattgactaaggagtctatttaccttcaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaaggtaaggattttatttaaattattacttttatgaagtaagcaatgatgttgatttctactgaaaataaagctttgtgaatgctcatgtaattgaatatgaaattttgatctctagtgatttttaggatgtcaaaaagtttttagcttaggtgaataactttatttttggtagattattagtgtgttgaagcttgattatgttataggactgatgtagcataaag

SEQ ID NO: 3503 - DNA, 1073 bp, Homo sapiens
tattaagacacatgtctaaatataagaagagaccaaaagactgaagatcagtgttgcttatttttcgtcccttaaaaaattagtgcttaaagagcttttgtttatgtgggttatatctgtcaatatttattgtattacaaattaaaattaagaaaaatttaaaatattcacataaaaaataacaaaagtctccgtagtgtacagcatataacaaatataattgaattcagttctacattgtggatctttaaaaaaccctttgccaacatagataacaagttttatgtaaagtaactgtatgttccaaaacaaaatttagtgagaaaattggcattacattatatttttgcagatcttttaaatatctgacttaatagaagacagctggattctcatctctctctgcattaaatctgttgtgatatcacacaccacatagtatctgaaaagctctactatacactgtatgagaggataagagtgaaaaaaggcaaataatgttttatgaaaatagttttgactcttcagactgcctgaagggtctctggaccacactttgagaactgctgatccataaacaccacatatagcagcttaaactgtttctttagcattttctgtacatcatacttaacactaaaagacaagacaggatcactttccaccgtgttagccctctgccagcattgatgccatacttacttgtataatgccatggaagcagaagtagagaaaaaaactgatgaaagaatatccagtaaatgttggctggtgagctgaagtagtatggttgcaaacagaggtcaggataaccactttaatgaaacaaaattagtggacatatgttacttgaaggatgtgtgtgtgtgttctaaactggatataagaaacattctggagcagattctgagtttttaaattacggctgcaaagatgatgttgaatcttcttatgcgaaagactggttgtgttcatcaatctttacaactactcagagacatagacattttaatagggtgagatttaaatgcaaaatacaatatttacttgatgacagaataaacatttggtta

SEQ ID NO: 3504 - DNA, 1047 bp, Homo sapiens
ttaagccctgcacaagtcctttttaagatatatgctttgcaaatggtttctgccagtctgtggcttgccttttcattctcctaacactgtctttgaagaacaaaagttttaaattttgataaagtccagtttattagttgttttatgaactgtgattgcttttggtgtcatatctaagaaatatttgcctaaccagattttctcttatgatttctcctgcaggttttatagatttagcttttacatctaggtttgttgttcatttttcagatttttatgtatgatgtgatgtaagggtcattgttaatttttctcccatgcagacaattgtttcaacataattttttgaaaagtctttcctttccccactgacttgtctgatgccttcatcaaaaattaagtgactgtggatctatctgtctgtctgtctgtctatctatctatctatctatctatctatctatctatctatctatctatctatctatctatatgggtcttttcttggactctgttctgttgatctatgtctgtcctttctccaaaacttggtcattggaattttacagtaaaccttgaaatctgacggtctaagtcctttatgcttttgaaattgagaaaagagcctgatatcccatatctgcttagtggagggttgaaaattagggtattcatatttacaaattaccaaataaaaatttaaaagatagtaaataactgtggcttctttgagcacatgggaggggttgagtagttccatcaagtaaagattgtgatgtttgaaggaagaaattgctgtacttcataagaagaaaaagataaagtctgtgataaagacagcacagttcagatgttttaaagtgatggcaagaaataaaaaatagaaacaaaaaatgtgggatcttttaaaaggagccagtataatagaataaagaagaataagaaggattttaggcagagagattcttagagtctgggtaagtataagctgcagcatctttacacgtggattattagtgaacaacccaaatagtgctgggattttca

SEQ ID NO: 3505 - DNA, 1010 bp, Homo sapiens
taccattattatccttacttcacaagtgaggaaactgaggtaaagttaagtaactcaaagatatataggtaattagggatagagctgggattcatacataggtccttatccagtgcccatgctttaaccatttaactctactgcctcttggctataagtatttattgtaatttcaggcttttttcttaaatgaagtctgccaaacaatattcttcttaattgagggtactataaaaaataagtaaaaaagagaaatgtcagtgtaggagactgtggaaaaaggtaatagaaaaccagcactttaattttggaatactaaaattgaaaaaaaaatcttgtttaaaattgataaaatattttgctcttttgttagcaaaagacaggaggtttttttttttatttcagggagatggagaaattttgagtttttatgagggggaatcatatatcagaggtaatagggaataaagaacatcactgaatatactaagagttaaatataaaacacatgcctactaacagtgcatatatagtgcaaaataatactactgaaaaataaaaaaattaaatgatttgatataataagcttatcataggcaagctttatggttcagtggcacttagtgcagagatgtatctttaggcatttggagcacccacttttctagattagggtttaggctgtactctacttgccatacagagaacttggggcagtggagatttcccagctccatgcctaggcatacctctgggtaactggtggttgcccattggaccccagctctcccctgccccccatacctggtgcttgtgccctgctattgggagacctgtaggtgggcctgcctggtctggacccacctgtcttggtctcctgctccagggctgggcagggagctcagacacctgtgcattctgcagatcagccccattgcttgaggcaacagagagcttctctgtaaacaaggatcacatatatacccatctacaatggcttcagctggctc

SEQ ID NO: 3506 - DNA, 1082 bp, Homo sapiens
tgtctccaaaaaaaaaaaaaaaaaaaaaaagaaaaaagttcagagagtgatggatgtaatttctgttaaacagtacaatcttaaaagtttagcagaatctttttgtttcctgagtttggataagatggatttgaatcctcagatgtacctgtattttatttccaagtacagatgcagtaagagcaacagcttactgaaaaagcaaaggctttccttgatcgtttgctttatgtagacaagtgaatatgtatgtatctcatatgacatacttcttttacatattgtaacaatagactattttttgtaacttccttttgtttcagtttttaatttttgtgggtaaaatgtatatttatggggtacatgagatattttgatacaggcatgcagtgcataatcacatccgtaagtggggtatattcatcacctcaagtgtttatcttttgtgttacaaagaatccaattacactcttttagttatttaaaaatgtacaattaaattattactgactgtagtcaccctgttgtgcaatcaaacacaaggtcttagtcactccttttatttttttgtacccgttaaccattctcactctccctgataccccgcttacccttcccagcctctggtaaccaacgatccttctactctctatctccgagttgttttcatttttagctctcacaaataagtgaggacatgcagtttatatttttgtgcctggcttatttcacttagcataatgacccccagttccatccatgttgaaaacgacaggatctcgtgtatatatgtaccacattttatctgttcatctgttgatggacacttaggatgcttccaaatcttggctattgtgaacagtattgcaaacaatatgggagtacaggtatctctttaatatactgatttgccttcttttgggtatatacccagcagtgggattgttggatcttatggtagctctacttttagttttttttgaggaacttccaaactgttcaccatagtggttgtactaatacacattcccaccaacagtgtacaaaatccagtgttcccttttccccacatcctctccagc

SEQ ID NO: 3507 - DNA, 1046 bp, Homo sapiens
ataataataaatgagtttaggattggtgagggggtattgatggaggatctttcaaggatagagggtttagtttgatagggtaccacaatgggttctaaagaatgagagtaagatgatgcatcttgttcctgaggaaggtttttgtttcagctgagtgtcctgggagtggagagactgattagagtgcttatggagaattttaggaataagctgatgagggtctgatataagatagtggttgtaggaataaaataatagctaacatttacttactgtatgacaggtattctaagcgcctacgtttgtttaattcattaaatcttcataataaggtattaaaatcagaagggactttgggcaagttgcttaaccttatgcatgtaattattcccatatacaatgaacggttagatgaaaggtagattttgcactgaccagggatatagatgctagtaaaacacatcagtagatgtgtgttgggagggtagtagtataatgaagaaagagctttgaggtttggaattttgggtcttgaaataggctaatagcattctgagaagaaccagaaagtgcatcatttccaggataggaagattttctacaagggcagggtgttgacagtttcaaatgcggtgtagaagttcagaaacagtgactacaatgaaaagacaattgaattaaagcagaagagataatttgtaaacttagagagaaaattgaaaggaggggtaagaatagatgccagatttgtttttcacaggatttgtagagacattagtatctgatatggtaattattagtatttccttaaaaaaagaaacaaacttatgttccaaagccagtgattttatactttaacgcttctctccttaaacttttattcttttttttttttaaaaaagctttcttgaagtataattcacataccatttcattcacacatttaaagtatacaagtcagtggtttttagtgtattcacagagttgtgcaaccatcaccacagtcatttttaggacagcatttcaaaaaaaagccttgtacccat

SEQ ID NO: 3508 - DNA, 1042 bp, Homo sapiens
ctgggactgggaatctcatctttcagctctatgttctgtcctctggactattctacctttgaaaatgacctagcgggagattttgctggtgaaaaggaaacagctggaatttctatttgtgacgaggaggcaatatccaatggagagtctttggtctagctgctgctagatttagctagagttttgtcattgctttgcaggtggccccctgctgtatgaaggcatcagtctcaccatgaactccaaactcctgaatggttcccagcgggtggtgatggacggcgtaatctctgaccacgagtgtcaggagctgcagagactgaccaatgtaagggaagcccagtgactgcaccttcccccaagggtccagcatccccccaccaagtgccccttgggtggtagccttcgccttcctcttcctggccacagttgaccacctcttctcaagccctcagctgccctggctaacatcaccttgtgttttgggccttgtaggtggcagcaacctcaggagatggctaccggggtcagacctccccacatactcccaatgaaaagttctatggtgtcactgtcttcaaagccctcaaggtaagatcaacactgggcattctagagtgtggagaaaggggtggggaagggggaagctcaggctttgaggaagagttggggctggtggcaggaaaggtgaagagggtccacctgccaacattcttgttgccaggaagcgaggatgagttatgttgcgtgaggttcacttttgaatcctgttagaccgagtgtaatcaaaacaaagtgagcaggataagactgttcgccaaagctatgagaatgctttctttagaaaggctgattctagagggctgtgcttctgtgcaggatgcacagtgtgctcataaagagagataagaaggacaggaggaagaggaatatagtaggggtattgggcgtgggcagcagaggctgcagcttcagtgggggtgtggggacgtgggatgggcctggtactcattgtctctggcccctaaagaggggcgttgtg

SEQ ID NO: 3509 - DNA, 1094 bp, Homo sapiens
aactcctgacctcatgatccgctggtctcaaactcctgacctcatgatccgcccgcctcagcctcccaaagtgctgggattataggcgtgaacccccgtgcctggccacggctggtctctttgataccagtgtccacatagttaattactagatcatcagtgatttatttggttggattctatatatgaaacctgtgttactttgacatgctggagtccattgctgtgggcattgtggtctgtagcctatttctccccccttggatttcttttttttttttttttttttttttttttgagacaagagtctcgctctgtcacccaggctggagtatggtgctgtgatctcggctcgctgtaacctccgcctcccgggttcaagcgattctcctgcttcagcctcccaagaagctgggattacgggtgtgcgccacaacgcccagctaatttttgtatttttagtagagacggggtttcaccatgttggccaggctggtctcaaactcctgacctcaagagatctgcccccttcggcctcccaaagtgctgggattacaggcatgagctaccgcccccgaccaccccctcagatttcttagagctatttgtttgaacctcatgagccctgagctttgagtcagaaaatactatgtctggacttagtaaaggaccttagaatttttagccatccaccttttccctaaatgtctcaaaaattcttcattttattttatgcaaaaaaaaatttttttctaggaaaattcttaggcatagtctgttagctgctcttttttctctacccctaaatccttgaagccacagaatttcttcagctcaggcattacatttgattcatgaaatatatatatgtatttttttttttttgagtcagggtcctgctgtgtcacccaagctggagtgctgtggcaccatcttggctcactgcaacctctgcttcccaggcccaagcgtcctcccacctcagcctgcagagtagctgggactacaggcatatagtaccatgtaatttttgtatttttcgtaaagacagggtttcaccatgttgcccagactggtcttgaactcctgagctc

SEQ ID NO: 3510 - DNA, 1034 bp, Homo sapiens
cccaccagcagtaccctctttgctgtattttatgctaatcattcttgctgttctacgttaatttactgtctgtgtacctctaaatattttgttgtgtaacaatatattgttttgaatgtttctgaccttttatatatgttaccgtgactggctgtcttcactcagcctttttttaaccattcaagtttatttatttttattatggtaaaatatacataaaatttactagtttcatcagccgcattctgtgtttcaagaatcatttgcggtagtgttagtaactattttcatcactgtgtagaattccatttttcttaaagatgacaggaatattcaagctttctagtcagtttggatcattttacttttcctaggaacttgtttcatttaggttgtcaaatgtgttggcacggagttcataatgtttcattttcatttctgttatgtcagtagttaagtcttctttctagttcctaataatgtttatttgtgcccactcccttttatgttgatctgtcatgtcagaggtttgcaaggttttttttagtattttcaaggaaccatctggcagtcttggtgatcctctctattgtaggtttggttgctttttcattcgtttctgctctttattttgtattttctatttgtcccacttctaagtttcattttttcccccttccttgtcttttcaattaatcaagttatagctcctctacacacacacacactctgtctttcatttttttcttctacaaattaggaagttttgtgatctgtttctgttcttagtgggtggattaattaagaataaagaaagatgatgaggaataaggtgtagttaccctgcctttcacctgaggatgtctcttgccatcttctttccatcaccactgcctgctgtagacgatattcccacgacctcctgtctggactgttgtaacagatgcctcctaaagcacagaaagaatcaacgttgcttatggctgggcacagtggctcacgcctgtaatcccagcactttgggaggccgaggc

SEQ ID NO: 3511 - DNA, 1487 bp, Homo sapiens
gggcacctcacacgccttagaacctgaatccaccccacccccaggaatgttctgcatcctgccacaggcggactgtgctgcaggcacagacaggggaccatggggcctcttagcaccgtccacatgcacaccacattaccactcccagcgggtggactcaacacttgcagccaccctgcaggacttaaatcattttgttcggatgaggaaacttaggcccaatgctggatacacaacaaatccaggaccatccccaggcttcctgccttctcgcatagctctgctctggcctctgtagcttctgtttcccctgaggatccatcacaacccagtctaacttttccccctctccgtcatcctcaacaggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggaggtgagaacccccactgtctctatactcacccgcacgcatgaccccacagtgctgtgcaaagtgctggcccagcattctcattaggaatcatgctgaggaggaaactgagggtaggaagcccaggtcacatgaccaagaatgctgacctcaactccagggttctccccttagccttgaatggtgctcctggagcctgttacattctaggtacaagcgtggtctcagttaattatgatagcatccctgggtaggtggatgttcccttttcagctcaaaggcccaaaggtaaagtgacttatccaaagtcctacagccaggatgtagggtcatgactccaaccaagtgtgtctgtgtgtctttcagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacact

SEQ ID NO: 3512 - DNA, 1045 bp, Homo sapiens
taagtagaagaacaagagctggtatctctaaaaccaggagaggataccctcccaagacagagggataatgtaagccatcgaagggccagggtatttgtctggtttgtccacggccgtgtccttagtgcctagaacggtgcctgtcatagtaatagacactggtggatagtgagtggaggaaggccatcgggtaccccaggggttgaactgggcaagcctctccacattgctgaatgcagaagaggcgatggtggccttgtggccactcgggctgactgggtggcacagcgtggatagaagcctcactacgattgggtgaagagtgagaggcagatgagaaagggtggagacggctcttccaaaagagttggtgggagagggagaaaagaggaggtttggaatgatggtatggctaggaatttatttatttattttaatgaaggttatttttaaacatgttggaaggaatcagcaggagagggtgaagataaggaagtgagggcggaggtcttccaggagggagggtggtgtcggagcagaagggaggggctgcctttggccaggagggactgagatacctttttttttttttttttttttgagacggagtcttgctctgctgcccaggccagagtacagtggcatgatcttggctcactgcaacctccgcttcctgggttcaagtggttctcgtgcctcagctttccaagtagctgggctactggtacaggtgtgtaccaccacgcccagctaatttttgtgtttttagtagagatggggtttcaccaggttggtgaggctggtctcaaactcctgacctcaggcgatccacctgccttggcctcccaaagtgctgggattacaggtatgagccaccatgcccagccagggactgagagacttctgaagatgtagacaaatctgagatgaacttctgtgatccccggggcctcccatctaatcagaaataggcaagaggttataactgtcatggaatatgggcagaacctctgaccagggcatcacggggctggtcagcagcaca

SEQ ID NO: 3513 - DNA, 1308 bp, Homo sapiens
ctgggttacagacgtgcctaaggggctttgcttatagaaaggaaactgagagcattgctgggccatcaggttcatcaggctttacagtgctgtagtgatgtctaggaccattcttttccaggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaatgtaagtgagcccaggtgcccgggtgaggagcaggctcagcctcccctcccactcccaaccctgccctctcccttcagttctgttcgtcctcaccctggggcagaaggcaagctgctatgtgaccagatgtggtatgtctttttctgtagaagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacacatacctttggttaaatagtctagactaaaagattgagaagttactttccattgctatctattgataatttagacattgagttcaaattgccttcattttatgataaataatgatttaactgacaccttctcatttcctttgtctcatccttctaaatagttatattacgatcaatccctgtaaagctcaatgcccatattttacaggtgtgagccaccgtgattttctttgtggtacagcttttggtttttcctccagttaaccttcaccttacattcttctgcttgcctaattttccttctatattcttagttctttccagatgctttgtcattttacccactttataatttttctcctacaacctagttatgccacacaactgtcaccttttttctagaccgtttaagttggcaccattatttccagaatcccatgttttcccatcttagcatatgccttcttttgctgtgtaccattttttggtatcttactaagaaagggaagatgagaggtaaactttttatctccttgcatttctgaaattgcctttaatttgggctgataggaatttcctccttagaattttagaatttcgcaggcactgtttttaagttttatttcagttctacttttggggggagatatatttttgttttttaaaatctttttttttttttttttttt

SEQ ID NO: 3514 - DNA, 1079 bp, Homo sapiens
cctccatagccatgggttcagcatctgtggattcaaccaaccttggatcaaaaatattggggaaaaaaatttgaaaatattgcaaaaggaaaactgaattttccgtgtgccgagaactacattgaatccatgagaatgaggtgatgcatagcattgtattcggtattataagtaatctagagactatttaaagaagcggtctggcactagagactagtttcgtggatgacaattttttcatgaacttggggaggggatagttttgggatgaaaccgttccatctcagatcatcaggcattagattctcataaggagcaggcaacctagatcctttgcatgcatagttccatgcatagttcacagtagagttcgcactcctatgagaatttaacgccaccaccaatctgacaggaggtggagctcaggtggtaatgcttgcttgcctgtcactcactttctgctgtgcggcctggttcctaacaggccacagattcatagtgggttcgtagcggtctgtggcctgggagttgaggtcctctgactttaaaggatactggaggcgagtgtaggttatatgcaaatgctgcaccatttttatataaaggacttgagcatctgtggattttgatatctgtagtgggtcctagaactaatcctctatggatactgagggataagtatatttaaatagtaccctggggtctcaagctggattttagggagcttttgtcgtggtagtagttcaccttcttactgtgaactctgtacaaattctcactgacaacttctcatcctttaactaaaatgtgtatgtttgactgaaaaggctaggcacctggtatctgcctgggtttttattgtgtatgtggtatactagaaaaggacactgaggccgcatactggtttccagcctcagtctactgacagtagaaatggggagaagtttgtcttctttcctgggctacaaataggcagtttgtataatgaaacagacagcacactgggagcgggaaggtgactttcaatctctggcttcactctggcacttttggtaaagtgctcagcctgtgggccccat

SEQ ID NO: 3515 - DNA, 1051 bp, Homo sapiens
tcagagtggagagcaccgccccgctccgaccccgcccccggcccggactcgccctccccgccctttgctcctccccttgtctctcccctttctcctccccttgtccctcccctttcccctccccttgtccctcccctttcccctcccccggggtcctcctccgcgccaccccacccccgcggctcctttttctgccttttcctttgtaccctcactgctaccagctccttctggcgacccccaggtaccccctcccacctttcgtttctctctgggtcagcagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgagttgctggcgctggagcgattcggtggcacgtggagccacggcgtgggagtagggggctgaaggcaggcagcagcggccagggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagaggtaggtgtcagccgagctcgtggggctgggcgtgggagagggggccttacacccctgggagtgaccgtgattgtgtcctgcagttgcaggatgcgttttcccgagggcttctgaagccaggcctcaatgtcgtgctagaggggccgaagaaggccgtgaacgacgtggtgagcgtgggcacagggtcgggggtactcggacatgggatgcgcttcaggcgctgttgggcttgggagaccgattcttgtcccaggaaagatgcaccctgcgcctcgccaagagggtcaattacctgtctgggtattggggattagcactttgtcccttcgcctaacagcctgtgcttgggaaagacaaactcagagttcccttcttgtgagctcagtgtctgg

SEQ ID NO: 3516 - DNA, 1010 bp, Homo sapiens
acagggagaaaaacccactgaccctgtggagctggcccctacaaaaatagaacctgcattttaccaaaatccctagatggtttgaatgtaacttaaagttggagaagcaatggtcttcagtacttttatcctgtttgctctgaatcagtggatggggctgggtgcagtggctcacacctataataccagcactttgggaggccgagctgggtggatcatctgaggtcaggagtttgagaccagcctggccagtatggtgaaaccctgtctctactaaaaatacaaaaaaattagctaggcgtggtagtgcttgcctgtagtcccagcgactcagaaggctgaggcatgagaatctcttaaacccagggggcagaggttgcagtgacccaagattgcaccacggtacgccagcctgggtgacagggcaagactctgtctcaaaaaaaaaaaaaaaaaaattcagtggatggctggtctcagctcttcagcctgtgctcatctcctgtcactgaaccccaagcctcctcctgggactgctctgtatgtggattttatgccaattctaggaggcttgactcttgtgtgggtggaggtggggacaggaggtgagttgtggggagggtgcatagccacatcaactcccatttttagcccctcaggcctcagctagggctcccattgctggctgtacagactaagtatcctcagtatcaaggaggagatggaacaccttcagctctcctgtgaagtcttagtttctctggcaccatttctctgcaagcagtccctgactcagatttgtctttagctgtacctggctctcacattacgaggactgatggtaatgactttggatgccttccccagtccccaggcaagggctacccaaacttctgtgagatcaagtgagagggaaaacacaacttcagtgttcatgcagtcccatggctttgatgctctgtgtatgctgatgacttcaaatggtatctctagctgtgacttcttccctg

SEQ ID NO: 3517 - DNA, 1026 bp, Homo sapiens
gaggaaaatcccagcttcacaatctaggtctgcctgtcagctgagagagcctccaacccttatatttgcacagcatctctgtggagaggagctcagctccttgctggatagatatgcacacagaccaggggctaagttggtgggtttcaggtggtgttcagggttttgttgcgaaatctccattaatttggaggcctgaaagcctttgcttttgtcagtgggaatgacccaaagtaggaagcccctaagtaggcgtggctcatatctgagcctatactaactctccaaggacgaacctaggtctggaatccccaaagtatggtctgtcctttcctggggcaagattgaaggtaggagataagaggtggggcagaagaaggtcagcatacttctctacttggggaggtctgctttggtccatcttgccagggcattgtgggctgagcacatggagactggtccagagcagaggctgagtgaggcctctgcagagcagggcagcaggtttctgtggcaatcagctgtatgaccgtgggaccagtggagttcttgggatctctggggccatagcggagttcgtacctcaggaaatcactgatttctggagctggctcctcccagctgatctgaagttcccctggctggctcccacccatggccttgatgatactggggggagccggcaggcctgagggcaagacagggcacatcagaactctgagtaccacagtctatggctcagcctctggactgcagagaggggtgctgggggctgaattggggcagcttctggattcaaaaattgtaggctgtcattctcctggagggcaggctagggaggctcctgattctgttcttctctcatgagaacagtgacttctttgcagtatgatggcttgctagactcagtgcttcttgtaagcagggatccctttttctctccatatccccatcacctagcccagtgtctggcacacagtaggtattctgtaactcttgaatggatgaataaatgatttgttgacg

SEQ ID NO: 3518 - DNA, 1038 bp, Homo sapiens
agatttaggatttgcaaaaggtgactattggcctactctggtaacattcctctgtttttgactgtcctgttttgcttggagatcgtgctttctcctattcttgggtcccctggagaaagagattaggccattgtctcctaggtttgtgtctaggatggagaaagaagcagcagctgtgaaacgtcaagagcttactacaggacagagttcatcctgctgaaggcggaagcttatccaatcaatgtcagcataaggcccattgcctaggatctctccctctccagctctgccctgagcctgggattcagtcattgctgaacctctcttttgctcattgtgccagtcaccccattctgttccccttctggtgtttattgctgccctacttagctggtgtacctcattcaaccctgtcgttttttgggaaacagccaagatagataggttgtagccaagtgctccttagaactccataatgggtcccagcattaggattgagctggagggggtgtaattgcccacctcctgttgtgctgccacagagaagaagctgaactctgcaggaatgccccagtgcaaggctggtcccttttcccacccccctctcacctcccccaggcagctggaaacaacctctccctttgtctgagcttcttgtacagaataatcctccttatggacaatgtattctctgtgccctgtggacacaggagctgtgtaagctgatcccagcaccaggcaggacggaggctgagtccttccaaacgcccaccctgggtcagctcctgattactgtccagatgaactacgaaggagtgtacattctcttccatctgcctttcctatctgctccagaattaggggaatagcctactgaagtttagcattgggccaggagtaggaacaggggatgtggtccttttctgttcagtcttgagggttcacagtgcctgcttatggaggctcgatgtggctcttgcctggaaacctcaaacacatggggactaacccttggaaagggcttgccactgtgcagat

SEQ ID NO: 3519 - DNA, 1033 bp, Homo sapiens
gtactcttttacctgtgacgttaaatgggagtcacacaggtttagctatctgttctaggagtggatgaacagactattctcccatgtcacttctttcctcctggacaccttcagggagacagctgggtgaagaatcatacttctgacctctgtcaaacagggtcagatgccgcagaggttctgagatgataaaggaagtgacagagggaacctgaggtaccacatttctgatttgtcatgaaagtcttaccttgcttaagatgacttttttaatgttcctttcagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccac

SEQ ID NO: 3520 - DNA, 1026 bp, Homo sapiens
accatttgtgaccatcctcttcagctctccctgcctccctagcccagccctcactcctgttctctaggccagaggaacaaccgcctgctggacatggcttcctttcttccctcttcctacaaagctcttctctttcatctccctgaaaactgctcctcatactacaacacgcagatcaaaccactttctccaggaagctttgcctgtccccaggctaggcaggtgtttcctctgggtttcagtagccctcatgggctgataatctctatcacaagtggcggtggaagtgcccagcccgtgactggaatctcctgcatggagccaggtgcaacccaccagtgggctagggccctctgccaagcagggacagatccctctctcctaccatcaccttacctgggcccaccacctctcatctggaatatctcctgttctggcaaatcacacctgggctcctccaaggcaaagtgcaggaccctggggctatactggacccaagcttgggcctggtccctgcagaaggtgcacaggaaggaagctgagaggctcctttctggaaaccacagaaaaggcaaccctggctccttgttaggggcagcgctagcccacctggtatctagggaaagggcccaggcctgaggctcccacctgccctcacagatggctttgtggcggagaccctggagcaactgccggagctcctggcgcaagaggtcctttaggagaggcggtggtgccagaagagaagaggggtcagagatggggcgggagctgggggcttgagaggatcgagcctcttggagcagtgcccgtaacatcgccacctgcaaggagagctgggataccttgcgactggggaggggagtgtccggaatggtgggggctgggggagtgagggagagggcggagtcaaaggggagaccaggataggatctcgggagttacccggcagggccagggacccgcagaggtgggaaatcacccgagtcgtggggcaggccaggggcgtggcccaccttccctctc

SEQ ID NO: 3521 - DNA, 1031 bp, Homo sapiens
ctcgggttcagtctgtcttccaggcctgcttgcacctcactgggctgctccggggtctctgcccctcattccaggcctggctgtcaggcccagccagcaggggcccgtgacccagcagcctgcccaaagcatttgtttctgggggatggggtgggggctgctccacaggaggtttgagcccagcaccctggggaaggggaccctgcacgacacccccttgccctccctccatgaggctaaaggcccagtcttcccaaatgtgctgccctcgttcatgtgccaaatggccccagcccacatgcccctcccctctctggagtgggagccccttctgaagtgtctgaatccctgaagtgttcatttgtccgtcctctgtgcagtgacagccccggccaagccacctctaatcctctgtagcaataacggtgcgccgcccatccctgcccattgtgcaccactaggattttaaagtccatagattttaatgaaatttctattcctgtctctgagcggctgctgtgctttgtctgggtcccccaggggacaagagtcaggctggaatgagacctctgtctgccaggcctttgtggaggcctgggaggagaaaggccaaaggctttgatgcttgggaccgatgcccggccactcagctccagacaccagggatctggcaagggggtggggcaagggccagacagaccaacagccttggggtcctggcgagagctcgccaagaccagatctgaagctggctgggccaaagcagctgaggcggcagcggcagacaggtgcgctgtggcagaagccagagcctactcggtgaccagcccttcaggctggggcttggggtgctgcactggacatgggtgtggaagctggcccttccctggggctgcactgaagctgccgtccccagcggtgggtagccgactggcctcgaggtcgaaggtagggctccagaggaggtgcaggcaggcagcactggagaggtgcaaccccgcagaggggaagcgggggtctgaggccctgtg

SEQ ID NO: 3522 - DNA, 1035 bp, Homo sapiens
tgaggagactcgaaagctacacttctcccctgtaggacatcctgacttgaccttcaaaaggcaagagagggaatgtcctctgaggcgatgtgggatgggtctgggaggaacagtacgcagggctgccctcaagcctcagtactgctagggtcaagaaccaaagccactttccagagtgcctgcctgctgctagccagtgagggtagacgccgcccccagccgctgcagcacaggacatgaccattgcctccagtcttccctcctgggcttgtctggggtgggaagcgaggagctggccagggtccacccagggtcctccatcactcaccccagggcctggagtggagcccggcatgcctgggggtgccagtcatctgtctgcagcccacaatattggcaggtcccttgctgccagtcagggctctgcaatggataagcacaaggcgtattcttgcctctctcatctgctatatgaaggcctggactctgaaggcacctggagtcctgagaggtgcccagagatggctctgaggtttgccttgaggcaggaggcatgaatggccactgggggctgctcggcccgggggagattttcccatgttctgcccctccaccccggccccagactctcccatatccaggtaactgaggccagagatcagagctgcagctgggtctctctgcccctactcagtgccatgtaggtgaaggacagaagattctgtcattgcagggtaggtgctgcctgtgggccaggctgggccctgcactgataggagagaacaaaaactgaggggtgcctggccggaaggaggtcgtggggtcttctgaggcagccacaatttactgtaatggctgttctgtctagattccccattggggcttagagaaagttgccagtgatctgatttggctcaaagtcagtctgggatgtgaggtcttgcccattctcctccataaagtttgtcttggatgggacttcatcccatgagcaaaccctggggctggagagtcctaaacacaaagcctgctggg

SEQ ID NO: 3523 - DNA, 1027 bp, Homo sapiens
tccctgagggtttgggcacctcctgtctgtagcatccgtcataggacctggcacatagtggggactcacccagcccaagtgttggcatgtagcaagagctcaactagtgcaggcttggtgcattattgggaggtcaccaagcacagggtttggcacaccttggacactcccttggtagagggcctgtccctgcctgggcactcacctaaccgaagtcttagcgtgtggcaaatgctcaactagtgcagacttggcacacattaaacactcccttagaagacagcctgtcaccctgtaggcattcatctagcacactgccaggtacacagtgggtgctcacccagctcagagctgggcgcacattgggtccttacctggcacagaattcgacatacccggggtactcccctagtacaggacctagcacaccacaggggctccccacctggggctgacacacaatgagtgctgtctcagcatcggacttggcacacaagaggcactctgctgatcagcatcggatttggcacacggtgggcactctgctgatgcaggttctcacacacagcaggtgcttccagcacaagatttgacatccagtaagtgctatcccggctcagggcctggcacacagtgggcattctccttagataaggcctagtacagtggaggtgctcttctagccaggacagcctaagcaatgaccttccgctgatcctagattagcagctaccccatcctccgtgaaatgggcaatatctagatccagaggaaaagttccagccttcctcagcttcctctctggtcgggggccctgccctccctccccctccccacttcctgtctagcccacctactcaaccctgtagcccggcctcccacacagcctccctgcagccctcccccatccccggcacttctcagtcccagctcagcgggaccttccctccagagtcacaggggacaacaaagaccctagcctccttgcccctctggaagcatgcccactcttattaggcaaagtcag

SEQ ID NO: 3524 - DNA, 1048 bp, Homo sapiens
cgtcccatctgacattaatccagtgtgcaccagcattgccatgagactgttccttccacgtggctgctgccccccagctcgccagccccaccttgccactcatgcttcccacaagatcctgggctggcctggacccctcatttcagaggtcccgacttcgctatttccctccatttcaattcaaataacaaacacatcttgcaagtccagtgctgtgctacatgctgggcacagagggtaaaagaaacacagtcccaagccctcggggaactcactgactcatagttgacgaacttataagcaaataagtgtcatatgaaataagagtactcgtagagatttgcacaaaacagaaaggaggaagcaactttttcattcttttgagagagagggtcagaaaaggctgcagagaagaggtgacatttagcccggtgcagtgccgaagatttgtagaatttcacctggtgaactgctgtggaggggacagctgggagtgcaaggaggtgcggctgcacatgggtgtgtggcaggcccagaactcggttcaagtgaatgacatgacaacaaacccagctgccctggagcccacactgagtgccacccagataggaaaggaccatcctggctgcctggctggggtgaggatggggagagtgtgctgatctgagctgattcccctcctggggaaaggctgaagccattcacacagaccatgaaggaattggactccatcccagtttggtattcattttttatcttttataggattgggcatctggaaagtcaaaaatagacctttgcccattgggacaggaagcctggagatcaagagatccaggggaaaggttggggggactgggaaggagctggatctgagggtcttccagaaaggagcaggatatggacatggcctggcagagggcctgggcaggctggtggtgggtggctcggcactacctgtctggagagccctgtgggccacacggccaagtcctcacctcaccctctgctctctccacagctcttgagatctgtggcctgaaaggcg

SEQ ID NO: 3525 - DNA, 1079 bp, Homo sapiens
aataataactaaccgagctactgttttaagcacttcacaaataactcatctttttaacaacactttgagggaagttattgctataattattattattcccattttagagaagaagaaaccaaaacaaagataagttaaataaaattcaggaacttgctcaagttcacatggttattaagtggtggagtttggattcaaacccagaagcaggatatactggggccatctgctgtgtcagtcctaaactcactgccttggccctcatcttccttctaagctaacatttgatgctaaaccttaaactgcacccagctgttgggtccccatcacagagttgccagataatacagggttacaaataatacaggacactagttaaatctgaatttcagataaataatttttagtataaaaaatatagtataagtatgtcctgtatggagctggtggggctgcatttaatctggcagtcctgtgtcaagcaggcctaggcactggcactttgctctcagggcattactgctgccaggatgtctggacagacagatgtggcaacagttgaggttctagaacgtggacacacccaaggatcctgctgtgtcacccttaccatgcatggttccttctccttgcactgttctccacacctacctcccaactaccctaccctacctcttctggtccctgttccatggactcttgccccattcctcaccatgtcctgaagatcagtaataaagtgtgttaccaagctaagcattctgcaggcaggaggcctgtggagactccagcagacctcaggatgtgtctgcatgttcctttaggccacactccctcttagtcccataagatcagcagcttgccaccctactgtccctcctgttcccccagtttgattggcttctttgatcatttcacatacattcactcctgcctccaacagacacatgtatgggaattgtatatgtgatagagctgtcgtttcaaaagggtggggaaagtgttgacagttcaatcaatggtggtaggacaattggctattagggggaaaaaagttagagtttttatttcttaccaca

SEQ ID NO: 3526 - DNA, 1793 bp, Homo sapiens
tgacctcgtgatttgcccacctcagcctcccaaagtgctgggattatagcgtgagccaccacgcccagcccgggttttaagacagggagtgaaatgaccagattggtggtttaaaaggacaccatggaagaaagattggcaggggcactgccgttacctagatgggagatgatggtggcctggaccaggatgttggtaatgggaacatgggcttagaaattattgaaaaatatatggtaattaaagctcctagaaattattggaaaatatatggtaattaaagctccaggaggggataagtttgcccacggagagagagtgagaagggaagagaccaatgacagttctgagcaacatccatatctaagaggtgatcaaaagaaagggagtgttcaaaggaaccaaggagaattgcatgaaaagtgagagtgggtcactgaagcctagggaagagagcttcaaggagtggattgttcaccaattgtctatcaatcaaaacctgaaaagcttcatcctcatgagtcatagggatcattagagaaagcagtgttggtagagcagtgatcagatcgcaaggtgggagatgaggaaataagatcttgagtgtaaacaactctgaagtttgcctctaaaagggaggagagattgggtactagccaatggaaaagggagttaaagggagacttgtttactcccaagatgggagagaattaatatatttacatgcttatgtgaaggaaccaatgcagaagaaaaaagtgaagctgtatcagtggaaataggagtactcaataatgtgtggaccctgaaaaggcctggattctgggttggaccctacccagctggagtggagggatgggcttagaaagtgacatcaggcaattagctgggcgtggtggcaagagcctgtagtcccagctactctggaggctaaggcaggagaatcgcttgaacccgggaggcagaggttgcagtgagccgagaccgtaccattgcactccagcctggacgacagagtgagactccatctcaaaaaaaaaaaaaaaagaacgtgacatcaggcttggccctctcttgtgacaggaggagaggactggggcaaactcaggagagtggcttctgtgtggctcctgtggagtaggagataagattgtttgcatgggtgaggggtttggggtgatgttgagggcaggggatttgagatttgtggaaagtagagaaacttgaaattgtcactatgggtgaagggagagagagtgcacactgatcaggaacactggagattggctgggcagttttatatacccagctgaggctgatgactctgattttgtaagtggcactagtctatatggttgtgattttctctagtcatacgctccaggtggcaggcacagagaaggcagagtctgggtttttccaggcaagggtgacaaggaaaagggaataagagagttgaggattggcaagaaaaagactgaaatgatggaccatgcaatccaggctccaaaggcagacatgtcagttacgttgctaggacagaaactatgacttttcccttctttttcactaaatagaacccctgtataattatagaaccgctgtataataatcagtgtgtacctagttaaaagactacgtttttagttttccagacagctaggtacagccatgtctctgagctctggccggtgaaacaaaaggaaatgtgttgtctgggacttgcaggaatgatacctaaagggaaacagctcatctgggaaatacgctattcttgccttttcccgtcttcc

SEQ ID NO: 3527 - DNA, 1053 bp, Homo sapiens
tggtattttggaggaggctggggtctgggctttgggtgagtcacagatggccttggactcaggccaaggtcctccttcactggctgcatctctagtgggcaatgtcctcagtgggtggggacatgtcagcttacccaccccccatggagctggaggaggctgtttaatattgtttgaagtctgtggccactaaactggacgatcaatgggagttaaggagatgaattatttaaacctcaccagcttttaattagtcggggtccttctgaccgatgactccgtccacagggtattgactcccccgcaggagcagcagcctccattgagcggtgcctgggttgagggggtccacttggggtaccaaatgggggtataccctcaaggggattcttgtttggaaggaaactggagtggctatgattccaggcagttggaggttttgttagtttctgatctatcagtatgaatatgttatctgtctgtatctgtgtgtctgcatatgtgtgacacctttagctgtatgtctctgtgtcagactcagagtataatgtatccatgattatacatgtctgttggggagcgtgtaacagtatatctgtatttttctgagggcatgagtctgtgtggaagcagctaccaatctgtgtgtgtatctgtcaggtgtgtctgttcagttctgtatatcttattttgtttgcatatgcacatgtgtgcatgcagatgctctcaggtgaggcacctgaccaagcataggccttgttccaagtggggaggagccagagtatctctgggcagtgtgctgacattaccacaacctgtgagcctttggggtcgcatcattgtggggggggactggagagagaataccaggaccaaaggacccagtcacctccttcagagtagatcctttatccattccagacattcactggtaccttgtggatgctgggcatgctaagtagaagtttctgttctcagtgagctcacatcctgggaagagacagggactgaaataggtgcttgccacccagggtactaagggctgtgacagaa

SEQ ID NO: 3528 - DNA, 1029 bp, Homo sapiens
acagaactgccatctggggttagggaggatgggcttgtgtcacctgatgcaagtgtccatccctttgctgctttagctgtgcgggtcaagcctctgctggacccgaggaatgggttgggggatatacataggctgagagtacagaaaaggaggagacagcaacagttccctcttccttaaaacaggcaactgagcccccagttccaagaatggctgtggggtgggctgttgctgttctgctgggcaagaacagctatggttcctgaaggagactgggtaggattggcaggagtagcagctccggaaaccaggcctccaggcttggtagaattatacccaaagaggtgtcttttcttcctctccccttctcctctcgcttctccttttctcagtggagaccactcagagacagcaaatacaaccccccaaccccctcaggaacctctcagcataatgggagacaaaatccatgttacaggtgccattcacagtatgggggatttaaaggagggatgagccaggaaagactataaaggaaggtactttttgaattgaatgttgaaagaggagtgtgtgttcaaattaggacaaaatgtgggagaaggcagagggcgttctaggcaggctgaaggaactgcttcatcaaaggcttgaaggcatgaaacagcaatcccaggacttggtgggcagtaaggaagaggaaggaatcaagattgactcccacatttctggcctggtagaccaggtagatggtaatagctttcactgcaatttgggagcccaggagaagaagcagtttgaagaggagatgttgaaatgagctttaaacatatggagaatgaagcgtctgtgtgaaatccagggggtgattcgaggtaggcaatagaatatatatgtctgacactcaagtaggggtaagaaatacagatttggaaattagaaaggttgaagacaatggacttgaggaaatcacccaaggaacccaaggagagtggtagcatgtagaaaaaaataggaagagagagtgca

SEQ ID NO: 3529 - DNA, 1085 bp, Homo sapiens
ggtctccagccccttcccaggaggcttggctttagggtcctcctcacactcctgcccctgctcaatccgcagtctgtgtgggtcatgctgtcccagccaaccaattgctgcctgtgcagtgaggcaggatcagaagcaacacacaccattctgggctccagaggccactggtcctgagaacttccctcctctcaatccctactgtgggtctctccactcactgtatcacagttatgggccattactggtttctgtgtctgtttcccgtcaaaggactatgagttctttgagcgcaggtctacatgtgattctgtttgagttgctgggttctggcaggccttcagtgaatgtgtgaatattcagtgaatgaatgcttgtgtactttcttcctctccttctagatggaaaatctagaaggatctattatcttggttctctattagtttttcccaggcctggctacccttaggaataaggaggggtagatgtgcaaaggaactactgtctgtctgtctgtctgtctgtctgtctatctatctatctatctatctatctatctatctatctatctatctagagggttttcctctgtcactcaggctggagttcagtggcacaaatacagctcactgcagcctcaaccccctgggcttaagggattctcccactcaccttagcctccctagtaactaggatcacaggtgcacgtcaccatgcctggctaatttgtgtgtgtgtgtgtgtgtgtgtgtgtgtgtgtgtctgtgtgttttgtagagataggattttgccacgttgcctaggctggtctcgaactcctgggttcaattagtcctccccactcagcctcccacagtgctgggattataggcatgagccactgtgcctggctggaactaccttttcatattggtagagcaccccaagatcacatagcgtggtagtggagggcccctgaatggccttaggaaacagtacaaagcccttaccgtgtcctttgaggtcctgcatgggctgcatctcctgccttcctcatcagccacatttcatgcttgattttctgtgctcagggactctggcgttga

SEQ ID NO: 3530 - DNA, 1024 bp, Homo sapiens
tttctgatgaagatttagcatcccaattgagatgtacagtaagtgtaagttacacgtcagatttcagagacttggtatgaaaaaatgcaaaatgtctcgtaattttctgtattgattacatgtgaaataatacttggatatactaaaataaaatatattattaaaataattttgtctgtttcattttactttttagtgcggctgctagaaaattctaagtttcatatgtggctcacattatatttctattggacagtgctgtgctagacgctatggttatgtacctacattgtctagtcctcgcaggacccagtgcagtggttgctattatttttcacattttaaggttgagaaaaccaaggcatggagcgatgatgaaacttgctcaatggtttcacagtagtacatggcagagccagaacttaaattcagttttgctaaatgctgaagagacagagagtaaaaaagtgatagaagaagaaagactgtaagagtgtggtattgcagaaaccaagaaaaagtgtttcagaagaagaggagtggtcagttcagagagggctacacaagatgaagactaaaatttgagccctgaacttgttaataacaagggcctcagtgaccttggtcctgagtggcatgataggaacaggagccaaattggagtgaactaaagagtaaatgagaaatgaggaggtggagaaacttcaactttttcagaaatgttgctttgaaggtgagagaaaggacaagagctgtggtggggcaagtaggggttaaagcgggttttgtttttaaggtagaaggcatgtgtttttctgtaggatctattagagaaggaaatcctgttgaaggtgcaggagggagaagaagccagtaagggaggcctctgaggaggtgagaggagaaggggtggagaacctaggctcttgaaattggctctctttaggcggaaggtccctgcttctattgtgacaggagggaaggagaggaagatgggcacaaatggaggtaggtaggcttgtag

SEQ ID NO: 3531 - DNA, 1119 bp, Homo sapiens
actgtgctggggactatggggactgccaagtgatcaggacagaaagaccagcacacatatacctaactatagggtaagtaaggtagagtatgaaaacactacaatgaaggcacaacacaaatgctgtgagaatccagaggagcactgtagagagatggaatggtagtattttttttagtactaaacttttttttcttttgaacagaattttaaagcccaatgtgaatctggttgaagatggggaaaagccctgcccattcttcctctcccattcttcctccttttcccccagtccatgaagtagcctgatgttcctccttagaaccctagaactccatggagcacactttaaaaatcactagcctattctaatgcccgcccagaagtcttactctgtataggacaagtgcttatacctcttgaaggtgtcaggggagctggaatcagggcagaggagaccagctagaaggttaagggtacagctgtgtcttgagtacctatatgagagcggaggtcagactgcaacccagatcctgaacgctaggaggatgcctctctgcggagcctccagagggcatcataggccacacaacggcagttcaggcatagggtcaagatggccacaggccaggggaagactgtagtgggatgagtgagttatcttggagacagctcaatctgctaaggagctcctggtttccctggccaaaaagagaatagctcattagctgaggcactgaccacagtgtcttggaaacctcccatcacttgctcagcctcctctccatagccactccctactggggcttctgccattccatctaggaaagagagctctggccaggccctggtggcagctccagcacttctacagtcatgacagatggggcactgtgcctttccctgatgagttgccatggaaaggacaccggagaggcacttgtcttattatttccctagagaggggctggggagatacaagttacagaattttaaggactatttgtggcactggggaggtgcttgtcatatggttccacagcgtgtttgtggcacttgtatgcttcatatggtctccatagggaagaaatgagagacagttggcagataggataaaga

SEQ ID NO: 3532 - DNA, 1046 bp, Homo sapiens
ctcataggagaggtacccagtcctgctttttggttcatctggacagaggaaggtttttttctggagggctgagacaatagtgtgctgagcactctgagggtagctgatgccctggtcttgacagtattcctaaaggaagcaggcactgccatgacaagaagactttttgctagctccctgacagagatgtgccagtctactctgtgaagttcttggatgtgacaggcctgtttttctgccctagctcttggcagcaaggaggatgaaatgtctggtgataagagctagcgatggttagcagacttagagggcttgactcgggtgcttaaagtgggtcaagtaagggtttgctctgagaagggagctgagagccatgggctctgattctcatttggtcagtacctcagcgataaggagttagtcacataaatgttctagactacacctttgctgtttaaattgtggtctgagaaccagcagcatcctcatcacctgggagcttgttagaaatgcagaatgtcatgccggccctactgaaatagaatatactgaaatataatctgaatatactaaatatactgaaatagaacctgcaatctgacacattcctcaggtcatttgaagtctgagaaacactgctgtagtctggaccagcggttctcaaacttcagacttcagcgagcgtcagagtcacctggagggctgttaaaaccaaggctgttggccccatccccagggcttctgattctgaaaggcaagggtggaggccagaaatttgcatttctaacaagttctcaagtgatgggactggtttgacaacagctgaccctcttagctttctcatctgcaaaacaggggagtgattcctgcctgcttacggagatgtgggatcatatgggacagtgtgtgagaaatgtgttcagtgcattgcgggggtggggggcgggtatccgtttgtgtattgcttgcttactagtcagtgaatttttaaaaatctattgtcatgccagcacaactgtttaccttcctggctgctggccatcatt

SEQ ID NO: 3533 - DNA, 1693 bp, Homo sapiens
agctagaaggtgtcattgtgatgctataagtggaagtacaaaggctagaagaggcttaagagcattttacccaataaagtgtgggtaaaaggggtgtgggtgaaagtggatatggtgtaagctaaggctctgaggtattgtcaagaaggctaaggctctgaggcattatcaggaggctgatacctcagcatagcatttgggtgggctgctaggtctctagggagagtcaaaggctggggaatgacatgacgcctccccttcaccttccccctgcttaaaaaaaaaaaaaaattgggaatttggatctggatctgctaggacctaccttcaatagaccagggaggtttagacccttcaaaaagataaatagctggctgactaacattgagattagtgtggaaggaatgactgatgaagaggcaggaaggtctgggtaatgtggagattggtgggatcagaagcgactggagggcatgggggtggaggctgagcttcctctgagcattggcaacaggtacagccatagaaagcaaagccagcaggttggaaagcggggacagtgggggaagtgaaatccaagagtgtttaggttaagtccataggcttcacttctccctacctccatcctgccctgcttttcctctcccctcttgattatatttcttttgtagactgatctccattgtttgacatgaggaaactgatatcaggagaccctttctgcatctctgtatctcattgggaaaaaggatcttgcatcattttgattaagatgccattgggatgattattttttatcctcttatcctgggtgttcacgatacttaaaaaacccccacattcttacatttatgtgatgagttttgagctctagctgtgaaaattgagccatagcctaaaagcctgaaacaagagtgtacccacattgacaccagctacccccacccccagcaaaggctggcaggtctgcagcagaagggtgaacaggctggcacaggcagaaaagcgtttatatgtattgatgctcctgccacggacaaaaccctgttaggtgttgggagagtcagaaaggaagtaaatcagaaagaagaaatctggagggagagacaaacatcagggcagcttttatttggatgtagaggtgccttgggataggctgctgtttgggtcctgtccctgcatgtagttggccagtaaggagatctggaaggcctgtgggtggcaaaacaggtctgatacacaagtggctctacttctgttgtagtgtatagtcagtgtctagtcctggaaggccattccagccaagggctgatctgagggttaggtgctggcagaggcacttatttggagatgccgacgttgctgaaagtaaaggagtgttcatactctacaatgggggtacagttggggagccggaaaaggaaatttgaatgtattactgagtggaaaagaagaaacagaaatagatgttataagccagagtccatgggaatggaaaggaagttgttccaagaggttaaaaatgtatgttgggagactggtacggatgcagtacttgagagagatgctagtgggttggactaggatgttagttggttggcgatggtgagaatggggagaagttacatgttgtaacccttaggtgtgctaggaaggaaacaggcttgagaaccatgttcttatgtagctcata

SEQ ID NO: 3534 - DNA, 1058 bp, Homo sapiens
ttctttggtctctcaggtaaatacagattgagtctttttataaaggcatattatttccctcattaaatgtgtgttttggcacatgtgttatttacctgatagacagtaatggctgcagaggagccattggtgtctgttgtgtaaatactctgcacagagaccatcctccaggggctctggcgcaggcctgcttctccaaatcgggctggccccgtggcagtcccatttacccctcccctgtccccactggggacctgggcccttcatattgaggagagaatcattcattttcctccttgccatgggctacttaatacctttaatttgctaggagacggaaaaggatgtctgagaataaatgtgtataaatcttagtctctgatgaaagatagtttgcagaaataggcagaatcataaactttcttttgagttctggccctcatttagatactcaaagtcccagttgatattataagctatagacttatagcctgcaaatttgtgactaaaacataaagacatcaatagaaaagagaaatccctaagacaccggagggtgcaagggcaagtgggatgctgctgcagggagcaggtgtgtttcctgagaaggctgtatggtagcaggagtgccagtgaagtgggcattgagtaggggctcttctgatggaaactcggctggatagagatactgtttgggctgagagatgctttgagcctctctaccagagagaacatgcagcctaccttctgtgggcattacagggagatctgtctcttcaaatactgtctgtgtgatatttttaattttaaaattgtaaccacattgcacatggattttaaaaaacaattttatttatttatttatttatttatttatttatttatttatttattgagatggagtctctgtcacccaggctggagtgtagtgatgtgatctcagttcactgcaaaccctgcctcctaggttcaagcgattctcctgcctcagccccctgagtcactggattacaggggtgtgctaccatgcctggctaatttttgtatttttagtagag

SEQ ID NO: 3535 - DNA, 1924 bp, Homo sapiens
gaggctgaggcaggataattgcttgaacccgggaggtggaggttgcaatgagctgagatcgagccactgcactccagcctgggtgacagagtgagactccatctcaagacaaaacaacaaaaaacaatcccagaacttttttcagtgtggaccttagtcccaacaccatcagtaaagcaaatcgagtgagcagcttcccgatagaaattcaccaaagtgtgaccagcattcctccctgtctgtctggggtcatttattagtgttgataccctgtggccttacatctttgtaaagtgcctctcaaattttttaaaattacttttcaccagcactctgggaagtgggtcaggtggtcagcattcttgtccttgataccatatgaagaaactgaggcctagaaaggttaaatgagttgcctgaggtcctgctgcgaggtactgtcaaagctagggcagatttgccatccagatgaaagtgtgttagtttattgctgtgatttcactttccttgagtgagaggtgcatagtcattgcagaactgcagtctgatgcatgccgtgtccagatctactaggtttgatttgggtcccacattatccatttggttctgttgggttttaattaatgattgctagaaccagaactgttgggaagcagactcccttttggatcattgtttttaggctttcctctttggggacattccttgaggagccttgggttaccagggattgctttgatgtgttcaaaattgtgccttgtgccccacagctacaggtaaaatcaaaaggcggataatttatgggagtgtcagagctggccgctggcacctcaggaggccattagtatgcctgttcagaccctctgtgtccttgcaattgattcctctttgcatgagcctgatttgggaagctgtagatctgtgggtagtgattggatgtgacagtccaaacactggtccctaaattaatccttttaatggtattccggcaccaaggcaattctctctctccctgtctgtctctctgtgtctctcactctttctttcactctttttcgctctttttaactagggaggacagaatggggtgggctaggaggaaggataaagaaaggaagagaagaagctttgtttgctgcttaggccctgctctgttctaattagcatgttctaattccagagcagttggcatcatgactgtgggcatattaattcatttagcaaacatttactcttgcttactttgtgcctggtcctgtgctgggtgctgggaatacagaggaataaaatgtggtccttacccttagggatctagctcagtgtttctcaggctttaaaaactctgagacttagcacagtttagattaaaacacacacacacacacacacacacacaacaaaacaatctcatgctcttctttaatgctatttgaaattttgaaatgcattagtctaacaagcaagtcaaagaattatgtcaaatatgctttttttttttttaacacatgcacacattcacctatactgctgtcttctatccttcttccttaactctttgaaaattactggtagtagaagaaacatacctaatatcttacaacatagtgagataaaagttatgaagtaggaataaactgtgccactggatcatacttaaacaattagctttatgatggagtgtcagagaaagccaccaaaaggggggagatttgagctggattttaaggaaggagtcataatttgtctggcaaaaaatggaagtgcattccaaaatagggagcagcgtttgccaaagcacaaatttgtaaaaggaaacgtcacatttgggtacttgagtaagaattggttataaccctgcctcctgccagtttccactctgtaagatggaaagatttgctcctgtggaattttgtttgagaagaga

SEQ ID NO: 3536 - DNA, 1115 bp, Homo sapiens
gcagagctttgcaagacaggatgggtgagtttattaagggggttgacttactgggattactagagaagaaaaaggtttgactagagaggctagaaatggagcatggagattgtgggtagaacattcccttgaccctctcgccaacacatgcccacacaccaggttagcagtttacctctttgtaaatctgaagcggtggtagtagtgatggtggaaggagtgaataagggcctaacctggctagctttctgtttgcctgtcttgcaaatggtccagcaacaggtgttttcttaaaaaaagcatgaacttggattgaggcttgactgcgagttcttgcaaaatataactgctccttgttgacttggaagatgctggatgtggggcccctcaatgggggtttggattttgtccttagagctggattttgcaacaaatagtgcccatcgttgtgtctgcgagaggtctctggccacttcaatggcatttactcttgtcagacatttaatcagtctcccagcggaagggcagcaaaacatgaatcctattggctaaaagagtgtacgctattcaaactatagtaggttgtgagtggctaaatgagttttgattgtagagtttcttccagaaattggcttcatcaaattctgctttattctgactttatcatatacagcatgccttgttttagtgggttcttgcttggagcttagtttattatacctgaatctcctaccatttaaaagccaatttataaacagggacttggagtgtgactccactaatgtgtgtctgtgatcctggttagaaacccacttggctgccttttcctcaggaggtgggggttgggggaagggagctgccgggaagtgattgataaggtttcctttatagattctgtggtgcttcactggagctcagagcactttggcaacttaagcactccaaattaaaagctcattaacaattcctgcccaaagatcctgtaaataatcagctagctaggtcatagagcttggctaagagcttttcttccaacttgaaatttccaaataaaagtgcttttattccctttcattttaaaaagtgttttctttgtggtggggtaaattggtgag

SEQ ID NO: 3537 - DNA, 1032 bp, Homo sapiens
tcagacttcccaccgagagcagaatctcagtgccttctctttcttttgccctttttttgttttgttttgttttgagatggagtttcactctgtcacccaggctggagtacagtggtacgatctcggctcactgcagcttccacctcctgggttcaagggattctcctgcctcagcctcccgagtagctgggattacaggtgcgcaccaccacgcctggctaatttttgtattttttagtagagacagggtttcactatgttggccaggctggtcttgaactcctgacctcaagtgatccacctgccttggcctccgaaagtgctgggattacaggtgtgagccaccacgcccggcctgagaagtcttctttatctggctattgctactcattcttctaggctcagctgagaaatcaactttcaggaagctgcccctggcctgctctcctctgccttcactcttcactcaggagtagatgtcctatgtctctgaacccgtagcaccgtatagaattcttgctatagaattctagtactatccactaaatggtctcctcactagtgtgtgaactccaatgaacatatctgacacatctcacttctgtttacctagagcctgaaaccattccatgtacacaatgcatgctccatacatcttgttgaaaagacctcattggattctgcattccaacaggcgaggcttgggtcatggcagcctaggaccacgcttagaaaccaccagcctggtggtggatgaccccagaggaggctctgcagtggccactgtggtcctcattcacacagctacagaactttcctagcttgaatcttggacaggctggagagccagaactgtggcagctgtctccccgtataccccatggccaactttttttttttttttttttttttgagacagagttttgctcttgttgcccaggctggagtgcaatggcacgatcttggctcactgcaacctctgcctcatggattcaagcaattctcctgcctcagcctcccaagtagctagga

SEQ ID NO: 3538 - DNA, 1071 bp, Homo sapiens
gtcttgaactcctgggctcaagcgatcctcctacctctgcctccttaagtgcagggattacaggtgtgagtcactgtgcaccgggcactgctactctgaacacatgtggctacatggaagacaggacttggccatgtgctctccccagctcagtagtcaagtgcctctctccatttactggtaagagagagagggtttagaggaactcttgttccggcgctcagctcatttgcatcccagaatgcattgtagatacgagaattattaccagggttatctgtttgaataataatatttaaactttttttctttgtcaggagattttacccagtgagaacatgtttaggacacttttctacagtggaagaaaagcttctgtctgcaggtccaaaggcaccgtaagtagagggagaccagtcaatagctgggaagccaggcaaaaggctaacaggcagatctctggtttctcttcataacgaataaatctttcgccttttactaaagatttccgtggagaaaaacaactatgagtttatggttaaattttttgaagtcttgcctaggcaaggctgaatgttctgttactaaagagagacgtgtgggtggggtgtttcatgctttgggaggttggggtagctccacaaatgtcacccaggttgtagcggagtggtgtggtcgcggctcactacaacctccatctcccatgctcaagcaatcctcccacctcagcctcataagcctgtctaattttgtgtactttttgtagtgcccggcctactgtcatgtttttttagcttcttgtaaacatttaggaagctaaatgtttataagatttttttttttaaaagaaaacctagtttttgacagtctgtatctaataatttggctgaagtcttgtgagtctttctagtgtgctagttccaatttatagtgatgactttgtgtgcatgattatcttatactttggactggtctcatatttgaaaaattaagtgtaggaaaaacttaagagttaggatgatgatactttcttccagagatagttttcttttgtttttatcaggtacctgg

SEQ ID NO: 3539 - DNA, 1089 bp, Homo sapiens
aaaataaaataaaaaaataaggccaggcgtggtggctcacgcctgtaatcccagcactttgggaggccgatgcgggtggatcacaaggtcaggagttcaagaccagcctggccaacatggtgaaaccccatctctactaaaaatacaaaaattagccgggcgtggtagcgcatgcctgtaatcccagctacttgggaggctgaggcaggagaatctcttgaacccgggaggcggaggttgcagtgagccgagactgcgtcactgcactccagcctggcaaaagagcgagactccgtctcaaaaataaataaataaataaataaataaataaaatcagcaaaaataaaataggaaatccatttagctttaaagaaaacataacaacaaaacataaatatattttgttaacttttctctcctttgtaggtacaaaaagaggaaagctgaggctcaaaataagtggggaaagcagaactgccttagaccaacaatgtcagggctggtgatgccctcttgtggcatcctggagaattactgccatctgacttcatttcctccgacttggagggactattccctcacaatacctcagtcactgattcatgcatgccaggtattgtcctaacagtatccctgtcctcgtggagtttacagtcagatggaggacatactattaataaacataataaggtaatgctatggaaaaaaatagcagagtaaggtgggaggggaggtggtgagtatagagaatggtagtgtgcattgcaattttaaaaagagtaggccttcttgtagagttgaagggagatgggggagtgagccctgtggatatatgggatgaagttctaggcagagtgaacagtcagtacaatagcgttgagacaagagcttgtttgccaatttctttttttctttttctttttttgagacggcgtcttgctctgtcgcccaggctggatggagtgcagtggcgcgatctcggctcactgcaagctccgcctcccgggttcacgccattctcctacctcagcctcctgagtagctgggactacaggtgcccgccaccacgcccggctaagtttttgtatt

SEQ ID NO: 3540 - DNA, 1098 bp, Homo sapiens
cgcccgcctcggcctcccaaagtgctgggattacaggcgtgagccaccgcgccaggcctatgaatacaattattttaaagcttttaattttttttttttttactttaagtgccaattataaaataaagtcactgtctagttggaccaggcatctacagttctgtaaatctggcttccgctctgccccctggtggtggcctaacgcctagaaaaagtaacgaactatttaaggtatttctggaaaccgagggggtggtgactcagcgtcatttacatacccacaatgcactgcacacagaccacgtcctactttaaaaggagattctcccttttttccccctcttttcctttaccataataacgaagctcctttcacacaatcgtctgagacaaaaacagaagtcactcttttgggttaatagtaaccattgctaatctagtagtgaccgtcccccgaggactgtgtgcaaccattccaacacatgctctggtttctcttcaaatcgtataaatctttcgccttttactaaagatttccgtggagagaaaccgttttgagtttcaagcaaattttttgaagccctatgttggtggggttcatcaacggtgtttaaaaatcagatagaaagttgtgtgtttgttgcgaggtgtgagacaacattttgtttgaacatttattttgggctgttgtaatggtgtgagtgtgcgttttttatttttttggaagtggggttttagactagactgtagtgagcaatctttgcctgccggcttcaagggattttcctgcttcagtctctcaagtagctggggctacaggtggcaacaccattccctgttagtttttgtattttaatagagatggggatttcccacattggccaggctgatctgcccgccttggcctcccaaagtgctgggattacaagcatgagccaccgtgcgaaaatttggttttgttttgtggttttgttttgttttgtttttaattaatttattctagaaacggtctcactgtgtcactcagtctggagtgcagtggcacgattatagctcactgcggccttaaactcctggcctcaagtgatccacccacct

SEQ ID NO: 3541 - DNA, 1045 bp, Homo sapiens
gtccctctctctaagcccggaggcttactgcgggtaaggacggcgggacaggaccttaacccctgggacgaacaccagctccgcaaaggactccgcacccggcgccgcccacggggtgcgggtcccaggaggaccagcagagaggagcataggagagcaaaggagatcagtgacccatggcttccccggtggcgcggaacagcccggagccgcctgtgatttgcatacccatggtgcaccacgaaaagataccctcaagatgcttgcactccctctgtgcgcgcatttctgcactgttttagagcatgatgcctcttacacgcatctgtgtgcataaactacatatagggagtgcgtaccacgcaggcatccaacaaccataagtgtgttaagtgttagttctccctgcgaggttcgaagcggaagtcacgaatatactcgggtttctcttcaaagcgcataaatctttcgccttttactaaagatttccgtggagagaaagttgtgagtttttattcaattttttgaggcctcttatttcctgaggctacatttttaagtattaaaagttaggcaactacaaccaaggaacttggtcatttgttatttgtaccaaatgttcacaaacttattcgggcgtggtggtgcctgtttgcaatcccacctattggagaagctggggcgggagagtctcttgactctagaagacggaggttgtagtgatccgagatcgcgccactgccctctagtcagagtggcagagactcctggggcgggagagtctcttgactctagaagacggaggttgtagtgatccgagatcgcgccactgccctctagtcagagtgacagagattcagtgtaaaacaaaaaaaaatcagaagtttgcgtgacaccttgttttgagctacatttggggtttattggcttctgcagtgtgcagtaagactggcttctattgtttatttcttgcgtttttgttgcatttcgttgcagatttaagagataaacagtggaaggcgctttcaagtcgtccggtcattaa

SEQ ID NO: 3542 - DNA, 1088 bp, Homo sapiens
ttaaactaatcaagtttcacctcctgatgctggggaggagcccagctgtccctaatcactgggcctttccgatgacggccacggaaatcagggtctgttagaaaggaggaaggtgctgacagcctcaccttcaaatctgcctccacagcaccaccctgtggccaatctccatctggccaagtcagtccccttcttagtgcccttccaccgatttccaccagattctgtaaaatcaaatataaactccatagcacacactctaggccctccataattggacttgattgcttctccagcattgccgctggctcctccctggctcactcttagcagtaccgaaacacggagtctttgacagttccctgcgcacacctggtccaggacacgtttcctgacttcttctcgtgggcacctcatcattcacaactcacaatagtgtattcacaaaaatacattgttaggtgatgaaaacgtcagatcccctctgcccaaaatctaccatgactcccatttcacctagagaaagcttaagtccctacaatagtatataggcctttacacgtgaaacttctggaccaaagattatggagcatatatattgcaatgttgctttcccccgaagagtgtaccatattacactctcatggtgggttagagtgtactcttgtaaaccagcaacgagtgccatcaattttaaaatttttgctaaattgttagatagtaacttattgatgtttgtatttgcatttacattattatttataaggtagagtctttttccatattggttaaccagttatattttcccgttggtaaagacataaaagtttggccgagcacagtgactcatgcctgtaatcccagcactttcagaggctgaggtgggaggatcacttgagcccaggagttcgagaccagcctgggcaacatagggagaccctgtctctacaaaaaatacaaacattaactgggcatggtggcacacacctgtagttccagctacttgagaggattgcttgagccgggaggtcaaggctgcggtgagctgtgattgcaccactgcactccagcctgggtgacaaagcgag

SEQ ID NO: 3543 - DNA, 1022 bp, Homo sapiens
ctggcatcactgtcaaatttttttactttgacttaacagtttcatttctagaaattaatcttatagataagcttatacatgtatgcacccttaatctcaaaaccttgaaaacatatcaatagatctaatggcccaggttggcaccaatactgtacagtgattcttgaagcctaggcacagtggttcatgccaataatcccaacactttgggaggctgaaatgtgaggatcgcttgagcctagacaacatagcaggaacccatctctacaaaaaaattaaaaattagccaggcacagtggcacacacgtgttgtcccagctactcaagaggctgaggcaggaggattgcttgagcctgagaggtcaaggctgcagtgagctgagatcgcaccactgcactctagcctgggtgacagagggagaccctgtcttaaaaataataataaaaattaaaatgactgattgcttttggtattattcctaaacctaaaataaggtggggaggggagttgctgaaggaattaaccccaccaactctgtagacgccacatcatttccttcttcagtttcttcccccttcccttttttaaagtcatatgccttccttttgggctttagaatcaaacagacctcagttcacatctcaactcaacttagtggctgtgcaccaagtgaaatttttaatcattaagccctcagattttccttttttttttttttttttttaattttaattttttgagacagagtcttgctctgtcgcctaggctggagtacagtagtgctatctcagctcactgcagcctcctcctcctggatccaggtggttcttgtgcctcagcctcccgggcagctgagactacaggggcacaccaccacccttggctaatttttgtgtttttagtagagacagggttttgcaatgtcacccaggctggtcttgaactcctggcctcaagcaagccacccacctcactttcccaaagtgctgagattacaggtatgagccactgcgcccagccc

SEQ ID NO: 3544 - DNA, 1031 bp, Homo sapiens
tcttgcctagcttcagagcatacattctttggctcttacgactgagtaggaagcatacccctactaccaccttggaaaaagaaataagacttttccattataaactagtagccaactgaaaggcagctctgtcccaggagcctctgtatctaaagctttctatacttccctattaccccttttggaggaatttcccccaaaaagcaggaaccaccctaactgaccctaactgcttactggactgctttgcaagttaggcaagttggaaagttatggaagctctcttaaaagcccacccactgagtgtatcccaagtctgccaaagggcaaactagtgctgtctctgcccatctctagcctacaccacagaggtgctgtggttttggccttttgctactttccaaaaggctttaacctcctaggagaacagagataaagaagactctgaaatgccttaaagtgctagtatttctttttgcattttactaagttttggcatttgggaagaatcttttttaatggtctgtgtatcagtgtttttagtccttggaatgtcctctttcccaccccctcatgcctcttgggttgggaatttttccttagttttgttttgttaaaagggtgcttacaccctctctatcctcctccttctcccttccagctgcccattttttctcttcccatttctgactcgggtactgaatatccccttgttaggaaagagcttcttccactgagccatatcagctcagaataaggcagttctaggtctcttctagtcttttcttaatttctttgtattgcattatgattaaattatggattctgaagtcaggcagacctagatttaaatctgttactagcagttatatggttttgagtgaatggtttaacttctctaaatctgttacctcatctgcaaaatgtggttgctcttttttagtgcatcagagataaaaatagtactcccagaatcatctaggaggggtttgcttctagttaaatacatttagctcctatccgagacctac

SEQ ID NO: 3545 - DNA, 1033 bp, Homo sapiens
gctgaggcgggtagatcacctgagtcaggagttcgagaccagcctgaccaacatggagaaaccccatacaaaattactcgggcgtggtggcgcatgcctgtaatcccagctacttggttggctgaggcaggagaatcacttgaaccccggaaggtggaggttgcagtgagcccagttcgcgccattgcactccagcctgagcaacaagagcaaaactccatcttggaaaaaaaaaaaaagttggtaccaatgttacaaatacagaagaaaatttgtggatgagtgcttcattccttaaagctcaccaaattgaaaaaacaaaaccacagaaggaagctttatctataataaaatgaaataacctactcatacctatgcacagactacagaatatctgccagatacagtgaaatttagattaaatccaaagagaacaccaagattcaacataaagagaagaaggaatgggaacatgggtgaaccaaagaaaagacatcaaacatccttttttcaaaataccaaggcatgcagaactgaaagaaaaacatcaggccacatagaagggagaaaatcaggctggcttcacacatttctttttttttttttaagatggagtctcgctctgttgcccaggctggagtgcagtgacaatttcagctcactgcaacctccacctcccaggttcaagcaattctcctgcctcagcctcccaagtagctgggattataggcgtgcgccaccacacccagctaatttttgtatttttagtagagacagggtttcaccatgttggatcaggctggtcttgaactcttgacctcaagtgatccccctgccttggcctcccaaagtgctgggattacaggtgtaagccgccacgcccagcctggcttcagacttttctatgataacatttcaggccagaagacagtgaaacaacatttagagaatttagaagggaaacatttgtgacctaagaatcttataacctcccatatttcatccctacaaggaaagaaaacacaaaagaatc

SEQ ID NO: 3546 - DNA, 1031 bp, Homo sapiens
atatgtgtctgttgttttattttgttttcttggcaagagaggagggcccatgcttcaaataggtttgagttggtctcagaggtgttgtatgaccttgtggccctgagaaatactgatcatggtccctcttgctgaagtgtctctatggaaagatcccattagatcccagcttgagggatctggagggtggtttgcagttggttgagatgggtggacagagttttatattttgccttttacaggttggagttgacagcctcattgggccagagacacagattggagagaagtcatccattaagcgctcagtcattggctcatcctgtctcataaaagatagagtgactattaccaattgccttctcatgaactcagtcactgtggaggaagggtatgtttccccctgtacccacttgaggcaaagataatggaaaaatgccttcaaaattctgaaggaaggttaattttaacctaaaattgtatacccaggcaaagtgctaatcaagagggcaatagaataaaaacattttcagatatcaaaagtctcaaaaactttactaggaaatttattcctctaaaatggaaaataaaccaaacagagaaagatcagaaacaagagattcaactcagaaaaagggcaaaaagaatccatgggataacagtgaacagagataagaatgacagctctaaatggggcataaagggattagttaatccaaactggaacaaaaccaaagaatccaggaaagatttattcagcaagatgcaactgataaaataccagatacatacaaacatttgaaagtcgatttaggcaactggctaaaagtttgaagttgaatcggggataacatagaaaaaacaacactatttaacaaaaacaagactgttattaactctgggaaaatgaagaagttgtacaagttgaatatccctaatccaaaaacccaaaatcaaatgctccaaaatccgaaacttttgagcaccaacttgacactcaaaggaaattctcactggaacatttgagagtt

SEQ ID NO: 3547 - DNA, 1031 bp, Homo sapiens
gccttgggtggagtgtggaagaagagaacctagggctgggggcttggaattagccttcacattccagtgtagccgtgctgacaaggcctccgtcagctagtgtggctgccacgcacagtgctctgaccagcattctgtctatgctggagaatcatagacaggcgcactacctgtgccttcctaatagactggtagccaaagccccccatacctctaacctttccaggtttctcacactggagagggaatagtgtgaacttccccttcatgttttcttttggctgggggatagatgccttctcagggtctgtccttgatttcgaatttgtctaaaatggatctcatcctcacctcatgcgtggtcacagtggtccaggaggtgaccaggaacccaggatgcttatgatcaggatgcggggtgttccttgacctgatcaggcctcctttcccaagaggtggtatgtgggtatctcaaagactggtctcagtgcctcccagccaagggacatggcattactttcaaggaggagcattcaaagctaagagactgacaataaggccatctagaagctgctgcataaataatcttggtcctagggggaatgcagcagcctcctgctccccctcactcagacaggaagctatggctgagaactccctgtatctctgattgagcactgggttctacctaaggtgttttttttttttttttttttttttttttttattgatcattcttgggtgtttctcgcagagggggatttggcagggtcataggacaatagtggagggaatgtcagcagataaacaagtgaacaaaggtctctggttttcctaggcagaggaccctgtggccttccgcagcgtttgtgtccctgggtacttaagatcagggagtggtgatgactcttaacgagcatgctgccttcaagcatctgtttaacaaagcacatcttgcaccgcccttaatccatttaaccctgagtggacacagcacatgtttcagagagcacagggttgggggtaaggtc

SEQ ID NO: 3548 - DNA, 1050 bp, Homo sapiens
tgtttatgctttgttctgtattagagatagcagccctagacattaagttcttaaaagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatgttctcactcataggtgggaattgaacaatgagaacacatggacacaggaaggggaacatcacactctggggactgttgtgggttgggggaggggggagggatagcattgggagatatacctaatgctagatgacgagttagtgggtgcagcgcaccagcatggcacatgtatacatatgtaactaacctgcacattgtgcacatgtaccctaaaacttaaagtataataaaaaaacaaaacaaaacaaaacaaacaaacaaaaaagcaagactcatacgtttctctggttacaactaaagggtgggtggaggttgttttctgttttctttttaacctctgtgggaactagtttatggctccatacaatggagtgttagtaactgccttaattgtaattacatttgacaatgagagcaaggcttgggcatgatgggagcaaagaagatggacctagtcagaggtgaggtgataatgaagagcaggtggatgtgtctttttccttcatagatgtcaagctcagggccttgactaagcactggggtcattgagagcagatcttctatcagtttcctaagactaggctgcatttttagttgttggcagatttttttccttgttcttctgatttataatccacaccccagtgattcaggatctttggtgtgtagttataaaagggttgcaggctggataaatatgcataaaaatattctctcattcctatgaccctctggggtgttgtgctcctcctgcctcaagtgagatgctggttaaaagctaattaga

SEQ ID NO: 3549 - DNA, 1021 bp, Homo sapiens
ctgcgacctctgcctcctgggttcaagtgattctcctgcctcagcctcctgagtagctgggattacaggtatgcgccaccacgcccagctaatttttgtatttttagtagagacggagtttcaccatgttggccaggctggtctctagctcctgacctcaagtgatccgcccacctcggccccccaaagtgctaggattacaggcgtgagccaccgtgcggcccattctaagtggcctttttttttggagagggagtcttgctctgttgcccaggctggaatgcaatggtgcaatcttggctcactgtaacctccgcctcccaggttcaagcgattctcctgcctcagcctcccaagcagctgggactacaggcatgtgccaccacacccagctaatttttgtatttttagtagatacggggtttcaccatattggctgggctggtattgaactcctgacccgtagtccacccgcctcagcccccaaagtgctggggattacaggagtgagccaccgtgcccagccctaagtggccatttttaagtgaacagttgagtagtgttaaatgtgttcacattgtggtgaaacagatctcgagaactttcatcttgcaaatctgaaattctatacctatcaaacaacagctcccctccccatttttttctccccgcaaggccttgctacccacgattctactttaaatatctaagtgaaatcatacaatattggtctttttgtgactggctaattttacttagcataatgtcctcaaggtttgtccatgccgtagcatataacggatttcgttttttttaaggctgaataatactccgttgtatgtatgtagccacattttgtcatccatttatcttctgacagacatttgagttgctgccacctcttggctattgtgaatagtgctgcagtgaacgtgggtgtacagacatctcttcaagaccttgctttcagttcttttggatatatatttagaagtgggattactggatcatatggtagaga

SEQ ID NO: 3550 - DNA, 1079 bp, Homo sapiens
tatagggagagcctcagccttgacagctggatttttcttttcatctagtctcttaccatccagggggttagcccaggcttgtttacaaggtagcagcagcaggttctaagcatgacagcagaggctacaaagtctcttgaagtctaaactcaaaacacacactgtcacttcagctgctgcgctctgttagttcaaagctagttatggagcaagcccagatataaaggatagggaactaaccttacctttggataggaggagctccaacaagtttgtgaccctttttaatctactcgacatactattttgacttgctaatgagtaaatttgcctgttcctttctcataatatccttgcctggttttggcatcaggatcatgctggccttataaaatgagttggaattcctaactctagacatagcacctaccatagggtaggtgtacaaagatatttattggtagaatgaatgaatcaatgaatgaatggataagcaaaatgcctgtagatgagacagaagaatcagtcagaaaagtaaaaatcaactagggaaaaaaacgtgaatacttgaatatgacggactttttttttaatagaagttcagttttgtctgctttcttaagtttgtgtagcctttcttcttaggaagacattctacaattacctgctctgctcccaaagtgaaattcctattttgctaaagcagaacagaaagaaacctttccaagtttctataatttgtatcacattctgaagtcccagttactgtaatagctgcaaagaagcaatacaaggtggagggtctgagagggagagaaaaatgactaaagtgcaacatagctgaaaaattggctggctggaaattattgctcccaggacatcagtgattcaaggtttctgtgagccttaggacttgagtaggggaagcattccaaattatatccaaaaataacatctccgtgtttcttttgttaaatggctggctcataatgagacccttacagactttgttacattctcaagtttccatgtaatgtataagttgatatatgtctaagctgctatgtggcatttgaaat

SEQ ID NO: 3551 - DNA, 1051 bp, Homo sapiens
aattttttggcatttaactccatatctccaaataacgtgcttttattttctgtgtcttaatttttttagctttaagaattatctgttcacttcttactatagaatgtaaagatttggttctattttaccacatgctctgcccccactacatgtatgcaaccttgtatttggcccaatttcctaatatagttattcatattgtattattaattaactgaatattttatgtttatattatcatgactgtataaatagtattcacagttgagccttgtagtatatgattacttttctctttcctccttttgttttcctaaagattgtcttgttttttcatttgcttgttttttatgtatttgtcactaattcaacccaagctccaattgtgtgaatttcctctccttacattgcaacacactagatgtcctctcaatttcaaattcttcaaggtacctctcctaaagcttttctaacctgagttagttgccctgctgtagagctgtcattttaggttcacccttcactgtcatatcttgaacctcacgttttcttctttcttactttatacccacattttctgtaggacacatcctctggaagcctcctgaggtacagattgtgagaagtaaatttttgagcttttgtatccctgaaagtgtctttattctgcccacatatttgtttcatattttggctggatataaacttctcttggaaatcatatcccctcaaaattttgaaggttttttgttttgttttgttttgttttgttttactgtcttctagcttttcttttaagaagtccaacatcattctgattcttgattctttgcatgaaacacttttttcctctttttcttgggatgggagggggagcttataggatctttttgtttccgaagttcttcaagtgagaacacttaaaatctactctcttaggaattttcaagaatacaatacattgttactaactagtcaccaggttgtattaggtctctttatgagcttattcctcctaagtgaaattttgtattctttgacaaaggtctca

SEQ ID NO: 3552 - DNA, 1045 bp, Homo sapiens
tattcctttttaaatgtctatctttatatatattatataaagagcatatcatattatagtgatctatatatttttttaaaaattttaaggtaagtggcaataagttcaacttttttgatgtttggaaaacactgttttagggtgtctttgagcagggaaaagacatatgcagtagaaattagagtatggattagaataagggaaaactggagcaagagagacaccagccaagagactggaagaagattttgagacctgaactaaggcagtgcaataggggaagagtaggggacagggcaggagaggaaggacttccatcctggactatgggcggatttctggcatcagattctggatggtagcaacagcatgattaaactaaggaatatagtaaggatatttagctgtgagcccaaggattatcacatttcttacttactgactgagttggtcatttcccttcctagagctactgccccaacctcagtgaaaacaatgtggcagttggcccttggccttgcactttgaggactatagactggaatcttttccaagcattttaaaccaaaactgaggtctccattgcagttagcctttggtgtttattcaagcacacaaactatgccaggtgcagtggctcatgcatgtaatcccagcattttgggaggctgaggcaggaggattgcttgagtccaggagtttgagaccagcctgggcaatatagggagaccccttgtctaaaaaaaaagaaaagaaaagaaaaagcacacaaactactcttggggatttgactgggattggaccacataggaaaatgtaaaatgtgaccttcatagtcacaccaagtagctgaattcatgagttccatatgggcaggggtggcatgcaggctggtgatttggatcatagccattatttgtggaagcactgggtgagtagagaagcatggtagttaccttgccctgacagtttttttccaagggagtaaatgtgtttttctttctccttgtcataagaaatcggttgccagattgtgttatttata

SEQ ID NO: 3553 - DNA, 1049 bp, Homo sapiens
gttctgtaccttgttctttcaccacacacaagatccctctccaatccatccactcccatggcttcaactactgtctgtagactcgtgacccctaaaatcctgacctctagccccagcctctcctaagcctggggccatatatgtatctgtaccctcgacgtttgccccaagatggcatctcaggctcagtgtgttctttatcttctccgaagactactcccctctagggctcctgcctcagaagggcaccatgtcccactcctccccatcccaaagcccacagggccatccttcaccccttcttctccctcgccaccatattcttaagtcttcctctgtaatctgtttgcttttcctgtctcactactgtctccctgcctggttgaggacacctttcctccttagctaatcacttactaaaaagctggtgtccctgtctccgttcttacccgtttggtctccatgcagccacagtaattcatttcactctccttatttaaactcattgatggctcggccctgggcttaggatagaatgcagaatctgtaaaggccttacgtgaaccctgtgtctccagccacttggttcacattcaggctccagccacacagtttccttaggccttttgctctttccagctttctccaagatgttctctctcctaacttcccttatgtcccagccatcatttgggtctcagctgagacaccattttccacaggatgcctcctctggcctccaaggctggttaggtgttgtcttgatgcttttacagctcttgtactgacaccctcattccctgctgcctccatggggactgccttgcctggctgtctctgcttccctgtgagcatcttgtggaaagacagggactatctccacagtgaaaaggttacctccctgcctctctccaacccctaggtgaagctcctggaagtgatggaaggaatggacaaggagacgtttgagttcaagtttgggaaggaactaacattcaccactgtactgagtgaccaacaggtggtggagctgatccctgggggtgcag

SEQ ID NO: 3554 - DNA, 1038 bp, Homo sapiens
tcaggaatgtctttccctgtttgtctacctgtttgaaatcttacttgtccttcaaagcacagctcaaatattattttctctctgtatatatttctatcatgttacttctttttagctgctttataattacatttatgtatcatttgtgagctctttgagggcaatgaccatttcctattcatctttgtactttctttgcccagcatactccctggcatttaataggttttcaggaaatgtaggattaattaaatgaatgagacttttcccattaggcagttagttgctacctccattggtttcccatagtataatatatgtttgcaaagagaaactacattttattatcctacttgtgtgtccctttctacaccatagaccacgctgaggctgcaaggtagctctttcaagatatcacctgtgatttattcaactttttatatccttaaagataaagacacagttcctggtatacagtaggtgtcaggttgaatttgaggaactggactgaatacaaactctctttgtcaggtataaattttcctgacttgaaattttaactagaccaaaatatcttcttcttacttggtagagcatgtgcctacagcctgtgctcgagttgacgccctgcgttcccatggttatccaaaagaggccctcagactcacagtggccattattaatactctgaggttgcagcagcagcggcaactggaaatctacaagcatcagaagaaaggtatagtaattaggagccatctaacccccttaggcccaaagctgatgaggatcctcaggggatacaaggcccagaagaactagggaattccgggtcattctccttgctgtgtggaatgcctcactttatctttatgaatgtcagttttctcatctgttcatttgggaataatacctgtttgcctccctcataaggcagttagaaggctcattaagatctggtatgagaagaccatttttaaactctaaagctgtggacaggcatggtgattcacacctataatcccagcactttgggag

SEQ ID NO: 3555 - DNA, 1261 bp, Homo sapiens
gccccctagacttggacaagtgttcctgctttgttctaccacttgctgagttttgctataacatttacttcctcaattataaatgtttacttgtctgtctctcccactagacaacattccttctcatcttagtatcctgtatacccagcttaaagggtactgtactgtaagggcttaaatgtttgatgaatgagtaaatgaatcaatcagtcagtcaccagatcgatatcttgggattgctgttggaatattacattcatcctgagcttaaaagtcaatgtttttctccatcagggtacagaaattaagataaagagctctctgtggccaccataaaaaatatgagtcctaacttgctgatcagagatttatccctttcagcattcattctctcaaatgattattaaattttagcactatttccgtagagacttgcttggttatttttctttttcttgtcgattttgcatgagaaaatgctttacctggcataatattttggcacagggaataggattctactgtgtggtccaagacttttgagcgaaagaaacttacttggctcttgatctacatgaattctttagatttttatctttcagctgccttgaaggtaagagtattttcattcaccctccaggactctgcatattcatttctgcaaaaacatcccagagctctcttcttcaccagcattcttagtcttgaaagcctcttcatgaactatagatgaactcttgaatctagacctgaattagatgggagaaggcttcctctagactttttgtttatcctacagactcccccagtgagtttgatttttataactcacagaagaaggcttttctttttcttgatgtctgtatactttctgagctatagtctgctttaattctgagaacagaccagggtaaattgagcttcagctcagaatatgactgttttataaacaaatttaaacattgtttaaatacaagggcaggtgtggtggctcacatctataatcccagcactttgggaggccaaggtgggaggattgtttgagcccagaagttcaagaccagcctgggcaacatagtgatatcccatctctgccaaaaaaaattaaaaattagccaggtgtggtggtgtgcatctgtggtcccagcttgctgggaggctgaggcgggaggatcgcttgagcttgggagattgagagtgcagtgagctgtcttcatgccactgcactctagcctgtgtaacacagcgagaccttgcctaa

SEQ ID NO: 3556 - DNA, 1086 bp, Homo sapiens
tctcaaaaaaaaaaaagatgaaaagtgataggatccagagcagaggtggaagaattacccttaactaggagcgaaacatctattttgacaagaagaaaagtgaaaggagggctggggatgaagaatagtgtataggtttagaagctttgggggaggttggaagttcgagagtagtggagaatgaaatagcccctgtgggctgggcatggcgactcacacttacaatcccagcactttgagaggccaaggcaggaggatcacttgagcccaggagttcgacaccagcctgggcaacatagggagacccccatgtctacaaaaaaaaaaagaaagaaaaactagccaggcatggtagcatgtacctgtggtcccagctactcaggaaggatgctgaggcaggaggactgcttgagcccaggaggtcaaggctgcactgagccatggtcacaccattgcactctccagcctgggcaacagagcaataccttgaaagaagaagtagcccctgtggagtaagatagagaactgaatatggaaaccattggaatgatatgagaaattgagagtgtgtttgaggttgatagctataattaatgtattagtgtcaatttgcagtgttgtgtggtttttgttgttgttgttgttttttcgccctgtcacccaggctggagtgtggtggcggctcactgcgacctccccctccggggttcaagtgattctcctgcctcagcctctcgagtagctgagactacaagcatgtgccaccacgcccagttaatttttgtagttttagtagagatggggtttcaccatgttggccaggctagtctagaatgcctgacctcaagtgatccacccacctcggcctcccatagtgctgggattacaggtgtgagcagttgcgcctggcttgtatgggttttgatagcaatgttcagcaactgtggttgaatttagaaagaacaggcaattgggttcatctagacttagggttttgccattgggtaaaatgaaaggatggttgtgcaaagtagaactgaagtgagtaaaagagagtggatgtgataaagataattttgtcggtag

SEQ ID NO: 3557 - DNA, 1028 bp, Homo sapiens
agaagtttaactatgatgtatcttgacgtggatttctttgggtataatcctctttggggtttattcagcttcttgaatctgtagctttatgtcttttgccaaatttggggagttttcagacattatttcaagtattttttcagctctgccctcttttttctgcttctgggattccagtgagattagatcttttgttgtagtctgacaggtccctgagactctggtgtggttttctgttttgttttgttttagtctattctctgtttttcagattaggtaatttctgttattctgtcttcaagtttaccgatttctctgtttcgtccatctgctgctgagtccatacatttttttatttcagttattgtattcttctgttttaaaatttccactttgttcttctttgtatcttctgtttctctgctgagagattctattttttcatttctttcacatacagttgtcattgctcattgaaaatgtttttataatggatactttaaaatctttgtgacaaaattctatatccctgtcactttggtgttgatatctacttattgtctttttttattcaagttgagattttctttgttcttggtgtatcgagtgattttaaacctggacatttggggcattatattataagactctggattttatttaaacttccgttttagctggtttcctctgatactcttgtggcagaggtaggaagggagcagcctcattattgctaggtggaggtagaagtcctggttctccactcaggcccctccatgcttagagaattaggaatccttcattactgttccttgcatggcctctactgacaccagaggtggaagggtggtggcctcgttaccactgggtagtgaaagtcctgattttccactgggcttcatctgacaccactgcagcagggagaggaggacatagggggcaccttgttatagcctgacagatatagaaggctccccactcagccttggtgggggtttggtttcagtgttctctgtgctgtttgtctg

SEQ ID NO: 3558 - DNA, 1050 bp, Homo sapiens
tatctttttagcccatcaaactcagcatgtccaagactgaactcttttcccatcaaagtcctcctcctccagagtcccctgtcttggaaatgacatcacattcaactaattgtacagccagaaaactgagaattatctttgacttctccattttctttgtttcttttttttttttaaataatttcaacttttattttagattcaggggtacatatgtagacttgttacatgggtatattgtgtggtgctgatgtttggggtatgattgatcctgtcacccatatagtgaggatagtactcaatagttagtttttcagtctttgccccctccctcctttctctctctggtaatccccagtgtctaatattgccatctttgtgtccatgtgtatccagtgtttagttcccacttgtaagtgagaacatgtggtgtttggttttctgtttctgcattaattcacttaggatagtggtctccaggtgcatccatgatttcattctttttttatggctgtgtagtattccatggtgtatatataccatgttttctttttttctgagttttaattttttttccttcttttaacaaatttttatttccataggtttttggggaacagatggtatttgattacatgggtaagttccttagtggtgatttgtgagatgttggtgtacccatcacctgagcagtatacactgaacccaatttgtagtcttgtattcctcacccacttcccactctttccccccaagtccccaaagttcatcgaatccttcttatccctttgcatcctcatagtttagctcccgcttatgagtgagaacataacgatgtttggttttccattcctgagttaattcggttagaatactagtgtccaatcccatccaggttgctgcgagtgccattaattcattcctttttatggctgcgtgtattccatcttatgtatatactacagtttctttatccactcattgattgatgggcagggcatttgggctggttccacatttttgcagttgcaggtttatagcgctgccgta

SEQ ID NO: 3559 - DNA, 1033 bp, Homo sapiens
gtattctctgatggtaggttgtatttctgtgggatcggtgatgatatcccctttatcattttttattgtgcctatttgattcttctctctttttttctttattagtcttgctagcggtgtatcaattttgttgatcctttcaaaaaaccagctcctggattcattaattttttgaagggtttttttggtctctatttccttcaggtctgctctgattttagttatttcttgccttctgctagtttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggacttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtcttgttgatctgtctaatgttgacagtggggtgttaaagtctcccttattattgtgtgggagtctaagtctctttgtaggtcactcaggacttgctttatgaatctgggtgctcctgtattgggtgcatatatatttaggatagttagctcttcttgttgaattgatccctttaccattatgtaatggacttctttgtctcttttgatctttgttggtttaaagtctgttttatccgagactaggattgcaacccctgcctttt

SEQ ID NO: 3560 - DNA, 1026 bp, Homo sapiens
atttaggggagtataacatagttaccttatttaaaagtagactattgaggccaggcgtggtggctcactcccagcactttggtaggccgaggcgggtggatcatgaggtcaggagatcaagaccatcctggccaacatggtgaaaccacgtctctactaaaaatacaaaaatattagccaggtgtggtggcgtatgcctgtagtcccagctactcaggaggttgaggcaggagaattgcttgaagccgggaggcagaggttgcagtgagccaagatcgtgccactgcactccagcctgggcgacagagtgagactccgtctcaaaaagaaaaaaaaaaaaaaaagactattgaagcaaaagctgaagtacccttctgcctagtggttttcttgccttaacagcagttgtttgcatactttgtatactttagtccttagagaaatacaaattaaaattcaaggaaatacctacattacacacacactaaaatggttaaagaaaaaaaaaagactgtaccaaatgctgacaagtatatggagtaactggaactctcatacattgctggtatgtaatgtatggcatgaatgcaaaatggtgcagctacattggaaaacaatgtcctttatagctaatcatatacttaagcaaaagattcagcaatcctactcttaggtatttacctgagataaatgaaagtgtataaggggatttcaaaagctcatggaaaaatggaattaaaggataaaaattaaaagtataaactttatttctcaacataaactccatcaagttcaagaacttttgtaagcaatgatacaagccacttagcacatccctaaagaaatgaaggtcctaggaattcaaccatgtcaatgcagtcttctttacattattgactgaagaaaaattggtgccttttgaagatttttttaaagattagggaacaaaaagaagtcagaaggagccaaatcaggactgttaggtggatgcctaatgatttctcatcaaaactcttatagaattgc

SEQ ID NO: 3561 - DNA, 1037 bp, Homo sapiens
gcaaaattccaatctctgattttgtggtcacgtggcattctccctgtgtgtgtctgttttcacatggccttcttataaggacaccggtcatattggattaggggctcaccctactccagtatgacctcatctcaatcacatacacaacaaccctattcccaaagtcacatcatgagggactgaggttatgttctgaggtattgggggttaggacttcagcatattttttggggggtgacataattcagcccataacagcttctcatacttgtttcttgttgcatatctgagtttcatgtgaattttaaactttattacattaagtatggcttaagttaggaaatcaccacattaattttattaggtaagcattatttagacttgcttgattcaatttgcatgattatttaatcttaatacatgtggaatatttttgacaaataagtggttatttaaaggttaaaattgtcattcttgataaaaaatgatgactgtgtgatatagcactcatggtatacatatatgaatgaatagattactgtgggttttttttcatgcacaccatttataactcagctttagaaatggataaccttgaaagcatatgaacagtgttttaatgtctgtttccaaaccctaaattactatggtttacaattagtgcttgatattagaaatagataataatttattccagataatttttatgtgaatttttttaccttgtggtttatttataggcttatttctttctaacataggcagcatgcttcttggacacttttagcctatcatggagctagtagactaagaaaatcatacttatttaaatattagctgtagtattatgtgattatacgctaaattactctgcgatagtttttgtaatcatatatagtcaactgattaatttttggttttcagtgtaattgttctcccccttaggatgtataatgtggtttgtcctaagttggtgctcagtaaatgtttattgaatgaatgagtacattgtcatatcattttttatatttgtgtag

SEQ ID NO: 3562 - DNA, 1050 bp, Homo sapiens
tacaaaaaaaattagctgggtatggtgcgggcgcctgtaatcccactacttgggaggctgaggcaggagaatcgcttgaacctgggaggcagaggttgcggtgagccgagatcacgccattttgcacttcagcctaggcaacaagagcgaaactccgtctcaaaaaaaaaaaaaaaaaaaaaattcctattggagactagtccctccgtaaacactacgattcccatccacctctgccttccagtgctcctttgttactcattgtttatagttaatcttcagcttctctcaactgagcccatttcatcattattcagaactgcttgggccgggcgcagtggcttatggcctgtaatcatcttaggaggccaaggtgggaggatcgcttgaccctaggagttcaagactagcctgggcaacatagtgaaaccttgtctctacaaaaagaaaattaaaaattagttgggcatggtggtgcgcacctgtagtcccagctacaggaggctgaggtgagaggatggcttgagcccaggaggtcgaggctgcagtgagccatgttcttattgcactccagcctgagtggcagagcagcaaagtgagggacacactgtctctaaaaacaaaacaaacaaacaaaaaaaaaacaaaaataaaaaaactctttggatttctcctatcctaaaaaagggaaactcttttgactatcccccatcccattaattcatttaacaggtatctattgtgtacagtttacctggcactgactttggacacacaccaatcaacaagagaatcagtccttgcactcaagtcgttttttacagtcaaattcaggaagtacacactgatggaaagaatcaaagtaatgtaaaattacattaggtaagagctacaaggcagaaatatgtgataggataagatgaggggacctgatttggacatttcagtcaagacttgaaaaatgataaggtgttaggtaaaagcataaaagagtccaaacagaggaaatggattgtgtgaggccccaaggtgggcagacacacttgaggt

SEQ ID NO: 3563 - DNA, 1048 bp, Homo sapiens
ctggtctcaaactcctgacctcaggtgatccacgtgccttggcctcccaaagtgttgggattacaggcatgagccaccatacccagcctttcttttgtatttttaacagagatggggtcttgccatgttacccagactggtctcaaacttgtgagctcaagcagtcacccacctcagcctcctaaggtgctgggattacaggcatgcactgtgcccagccaactcatacatcttgagagccttcatgtttaacttcaatctcctgaatatgtgttacaggagcaaatgacatgagaagggttaagaaattcttgccttataggaatgacagcagtcaaggcagtataggggcctatcagttttctttcctgtggccccaggatgtagttcttagctaagagcaggagttcagtgatttttagtcacttgaatgcaggtttttagggccatatgtactgacccattttctgcctgtgtgattgagtttctgctgccctgccagttcctctttggcatcagctgatctctgtagcactctcttgctgtccaaattgctgtgtgaccaggttagaaaagagtcgctttcagaggaagttggccatgccacaaaacagacacctcatagccaaatggcctaagataccatcatgacaaggcttatataaatagtaccgtttgattattaatgggggaactataaggcaatctaacatatctaatatgactgctgcccaagaactgaattaaagtctgctagggaggtgtataagagttttgtacctgcctaagaatagctgtcacttcattccccaccctcaatacctacatgtacacatattcacatatgcatgcacatactcctactccttctgccccagatgaaggggaggggaagggagcccatcttaagaaaaagcttgaaagggaacaaaagcagcagtactgagtcaataaagcctaaagcagtaagtacctggatgcctcacatagaatggttttggtgtgtggcagagtcatttgtagtcagctgcactgttcctgaaggagc

SEQ ID NO: 3564 - DNA, 1032 bp, Homo sapiens
gctgaacagagtaaacaagtgtttcccagaaccaagagtcctggtgtcacctggcctatagagagtgcacatacagtcttttcattatagtgtcttctgcctggcactcagttgggaaacctgagtggctcctgaagacaggcccgacatatcacactgtcatcatgctaaagaagtgaaccactgcctaccttttgactttcagagctaaagaaatctgcctgcatgattagatgtcagcttcactgcccacttataaccctgaagttcacaagctcagtttcttttcagcaaatgggcacctcaaatgtgaatcttgggcagattcaactagaatgaagagagcaaggcgctgtgcttatgccgtcattatgccttattttaagattttcaaagatggattatcaagcaggatgaagcagatcaacaagtttcccttttgagaagttggaagatttatttttagtcattctttctgtcttgccaaaactggtccgacgcttccaaggatctgaagtgctgcatggtgctgcccccaactggttctttttggtgcttatattattaccacatcagaaaatatatgacatttaaatttttttcgaagcgctttcacatattttattttattattatttttttgagacagagtctcaccctgttgcccaggctggagtgcagtgatatgatctctgcccaccgcaacctctgcctccaaggttcaagtgattctcgtgcctcagcctcccaagtagctgggatcacagtcgtctgccaccatgccctgcttatttttgtatctttagtagagatggggtttcaccatgttggccagactggtctcgaactcctagcctcaggggatccacctgccttggcctcccaaagtgctaggaatacaggtgtgagccatctcgcctggccaacttttacatatttttttttcaagacagggtctcactctgttgcctaggctggagtgcagtggctcaatctcacttcactgcagcctccgcctcccgggttcaagtg

SEQ ID NO: 3565 - DNA, 1037 bp, Homo sapiens
gcctgaccaacatggagaaaccccatctctactaaaaatacaaaattagcttggtgtggtgctgcatgcctgtaatcccagctacttgggaggctgaggcaggagaatcgcttgaacccaggaagcagaggttgtggtcagccaagatcgcaccattgcactccagcctgggcaacaagagctaaactcagtctcaaaaaaaaaaaaagaaaaaatagtacaccaatttatttaggtttcatcaatctttgcatgcatctgtttctttttcttttttctttttcttttttttttttttttaaagacaagatcttgctgttttgcccaggcagagaagtgcagtggtatggtcatagctcactatagccttgaccttctgacctcaagtgatcctcctggctgtcttctgagtagctgggactacaagcacacaccaccatgcctggctaatttaatttttttatttttttagagacagggtctcactatgttgcccagactggtcctgaactcctggcctcaagtggtcctcccaccttgatctcccaaagtgctgggattacaggtgtgagtcactgtgcctggcctcttttcttttcttttctttttttttaatggttattagcagggtttcagtgttttagatgtaggccttttagaaaacataagtatcaaaattatgtccacgttttaacattgtattataggtttatttaggcctcttaattgttgttaccataacctttagaatcacatttttctggaaagaccagtatgggtcagaagaacccctatgatatgtatgctgcttactgctcaacgttggcagcagaaaagcttgtaaagcaaaccaggtagattttcattggttcgtagaagggcagttcttttttatgaatcaaaaaccaaaagtggttttattgaaccactggcctttttttctttctttctcattatcacaaggcaaaacacagactttggagccaaacatccagattccagtaccctctttaacctttgtcaagtcatttaaatac

SEQ ID NO: 3566 - DNA, 1074 bp, Homo sapiens
attcttgggggcttggctcaagacttttatagaaccacacatgaaatgtcgccaaagaggaagcaaaaagatgcaacccttgccagtgacttgtcagccaccacaaacccaaaagtcatgtgccatgctacagtacaaactaaccctagctgtctcatcatcaagtgctctctcacaacacaaactaacccttggtatcccaaaaggcaaagagatcagagagatcaaaggcaaaagagcagagctcagacctgagagaggtttactcacgactctattttttctgtttgtttgtttgttttagatagggtctcactgtgttgcccaggctggagtgcaatgtcttgatcatggctcactgtagccttgatctcctgggctcaagcgatcctcccacctcagcctcctgagtagctgggaccacaggtgcacaccaccacaaccagctaatttttgtatttttttttgtagagatgtgttttaccatgttgcccaggctatctcgaactcctgggctcaagcagcctacctgcctcagccttccgaagtgttgggattacagctgtgagccaccatacccatcttcacaactctttaggctccatgagaagacagattctcatccaaaaaggggttagcagagcttagggtctcagggtcttcagcagtctccttcaggtccctttgtggtagccacatctgttaaaggacaaaattagaataaatatagtttaaagacttcaatagtctttattgctattctagagtccagcaactcttcatttcctaaaatagaataagtgtaccaatgagctgagtggaagaatttggctttatagtcagagaagggcttaaaaaagcagaagcaaagacctgagagtgtattattagccctttcaaagttcttataatgcaaaggcagggatatcaaacaacagaaaagtaactgatttgttagtatcaactaacttcaggctacttcttttgtgtaagagttaaagcggagggactttagttatgccaattgaagattgaagctggtcagtttgggtgattggctgttatctctctttc

SEQ ID NO: 3567 - DNA, 1025 bp, Homo sapiens
aataatggcatctattttataggactgttatggatattaaatgtaaagcacttggaaaagcatctggattatagtaaatgctcagtaaatactatagcacctgtcctaaagccttgcacctagtggctacccaattaacatttgagtcagctaatagaggggattcctgaattggtctaaagattaaactagttcatctctaactgcctttataactttcaccctaagtttctgttttatgtcatggcttagggcctggtggattgaagttacacagcaaatatgatgcttatttagaagagctaatacacttttaagaactggcttttgatctgtctggtactaatatatgccattgtgtatattcgtggttaattagataagggatgccagtttttatgctagattgcctttggtttgaatggaaactgcaactcattatttcacagcaggaaggtaagctcagcagtattgcttttatttttaattagatagtcatcctgaaacgtgtctgtattagctgtgttggtccatagaaagaataacagctgagcagacttgtcatgtagatttgccatgtgtttggtattgatacacagctaatgtacttgtcagtattcccattctagaaaataagtggccagttttcggggctacatattactcataatgaatccttaatttattctggattaggtggggactttttatgattatagaaagaaaacaatgtgatgaggatattggtatattatgtttgcagtctttttctactctttatatctagggtgtgaaagtccactgaattctcagaaatcttttttgatgactttgtgggataatattaccaactttgtgcacatatgattccatatttggatggacattgacaatttttgattgctggctgacactgccaaatccagctacctgttggtagatagctttctagtgcattgcaggattaaatttgtgtctggactattgtgaagttgtatctactttgttttgctgaaatgaagggg

SEQ ID NO: 3568 - DNA, 1051 bp, Homo sapiens
aggctgaggaatgtgggacctggtagggagaggcctttaccagtctatctcagcctctatttacattttccctctcacctggttcccccatgggtcagcctccacatcttgtcgttggtagtagtaagcagccccagctacatgggctgctgtctgggccaggatcttggggcgtcggttggggtgcacctcgtagtcagcaatgatttctatctgcagctctgggaggctctggaacagtggacaaaatagagggtactgtcagcatgaggggagttatgaccttgtccgagggagccctagtttgttttgtgtgtgtgaacatggtcctgtcctcagaagggaaaacatgaccttaacttgggaggctccagtgtggacatagttatagttatttccagaagggcacatgtttgaagggaaatacataacacctggtgtgaaggaaggcatggtcagctttggggagatccagtgggtatgtacatagttatgtgtatatgtgagtgtgtgttgggagaatattgttctgtcctcaaaaggacagcataaagcttgcaggtctaggacaaagcaatgcctggggaatgttggactcattcctattccacttggaggccaaggaaaacctggtctgaggttcatatagttgcccatcagtgtagggtgagtgagactatttcacactgggggactgctagatgagggtggtggaacctgggtgtgtgagaaggcagaatgaggaaagatcacagaatgtcaagcctggctttagggtatcatttcacctttgaagtggctcctagccctaggtctagatcctgcattgagtgtggaggaactggaggcagctgtaggtttgggagctgggggaaaactgagccttcctcacctctctaacacggcccagatggtaggccacacactggtccactgggtcagtcagcattcggaggtggcagctctgcaagaagggcttgagggcccggtcaaacatggcaggcgtgctgagtaccaggaaggccagggtaggtcctggcagcggtaggtg

SEQ ID NO: 3569 - DNA, 1654 bp, Homo sapiens
aactttgcctttttttgtggaaaatttaaatttcaagtgctacatgaataaattaggcatgatagtatcttaaggctgtggtgatgattatatgtttgtaaaatggttagctcatactaaaagggtgaatgatctaagactgattgcaggggtaggtttcctggtatctgagtgttcaggtgcagaactggttttgtccataggagaatggtggtgcataccattgagaaggttattaattagtggtgcctttctcttgcagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggagagaccagcctttcttcctttggtaggaatggcctgagttggcgttgtgggcaggctactggtttgtatgatgtattagtagagcaacccattaatcttttgtagtttgtattaaacttgaactgagaccttgatgagtctttattttaggaagcatattattagcttttgattttaagaggaatttactccttgctttccctgttttggggaaaatgaggagagctgcctccaaatcagggaattatattgacacaggtagatatagggaatggaactgaatgaacccaaggtgttacattttgtttcactacacatgagggagaagaataagccctgctatagtgttggccagagcactgcgactgacgccacaggctgggttaccagttaaagtctcagtgtgactacttggacacctatttttgtttagacacactattcaaagggctgcatgggaaccagaagcttggcctcttctgataaatgcctggtacctgctatgtaaaagagctggaggtttctgttctttttgaactgacagaggaaagaggaagacaaggctggtggccttgggtagggctttcgtagttgcacagtactgggcaattcttagccttcccttggttctagccttgattagagatagtcttttttagtgtcattatgttgcccagagtggttctgaattccttgcctcaggcggtcctccgcctcagcctcccaaaatggtgggattacaggtgagcgccacagtgcctggccaaagctcgttttgatcctcattcatatgtcattgtcctcagagaggctgtcagctgggaaaagttattctcctgggcccttgaggccaaggtagattcagaactgaggatacttctgtgtatcatgtgataccattccagccacttgtcttcctcagctactcccacctgcccacccctctagaaccgactacacccatgagcagcagtacagaattcccagggcctttggtaatggccaacatactgcttactatatatgccaggtatttttccaaagtgccttacacgtgtttattcagtccctacctgaggtaggtacttttttttttttttttgagacagagtctcacactgtcacccaggctagagtgcagccatgcaatctcggc

SEQ ID NO: 3570 - DNA, 1023 bp, Homo sapiens
ttgtgtttctagtagagacggggtttcaccatgttggccagactggtctcgaactcctgacccggtgatccgcccgcctgagcctctcaaagtgctgggattacaggtgtgagacactgcgcccagtggtcttgcctcttaaaagttggactgactggaagggcgcggtggctcacgcctgtaatcccagcattttgggagactgagttgggcaatcatctgaggtgaggagtttgagactagcctgaccaacatggagaaatcccgtctctaatagaagtacaaaaaaattagccgggtgtggtggcctgcgcctgtaatcccagctactatggaggctgaggcaggagaatcccttgaacctgagaggtggaggttgcagtgagccgagataatgccattgcattccagcctgggccccaagagcgaaactccgtcaaaaaaacaaaacaaaacaaaaacaaataaaacaagttgaattagttataggttgtgtgctgtcttggacaaagctacctggagaaaagtcaaatatgcttctgatgttatgaaggcaggtggaggcacagtgatgggaaaggtcaacgtgacttttggggagccaaacaaaagtgtttgtggcattgtgcatttggattctggtttgagagtcttcatctgcctctctctctgcttctgtataatgaataagatgccactgcactaattatggttcagaaagaatgagaggttatctcagtatataaagaaattgccttgctgtttttaaatgaaaacaaaggctgagattcagagacttgtttcgttccaaaagttggaaagctcagactgtgacccttgactgctggctggagcttcttactaaaacaacatttaatgtattcagggacactggacaatgccttgattgtttacagctaagtctctttaagtaggtgaaggctgctggttatgtagaaaattaaggcttgtttctaattcatttctgttatttctagctgataggaagatgtcttcaggaaa

SEQ ID NO: 3571 - DNA, 1130 bp, Homo sapiens
cctgtatccagactcgtggctgtagaagacagcctctatgtatttggctgttccgggtcctgagccttgactagctgcggagcttcgggtaccctttccccgtctttattttcctgtacgtggaatggagttagcgatgagcccaaatgtccccgctgaagcactctctctgctggtgctttctccagtgctggggagggacagggggcacctgaagtggggtttagggatgtggccctctacgctgggcagatcccctgaaggggcccggtggcggcctgaatcccagcagcctttaccccgaattggttgggttttgtacttgggggccacttgggaaagaaggattggacgagaaggccatttgggggcaccaagttgcagcatgccttagtttttggtttttgttttttgtcgttaaaggtgttaaggactttttaaaaaacagttaaaagtttgctaagatccatgcttacaaaatttcttttgcttgtggtattgtgaactaagaactttgggacttggaaaagctttcagaccgcggcttagtgggttaaatctctgttttttgagctagagtctcgctctgtcggccaggctggagtgcagtggcgcggtctcggcttactgcaacccctgtctcccgaattcaagcaattcttctgcctcagccttaggagtagctgggattacaggcttgtgccaccaagccccggctaatttttgtattttttttttttttttttttttgagacggagtctcgctctgtcgcccaggctggagtgcagtggctggatctcggctcactgcagcctccgcctcccgggttcacgccattctcctgcctcagcctcccgagtagctgggactgcaggcgcgtgccaccacccccggctaattttttgtatttttgttagagacggggtttcactatgatggccaggctggtctcgaacttctgacctcaggtgatctgcctgcctcggcctcccaaagtgctgggattacaggcttgagccacagcgcttggccaagatctcaatactaatcttggtgttgatctgggtgaatccagtgcaaccttccttttcagcagtaaattgattcttatacttgttttcgccctggg

SEQ ID NO: 3572 - DNA, 1036 bp, Homo sapiens
ctccgcctcccgggttcccaccattctcctgcctcagcctcctgagtagctgggactacaggcgcctgccaccacgcctggctcattttttgtatttttagtagagatggggtttcaccgtgtttgccaggatggtctcgatctcctgatcttgtgatccacccacctcggcctcccaaagttctgggattacaggcgtgagccaccgcacccggcccattcaacaaatactttctaagcccgtgttgtatgtcccaggcattatgcaaggctctgaggatgcaaggagtgcccagcccagtaggggagagaatagacagtgatgtaagaaaaggacaggggttcaagaccagcctgggcaacacagtgacctgtctctataaaaaacaaaaacattaaaatggtcaggtccagccaggcgtggctcacgcctgtaatcccagcactttgggaggctgaagcgggtgaatcacctgaggtcaggagttcgagaccagcctggctaacatggtgaaaccccatctccactgaaaatacaaaaaattagccaggcatggtggcgggcgcctgtagtcccagctactcgggaggctgaggcaggagattggcgtgaacccaggaggcagagcttgcagtgagctgagatagcgccactgcactccagcctgggagaaagagtgagactctgtctcaaaaaaaaaaaaaaaaaaaaacaaccaggcatggcagcaagcacctgtaatcctaactatttaggaggctgaggcaggagaattgcttgagcccaggaggcagaggttgcagtgagcccatactgcaccattgcactccagcctgggcaacagagcaagactctgtctcaaaaacagaaacaaaatagacaggtccacgtggtagcacacacttgtagtcccagcttcttgggaggctaaggcaggaggattgcttgattccaaggcagttcagggctacagtgagccatgatggcaccactacaatccagcctggatgacagtcctgctcccgcctcttcggc

SEQ ID NO: 3573 - DNA, 1035 bp, Homo sapiens
tgaacatcctacctgttgctctcaagagtatcaccaatgccgaaaagagagggaaacgccggttcttactaggccatgctccaaagtcattgtccaacttctagctgtgatgatgaagcatcgttacattggcaaatttgaaatcattgatgataacagagctgggaaaattgtgaacctcacaggcaggctaaacaagtgtagagccccagctttgatttgcaactcaaagatctagaaaaacggcagaacaatctgcttctatcccaaccatttgacttcgtcatattgacagccttagctggtatcatggaccatgaagaagcaagacgaaaacacacaggagggaaaatccttggattttgtttctagggatgcaatacatatttacaaataaaatgcctcaaaaaaaaaaaaaacaaaaaacttcggaatatcgttcccaagacttttcctgagaactactgaagaacaagcttctgacaaactaaccagaaagattacaaaaggaatggtggtaaatactaaatgtatggttaattgtagagctaagaagaaatgagggttaaaagagagttagcatgtgatagttatatgatctcacaatctggacatagtataacttttttaaagtgggaagatggggagaacatgtccaaaaaaaacaaaacattttggtcactggtgaaatactgacattgctattctgaaacttgtgcataatatggaataaagcaattaaatatgatattctatactttgtatgcttgagaatcaggattcttgtaggaggaaataaaaacgtaaaatagatgttccgtaaaatccacaagggtactcagtttgaattgggaatatcagtaataagttatgaggtgttttagctttggagtgaaaaatacatacttctaggcggttctgtccactgaaaagacataaaaacagtgaacaaccccatagcaatgagtggctctactgcctggattgtgatcttgaaatagtttatccagacagcatacttaaaagaagagcttg

SEQ ID NO: 3574 - DNA, 1043 bp, Homo sapiens
aagattatcattttaacaaatcagtatctttaagttggccaggcatagtggctcatgcctgtaatcccagcactttcagagaccaaggcaggaggattgcttgatgccaggagtttgagaccagcctgggcagcacagcaagatccttgtctctataaaaaatttttgaaaaattagctgggcatgatggcacatgtctgcggtcccagccactagggagactgaggcaggaggattacttgagcccaggagtttgaggctgcagtgagctatgattgccccactgcattcatgccaccacgcccagctaatttttttgtttcttatacagactagctatcactatgttgcccaggccagtctcaaatgcctgacctcaagtgatcttcccacctcggcctcccaaagtgctaggattacagacagccaccacacccagcctctagctgtttttaagtagcacatcgatcagtcgcttctgttatagccatttcatcagttagtagagtcacctaaagaggagtgaaatttaggcattagctcctctaccctcaagtctaggaagtgacctggggtccttgctgtaaattatatattaatgtgaattcctattcccaggtgagtgttcttcaaaactttatcctcaggaaggtctatactgcccttacatattgaatatttgtccagaatgttctagataacaaatagtccagaaattactacaatttcaaatgtaatctttattatttatacagcaaacttgtattacaagcaaatccaagaaagaccagtgggaatgatttgaaaacaatgtatgttgctcattacacttaaggaacttgatgaaattcatatcaaactagcaatgaaagcattagcaacagagctggtggacatgggtggcgtgcacctatagccccagctacttgggaggcggaggtggaagcaagactctatctcttaaaaaaaaaaaaatgcagcaatcacagtatattcttattaaaaaacaactttcctttaatacttttattctatgattaaat

SEQ ID NO: 3575 - DNA, 1302 bp, Homo sapiens
gtttagatgacttttctcaaatccttaaaaaagatttatatccaagtcatcttgttggtataggtggtgacatacatctgtagtatctaaattggacttaagagttttgactctcaggaccttgatttcattatttaactgtgtctcattttagcagatatatgtatatatgatagtgattttgccttctgtgattttatgttttgttttttcatttacagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctggggtaaatattctccatatgtctaacttggaaagaagactc

SEQ ID NO: 3576 - DNA, 1030 bp, Homo sapiens
tccaccatagcacacagagaaatggcatagtatggtaatcagtggttggctttgtagccagaccatttgggttcgaatctcagctttgctgcttacagctttgtgactttgagtgaattatttaaatgagactgtttgcctgtttcttcatctgttaaataggaacaataatagtaccttctcctagggttgttgtaataaataatatttgtataattcttaaaataatgtctgacggtaagaacttcatgattattagagaagttgtctttaatgaacatcctttaacacaccaatccagtgaaattcagtgaaatctgcacagatgagttgcacacggaggggtgtttttctttcttaggtactacttttctgttgacctttgtaatttatttgaatcaggatctaggtcccacaaactgcaattggctgccattttaaatgccttaatttgcatatttctcctcagtttttttccttgtactttgttgaagaaaccaggtcatttgtcctgcagtttcccacattctagattttcttgattccttgtaaattggtagttggatatagaggcttagattgagatttgatttggagatagagaagactgagaagactaaatttgttaggtgattctgtgtatttggggatttttattttctggtttgttcagtggttctcatctgtatcattttcttgcaatttctctgttgggcaacatagaataactttatggtttatttactctcgtttgagatgctaagtaaagtggagtgtttggtttgctttggtgcccaattcagtattaactgttccaggtagtttctttcctgccttttttttttcctacttgtatatttattctgttataaaattgagccaagtatcatgggttttcagtgttcttgtttcctggttttggttactaatgaatagttgtctcagcatattcaatctgaaaatttctcaaaactgaatttttttccctattttctaccctccaactattaggcattttattatttgcact

SEQ ID NO: 3577 - DNA, 1050 bp, Homo sapiens
ttacattgtcgattgttaggtgctagatatttttatattcctataaatattcttgagctttgttccaggaaacagtttgatcctctaagccttgcttttaagctctgttcaatggaatcagtgcagcagttagtctatggctaattttgctacactactaaagtactactgaagagtactgagcatagtactctacctgatgacctactctgcctcttgggaacgttaactatttctggcctatatgaagataggatttttcccatctgctttcccaagatctggatagttttttcacacccttgtactgatcggtatccaacagaacacaggaggggaaccttctgcagatctcacagtgctccctctgtccagctctctcttctgtgtgctgctctctcctctctggtactttgccctaaaaatttgatccaccttggccttctcaaattctcagctctctctcctcaactcagggagaatgctgaactctgtttttcttgctccttgaactgtggccaggaaattctctccatgcagtaagctggggcaactctagggctcacctcattggtttcccttatgtcagggatcaccctcttgtgctctctgtttcccagcatttgaaaaatgtttcctcaaatattttgtccagttttttagacgttttatgtaagagtaccggtaaattgtggttggaagtgaaggtctgtgggggaatacttcaagattttgtaaatatctgttctccaatatatttttatttttatttatttatttatttatttatttatttatttatttattttttgagacagagtctgtctctattgcccaggctggagtgcagtggtgcaatcttggctcacagcaacctcccctaggttcaaaagattctcctgcctaagcctcctgagtatctgggattaacaggcgcgtgccactacgcctggctaatttttgtatttttagcagagacggggtttcaccatgttggccagactggtctcgaacccctgacctcaggtgatctgcccgcctcagcctctc

SEQ ID NO: 3578 - DNA, 1105 bp, Homo sapiens
gtctcaactagttgggaagctgaggtggaatgatcccttaagcccaggatttcaagtccagcttaggcaacagttttaaaaaaaccaatccacccacccacccaccaaccaaaactgaaaccgaaaccgaaaccaaagccaaaaccaaaaccaaacaccccagcctagtaagtgctagataatgtaggaattatcccataaacatcaaaacttctagaattgtaaacattcaggacagcagtttttctagacccttatgcatatttattgcctttctaaaaagcaaactgaacaaaatttaacctgaagatttttggggaattgtgattcagatgcctttttgtttttttgagacaaagtcttgccctgtcgcccaggctggagtgcagtggcacaatttcagctcactgcaacctctgccttccgggttcaagcaattctcctgcctcggcctcctgagtagctgggattacaggcgcccgccaccacgcctggctaatttttgtatttttagtagagacggggttttgccatgttggccaggctgtcttgaactcctgacctcaagtgatctgcctgcctcggcctcccaaagtgctgagatcacaggtgtaagccaccacgcctggcctattttatagtttaaatgatgtattttacatacaagtaatagagtaggggttgaataaaagctcttgttttagtcctcctaaacaaggagaagacttttgaaagactaggtgttatatgggattacattaataactggaattacaaaatttgtttaagaccaaggttagaagaaaataataaagataatgaagcctgtgttttttctttttctctcctgtaggaaatacagatgaagaggactgcaatagaagcttttaatgaaacaattaaaatatttgaagagcagtgtcacacacaagaacaacatagcaaagaatatattgagcgatttcgcagagaggggaatgaaaaggagattgaacggtaagtctacttagtacctccaagggcatcagtgagacaggatttcttttcttccccaataatttctgtcttgttttcttttaccccctcaaactgcacagccctacta

SEQ ID NO: 3579 - DNA, 1027 bp, Homo sapiens
gtttatcattcccttcatatagagatggcttctgctccccccacagagacatacaaccacatatctttaggtccttaagagattttttctgttcttcctgataaaaatattgatagaatttaaatttgaaaattcattcagaatataaacaaaaatagaatttacttctgttttatttttcttaagtgattttttttgctacatttgttcatactgaatgctgtgtagatatgttgacctttaataaccaaagtattttatggacaaaacaatgcaaaatgaattatatatatatatatatatatatatgttcacacacagaataacatgccttttcactccttccagcctcattaacatagtaaaacttgtttatcatgtgacaccaagctttcacgtctccatatgaaagcagtagttcagttgaatttgggggaaaaaaatccacagttgttgtcttgttgttcacaggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggtatgattatggaaatccttgctagctattgagcaagtgattatttaacagccttatttgattttatttaccaggcttatcagttttaaaaaactagccattttgttatttatttatttactttgagacagggtctctgttgcccaggctggattgcagtggcatgaatatggctcactgcagtcttgaccttctgggctcaagtggtcctcctgcctcagcctccccggtagctgggatcacaggtgcatgccacaacttcagggtcttgccatgttgcccaggctagtcttgaactcctgggctcaagcagtcatctcactttgaccacccaaagtgttgggattataggcatgagtcattgcgcctagtgca

SEQ ID NO: 3580 - DNA, 1052 bp, Homo sapiens
attttggggttcccggaattggctctcttaatttgatgagacttaaaaatgctaaggaccctacttctaatagtacagagagcactgacagtccatgctgtgaactgtttatatagcgatatgctaaatatctgcatttgatacttctaatttaccacctataagaggcaaggaacttggcaaccctgtatttgatactgtcaaacgtttgtagaaaaccaaggttttctaatattgctggacgaagtgatgaaagaaaagggtgagctcagggttttgatttcctggccccagctctgccataaatagcccaagagcttctaaatatgccctaagtcagaatcttctcttctgttgccaaaggtctgaaattgcacaaaatcaaacacatactctcatcatgtgattagctgaattacaatcaaaggtgaaatatcagccttgtaaggtatctgctgttaaaatgagggcattggttgggaaagatggaattctatacgtttggatggggatgtgtgggaagaccctgatgaggctggggacgttgagctcctaaattctgatgagtcttgtttgccagcagaaatggcctcccacccccagtaacagcatcccccctacactggcctttccacctttgtctgaggggattgactctgcattgcctgaggaaaccataatggccttcctctaggcagctgctaagccagaggatgctgagtcttctcaggacccacccccaccacacctctttgcttctagacctatagctagacttgagtcccagcagcccctaaagatgaggtacaaagttttactcatgaggagatgtgctacatggtaaaaaagctacttgaggtttctaatttatacaaggagaaatctggaaaatatgtatgggaatagatatttagggtgtatttagggtgtgagataatggtggaaggaacataaagttgagtcaggctgaatttattggtttttttttttttttttttttttttttttttgacggagtctagctctgtcgcccaggctggagtgcagtggct

SEQ ID NO: 3581 - DNA, 1035 bp, Homo sapiens
agatgtattttctttttaaagccctatccatttctgtcaaatcagtttccaggttgatgctgtattcctcagaacacttacctatccctttctcttctctgttctcttcctctaccaaaatggtatttatttaatttttttttacccttacgatttcaactattttaagagtacatttgcattgttgtgcagctatcatcaccatccatctccagaactttttcattttccctaacagaaattctgtacccattaaacaataaccccccattctcccctccctcagctcatggcaaccaccattctgctttctgtcttatgaattcaattgtaggtactttgcataagtgtaatcatataataattgtacttttgtgactggcttatttcactttcttcatacgtcttcaaggttcattcatgttgtagcatgtgtcagaatttcattccttcttaaggctaatatatgtatatgttatatatttttttaatccattcatctggacatttagattgtttctaatttatggctgttgtaaataatgctgcaattaatattggtgcacacatatctgagtccctgctttcagttattttgggtatatacccagtagtggaatggaattgccaggtcatatggtaggtaattctgtgtttaactttttgaagaggacttaatatgttttattaaaaaaattttttttttgagatagagtctcgttcagtcccccaggctggcgtgcagtggtgcagtctcagcccactgcaacctccgcctcccaggttcaagtgattcccctgtctcagcctcccaagtagctgggattacaggcgcttgccctgccaccacgtccggctaattttgtatttttagtagagacagggtttcatcatgttggccaggttggtctcgaacccgtgacctcaagtgacctctctgcttcagcctcctaaagtgctgggattataggcgtgagccactgcacccagccattttattttaaaattggttagaatatttctattttaatattg

SEQ ID NO: 3582 - DNA, 1033 bp, Homo sapiens
tctgtcacccaggctggagtgcagtggcgtgatcttggcttaccgtaacctccgcttcctgggttcagttcgagcgattctcctgcctcagcctcccaagtagctaggattacaggtgcaagtcgccatgtcagctaatttttgtatttttagtagagacggggtttcaccatgttggccaggttggtctcgaacttgacctcgtgatctgccctcctcggcctcccaaagttctgggattacaggtgtgagccaccgtgcccagctgatgagctgttttttaaacaattcagtattacaccagctgggatgattactgatctctccattccttcggagtgactctcccatcaggggacaggttccattctattccaatttgagttgctacataagtccatacagcaatagagaaagtggctccactagctaatacagcattactgtatttgtcatgaaaatcaggtgtatgtttctggtggctctgccttgcgattgtttgcagaatgctttgaacttggagatgacttagtgtgtgtttttttttttttttttttttttttgatggagtcttactctgtcacccaggctggagtgcagtggcgcaatcttggctcactgcaacctccacatcccgggttcaagttccctgccttagcttcctgagtagctgggattacaggcgcttgccaccatgcccagctaatttttttgtaatttttagtagagacagggtttctccatgttggtcaggctggtctcgaactcctgacctcaaatgatccacctgcctcagccttccaaagtgctgggattacaggtgtgcgccactgtgcctggccattagtgcattttcaaccaagggaaacattgtgaaggtgaagatagaactgtggtaatgcaactgctgctttggtgcaaattcttatgattgtaatctgtctcgtttgtagatgtttcatttaatggattatggcttcaaatgggtatttgatactttctgataggatttacatggtaactacacagaatt

SEQ ID NO: 3583 - DNA, 1117 bp, Homo sapiens
cattttgtgacttaagctttaaaatgttaatattatttattatcagcatgtgacctctaaacttatgaagataattggctgggcacttattgtaacaaagggaataatgaaaaaaaatgcaatacttaatgttattagcaagatttatatagctctgagtaaaattgtgtttgaaactttgaacaattagaaatgaataggccgggcgcggtggctcacacctgtaatcccagcactttgaggtgccgaggtgggtggatcacttgaggtcaggagttcgagaccagcctggccaacatggtgaaaccctatctctactaaaaataaaaaaattagccaggcgtggtggcgcgcctgtagtcccagctagtcaggaggctgaggcaggagaatcgcttgatccctggaggcagaggttgcagcaagctgagatcgcgccactgcactccagcctgggtgacagagcgagactctgtctcaaaaaagaaatgagtagtaagtttttcacagtgtattaggttagttttaaataacacagggccaaacggagagttttaagttatccagtgtgttattataccacttaattttactgtgtgtaagacttgacttttaacaagtaaagtgagccatcaagccttattaaagatcaatttccacattgcttgcccatatatgttgtatgtattgttccttgtgcatatttgtaaattcacataaagtaaaagggttatcttattgttttctttttcttttatttatttattttattttattttattttatttttgagatggagtctcgctctgttgcccaggctggagtgcattggcatgatcacaagttactgtagccttcccacctcagcctcccaagtatctggggctacaggcatgcaccaccacacctggctaatttttaaagttcattattttaataaaagaggcagtaggctacgtccagcctgccaaatcataccattttgcatgtcgcatatcagtatgaaaactgccctatgagttggtattgatgagccaacacaaagccaaagtcaataccatctacccttatccatacttggacttcctgtttcatgttctgtttgtgggccagattg

SEQ ID NO: 3584 - DNA, 1088 bp, Homo sapiens
tgatttaacttaatttatgggatagggtttaatgtaacttcaattcctagaataaagaaaaagcaaaaacaaaaacgagggaacctttctgtttcctgtgaacgtgtgatatatacatatgtgttcctatacacgtaatgtaaagtatacatatatagcactatatttttattttaaagctctgtctgacgctattacagacattttgtgtatctggtaggaaaggaaaaggaaagcaaaatggaaaagttggcttttttttcctttaaagtctaccccattttatgattattagctgtcagattttctcaaaccctgtttgcagttacagatggtgttttatgtaatgattctgaataagtagagagcctttgtgactccttgtttctgtcgaggatgaattctttatgtattttaaaacgtgttatggctaagtctacagaataaaatgtgtgtcattggggaacctcgtttattataagactgtatttttggaaacgtttgaaaggatttgagccatgcaagtgtgaagaagtgtaactgtcttatagaaggtatgtagaaattgtttcctgtgtccttgcaaacggtgaattatcctgttttttttttcaattagtcagtgttaaatggtgctgtactaaaaactagtattgaataaacctttttcactcttgatgatcacttagaatttttttcttttcctttatttcagagctttatttgcttttataattgtgactgcaatccagatgcagcttttcagtgttttgtaaagtttgtaagatttgccacccatctattgtgtctttccccctttgtttccccctaacggtaaagcatgttagatacatttgtcatacatatgaatagaaatttagtacatcactggtacttttattgtaaaaagtaaggttaataattctagattcctgttataagaattatatattcaaactgccttagaattatactgcattatatagtaccttgccttgcagacatacaaagggaatttgttgggtgggaggtgagtagggaggaggggagaaaatgaagaatgcacttatggttgaaatatattagcc

SEQ ID NO: 3585 - DNA, 1028 bp, Homo sapiens
ggctggagtccgggcagagcttgagggcagttggtgcggtcgggttggttcttacaccccggcgggagcgcccagacaagccgagctgactggacttctccggccggccccattcccgaggctgcggcagcttcggttccgagaccgaccggagaggagcccgagtcccggcctctgggggattcgctctctgcagaccagtgggaccccgaaacttgaacgcaatctccagcccccttttttgccttcctttgtcacttgcccgggtttctcccaacgtgttcttttttttcctcttcattctccctccttcgaaggacacaaaagtggcttccgcggaaagatttggaggcggtgggagcttttctccccggagagcgactgtgtagaaaggatttttgggaagccgctttttaacacctctgctctccgtcccccaagcctctgtgtaatcctctgaggagaaaagcccatagcttgaaagttcgggggcattttgttgtgttctgtaggagagagggggaggaccctgttcgggtagtttggccggactggtactggccgttggaaaacccgaagtacatttccgtgtggaacttttgcagatatatatttttagatttttaaataccagataaaaaatatatgccttctatatatctcctggcgacctgcccctgacagcgcgatgtacaatacggtgtggagtatggaccgcgatgacgcagactggagggaggtgatgatgccctattcgacagaactgatattttatattgaaatggatcctccaggtacttgggagaaaaaaaaaaagaatctcgtgatgggtctgatttgtatttaccaagagcttgctgatgttttcagggcagaagtattcctgggtgcgctaggttcgggatgaggagatttgcagttacagctgcggtaaaactgcttctggtttacacgtttaaagtttgcagttaggaccctgatcctattgtcctgcgaaggtgggggtgggggctggaagtgggggtggg

SEQ ID NO: 3586 - DNA, 1049 bp, Homo sapiens
ccaggctggctggtctcgaactcctggcctcaagtgatccaccaccttggcctcccaaagtgctgggattacaggtgtgagccaccgtgcctggcctgacatttctttattgatctaacatgctccactctgctgctcctgcctaagatctggttatatgacactgaatgtggtgagtgggaatttaagcagtattcgcagtttgtgtgtgtgtgttttcttccttccagaagaatttttataggttgggcctgtccctaagctctttaaatagggtggacatcccactattctctgagccgtgtctattttgttgcacctttgagtctatgtattgagagagacagatagtatttttttaaactggggaagctgctatcctttcactatttctctaaaggttgagctgttaactaatgtaaattctggacctgcttctggtcctggcagtttatcttttgagaaacttgagtcttatctgccctgccattttcattaaatgccttctgaccttctgaatgttttgggtcccaagaatttttgacatcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatggataaatgtgtggggcatgactaaagtaccacgtagctgttctttatatttatttacctagaaagatctggcaaagaactcaaagaaaattgtaccatttaatcagtaaatttgtcccctggtgctagcatggtgttatagaaagtggacaggctttagagttaagtgaatctgggttcatatgttagtgttgctattcattagctctatactgttgaacaaattgcttaaactatctaattttggggttttttttccatctaaaatagggataataatatctacctcataggatta

SEQ ID NO: 3587 - DNA, 1048 bp, Homo sapiens
gtgaacatgtacattaatttattcagtaaacattcaccagatgtcactctgcagagatataaaacaaaccacggtctatgtctttgaggaatttgtactagggaaaatagacaaaaaaagaaaaggaaaaatacaatacagtgtgataaatactatgacagtggtaagcacaggatgatttggtacacagagaaggggcacctaaccaagactagggacttcaagaagttaaggaaactttctggaagtggtgactcctgggcgagggcccccacccaccacacaattcagacaagagctttgtggccctgtgcaagaaaggacctcattattctttttaccttacagaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccaggcaccagtcagctgaacaaaagcataagccaaacatcctgtttaaactgtagaataaccagatattcccatc

SEQ ID NO: 3588 - DNA, 1284 bp, Homo sapiens
atttatacaacattcatcatttatagtgtttttctttcctccttttcccactcctagatgagaatcactgagatagagcattgaccatatgctcatagttaatgatgcccactgtgttctctctgcacatccaggtgccaggagcagtgttgtgattactgtacactgtctgtctagtccttgctcatttcagtcacatatccttttatctggcagaggttaagttcagaatgtccccaaacagtggacacttccccctaacagtcttcattacagcacccacttattttttctctttctcttaccagctgcatagggagaaagaagtgatatcactcagctgatatctcacagtagcagtaacccacaaacctaggacacagtgaggattctacttccctattcttgaagctattcagtaccatctctcccattcttccttccacattaacccttccattcatcacattcaactgaaagccaaaattctatccaagaatatggaattgccattaactgagataggcaagattgcaggaggaataggcctaacaggaaaatcaggagctcacttttcgatgtattaaatctgagatgcctattagatatccaagtagtaggcaattagatatatgagcctggacttcatgggagaagtccaggctggagatataaatatgggagttgtcagcatacagattgtacttaaaaccataggactgaatgaagtcaccaaggaagtaagtaaaaatagagaagagacgagatctaagaactgagcgaggggtctccatccctggagagatgaagaagcatcagcaaagattaagaaggaatggccatgaggtaaaaggaaaattaagatggtagaatgccctggaagctaaaattgaatgtttcaaggaatagggactgctcaactcaccaaatctcccttgtttattagggcaaatgagattagaactgagaatttactgatttcacaaacatggaagtcactgggggccttataagagcagtttcataaaagtgtgattggagtagacttaagagaggatgggaagagaaactccgaagaatcagcatagaaactctttcaaggggcatttctataaagggaaggagagaatggggtattagctggaggtggagaagtgcgcccaagggtatcttttgtttcaaatatgagaaagaaaacatatttgtatgctgatgggaaaggtccagttgaggctgggacagtggctcatgcttgtaatcccagcattttgggaggacaaggtg

SEQ ID NO: 3589 - DNA, 1047 bp, Homo sapiens
ttaggtggattgataagtacatgagtatttattgccacatatgaatttcttaattttaaaaaaatgttttaggctgggagcagtggctcatgcctataatcccatcactttgggaggctgagggaggcagattgcttgagcccgggagttcaagaccagcctgggcaacatggcaaaaccccatctctaccaaaaaaaaaaaaaaagtagccaggcttagtggtgcacacctgcagttccagctacttgggaggctgagtgggaagatcacctgagcccagcagatcaagactgcggtgagctgtgatcatgcctgcactgcagcctggacaacagagcgagaacctgtctcaaaaaaataaaaaaatattttaaaaaccaaatatggaggaaatggaatgaatgttacaggtggttggatatagagcaaataatttcatttattcatctgtctccttgtatatctgtttttcacagtttctatgtgctctgccaagaagggaaggttatgagttttttgtaggacaatggacaggtactgaactccacttcactgcacttataaatattcaggtaggtggcttgtgcccttcctctagaggaaagaggactaccccttggtaggactagaaacccttgctgaggctcaaggacacagaatagctgcttactcccagcatttattattgtggcgcagatgaattgtcatactttttgtgttggactagttttctaggccctcctcaatacctagaaattggaaaagactccaaaacaccttctctgactacttctggttctcttttgtctcttccccagacctctagttgtatatactgcatgtgcctcacttaacaaacatgcctgagttatgatggctatctttttaacccaagctagaagccccttgaggaaagctccaagtcttaaatgtgttttattacctaagtcaacaccttccaacatgctaagtgaatagtttctgtttaatgttattttgtttgctttcttcctttatttctttatttccaataaaacaatattaac

SEQ ID NO: 3590 - DNA, 1033 bp, Homo sapiens
agtgttgggattataggcataagccactgcacccagccttttttttttttttttttttaatatatttttaagggatcaaaaattagtcttcctgatttagtgaaatcctaaactttaccatttggaaacaaaatttgcggagtagcttttcttttagtgttttaaattcagttgagactacttttaactaaatttagctgtatgtttagacgtatacattttttgtaattcatttttgacagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccaggg

SEQ ID NO: 3591 - DNA, 1061 bp, Homo sapiens
agacaagagtctcgctttttcacccaggctggagtgcaatggcactgtcttggctcactgcaacctctgcctcccaggttcaaggcattcttgagcctcagcctcccaagcagctgggattacaggcgtgcgccaccacgcccagctaatttttgtatttttagtagagatggggcttcccatgttggccaggctgatctggaactcctcacctgaggtgatccgcctgcctcagccttccaaagtgctgggattataggcatgagccactgtgagatggcgagatttctaaagattctccgtattgccattatatataaaagagtctatttttgagtgatagaaccttaatatttatatatgaaatgttatctgagatttgcttcaaattaattctgtgggagaatgaaatggctaggagtataaatgaaataagattggctatttggtaatttttgaaactgattgtatatggtgatttgtaaaataattctctcatgtttgaaatttttcattatgaaattttccattaaataaggatcgtaggctaggctcagtgactcttacctgtaactgggcacggtggtgcacacatgtagtcccaggtacttgggaggctgaggcaggagaattgcctgaacctgggaggtggaggttgcagtgagccgagattgcgccactgcattccagcctgggtgacagagcaagactaagtctcaaaacaaaacaaaacaaaaaacggattctaaagtaaatttttttttttttttttttttttagatactcgctctgtcgccctggctggagtacggtggcgtgatcttggctcactgcaacctcagcctcccaagtagctgggactacaggcacgggccaccacacctggctaatttttgtgtttttagtagagacagggttttgccatgttagccagggtggtcttgaactcctgacctcaggttagccacctgcctcggcctttcaaattgttgggattactggtatgagccactgcacctggcctaaagtaatttatatcctcagcaaatttggaaacaaac

SEQ ID NO: 3592 - DNA, 1027 bp, Homo sapiens
tgctttttgttgttgttgttgttgttgatgagacagagtcttgctctgtaacccaggctggagggcactggctcagctcactgcaacctctgccttccaggtgcaagtgattctcctgcctttatcacctgagtagctgggattgcagccgtgtgccaccatgcccggctaatttttgtggttttagtagagacagggttttaccatgttggctaggctggtcttgaactcctgacctcaggtgatccacctgcctcggcctcccaaagtgctgggatttcaggtgtgagccactgcacccagcaagagatgcattttttattgtataatgaaagtatcatatgtttgcatctatttctgaactatagtctgctccacatatctgcctgccccccaccactagttaccatttgatttaatcacccacagctttatatttcaatattccaactttaatggcttttttttttttaatggagaagatgcagcttgaggagaggaactttaaaaaataacactgaagtcctgccaaatgatccctaaaagttctgagaaagaggctgggtgtggtggctcacgcctgtaatcccagcactttgggaggctgaggtgggtggatcacgaggtcaagagatcgagaccatcctggctaacatagtgaaactccgtctctactaaaaaaaatacaaaaaattagcctggcgtagtcccagctactcgggaggctgaggcaggagaatggcgtggacccgggaggcggagcttgcagtgagctgagatacgccactgcactccagcctgggcgacagagcgaggctctgtctcaaagaaaaaaaagaaaagttctgagaaagaaagaatattagctgtttcaaatgttaaaatgcactatagaattctagtgattaatgttttaaaaacactgagtgatcaattttaggacctgagtgtgtgtaatgtcttttactgtacatttcctatgtgatttctctacacttcacttttctcacctataaaatgggagaaa

SEQ ID NO: 3593 - DNA, 1048 bp, Homo sapiens
caatgtcttttaattgatagatggaagttttaaggtattaaatctctttaatctcttcctcttaccagagtctttttactgagtcagtaaaaagtttctgtttcttttgtgtgtgcaagacaacgttcatttgaattatctcccctttctaaagtatgcttcagcatttagattatgtcttttaggtaaaaagtacataatttcagttattttcacatgaatgtcttctgtttagatatcttaccatggatgaaacacgcaaattgttacttttgttggaatctgatcccaaggtttattctctaccattggtgggaatgtaagtattacattatttatgaaaaccttatcagccaaatgttcaaatgtatatgataagcatgtgactcagttgtactataaatatttagatcattttataaagccacaaagataagtggttgtcaggttttcttattttactagtagaatcagctaaaataagattttacccaatcttttttttgagatggagtcttgctctgtgcccagactggagtgcagtggagagatctcggctcactgcaatctccatcccccaggttcaagtgattctcgtgcttcagcctcctaagtagctgggattacaggcgtgcatcaccatgcctggctaatttttgcttttttagtagagacggggttttaccatgttggccaggctcgtctcgaacccgtggcctcaagtgatttacccgcctcagcctcccaaagtgcttggattacaggtgtgaaccatcatgctcagccagattttgtccaatattaggaagaactctaacatataaaacagataaaagcttaattctatggccaggcgcagtggctcacgcctgtaatcccagcacttttggaggctgaggtgggcggatcacctgaggtcaggagttcgaggtcaggagttcaaggccagcctggataacatggtgaaaccccatttctactaaaaatacaaaaaattagccaggcatggtggtgcgtgcctgtaatcccagctacttggcaggctgag

SEQ ID NO: 3594 - DNA, 1075 bp, Homo sapiens
aattattcacataatcttttggtcacatggaataaacgagaactgaaatgctgtaaatcagaactcatttaattttatttgtgcaagatattatatatgtatatgtatcagtataaaataaactttggcgatatgggcacatttcaaagttttaaaataattatttaatattgatttctcaggctctacagtgccatatatgtagcaaagattccttggactgtggtaagctgctttccctaagagttcatatcacttccagggagagtttggacagtgtggaatttgacttgcattgggcagcagtaactctagcaaataactttaaatgcacacctgtgaagcccatccccattattccaacagctctggcaagaaacttgagcagtaatctgaatatttctcaagttcaagggacttataaatatgggtaagtaaaagatacattaatctaaatgttagttgcattagtatattttcagaatgtccatgtaatgtgaaagaattgtccagtcaatttatatgccagagatatggtggcttggttaataaccagggaaagtaaaaaatgaaatggtttattttcgttgaatatgaaattttctttaagttgtgccaccacctacaaaaaattggtggtagggcctggcgcagtggctcacacctgtaatcccagtactttgggaggcctaggcgggcagatcacctgaggtcaggagttgcagatcagtctggccaacatggtgaaaccccatctctactaaaaatataaaaattagctgagcgtggtggtgcatgcctgtagtcccagttactcgggaggttgaggcaggaggatcacttgaacctgggaggtggaggttgcaatgagctgagatcgcaccacagcactctagcctgggcaacagagactccgtttcaaaaaaaaaaaaaagacaaaactgagtggccataaagtataatgtctggataactcagttctttttttgagatggtgtcttgttctgtcacccagactggagtgcagtggtgggatcttggctcactgtaacctccacctccctggttcaagtga

SEQ ID NO: 3595 - DNA, 1053 bp, Homo sapiens
aatcaaaatttacttacaaaaacaggagacctacctgctgaggttcataaagttaacaaaatgcctggagaacaactatagtttcagtgtctgtttattgccattctagtttccaagtggccctccgtatcccctgcctttgaccctgggatttcctgacaatgatctttctgtacatttttaaaaatgtgtgttataatttagacagcattttatggcaggaggtttttttaagatatgaggtctaccatattcataaaagacttgttgtttttcagaaatccaaagcttgtggtgactgagaagaccatccgacttgcttatcgtcatgctaagcagaataaaaaaaattcgtcatgctttttacttggttctctgacagcagacgaaggtaatacacttttaaaaatggaccagtgctcacgcctgtaatcccagcacgttgggaggctggagtgggaggatcacttgaacctaggagtttaagaccagcttgcataacatagtaagactccatcagtacaagaaaacatttttttaaattacttgtatgactgcaatagaatttattgattcggccaactattgtatttgctttgcgctaattttctttgctgtgtaccaaggatatgaagatgagtaaaactattaattacagagttcactgtctggtcagatggatcaatatatataagcaagtaagactttagtatacgcttataagagtttagtttactgtaagagtttagtttagtatttaagagtttagtgtactattggtatgaacaaagtgctttgctataatgtagtcttgcttggttgattttatgtttttaattagtatgctgtataatagctgttatttttgttctacagatgaagaaggtgtaacattgacagtagatcgctttgatcctggtcgagaagtacctgaatgcctagaaataacccctactgcttctcttcctggggactttttgattccatgcaaagttcatactcaagaactttgttcaagagaaatgatagttcacagtgtagatgacttcagtt

SEQ ID NO: 3596 - DNA, 1088 bp, Homo sapiens
gggcttccgggggagacatcacacgttggtaggattcgtgatgccccacaagccacaaaaaccagcaagtttttattagggagtttcaaaaggggagggagtgtgcgaataggtgtgggtgacagacatcaagtacttaacagggtaatagaatatcacaaggcaagtggaggcagggcgagatcacaggaccacaggactgaggcgaaattaaaattgctaatgaggttttgggcaccactgtcattgataacatcttatcaggagacagggttttcagatcaaccggtctgactacaatttattaggtgggaatttcctcttcctaataagcctgggagcgctatgggagactggagtttatttcacctctgcaatctcgaccataagagacaggtacgccccgggggggccagttcagagacctacccctaggtgcgcattttctttctcagggacattccatgctgagaaaaagaattcagtgatatttctcccatttgcttttgaaagaagagaaatatggctctgttctgcctggctcaccggcggtcagagtttaaggttatctctcttattccctgaacaattgctgttatcctgttcttttttcaggtgcccacatttcatattgctcaaacacacatgctgtacaatttgtgtagttaacgcaattattacagggtcctgagacgatatacatccttctcggctgacaggattaagagattaaagcaaagacaggcataggaaatcacaagggtattgattggggaagtgataagtgtccatgaaatctttacaatttatgtttagagattgcagtaaagacaggcataagaaattacaaaagtattaatttggggaactaataaatgtccataaaatcttcacaatccacgtccttcagtcatggcttcggccggtccctccatttggggtccctgacttcccgcaacaagacagagtctcactctgtcactcaggctggagtgcagtggtgcggtctcagctcactgcaacctcaactgattcaagcaattctcatgcctcagcctcctgagtaactgggattacaggcgtgtgcc

SEQ ID NO: 3597 - DNA, 1051 bp, Homo sapiens
tatccatcttttcacccaaatgaataaaggaataaaacacaaatagcgcattttaagacacttctgtttaatgaagaaaaaattggcactttttatactttgtagagttacagttatccatgtgaatactgttatccatgacaaccaagtactaaggaagggttttaggatttaaagcctgcattctgtggaagctgcattaaaccttttaagtccagatatttctaagaaggactgtttagtcacctttttttttttttgagacggagtctcgctctgttgcccaggctggagggcagtgacgaaatctccactcgctgcaagctccgcctcccgggttcactacaggtgcccgccaccacaccccactaattttttgtatttttagtagagacggggtttcatcgtgttagccaggatggtctcgatctcctgacctcgtgatccacccacctcggcctcccaaagtgctgggattacaggcgtgagctaccgtgtccggcctagtcaattttattagaagcacgtttttctctgtcttgaacaaggtataagagcattttcaataggattttcagcctctgactttatctaaaaagtctcttctaaataatctctgcatctggattaataatccttttctcctttatcttgcttcacacagagtgagacagaggctcattctcttgcccaggctggagtgcagtgggatgatatcagctcactgcaacctcccctcccaggttcaagtgattctcctgtcccagcctcctgactagctgggattacaggtgtgcaccaccatgcccagctaatttttgtatttttagtagagacggggtttcaccatgttgacccggctggtctcgaactcctcacctcaggtgatccacccacctcggcctcccaaagtggtgggattacaggaatgagctcccacacctggccttagacagtttctttttcctagaattgatacagaatgtgcaggacctaaggaactctaaggcttgaaagaatataggacatactgaactctaaagaaaggact

SEQ ID NO: 3598 - DNA, 1037 bp, Homo sapiens
ccccttgagaggcggcagcggggccctgggaaggttggtgggtaacattcaaagccctgtagtgggttccgccctccaggagcctggagcagatgacgagaaggggagctagtgggagaaattaagcagtccatgaaatccttgggtatcatctgagctaaggtatgtgaaagaggtttgcagtcgataacgtgccatttaaagttgtttttacggtgggaatttcttgaggactgaaaccttgaatgctcgctcttgcattcctcacaatttctggctcacactctgctacgtagtaagggatcagttaatgtttgaagttcatggactactggaagtaaagtgtaaacagcaaagtgcgagaatgctatgcgtgtgagtacagacagtatagtaccatcgccacggtgtctgggagaaggtttcacagaggaagtgacattcgagttggattgtgagggatggcgggggtttactagggcattccaagttaagggaggcatcctgtgcagatattgaaaccggggcactgcaagtagttcagtttgactggaatgtaggatgagtggatgggggggttaaggttggaataatagagtggggctggattgtgaagatcctttattctgtatgtaaagaagagccatcggctttttaaaaaaaatttatttttatgtttatttttgagacgcagtttcactctttggcccaggctggagtgaagtggagtgatctcggctcactgcaacctccgtcccccgggttcaagcgattctcctgcctcagcctccctagtagctgggattacaggcaaacgccaccacgctcggctgatttttgtatttttagtagagacggggtttcaccatgttggtcgggctggtctggaaatcctgacttcaggtgatccacccgcctcggcctcccaaaatgctgggattacaagcgtgagccaccgcccctgacatgagccattgacttttaaagcaggagaataatttgatcagatttatatggaaacactcttctagcagcat

SEQ ID NO: 3599 - DNA, 1022 bp, Homo sapiens
ggttgttgagaccaaggcgagctgcggagcctgtgggctgttgttcgtgggaagagggttgcgacctcaggagagaccgaaaacagcgccacttgaaacccgccggtcctgaagatcacagagttcccggagtggtagggaaggctccacgctcttgagagcagaggcggccaggggcagtgggggacgcttccaggtatgtgggaaggagaacttcatgtctaagtgcgctcttgtgggtttctcggccagctgggccgagcctctctttctctgtcctcatgtgtctgtcctctggacaacagtggctctgtatggcggattgcgaccctgagtgacgggcgcctgtcttgcatcctgtgtcctgtgtcctcccctccagacctcatgcttggtgtccacagagtggacccaggactgcctggaaggcttatcatccaggcccgcgacttccccccagagtctgaagccttgcgacctggtcggggacgacaaacctgctcggggtcaacagcgagaccctagtggggaatgaggatgggtgagggtgcgcctgggttgagggtctgtgactgtagcatggaaaaggagttcatgcagggatcgcactgagggacagccaagaatactccagcggcagcctccctcctaccaattacacgccgcctgctggcacagtggcacctcgggaacaggacgcccttccgggccctgaattggggcagcgcaggagggagggtgcagagccatagcgacctgtgtgtaccatagacatgcacatgcgctcaccttcacgtgtaacccttctgagtcccagacagggtaactggcgaggccgtaagtaccctcgtgggggcggaaatattgccgcgtccctgagtcctctgggcagatgcagagccgcgtaagcctcatagaagcaaagccaggggaacagtgggagctctggcctcgcggtgcggacgctagtaatggattcctggggaacagcgacctctggaggagcctctcatccacacaga

SEQ ID NO: 3600 - DNA, 1040 bp, Homo sapiens
tcctgacctttactcatgctgctttcactgcctgtaattctcttaccatgaatcctgtctgttgaaatcttatcctcgtaggcccaacagatgttcctgaatccatcattccctctccgggactcacatcactttatgcttttttctcctgtgaagaatttagttcattctgccttacccttggagcagagcgtctgcccatctcttgggtttgccagagagtaagcactgtaccttagcacacctgagtcccaggcactcaggccagagcctggcccaaaagatgttcattgagatcatagggattggagttggagggctaacggcatctgggcaatgagagaaacacatcacattgatgtgatcagaggacacagaaaagatgaacttctcccgcctccaagctgggctgccagccagccctggatgggccccaactcatatggacctcgtataagaaggtggcccccaagagccaccctccctccccaactctgggcaggcatggacacacacgactcttgtgggctccgggagaaaaaggcctattcaaagggtggcctataaaacctcttagcttgcactcagaggcttatatcactttttaaagtgtggtcagcacggtgttattgcactggggctgcaggggacggtgacatgatttacttgagtaattaactggttgctgcacccaaactctaagcaaacacagtgcacttggctgaaattacctgcttccgagctccagcttttccttgtggggttcaaagacattccaggagttagggctaaagtcagcttctattggggctttcttccacatgttacgggcctggggctgggtgcccatcgagagaggctccacagccctggccattccatttccaaaaagatctattctgaattggcatcttgggaggggataaactaccccatgtttggtttcctcttcttttcaggctccacaccccactcatctgccttctcctgcaagggagtcctgttgtcagcaggctttgactgagttggcaacttcttaa

SEQ ID NO: 3601 - DNA, 1112 bp, Homo sapiens
cacttgctcggttcctgccaactcatggctttagcactctctcctgaagtcgtgtgagagcaagtgggccctgccttaggaaccctaaacccaaacggggagagagagtattgtgggctggccaggtcctgcctctccagcccaatcttccaacagtccctccaacaacaatctgccaacagcaccctcttctgacctcctcccccacaccccctcagtctggcaggtgagttctctgggaagccgactctgaggtggtttccatgtatatttattagggaggtccttgggggtgggtggagaaaacaaatggagcagagggagaagtcaagctgagatgcaggcccaagcactttccacagggaaacttggatctgaaatagctggctgggcctttgcatacctgcctttattcctcattgaattgactctcattggatatgggtcgtgcattgaagggcccaactttgagcaaagaggctctgcaactggggcaaaagagactgacagtgcaaggctgcactctgacagcactgacagcagctggggcaacaagtccttcattaacatgggacctgggggctgcatcgccctgtccaccacaaccagggctcattatcatttccaagggcttcccttggaatgctgtatctacccaccacacacaccaccaccaccaccactattgcacaaacacacaaaacttaccaaaatcctttttcttcttcaaaatgttctaatagtacctcctccagaaagccttccatggtttccccaactttgaatgattgcatctctcactgctcccaagattcatgggcagagtgccacgtaggcagatatcctcttatcagacagcagttttctagaggtggcattgtatgtaatggagtgggccacagcagtgtccaagtggccttgcagggccttgtttcaggggaccaaagcaccagaaggggctaaaccagaagcgctcgcaggtccttcttgccttactgatctgtgattctctaggtcccactctgggtggcccactcctccaggtgtgcatgagcaccttagagaacagggcctgggccttctccatgtctgtaggaggttgttgagggcac

SEQ ID NO: 3602 - DNA, 1906 bp, Homo sapiens
atgctgcatggacttgtttgtgggtggatcttgtttttaacctacttcttgaacctgggaactaggatgtatactgaacctgcatccttcagctgaatacacagtcagcgcttagcaaagactataggatgagctctctaaagcaaggcaggaagggtgtgctggagaggaagggagtagggctgagtagttggcaccagtctgtggtgctgcatgccccagggaattcctcttggcctccttcctctaaaaaatgtttggaaactatgccctatcctcaaccctccccattctctccaacccctctgtacccacaactattgggtagtaatgcctgcccttctcaacaggaagagggcctgccgccagatcttatcccacagcatgggaggatctggaggtggtctaggtggatgccaagggaggggttttaaaaggacagagtgcttggcacagccaggaccaacagtcctgcaaagtgggagagccttggcagatcaagtagggttgaagcacaagcactcattcctggagcaagagcctctgggatgctttcctcctccccagatgctgggaacacctcatccccaggagcccccaggagccatgacttggcccgggcagatctacagtgcaatagaacgcactattggagccgtgctgctgtatgtatgagattttacttccccagtcttatccttgggcctcggtgccttttcctctgtgacatggtaagaagttgagagggcagggacccagcctcttcttctttttatttttgagaaggaatgattcctttttattattcgtagataacatatgatttacctaaaatatcaaaaacgaattataagaataaacaagtgactttagcaaagtcacttgatactgtgtccacatgtaaaagtcaattagatttctacgtatcaaaaacaaatagagcataacatttaaatgattataacatttgcatcacacttatatgaatgacacagggaaaagttgaacagaagaggtataattcttctatcctagaactacaaaatgtattgaaagaaaataaagatataaataaaggaagatatataccagcctcttctttaatccctctcctcctgcaccatggcagcttagacttttcagacatttctttcttgtctctgtaagaaaggataatgatacttgtaaatggatgtaagaattcaacaaaataatgcttgtaaactgcttagcctatgcttggcatgtagtaagtgctcagagaaagaaaagctccatctcttgaactctgagagaaacacttactccttaggacaaactgtgtcctctgagatctaatttaaaccaaaccagagcatgaggctccagcatcttcagcactgtgtgaaatggagataatagaaactacctcactgagtagcttagtgaggattaaatgaaagaaagtatataaaacagaacttgctaagtgattagttctcagtaaatgttacttgctgttgctattacactgcagagattttttttcccatttctttggaggtcagttcttgaatctcgtgaagtaaaatcttaatcggaattattttcagtataaaataaaaaaaatcttctttcatatccttgttctttgctttcttttttcaatttaattccttaatactttttgaattctttgtttatgaaggataaaaggctctgagaagtgctaatatgtttttaaagtctattttctataagatcctcatgaaactgtgtaaggacaccagaggatgggatagggatgttttgagggagagtaacaagaaggactggaagtcaaactaatcaaactggaatcatgagagtttctatcctaccttaggaggtagagaaggtgagatctctggactgagtttcaaaaagg

SEQ ID NO: 3603 - DNA, 1032 bp, Homo sapiens
agaagctctattttaatgaagcaagagacaaaacagcctgttgcaatacagtgacgacgggtgcgaacacatgtggtgtaaggcttaaattttgggttggaatcttctgaatttaagtccagctccattatttggcagttgtttgaccttaagcaactcccttaacctctctgagcttttgttccctagtctgtcaaatgtggataaggatagtgcctttctcccagggatgaggtgaaaaatagataaggtacatggtgcctggcaaagaggaagccctcagtaaatagtaggtgtaattatgattatggtgtgccatgctagaagagatttacagggagtagagactacttgtctacctgcgggtgggaggctgtgggtgtcagagcaggcttcttgcaggatgccaaagctgcctcctgaggcatgagtaggaattttccaggtggataaagagagggcattagcagggttggacagtgtttttcggaggcccctttcactgtgactgtatcacctgctgcttccaactcggactctgccttgcattttgagaggaagggagtaggctcttttgagtaccatcttgaaggttctccaggactcaggagatgccctgttggggctctgatgggaattccaggtcaccagatgcctcctgttacatctccactctaagccctgtgtctggccttggatcctcctcccttgtaaatgtggccgatgacgaaacagagacatcagtcccatttgtggctccatcagctttggaagcagatcacgggaattttctgagtctgggcccccagccagaaggcatttataatcagacatggagcaatcattagagcagaaacaataaattacaacagcaccaagagaactccccaaagctgctcacgcgaggggagatccaaggagcagaatgctagcaggctctgggcccgcctgcccctcccgctggcagccaaggcctcctgcctcaccacactcagcctctgcccccagacgtctgtgagtgatgcagcagca

SEQ ID NO: 3604 - DNA, 1050 bp, Homo sapiens
ccccgcatcagtgcctttgggggttcattttctactccaagaattgtagcccccttttttctatctaatgagtgtttgttctcaacctccaaatctcctctgagatgttccctcccgggaagtttgcccaggacagagctggctatttcctccttggtgttctggaatcagcctgcttatcacatcttctactgtggtagccatgtccgtgagctgcttacatctgccttcgggaagagtctgctgccagggagtagagagaagtggcagacttccagctaacagtcaagcctgaccatttctgcccaaactcctgtatggacaatttttgcaccggagcttcttgttgggcaggctgagaaatgtgtagaggggcttcagtctgcagcacttcctacctgatccttcttccttcctccacctgctcttttcaccatgtctggcctgcactacagtcaactttttccttgcctacttgtgcttcttctgtcctttgcctttcgtaagcattactcccagtgagttgcttgcacctctgactctgtcttggcttctgttccctgagacacttcctaatggttatttcttttttcccattggtctttacttcattctccactggctctgaattcatacatttatttattcattcaacaaatatttcttgagaaccaccatccagagttcccaccattcacagctcagtgccaaggttgctctcttttcataggacctagctggatccaactcttctgccattccccctgctccctctctccacacccctgagaatttcatgttctgtggcccctccattcctgggctcatgcactcccgtgtcctgcagcatcatcctttattccccaggtagcttcctcctttaaggctttgccaagcctcaggtctgggaagcctcccttgatggcccctggccctggttattgctcatgacagtgcatagcatatattaggttgcagaaatgattagttgagtgtctggctgaatctcagatgactattgtcagcattgattagaagacataatgtgtg

SEQ ID NO: 3605 - DNA, 1042 bp, Homo sapiens
aaggtgggaagaacataagctttgaaccaggcttcaaaccacagctcttgcttttgagaataatgtgactttagacaggctacttccctcttctaagcctaaactttctcatccttaaaatgcttaaagctggcataacagggttgcaacaaaggtttggtgttcatatgagtaaaatgcatggaaaagaccaggagctcaataaagggtaggtacctattattattatttctctttacctccatatggaaaaaaaaaaaacctagtcttacttgtcttttttcatcaccttgagctattgtgtgtagcacaattgagtctctgaagcaaactgaattagcaaaactagtaacacagatgaaaaagactacaaagaatagtgaaaggacaaaatataaaattttgagagggtagaggagggaacacttcctaactcacttcccagctttataaggccaggactatcctgataccaaaacaaggccaagaaattataagagaactatagaccaaaaccccttgtgtcattaaattgatgcaaaaactctcaacaaaattattagtcattcaaatccagcaaaatataaaaaggataatacaatatgacccaggaattatcctgggaatacaaggctggtttaatgttcaaaaatcaatcaatgtaatttcttaaatcagtagactaaagaagaaaaacccatatgatcatctcattagatgcagaaaaggcctttgacaaaattcaatattgctcatgataaaaactctcagtaaactaggactagaagagaactttatctgataaagaacatttacaaaaaacctacaagcaatatcatatataatggtgaaaataaaatactttcccctaagatcagagacaaagcaaattacatatctgataaagaacttgtctttagaatatataaagaatgctcaaaactaaatgataagaaaacaaatacaattttttaaataagcaaaagatttgaacacttctcaaaagaagatatatgaatggcaagtaagtaccataataaaa

SEQ ID NO: 3606 - DNA, 1028 bp, Homo sapiens
ttgtaccttttgcaaagccattttgcttattggcctttagctggtctgtctgctccccctaaaggacatccctggcaagccatcactcaggatatgccctcaggataacagcacctttgcctacatgcccaagtctctctatccccactgtcccagagcctattagcactattttggaatctttgaccctaagattttacggcctgcgtcattagaatttcagaccttttgacctcaagattccaaagcccacggccccccaaattccagaatttttgttgccacagatttaagagtccatgtcaccaaaagtctcagagccttttggggtacttatctggcttcattcagattcatgacacctgggctgctctgtgcttgactttctgtcttaaggagtactggactaggaatcaggtctaggcctggagcttctgataggttgtgtatagtcaccagcaggggctttaccctctgagcctcggtttcctcacctataaagtgcgggtaatcaccctgtgagctgcgggagataatgtgttggaaggcaagtgctctgcagatgtgagctattcctgtgttagtgcatgtcagctctgctcagcatcagcgtcatgacactggaaaatctagctgcatgacctccttgttttggcttttattcactctatgggccatggccatcctttgctgtttaccaagatttttaactcaattgacgcccgaactcctccaaccatgtcttctggtcttggctgcttgacctctttcctgtacactttctaggagtgcccaagtcataattaatctcttccttgccttcagcctctctgtttatgcctcagttgtggcactctgcaaagctgctttgtatgagttatatattgtatgtgttaatgacgccattatgctaattacctcctgccccatcactcctgggtgtttggtgcctaacagtgttgaccaaccttgggtgaggtccttggcctttctgaatcttaatttccttgctgttaacgtgggagaaa

SEQ ID NO: 3607 - DNA, 1044 bp, Homo sapiens
gacacatgtgagtccaggagtgggtgacaggtgctgagacagagggagaggtgtgctcgaggccttcgagtgtcagggaaggagtcctggaggattaggaactgccatacaaagagcagaaagggtgtcttagatacagagaacagcagtcagcagatgggactggaggcctgaagtagcctggcattcttctgtttgtggccattgtgggcttggctgccctctgcaccttatctaaaggccaccagatgtctgctcagggtcttagtggagcccagctatcagaatgggcagcagaggctgtaagaagggctagatgagcagaggcaggagggagcaagggaggattcctggaggagatgtacctggggcctcaatgaaggagcacatttggacaggtaggaaggaaagcaggataggagctcaacaggagcaaagaaccaggggcaggatgggaacctgacatggagggggcctcagactgtaggtgccttggagtgtggcacatggcataatgcctggctcctttaggtgaggctgtagcttacttctcccaactgcagtgagtgccagggaggaagctttgggtcagaagaaggcttctgcaatagaagtcgctgctccctcttcagggcactgagggtgctgagcgatgcaggggtcagaactcccagctcctatgggatcaggcaatgcctttgactgctttatgcctcagtttgaccatctagaaaaaaaggacacgggagggaacctctggcattctgtgattatctcactttgtgacattgagcggggcacatcacttttgggacttgttccctagtatataaagtggggagaagcatgggccactgctgtcacctcactgagagtttcagaggactgtgcagatggtctctccagaccaagcctctggaccaaggtgaggggtcagaggacaccgggctactagggactgctcagcctgcttccctgcagccaggcccccatcttttcctctgctgccccaccctctctaccttgggtatgagatggcacagc

SEQ ID NO: 3608 - DNA, 1681 bp, Homo sapiens
tattacctcccagaggccccatctcctaataccatcacattgtgggttagaatttcagcacatgaatttgagtcaggaggctaaggggacacaaacattcagtacataacagtgctgaaaaactagttgttgaatgagtgaatgattggaaagtaggtggatactgctgcctggagggactctcaggccagaatgaggaattcagtggctcccatgggtagtgggggaccactgctggatataacctgtgtgcaagaaaactggaagaaaccagatcccgaagaaagacttgaatttctagccagtatttaatttattgtaataataatgatactgctaataataacaataatttttataactacttaattagcattatttttgccagaaagtctcagttagttgcatgcttggccctgtctttgtgtgattagaggttgtggacttatcttgaggttttgctgttttctttcctggttggtctctgctgatagtccatctcactgttggctctttcatctgtttgtgctccatgagataccacaaaagcacaatctttgataaggcaaatatgtcaaatccttattataacatttaatcacttagggaggtttcatctggggtgagagtgggaggggtggtgggaatggaaagaaaaggccagattgctttaactgaatttttctttctgggtgaatgggaagtctttggtggaaacctcattgtttgaggctgtatccaggaaagagtaagaaaagcaattgaggaggttctggagtcttggtcaggagcatatattgagtacctattgtgggtgtggcattaggctgcgtgctgtcagggaaggcaggaagaacacacctgtcctcctgttaaggtgtggtatctgagtgtagggagttagggctgggcaggcctacctggcacaaggtagacctggataaattctcattgattggttgggcctttacctgtttggtaattaattgttttaagaattcagattggcgagagagatcatttccaaggagataagcctttctccacttataactatacccaaggctggctttccacgggttttcccatttattgcaaggtttctcatgtattgagagagctgacattcagaaggttaagagctacattcataccaccaggatagcagggacatgtctgtttggtttacaaaactggctcagggtctggcatgatattcctatatatagtagattgttagcttatgtgcactgaatgaatgaagtattgggggagtatactgtgtctaagtctctcagaaagtaggatgtgtacctatgatacaagccaggccttccatttccaagcctgatttcttttaccgtgctatcaaatttcattaggcagagatggtgtgttagattagattattgttcaaacatattcactctctgcctcttccttcccccagcctccagtgatgtagagtttgacgatgtcacttgctttggctttctggtgggctaagtgtacttcttgcttcttgactttgggctctgtcttgtcacttgctttggccagtgagacgctagcagacatgcgccaccagagccttagatgtgcttgctttagttgagctcatcctctcgtgcctctgccatcaccatgagaagggaatcttccatgtagctgctgcctcttc

SEQ ID NO: 3609 - DNA, 1049 bp, Homo sapiens
accactacagaacccgcatggtgaggcctgctggtggtcttggaggtaatttaatattctgcttccatcagtagttttgtggggaggctttttgatggaggtggctttgagagacaccttgcaggtgggataggatttgggcccctggagatgaggtggaaaggaagcagacttacacggaagtgccaggatgggaaaatgcagagggaatgcagaacaagcctttctacactccctccactggctttattcttcctgtttcctatccagcccctaagagagccattgctatttggtgcctgttatatgctaggcctctggtttatcacagtaaatttctaaaacaatcctgaaaggtaagcatttttccctcattttgaggacactgaggctaagtactttgttcaaaatgatggagccaggatttctacttggatcttttgataccttaaggaagaaactggactggagttggaaatccagctcctccactttggctagatggctgaacatctgtttccatatctgaaaaaatggtgctcacaacagtatttacctcctggggttgttgtgaggcataaatgagataatgcatataaaccacacagctgagtggctggcacacagtaagagttaatgaatgttaactgtggtggcttaagtaatggtcattttcattattattattggcccattttcacaatgtctgtcttgaagtgaagcccattctgtacaaaagatggctcttggtcctttggtctctcacacactgagcatcatccagtgcagggatgggttgttggttggtctgatgggaactatgtggttggaccacccagagcatggccatttatttttctgaccatctgcagtgtgtaatgtctgactgtattcattctggcttgccttcactgtggtctcccactactctctggagttgggacacaccaaaaggagggagtgaaaggtttaggctggagtccccagcttgaggcccagctctgccctgggttagatctgtgacctggggttcctgcctctcagcatcc

SEQ ID NO: 3610 - DNA, 1057 bp, Homo sapiens
catgctttctttactattcctttgcacccttcatcccagcctctctttgctttcacttagactgaccctgacacctattaggctcagcaaattacctgggctgtactgccgcaaggcttcacagacagcccccattacttcagtcaagcccaaatttcatcctcatctgttacctatctcggcataattatcattaaaacacaagggctctccctgctgatcatgtctgattaatctcccaaacctcaattccttacaaaacaacaactcctttccttcctaggcatggttaatgcagtcagaattcttacacaagagccaggaccgcaccctgtcgcctttctgtccaaacaacttgaccttactgttttagcctagccctcatgtctccatgcagtggctgctgccaccctaatacttttagaggccctcaatatcacaaactatgctcaactcactctttacatttctcgtaacttccaaaatctattttcttcctcatacctgacgcatgtactttctgctccctggctccttcagctgtactcactctttgttaagtcccacaattaccatttttcctggcccagacttcaatccggcctcccacattattcctgataccacacctgacctccatgactgtatctctctgatccacctgacattcaccccatttccccatatttccttctttcctgttcctcaccctgatcacgcttgatttattgatggcagttccaccaggcctaatcgccacacaccagcaaaggcaggctatgctatagtacaagccactagcctgcttctcagaacctctcatttcctttccatcgtggaaatctatcctatcaaggaaataacttctcagtgttccatctgctattctactactccgcagggattattcaggccccctcccttccctacacatcaagctcaaggatttgcccccaccaaggactggcaaattggctttactcaacatgctccaagtcagaaaactaaaatacctcttagtctaggtagacactttcactggataggtacaggcctt

SEQ ID NO: 3611 - DNA, 1024 bp, Homo sapiens
tcaaatatgagcaattcctgctctacaccaggtgctctaccccaggcttgtgctaggtgctggaatacagacctgaaacacacctgggccctgtcctcatggattttacagactgaggcaaatgaggctggacagggaggcaggcacttgagaacaagtcttcaaaggtcaggctgaggagtcgtagcttaaagaacaaaaaccctgtaggcaatggagagtcactgcagactttaagcagcagatagactgtaagtgccaggatcttcaaagttctcttggagtgaattgaaaggggtccagcctggaggatgttgtaaaagtgaagccaaaaataatgggcacctgaggaaatgggtaaaggaggtgaaatcaggacaccatgactgactgaaagagccaggtgagggacatgggagaggctaatatggctccagggttcctgccttgggtgaccagacatgtagtggtgcctttcccaggaatagagaacacaggacaaggagtgggtattagtgctggtgaaagaagggatagagatagagagaaagagatagagaaagagagagagagagagagagagagaacatgtacacacacaaatatgatgatgtgcttcaggagtctgcaggtcctccaagtggagatgttcaggtgaggagaaatgaaacttttacttccttggatggccctggtggctttctctcttctcctttttggtggctcagtaaactaaaacacagcagttctctgccttatatcagtgatgttggactcaccactgcctgagctctaaggcagctttctggtgcatgttgagctgggtatcccttatcctgctcccaacttcttactttccactgtgctgggcccaagcatgcatctctctgggatcatgagagcctgggaagcttccttgcttgtaagtatctctcaataaaccttacctaatacttctaatgggtgtcacaaatagcatatggactgtgtctctttatgtcaccagggtacagttggattttgg

SEQ ID NO: 3612 - DNA, 1005 bp, Homo sapiens
ctgcaggatggtctgactcacgcgagtggttttgagataagttgtgttatacctcaagttaggtaaagtcgagagatgaactaacttaaaaagtagtgatgtttacatagaatctaaattggaaaagacaataatatcagcattagaaagtttgcctttaagtaaaaaaaattattagccataataggttttacattcttcgtaatagaatatcctaaagcaataaaacctccactatgtgaactctaagttctgaacatccgaatttttcaaatagttctgagttatatttaatttgttctttactgactagaacacttcctaatttatcacatcatttttaacctcctcaaacatactgaatatattttttccaggtttattgaggtataattgacaaacaaaaattgtgtatgtaaggtgtacaatgtgatgttttgatatgtgaatacatttgatgattctggcttcccaatatgaagatcacttattgtgtcagccagcataaaacgtaggactgttgagatagagtagaatcatttatgtctgcaatgactgcctccatgctaatatgtctcaattttgttttgtttttagaatttatattttcacatttgctgcatatgatgcagagtaggcttggggaccaggttaccaatttgatatgattgcataaaacaagaatgaaaatgttctgtgtcagggccttttaagtattggtgttatgtcatcagctttgactattataagaattttgtgcttgcttcctgctccatttagatgcatgaacttggtgcatttaaagagtatgtcagtgtagatgtcaacagtctatctccccaaatccaatttaatatgtaaggataaaattacattgattaaatgttctaattttatatacattttaatataacagaaacataaaagcatgtagactacatttagatttctttatatgatgatttactatatcatataccatccactcccagacagattagaatg

SEQ ID NO: 3613 - DNA, 1070 bp, Homo sapiens
agatcagatagttgtagatacgtggcgttatttctgagggctctgttctgttccattgatatatatctctgttttggtaccagtaccatgctgttttggttactgtaaccttgtagtatagtttgaagtcaggtagtgtgatgcctccagctttgctcttttggcttaggattgacttggtgatgcaggctcttttttggttccttatgaactttaagtagttttttccaattctatgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattggtgtataagaatacttgtgattcttgtacattgattttgtatcctgagactttgctgaaattgcttatcagcttaaggagattttgggctgagacgatggcgttttctagatatataatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacttaatttattgagattttttagcatgaaaggttgttgaattttgtcaaaggccttttctgcatctattgagataatcatgtggtgtttgtctttggttctgtttatatgctggattatgtttattgatttgtgtatattgaaccagccttgcatcccagggatgaagcccacttgatcatggt

SEQ ID NO: 3614 - DNA, 1067 bp, Homo sapiens
caggcaatctgcaagacattgagtgataacccagagataaacagaaacacagttctcaatcaaagtttgtgtgtgtatatgggggttggggagagactggcatttacttgagggataataattgaaattacttgatattctttctagctgtcttggatagcataagccttagaaattccacttactaaggtttgtgaagtaagaaggaaataagctaacacagaacagatatcagctgatatactgttctctaaaagttaataaagttacttaacattacttaacagtaacttagcattactctcattaccaaggtacttctgcttttgaggggaaaaacatataagatattcaagaaggaagtattaccaacaagatggtagagtaggagaccctggccctcaaccccacaaacaacaatctgatagacatccaggaatggaaatagctgtgggagggctttggagtccagataagaagctgcggcagcatagtagagcaaaaaagcaaagcaaaaccaaaccaaaacaacaacaacaaaaacaagaataaccacacagaatgggtatgaagaagtctcattttatctttatgccatccgtcaggctggcacagctcattaccaaatgttaccctcaggtgaaaatgagagcagggtgagtgtccagcctcttcacaatttgtgggtactgcccaaaagatccacattggttttatcccactcaaatcccggggaagactggcatagctgagatatctggaagcagctaggaataaagaaggacagagggcattgtgtcagccacgtggcaggggataccatggttcatagcggcctggtcttcagatgaccccagcacccttctccactgaagacctcccagctggcttggaattcccatggctttcaccgcagatggccttctggctttctccttcatggaccccagctgactaggctatttttacctccagtggagctgccccagccagcgcctctgtgggcacccaaaccctgggaaccagtgcagtcactgcatgcatgcctgcagttggcactgacccac

SEQ ID NO: 3615 - DNA, 1054 bp, Homo sapiens
tagtttttgaagtaaaagctttgggttattgatttgaggtcttcttttttcatgtaggtgtttatagccatgttcctctagaagcactgcctcattttcattattaagttttatatgttttgttatattttaaatttctcttgaagcattttctagtgtcccttgtgctgttttatttggcctactgatcatttagtagtatattgtttgatttctacatatttattaattacccaaattttcttctgctattattctctaatttcatgttattgtggccaggtaacatattttgtatgatttcagttctttcaaatttattgaaacttgttttatagcctaacattcttcaagaatttttcatatgcacttgaaaagaatatgtattttgctatcgttgggtggaatgttctatagatgttgttaggtctggttgatttatattgttgtttaggtcttccatttactggttgatcttctgcctgattgttctgttcattgttgaaaaatcaaatattgctgtcttcgaactgtacacacatcctgttggttctgttttctctagagaatcctgacaaatacagcatgagagtaaaaaactccttggggccagagtcctagggggctctcacaagttcatacactttatctctagaaactcaagcaaatgcttcaacatgaaaaacagctaaatattggtagggacagtaagttttatggcattttaacttgaccgagtcccatctcctgctctctagctgcatagtaggcttgataaccaacatgtcacaatctcagtgaaaaccaaaattttggcaggcactgttagaggtaaaataaagttaggatttcttcaaagaccattcccagagaattgtaattacttgacttgctggagattgcctggaagaccccactttgagtgagagctttcccagtgcaaaatctttgccctggagggcatttttaaaagaaataattacaggcaattgttaaacctcattgccaactgaaatggtggatagccattgaattaaacaatagaccaatgaaa

SEQ ID NO: 3616 - DNA, 1028 bp, Homo sapiens
aaagataatttgacttgttcgtttccaataaagttggatgccctttctttctttctggtctgattgctccagataggacttccagtgctatattgaataacagtggtgaaagtgagcatccttgtcgtgttacagatcttaggggaagggttttcacttattcccgactcggtatgatactagctgtgggtctgttgtatatggcttttattgtgttgaggtatgttctttatatactcagtttttttgagagtttttattatgaaggggtgttgaattttataacatacttttttagtattaattgaaatggttatatgatttttgtccttcattctgttgatacgatgtatcacattgattgatttgcttatgttgaaccatccttgcatccctgaaataaatctcacttggtcatgataaataatctttctaatgtattgtcaaattcgatttgctagtattttgctaagagtttttatatcaatgttcatcagggttattgatctgtagttttctttctctgatgtgtctttgtctggttttggtatcaggatagtacttgaccatgtaatgagtttgaaagtgctccctcctctattttttggaatagtttgtttaggattggtattagttctacttccaatgtttgcgttgcaaggcatgatggctcatccctgtaatcccagcattttgggaggccaaggcgggagaatctcttgagcccaggagtttgagaccagcttgggcaacatggtgagaccttgtctctacaaataataataataataatagagtagataggtgtggtggcgtacatctgttgtcctagctacttgggaggctgagatgggagaattgcttgagccctggcagtcgaggctgcagtgagctgtgatcacaccgctgtcctccagcctgggcaacagagtgagatcccatctcaaaaataaaataacaacaaagtaataaaataaaataacaaaaataaatgtttgataaaattatttagtgaatccatcgagccc

SEQ ID NO: 3617 - DNA, 1023 bp, Homo sapiens
atttttcattattttttctctccagtttggatatttgcttttaaactgttctttgctaatcctatattctgctgtatttgcattgatgttaaaactttgatgaaattttgattgtgaagttttgatgaaagcttttcatgaggttttgctgttgaaactttgatcaatgaaatgggccaaatcctggaaaaatacaaactactataaatgatatggtttggctgtgtgcccactcaagtctcatcttgaattcccatgtgttgtgggagggaccctgtgggaggtaattgaatcatgggggcaagtctttcctgtggctgttctcttgatagtgaataagtctcatgaggtctgatggtttttaaaagaggagttcctctgcataagatctctcttttcttgctgccatccatgtaagatgtgacttgctccctattggctttaaccatgattgtgaggcttccccagccacgtggaactgtaagtccaattatacctctttcttttgtaaattgcccattctcaggtatgtctttatcagcagcatgaaaatggactaatacaataactaactgaagatgaaataatattactggttgtatatctattaaagaaattgaatttgtagttaagaactttttcaaggagagagccctaggcccagatggtttctctggtgaatccaaacaaaatttaaggagaacacaataccagtcttgcacatccctgaaaatagaagaaggaaaacttcccaggtcattttatgaagtcaatatttactgtaatgctataaccagacatcaacattacaagcaaagaaaaatgtagaccaatggccctcatgaatgtatatacaaaaattcccaacaacatattagcaaattaaatccatctgtatataaaaatgaaaatacatcacaattaagtggacttattgcagaaatgcagtataaatttatcctagtaaatgattaagaaaaagcatatttcttatatgtagtttcagcagacccaaaaaaggat

SEQ ID NO: 3618 - DNA, 1005 bp, Homo sapiens
ttacacgaatatttaaatatatatgtaaccaatgtttgcacttttttagtatactgaaaaataatttttttgactttgtttctttaatttttcaagtgattaagtatcgggctttaatttttataaagtccttgttggacttaaggaagtttgagacagtgtactttaataactactgcagaaagagttatctaggagaatgtggatttgacttatcccaggatcagcacagataggaaggactgatctagttggctttgatagattttgcgtcttatttaaattactttttaattttttccccaccaacaggaattttaaaaatcccctttgaccaagttaatttttattttttatgtttaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgtatgtgttctcttaagcatttctatttgaaactgatcagcttttttcccaaaaaaactgttattctgaaatatctttcaacttctagcttatattaataatacttttctcttctgactgctaccctagcagtctaagatgggaaattaatttagaatgaaagaacttgctttttttcagtcttcagacctgacagagatcaagctgtgttatgaatgccatgttaaatcctctcagtaccggtttcctttcttatacaatagatagcataataacgctaccaattgaacttggttgtaattgacattagtactaaaatggcagagtagggctttaaaagagaaccaa

SEQ ID NO: 3619 - DNA, 1031 bp, Homo sapiens
atacgcggctaacttttgtatttttttgagatagaatttgccatgttgcccaggctggtctcgaactctggagctcaagcaatctgcccacctcagcctcccaaaattctgggattacaggtgtgcacttatctgcctggcctagtctgacttattactgagtcaccagggtggcttacttctttgtccacaggttatctaataatgtccagatatcattcatgtgcagttgcattgtgatagggtaacagtgacctatctgtgatgaagagccaataatatgtaaagcccagagggctcaaagggcaggactgggcttatcgtggaaggagtggattgttcatttactgcattatcagtattcaagtaaatttgctgaagatgataactgtgacttaagccaagaaaggtaaaatatagaattattgaggggaacattcttattttatttagaaagatatttaataattcagagtcaggctgtagttatttatcttttagatgcaagctgaaacacagcttttagagctctaaaaacctatgcttgccaaatgcagagctatgttattgacttgttttagagatgtgcactgtgcacattgtaaatggttagatatgctttgcctggactcagacagtttttttttcttcacgctggagtatgttcttccaatagatggatagagaagtcttttttttctttttaactttttgtctgaaatatagcatacacatagaaaagtacatacattctcagggtacagcttggtgaaagccatttctaaatgtaaaaccattacccattcatagtttaattgtacttatgaactaacatttccctctgtaaacttttaacaagagtcttccattttatttttatttttatttttactttttgacttgggatctttattgaacagagatatgagagaaaaggcattggtgtcagtatttaaggaaatacattttctttaaatattctttctagaaacagacagatctgggttcgagttcctcataaggctgctgta

SEQ ID NO: 3620 - DNA, 1025 bp, Homo sapiens
tttctttgtcacccaggctggagtgcagttgcgagatcatggcttactgcagccttgacctcccacgctcaaacaggaatgtctatagtgattgtcctgtccctgctgcacatgtgcaccttgggcatgtgtgaggcagataacttttctctttaggtcatatgtcttctgattgtgagaaactgcattttaggagctgtacataaggaactacacctcagcagccctatctataccaggattttatttagatgccaacatcctggatttcaagctgaagttgtacaaggatgagactttaattcttttcttttttttggtagagcatgaatgtattttgcatgtgagaggaatgtaagtaatttgtggtcagagagcagactggtggttttaaacctgtgcacaaaatttttgctactccttcattgaaaaggtagcctaactactctgtcattgagtttggattatacttagtgagtctgatgaatagaatgtggtagggatgacagtgtcagattctgagactacatcattgtggcttccttcttgctttgctcttggatcatcccctttgattaactagaaccacatcatgagaacactcagtagccttttggagaggtttatgagttgctgaatgttcttgccaaaagctagaaaggaactgaggcttccagccaacagccctgggaatgaaccttcttgagaagcagattctcaaactccagtcaagttttcagttgactgcagcctaaatgacatcttgaccacaatttcacgagaaatttcaacacagaaacacatagctcaacctctctcagatttctgacccatagaaattacgtgagataataaatgtgtactgatgctttaaaccgctaagtttcaaggtaatttgttttgtagtactaggtaattaacaagtagatatagtggatatcacagatatcactatgaagatacgtttgcagaagaacacacattgaaaatgtagcctaactactcttcttgagtgtagactgtag

SEQ ID NO: 3621 - DNA, 1031 bp, Homo sapiens
aataaaatcatgtcttttgcagcagcatggatgcagctggaggccattatcctaagtgaattaatgcaaaagcagaaaaccaaatacagtgtgttctctcttacaagtaggagctaaacactgggtatacatggacacaaagatgggaacaataaacactggagatttcaaaaaggtgaagggaaggaaaggggaaagggttgaaaagctattaatagctgtcacaggtgctatgtgcactacctgggcaatggaattatgattaatagaaacccatacctcagcatcatgcagtttttatccatgtaacaaacctgcacatgtaccctctaagttaaaaaaaagttatatggaggttttcaacagtgtgtgggtttgatggccctagcccccatgttgtttaagggtcacctgtatatgtaaatatcagtgtcttaacttttaaaatttggtttttacttatatcaaaattatgtcatttttaattggttataaaattaggttgtttttctttaaattcgttgtatatattctataagtcttattatagaaaacagcaataatgtatccatttcagcaaagtttcctgaacgatagtttgtagtattcattttcttttttttttttttttgcctcaattttcttaattaggaactactattatagtattttggatcattttgcctgtttagtgtttactttctgtgctatttaaaattctttggtttctttttgattaaaatattctcattttcttgtattttaaggcattatatctgtcgtattatttcctctcctgtttattttaattcatattcagttatgaaatgatttctgattgggtgtgtggtagctcataaatataatcccagcactttgggaagcgtaggctggagaattgcttgaggctgggagttgaagatcagcctgggcaacatagtgagacccccatctctacaaaaaaaattaaaaattagtcagttgtgatggtacatgcctatagtcccagctgctcagaaggctgaggtcag

SEQ ID NO: 3622 - DNA, 1087 bp, Homo sapiens
gaattatgagactatattactcttatttgaaggtctaggagaagagcattttaagcagaggaaaaacaaatataaaggcttgtagttgaaaataatcttgatgggttggaggaacaccaagaaggcctggtatgatcatggtaacaagaggaagaatgctagcagaggaagttggagacggaggcagcacaagctataaaggttatttgtagaatcttttgtagtgatgggaaggagagaggaactgacagttctcaataatgtcaaaagtttctgtgattgtgaaaggaatgatattttggggatgaagggagaaaaaaaatatatatcttccttcctgcctctccctgtatcgtctcactataggtgttcccggacgcagtagatcctggagatgtggttacacagcttgaatgtaagttttttaactttttaattcctgattctaagacattttaggatttattatccttatgatctttaatcttgggttaaataaaagtttaaaaggggttagtagaactttaaaaatcttgagctgagactttttaatactttttagaatttcagaatattcctggaaataataaaagatatatatgctgcagagaggctgagaattctttctttttttgtgtgtttggtctgtggaaaacagagacttatttaagctttttattgattaaaatgatatggggtgtttgtgatatagtgacagaaatttatgttagttgagattttcccctgcaaacagaaatatgtcttctacttcagtgtatttcaagtcaagagagtgaataacagatcaaagtaatggtagcttaaaatatatgcttttgcactttacattgcattcattacattaataaattatttgaaaaacacattttttcaaggctctgcataacaagtaaattcttcaaactacttagaataactataaaaagatacaactatttgtgagagcagcaatgcaaaagtgtacactttttaagctctgagtgttaaatgaaaagctccgttaatttatctttgtaatttgaaagggctctgggatcaacagattgatctaatgtataaatgtggc

SEQ ID NO: 3623 - DNA, 1035 bp, Homo sapiens
attggtgagaaattcttaatatttagttcatattcaagtttttctggttgtcccaaacatgagttccatagttaactttttcaaaccgggatccagtcaaggtttatatattacctttaatcatttgattgataggtctttgtagttcattttaatatagagcagttctattttttttttattcccacaatgttccttttttttcctcagttggttttggtcaattcatacactcatgtcaccatcacccagatcaagatttggaacacttccatcacccctcgcaattcccttgttcccctttcaggtccattccagacagaactgctttccagagagaaataagtataggagatgatggaaatgttaattagcttgaattaatcatttcacagtgtacatacctgtagcaaaacatcactttgtacagtgtaaatatatgtaagttttgacaaaaaagaatggataaatatattgtagtatacacatacaatagaatactactccacaattcaaaggtactactgatagaaccaacaacatggatgaatctcaagaacatgctgagcaaaagaagtcagatactaaatatcacatactatgtggctccaatgtgaagtttaagtactggcaaagtaatccatagtgatagaaatcggaatagtgtacacacacaccccctcacacacacacctaccacattttctttatccattcattcgttgatggacacttaggttgcttccatatcatgagtatggtgaataatgcagcaatgaatatgagagtgcagatctcttccatatactaatttcctttggatacatacccagaagtgagattgctggattatatggtagttctattttttaattatttgaggaaatttttctttttttaaattatttgaggaaatatgctttttgtaatggctcttctaatttacatttctaccaacggtgtacaagggttcccctttctccacattctttccaacacttacaattttttgaatttattatagtagtcgttcta

SEQ ID NO: 3624 - DNA, 1045 bp, Homo sapiens
ctggcctgggaacagtgtaagagcatgtttaacacatgcaaatacatacacacacacacacacacacacacacacacacacacacacacacaaaacccttaaagactggatttaactaactacctggccatatgctacatccaacattgggcaacatgctacaaaacgcatttgggatacaccagtgggaacctttgaggactatgagaaacagcaatctctaaagtgtcagtttaagccctgaacacaaagtattttaccacaaggggacagtccagagatgattcagatttttgcctctggagccctcttgtttgaacttttatttttgaacatatccagtgagagacaaatctggaaagtccagtttgaaatctgtgcagaaaaagaaacagattatcttaggttgagcttaaagaatgagaaaatgagtagaaataatatccttttatatttgtgtagcactttacattcagtatgtgtcgtgagcacacgtaagcagtgggcgaggtgccagaggcctctttcccactcccggctgttcctcagactcatgccgtgggcaagcctcttccatcctctgggtttgaatttcctcatgtaacatgagcgagttggaccacttgttcactgaggtccctcaaactcagtcatgctgagatttgataccagtaaaaaggggataaatgttattcttctcccgtctgccttacctcagcctgccttatgtcagggctgtggagatacccctgcccttccttacatccctatcagctataagctctctcatgtctattggcacttgagctgacagaaacccaccaagttctcctgggaagacacttggcttagaaagatctcagttgagttgagggattcatgtgccattttagtttagatcagatagcaatctaagggctgttccaattcaagattctagaattccataaaaggccaccctttaggatgtacttagagaaacccctaagcaaattcactggctgctatttcaacactttgtatgacagtgcttttagcaaacacc

SEQ ID NO: 3625 - DNA, 1009 bp, Homo sapiens
gttccaggaatgtgtttaaagcataggcttaggaggcacatagatctatagcacatcttggctctgcaccttcccagctgggtgactttaggaggagagttttgtttctttgagcctcatttcttcttttttggaaaaaaaaatgtggcttataatacctacttgcaaggttgttgtgaggtataatttatatgaagatctttatagaggtatctgacatgtagtagacattccacaagtggtaacctaattttttattgaggtatatttcattcaatgtgaattttaccattttaaccattttaaagtgtgtgcaagtgagtgttttttggtatattcctaaagttctgtaaccatcactactacttaattccggaacgtttttatcacccaaaaagaaaataaatccgtgttacccattgagcagtcactctttattgcccttttccccctgctcttggtaacaactaaactactttttgtctctatggatttacccattctgaacatttcatataaatgaaatcaataaatggcctttgtgtctggcttcttttactttccataatatttttaagattcatccatgttgtaacatgagtcagtacatcatttctttttatggttgaataatactctgttgtatgggtataccacattttgttatccattcataagttgatggacagttgggtttttttccaccttttggctgttaatgaataatgctgttatgaacatttgtgtgtgagtttttgtttgggtatatgttttcatttatcttgcatatacacccaggagcggaattgctgggttatagtaattctgtgtttagttttctgaggaactgccataatgttctctactatggctgcccattctacaatacccagcaggaatgtatgagagttccaatatctttacattctttactcttgttattttccttttatttttgatttgagccatcctaatgagtataaagtggtatctccttgtagttttgatt

SEQ ID NO: 3626 - DNA, 1048 bp, Homo sapiens
ttcagttatctctaagtgggtaaaggctcatctggctgcccttacctcaggctcacccttgctaagaactaggaagccctcctcctccaggacaccccctgccatgcagtctgagggcctgaaagtgttcaggaagactgataggtgtgtttccatctctgagatctccctcaatactggagcctcccatatcatagagtctttgccctgcccacatctgttctgctcaagagtagtcctttctgcttatttccttttagaactggtgagacccatcttggacagatgatcacctgtcaagggtaccacaggatggcttctgccctgagatggaaagtgtggatgaggttccatgaagttgtttacaggcccaagggctgataattctttaataatgtgtctacattttctttgaagactcaaaagtgctgtgcccaagtgagagggcattgttattaatgctattagttttgttgatggtgacaacagccacattagtaaaactaaccatgctgctctctcaacacagaggttttagagtcagacagatcgcatttgaatccgagatacaccactaattcattaccaaattaagaacattattccatatcactcagcctctttcttcatctgcacatttgcaaaataacccttacttttcagggtatttgtcaggggtaatataaaccaaagctaacatttactgaatgtgtatatgtgccacatatggcactagctaagttctttgtgtgtattatcctgccttttaaagcgtgcgcccttactctgtccattttaaagatcaggaaactgaggtgcaaagagactaaataacttgcctaaaatcacacagctaattagaggcagagttgagacttgcaatatgaacctaataaatttgtctcaaaagtctgtgatttaaaaaatattatgtctaaaaagcagctgccatgttgcctggaacacattagattctcaactggtaactataatttaacagcatgttacatttctaaacagctacacaaatgcaaagtgtttgtttttg

SEQ ID NO: 3627 - DNA, 2048 bp, Homo sapiens
gtatcatgtaattgaattcttacaacaaccctatgagattggagtatccttactttacagttaagaaatcaaaagctcaaagaagcagatttcaaactcatgtccaaaaccttttataccaggcagatattatctccattttatagcttcaaaactgaaactgcaaattaagtgttttaaccaagatcacgtagccaagcagtggcagagctggcacttaaatgtgacggtagtgattctttctgttatatctcactgttaacctggaaagatgaattaacatggaatgaagaccaaagccagaagaataattaagggtgttgtagtctttaaaatgagatgatagaaataccaccaggcaggggaagattggagagatgattggatgtaaaggttaccaatgcctagactaagtatttggtaaatggcccatagattctcctgtcctctgtatacttggagtcagacagatctttgttctaatgctggcacttccacctgttagctgaggtactctgagtacatcatttctcttttctgtatttcagctacttcatctttcaagtgaggataatgtcatgtgtcctcacagataaattgtgatgataagatcaaaagtgataatgaaaatacttggtaactggcagagggccatgccatttgagttggtaatggctaaacttctttaatccatgtcccaaaattcactacttttgacctgtctctggccttttaaaaaataagtttttagacacattcttcattcttaatatgacagtgacttgcactttgccagttgcattataacagactcttccttggaagaaagtccactgtttattgcattccccttagtaaaatgcagtaaaaatgtgttctgagtcttggcaatgacagggagacagcatgatgatataacacaaagaaccaactattaggggggccttgggcaagtcacataaccacactaaactggttctttcacctgtaaaaggcagataataataaccacctttgcgctggatataagaattaagtgaaggccaggtgcagtggctcacacctataatctcaactctttgagaggccagggcaggaggatcgcttgggcccaggagttcaagaccagcctgggcaacatagagagacacccccatctctataaaaaataaaaatttaaaaataaagaattaagtgaggtaatgtgaggacacagacatggcacatggtacattcaagacatgtgaggctttaagatgtgtagaccttgtgctgggaaagaatagcacagctcaccaactagacctacctctgggtgtataggatgacatcacaccatctcactttcactcctactttcctctaaggaagcatattctgtcttctctcaacattacttttttccacaaagcaaaatcctctcagctagggttacatggaaatgtgaccaaacatccaagaagttttgagtgacttttgttggtagaattttctgcctagttttaagaacagttgggcctgagccttccaagaggtggtggatctccgatgtgaaagttttctttgaaatttttatggctgatttcaggacctcttcagtttttacagccttttccagctttcagttagacagaggaattaacaattactaatgttctgttccacgccagaccttgtgcagacatttcagaaagtattctgtcatttaattttcattcaaccctaaagcatagatagtagtcctattttacaggttagacaactggggctaagagatattaagtgctatttccagcaccacacacatagtaactgagataattgggattctaacctccaaagtctatgctctttaccctaaacagaaaacattttcatataatgtgttgggggtccccaagactatctctaagttcagtgatttcctgggaagactcacaggactcagcatataatcacacttgtggttatgagttgttacagcaaaaggatacaaagcaaaattattgaagaaaaaaggtacatgggcaaagtccaggggaaaccag

SEQ ID NO: 3628 - DNA, 1029 bp, Homo sapiens
actaatgagagaaggaaactgtcttactcatcttatctccagtttctaacacagggcctacatcttgtaggtgtgcagtaaatattttataaatgtgtaagtggatgaacaaattgtatggggaaaaactggaagttaggagacttgattaacaggttaatgccataatctgtgagttagtgatgaccggatctaaactgaggcatcgttcttgaaaaatgtacaggctccatcctaggttaccaggcagatgtgtacattgtctctggattggtttagccttaacataaactctcactagttagccagtttcatctaaagcagacactgagatggcaatccatagtttgaaattctgtcactaaagaaattagtaagccagtcctaaatccagctttttagctgactcccacataccacttctatccagatgaaaaagaatcttttctaaacatctccatcagaaattccagagacttacattctagcaaagcaagacaatctcagttaggacttggaagttacttgctacttgtgaattcatctctgtttttatagtcctacacaaactattttgaaatttctctgtttaaaactgttgattactggagtttacaaaaataaccaggtagtctaacattatattaaaggctcaatctttgatataataagtagtaacctgaaagagtgtcatgtcagatttgccataatccttatttcactgtttttgagcaccagcagataatgattttacagacaaatccatttagcagatatgaacttataatgcagatgtatgtggaaccaaatgctcatttggtgttcattttttaaaaatctgctaaacaccaagcactgcttgggggtcagaataaagagataaatatggcaaagtctcttcagtttgcttaaggtctgaaaagagaaatagacatataaataaatggtgacaactctgcagaataatataaggctggaggtaaatatcattccttagcatcttgctcttctctaaggagaatccattga

SEQ ID NO: 3629 - DNA, 1087 bp, Homo sapiens
ttacctctccaaattactttatcctgattttcatgcctctcatgggggatactgagaattatctggcatttttcttccagttacagatttgccttgaccctggttattctttccaattacctatcatcccaggaaacaggtacttgcaatatggtatgaaaaacagcaatggcaataagtatgatacggaaatgacacaaacaagacttcttaaggagtaaacatttgagtcttaaaggatgatatgtagacatttagtaggtaaactaccattaatttgttttgaccattaaatctacacattttttagggacttgctatatatccgcattgtgctcaacaccaggagatatatggatgatgcattcctttagatgatcagtgacatgcaaacaaaggattgcatgtattatgacataaattccgtgatggagatacatgtagggtgttagagctgcctagcagagttaggcctcaccagggcaaattttttaaagctgagacaacaaattagcagcattgtggcaggtagacttgtggagaagtatcttctagaagaaagaagggtacttttccaattgatggttagattggaggagtacactatcagccaataacacacatcataattaagttagggatacttggttaggcagaaagattctaatttcagattagatatttcactttaacaatagccatacatacttctcatttcctattatactcatctttgcagagtatttttagcataaaccacaccaaaatgtgttagaggtttttggttttatgcctggacatatataggcaaaacgcccctatcaaaaattgtagcagactagtaaaaactattttctttctttccttccttccttccttccttccctccctccttccctcctccttccttccttccttccttccttctctccctccctccctccttccctccctccctccctccctccctccttccttccttccttccttccttcattccttcctttctttctttcgagacagtctcgctctgtcacccaggctggagtgcagtggcgtggtctcgactcactgcaacctccgcctc

SEQ ID NO: 3630 - DNA, 1043 bp, Homo sapiens
tttctagttatgaaatattagctgactttgggggtaatatatctagttgtattttcttttatgtaacatttaaaaagtagccatcttagtattttccaaataaaaattgaaaccttctaaagccttctcaagaggctattgagaccttcccaatgtcttaaacctgacaggcacctagaaacattttttcttcttatacagattcttttaaaaagaattggaagaaactgttcttgccttaaatataacactaacttgaattcctatgtttggagacagtcatattcctcatgaatttttatttcccatggggccttatatggccatgtttgcgagaatttgggagctgaaagtacactttcatgtgcattgtacctttaccttgtttactactaaactgagggactactactggttgtttctggggacattaaaaaaatagtgtgagttctcaccataaaaagcaataagtatgtgaggttatgcatgtgttacttagctcaatatagccattctacaatgtatatatagttcagaacatcagattatacatgatatatacaatttttgtcaattaaaaataatgaattaatatataaaaaacagtatgagtgccagtcctgttctttaaggaatttgtcatctaaagttggagaaccaaagcatatccttacaaaaagtatccctagcaaagatttgttatatgatctagaagaattcagaaggaacaatctttatagtcagaaaggactttaataaagagctaaagttttttggttttttgagacagggtgtcactctgttgctcatgctggagtgcagtggcacagtcagggctcactgcagcctcgacctcccaggctgaagcaatcctcctgcctccctcccagttgctgggactacaggcgtgcaccaccacacctagctaattttttgtatttttagtagagttggggtttcatcatgttgcccaggctagtcttgaactcctggactcaagtgatccacctgcctcagcctcccaaagtgctgggattacagga

SEQ ID NO: 3631 - DNA, 1050 bp, Homo sapiens
attgttctgttataaagacacttgcatgtctatgttcattgcaacactgttcacaatagcaaagacatggaatcaacctaaatgcccatcaatgggagactagataaagaaaatgtggtatatatacaccatggagtactatacatccataaaaaagaatgagataacccacagaatggaagaaaatatttgcaaatcatatatctgataagggtttaatatccagaatatattaaatatattaactcctacaacacgacaacagaaaattaaacaattcaattaaaaaatcggcaaaagacttgaatagacatttcttcaaagatatacagatgaccaacaagctcatggaaagatgctcaatgtcagtagtctttggggaaatacaaatctaagccacaaataagatgccacttcatacctagaaggatggctataattttaaaaatggaacataagaatttatgaggatgtagacacaaatttagaacccttgtacattgctgattgggatgtaaaatggcagctgctatggaaaacagtttgttgactactcaaaaagttaaatatagagtaaccatttgaaccaggtattccactcctggccatatacccaaaagaactgaaaacagggactcaaataggtatttgtgcctgaaagttcattgcatcattattcataatagccaaaaagtggaaataatccaaatatctatcaacagattaatggataaaaatatggtatatccatacaatggaatattatttagccttaataaaggattgaagtactgataaatgttgcaacataaatgaatcttgaaaatatgctaagtaaaataagctagacacagaaggacaaatgtatgattcatcaataggcaaatttttgaaaacaatcaaataggcaaatttatggggacagaaagtagatttgagtttgccaggaactaaagatgtagggtaaattgggaagttattgcttaaagggtacagagtttctttttgagtaatgagaatgttaggaaatagatggtggtgatagtttca

SEQ ID NO: 3632 - DNA, 1092 bp, Homo sapiens
aaacggatcagtttccgcttttcctgattattatgggaaagcgatcatctaatgaagtgttgaatgtgatacaaggtaaagtacatgtcacaaggagagtaaagccttcctggtatgtgataactttatagtttttccacccaagctgacaatatttctattagtaaatatctttgcatttgaaaatatagaatatcctgaaaaatgtcttcaaaaaatataggtgctataaaaaataatatgctgcatgaaaatctaaaagaaacatcttaataaaattgcacaacccttggggcacaggatgttcaagttaaatgttcagaattgctaaattgtataatctatcaattaggacataatcagttgtcaagtgtgacatttctatttatattgatttattgttataatgttgattaattggaagaagtacttatctttagttatctagaaaatccagtcactgtatattgaagattgaatttttcacagtgacaattgtttcttcttatttgtatgattccatgtttagggtgcaaccctgaagcatgaagctgtgggatgcctgtgaatttaaccacagtgcacattctttaccaaaaaagaagtgaatgattttgttttgtttactgttagtaatgcactccaagggttggtgtaaaatattaccttgttcattacaaagcttaggttgaacagtatatcttctctatgccactggggaaaagattttcaagtgcctcaagctaaaactatatctggtatactaatttctgcctccatttaagtctgattgggaggaggggatatgtgtaaattgcagtgcctttaaaacccaaataaaaccagacctctagcattttatgttttctctataactagagcattcaatttcataaacagtgtttaaaaagacctccaggggaactgatttgcatagggtaaatggataatgaagataacacttcattcctgctttccctgtcagaggcaatgttgcaagaactagtgtttctcaaggtgtggtttgtagacatcagactagacccttttaggatatctgtaaggtcaaaattattttcctaactgtaataa

SEQ ID NO: 3633 - DNA, 1050 bp, Homo sapiens
gagctcacagacttttgagatatttattagtatttttttcagatcagattggagtttacccatacaaatgaagcaagtgggaattaatatttttaaagtggttgactcaggagactagacacttggtccagtgaagctatcattgcccaaaatatttttatgatgatttcttttaagaactgccttcagagacagattaaagtcttacaaagagagtcctgtgtccagaaagcaatgtgtctcaaagtgtggccattaatcacttgcatcaaaattacctggggtggggttggagacgtattaaaaaggctgtttcctgactcaaatctattgaatcaccttctctgtgggaatggggctgaggaacttgccttttaaataaattccctaggtgatttataggccactaaaggtttaggatcactgcctttaccttagtttcccctagcttagtcatatactctgttttcctaacttagtttagtttaaaccaaagatttaggattatgctatggtttgagcatccccaccgaaactcatatgggaaccttaattcttagtgtggaaatgttgggaggtgcaacctttaagaggtggagcctaatgggagatgcctgggtcatggacccaccatgtccttgactgttctcatggtagtgggttctccctcttgttctcattaagctagtttagcaatcccaggaatggatttcttcccaggagagcaagttgttataaagggaggatgccctttccacatggatccacttcccccttgacctttcgccatattatgattaaatataaatgtatttaaaagaaaatagtgattttagttttgtatccagttgtaaatgtttaaaattttgtggtattgtacaaatgcagcatctataatgtattgtcttattttctaaatattgatacctgcccattcattttctgaatggaaaaaaaaaaacagtgacagtgttggtttagtcaacaaatctttgctaatgtatcttcctgtgcaaaataaagtctcatagagctggcctgtagctataa

SEQ ID NO: 3634 - DNA, 1031 bp, Homo sapiens
ttttaaaggaagtgtattgccatcctaaacatcccaggtcaagggcttaattaatgctttaaaatgaaggttccaaaacaccaggagagtttgtcattttctccctggtttgttttgtgaagagggaggagagaaggtgaggaggaacccctcctgttccatgattacatcctacccactcattttctccttttctcttctgcttttgatttttagtggcggtcttaacagaatgtcaagatcaatttgcagcatggtttaactcaaggtttgcgttctgccagcagcaattgtccctgcaaacaatgccgtgtgttcttgtaacttcagaagcttttagagggatcatggcaagggcagcatctaatgactttattagtgtagggtttcaaaatgggctcagtaattgttcatatctctttgtcagcaagtcataattactgctcagcattgtccaagggtacacttgtgaatagtttcctaatagtactgaaaggaaaaaaggaaagggagaatggataaaagtgatggcctcttacaattgagaataagtcagtctctatatagttgatggctaaactgtttatagtacattcaacattcttaaaacagattatccttttttttttttttgagacggagtctcgctctgttgcctaggctggagtgcattggtgtgatcttggctcactgcaaactccacctcctgggttcaagcaattctcctgtcttagcctcccaagtagctggggctacaggcgcttgccaccatgcctggctaatttttgtatttttagtagagatggggtttcaccttgtaggtcgggctgatctcgaacccctgacctcaggtgatccacctgcattggcctctcaaagtgctgggattacaggcatgagcctcctcgtccggccaaaatagattatccttttaaaaatgttctttgagataatttaaaattaccaatttacgagccttttttactctgatttggatacttcctacactcctacctagtactacagttata

SEQ ID NO: 3635 - DNA, 1031 bp, Homo sapiens
tccatcattactactgttaaggcaaatgggaaaatacacattttataaacacaaggtgaaaattcattagaatgacatattcccaaaaaggggattgactttgacatatgaaactgtaagataattaattaggctggtttattgcttaaaaaaagggtttaacttaaccacaattttcttgccacctatcatatcacagattcatctaaataaaattgtctaattgggtttcctactgtattatctttcttggatttttacaccacatttatccagaggtgtttatcatgaaaactgattgcatcactcattagatgcttttaactttgagtaacaaaacctcaagctttcactctcaattcagtagacgactgcttgcactaatatttattgatccatggggtacatgtcaaaaggtgttatgacatcatttgcatatgattagcaagctgaaatggggacatattaatatatggaaatacagaagagatttctaggcatcacaagtaagattgttgttttgggcttccttttaactgttatttctttatgatagatgtaagtttggaaataaattcctggttaatagcttgcctcgtcccatatctggttaacctagttcagacaggccataaaaatttagagagtcctggacctgtaagccatttggatgtttttgtagtggtttcctaggactaccatctgatattatagctgaggatgttgatatccaatatgggaagagacttgccaagcagatatacttttgcttaaggattactctgactaagcctatagaggcattagttcttcaatcacagtatactgtggatctctcatgtatgtaggagataagtgaaggatattaaactaagtgaatgctttgatgaagtcaccagaatatgagtatcacttgctattataaattaaatttcctaatttctctaacaaattggaataagaaaagaaacatttctatagaatgtcataacccctgtgatgttgatgatttggatttttacacctcttaa

SEQ ID NO: 3636 - DNA, 1066 bp, Homo sapiens
attttttcctttatttttttcttttggaattgctttacatttcttccttaagtgtcaaatataaaatattttatatgcatttgagagtctgctgaggtattcaaatataaagagaattaatgtttaatcctcaatttggtgtaaatgatattgttttagtgatattttctgttgaaatataatatggagacttttaaaagaaacagttttttccttctattggaattctggaataaatgaactgaagtgggaaaataaggctaatgtaactagtaaaatcatatgaaagtgagtaaccaagagtttcttcttataaatggcatggttttatagcacttattaaattcatttgctaagtgtacttaaaattccagtattttagtatatcagtataggccaagaagaattctaaaaaccaataaagctcatttccaagcttttaaagaaatgtttttatgtttagtatgcactagacattagccccaacatttacttaaaagtcattgattagacttgtgaaatctgaagtgaatttgaaaagtattttaattaatagactcactttttcctatagatatggtgattgccatcctgtattttttattggctcattagaagctgcttttcaagaggccttctatgtgaaagcccgagatgtaagtacagtttgaccttttctgattaaaaagtgcatcccacaggtttaccactagggctgaggcaatgcttaaatgttttctgtttttgtttttgtttttttccaaaaacatggaactcttcacgaatttgtatgtcatcattgtgcatgggccatgctaatcatctctgtataagtccaattttagtattatgtgctgctgaagcaagcaccgttttctgttttcattttgagattggagactttatttgtttctggttcatctgctaacctagtcttcaccaagatacccatttcacaagggacattaatgtgataggggtactgctggctcttgcagaaggccttgtgaagcactgaaatagggtttttttttaaatgggaaaaaaggtggatgtgcttagaagg

SEQ ID NO: 3637 - DNA, 1028 bp, Homo sapiens
tagttggtgaatgttgctgaaaggaacatctatttcaattataagcttgctttaatgccagttatgagttctaaatgtttaccttaaacggtttagttatcatctcctccaggaagtttttcctgattcctaccccctatgatttaggtcctctcttctgaatttacatgtcatagcactaatcactctgtgtataatatatggtgctccttaagagaggatatactgtatcttccacataggtccaaacagcgtagcacttaacagtgatttgtaaatgtttgttaaatgttaaaggtaataaatgaatgcaataagcataatcactaattttttagctgtttttaaaattatgaataaatactttttctggatttaaagaattttagggcagccatgacagataccgagagattatctattctcatcagcaaacattaatgaaaaaaagtttatcttattttttagaaaaagctttttctaacctgttagatggctgataaaaaaatatgaagagactgggagttccttatacataattaagtagttcattcttgcagatatttcaataattcatatttgaaatatacttttttcaacaaaattggctttttagatacctccctttgaagatgttgtggttataggattttgttttctggaattttaagaggtttggggattctctactttgtgaagggaaaacgaataatggagacacatggagaatattaaaatcactatcttagtatgaagtaaggtcctgttgttatagaaggagctaatgtattgaacaggatttggagaaagaggatggatgtgggacagtaaagtaaaaggggtaagtatagaaagaagtatatatagaacattcccttttttctcccctgtgtctcccaccccttgttcttaacctgatgcctcaaaggagggggtgagtactaggcaagattaagcaaagactgaattgatagcttacctgatagaggatgtgagaagatttgtcatactcgtcctttgtttctttt

SEQ ID NO: 3638 - DNA, 1264 bp, Homo sapiens
ttaattcagactcttttttcctaggaggaaaagccaggacaagatgcccagcagcactatgtccatgtcccgagaccaaagttgttagcatgactgcctaggttttgccaaggaattagatgctgctggaaaaatatccagagctcttatatttgctatccaaagagttccacagtgttgaggggtaaatggcatctcactattgactagacatgagccaagtggctcgttggtacccttcatgcatacaaagcaggcttgagatgtatccttgcatatttgaaggttctgtggttatgatgagctgaaatgaccactgattaatacagtagctctctaaaataatgaggtttctccactaacggaacctctttatttatcaaacttataataaaatgaggaatctgcttgaggtaaaataaccttttcattgtaactgaagatttcgtcttgattctctgaatttgttgtgattgtagaataaggcaaagggcttgttttgataagatcctagactgttataatcaatatatcatgtgttgactttatatgcttttgttaatgtgactatctaaatgttaggaaaatgaagaaaaatatcttcagaaaatgttacatttctaataatgcacttttcctgtgtatgatggtttttaaatttttcaaactattaagatactgaaattatgtggccataacaagattaccatcgaactgttttcgttcaccaatatgtgtgattttctacaaacaagcaatttcttctgttgaatttcctgctcagcgtcattattttgccctttgcttttcatgtgtttaacactttctgtttcaaagccagtttccatgagctctgccttgtgtcctccagcctgtgcatgtgtatatacgtgtgtgggtatgtggggaggttggtggggggtgagaaatgacagttaattcctgttaactctgaccaagtaatgtacggtgggtatttgtgaatcaaattgtgcattgtgaaaaatacgtatctgtccactcctgttttcctagtgaacattagcattgattatgatgtggacatatttctcagactttctgggtcttcatctaaatagcagcagcaaataatgaagtattcagagcttaaccatcatcatctcatgtttccttgagtttaaattgaagtaaaaatggagtaaaagaccatcttatttatttttaaaatctgctatccgcagaaagtaattaactcaagatccacaattagcctcacagcagt

SEQ ID NO: 3639 - DNA, 1046 bp, Homo sapiens
atgaaaaaatgctaatcatcagaggaatgcaaattaaaaccacaatgagataccatctcacaccagacaaaatgactatattaaaaagtcagaaaacagtagatgctggcaagactgcatagaaaagggagcacttacatactgttagtggtaatgtaaattagttcagtcactatggagagcagtttggagatttctcaaagaacttaaatcagagctaccattcaacccaacagttccattacgggtatatacagcccctccccagcaaatagattattgtaccaaaatgacacttgcagtgctattcacaatagcaaagacatggaatcaacctaggtggacatcagtggtggattggataaagaaaatgtggtacatatacaccatggaatactatgctgcctggaaaaagaatgaaagcatatcttttgcagcaacctggatggagctggaggccattacctaagctaagtaatgcacgaacagacaaccaaacactgtgtgttctcacttacaagtgggagctaaacactgagcacacatgggcataaacatgggaacagtagacactgtggactactagagcagggagggagggtgtgggttgtaaaactacctattgggtagtatgctcactacctgggtgcaatatacccatgtaaaaatcctgtacatgtactccctgtgtctaacataaaagttgaaatttaaaaaataaaaataaatcatgctcacattctcatgtcattttttttctcattttgctgggaaacttttttttttttttttttttgagacggagtttcgctgttgcggcccaggctggagtgcaatgacgcgatctcggctcactgcaacctctgcctcccaggtttaagtgattctcctgcctcagcctccctagtagctgggattacaggcatacaccatgacgcccagctaattttgtatttttagtagagatggggtttctccatgttggtcagactggtctcgaactcctgaccttaggtaatccgcccaccttggcctcccaaagtgct

SEQ ID NO: 3640 - DNA, 1068 bp, Homo sapiens
cacaatctcccaaggttgaatcaggaagaaattgaatccctgaatagacgagtatcaagctttgaaattgaataaataataaaaaacttgccaaccaaaaaaagcactggaccagatggagtcacagctgaattctgccagacacctaaagaagaactggtatcagtgctactgaaattattaaaaaaaaaaaaaaaaaaacagaagaggagggactccttccctagctcatgctgtgaggccagcgtcaccctaatactataatctggcagagaccataaagaaagagaagtaaggccaatatctctgatgaacaaagatgcaaaactcctcaataaaatactagcaaactgaatccggaagcacctcaaaaacttaattcgccacagttaagtaggctttatccctgggatgcaaagttggtttaacatacacaaatcaataaatgtgattcaccacataaacagaattaaaagcaaaaaccatatgatcatctcaatagacgcagtaaaagcttttgataaaatctgaacatcacttcttgataaaaaccctcaacagatgaggcattgaaggaacatatctcaaaataataagagccatctatcattaaccacaaacccacagctaacattatactgaatggacaaaagctgggaccatttcccttgagaactggaacaatacaaggatgcctactctcaccactcctatttaacatagtactgaaagtcctagccacagcaatcaggcaagagaaagaaatgaaaggcatccaaatggaaaaagaagtcaaactgtatctctttgctgatgatatgattctatacctagaaaaccctaaggactctgccagaagctcctagaactgatagacaatttagcaaggtttctggatataaaatcaatgtacagcctgagtgcggtagctcatgcctgtaatcctagcactttgggaggcagaggtgggcagatcacttgaggtcaggagtttgagaccagcctggccaacatggccaaatcctgactctactaaaaatacaaaaattagctgggcatggtggcgca

SEQ ID NO: 3641 - DNA, 1016 bp, Homo sapiens
attgccactgaccaaaatcctacagtttcaaatcagatagctgtgtgtagaaaaagagcaatgaatatggggacagaaaatgttgtttctagttcaggctgagtaaaataagtttcttcacctgtgttctgtaccccatcaccttctattttctcaggaaacatatgttatcaataatatctaatatattttttctttgatctcattgtactagaaattctgttcacatttaaacatggcaagtctctcatcttaacagaaacacacacgcatacacacacacagaaacataaacataccattaaagcaaaaccaagaaatcctccctgactttagctactactttctcttctctttacagccaaaattcagagttatctgcagttattatctcaatttttttccttctacttattcgtcaactcatgccattctggctttcaatttgtttctccaccagaatagcttttctttaggtacgaatgactgccatgttgctaaatcaagtagactttcagtcttcactgttcttgacttcttagcagcatttaaaaaaaaaaatgttttgttgaaaacaattaggaaaatacacaaatcatgaatgtacaatttgatgaatttttaaaagtaaatactgccatgtagccagcatccagattaagaaagaaaacattttaaagtatcccagaagccccccctcacattccctttatccaaaagataagaccatagattagttttgcctggttttgaacattatatattatgaatcatgcggtatgtactatttgtctctttcactccctcctttcttcctttccttccttctttgtccaaccttccgtttatgagatggatccatatttttctatgtagttatagctcattcattctcagtgctttattatattccattgtgtggatatttcacccgtttatctgttctactattgatgaggcaggcatttagatagttttcacttctgggctatttaaaatactttctaggagcattt

SEQ ID NO: 3642 - DNA, 1331 bp, Homo sapiens
aaaataagaaagcaaacaaaattatgcaacctatagaatagggggaaagggcatatagtctcaaaaaatgtggggagactgcatgttaaaaaacggttatatttagggaattggctctttttactaacatggcaacttattcctgaatccagaagttcaaaaatgctatcatagttcttacctatgatatttatctattttcagatgtttgtaaatttcagatgtaatgaaaattagccttttacagtatgacatcacaagttttgaagtgagcactaaaatcgctttttgaattttagtttaatgcaaaatatgtcttacaactaaacatggagtatttttgtgacttgactccagggaaccaaaataaatttttacatgaactgtaaccattctcttgacttctgtattatctttgctttattaataaataattagtaacaggaacaatatttaaacaatatttatgtatcttactttgttctaggcattttgctgaacgtcgatatgtttttttttttgagacagaggctcgctctgtcgccaggctggagtgcagtggcgtgatctcggctcactgcaacctccgcctcccaggttcaagcgattctcctgcctcagcctcctgagtagctgggattacaggcatgtgccactatgcctggctaattttgtatttttagtagagatggggtttctccatgttggtcaggctggtcttgaactcctgacttcaggtgatctgcctgtctcggcctcccaaagtgctgggattacaggcgtgagccactgcacctggccttatatgttttatctttaatcttcacgttaatcaatcccgaagggtagatgttattatccccacatttacacattaaggaactgaggcttagggtggtttaacaacttgttgaataacacagaaagaaggggtattgaaaagggatcttgacccgtgtttgactaaaggctacctctttttactataccataaattatttctctgtgaaccttaaatcccaagttcttatcctttctttcctagcatagttccccaattttacctattatgcacagtcagagattttccttaaagaatcttatctggaggccaggcacggtggctcacacctgtaatctcagcacttcaggaggccgaggcaggcagatcacttgaggtcaggagttcgagaccagcctgaccaatatgatgaaaccctgtctctattaaaatacaacacttagctgggcgtggtgccatgcacctataatttcagctacttgggaggctgagacaggataatcacttgaacgcgggaggcggaggttgc

SEQ ID NO: 3643 - DNA, 1048 bp, Homo sapiens
ggctggtctctaactcctgacctcaggttatccacctgcctcggcctcccaaagtgccaggattggaggcgtgagccaccgcgcccagccaagaccttttctttgagaaaccctgcctatgcccttcttcccgtgctgccttctccaaccctcttagaaatgcatttatagttctcttcttctacttaagtttttttcacttttttcttattttgttatttgtttccttcatttctcccttccttcctcctctctggcttcatctgggtcaccacaagcaacttaatgtctatggatctcagtctccgtaactgtcgaacaataactcgtagagttattgtgaagattaaagagtcagtagttacaagaatacttactgctaggtttattttgaagactgaagtagtatgtactagaaagaatgccttaacatggttgacttttggctattactgtgttttatttattgttttaatctatctattcattcacttgacatttgtggaacaactctgttaaaagaaaacttcagacaaattaaatttaacagagtttaattgaacaagaaaaaaaaatgattcgcaaattggcagcctccagaatcatagcagattcagagagactccaggaatgcctcgtggttagaacaaatttatagacaaaaaaaggaaagtgacgtacagaaagaagcgaggtacagaaacagctgtattggttacaggttggcatttgccttatttggaaacagtttgaacatttagcagtgtatcagtggttgaagaatggctgctgagattggccaagacttaactattattataggcatatgctcataagttaggttttcagtcttgtctacctattaagttaggttaagcttcctccaccaggactcaaatgtagaagtccggagccctaggctgggcatggtggctcatgcctatactcccagcggtttgggaggctgaggcaggtggattgcttgagaccaggagtttgagaccagcctggccaacatggtgaaaccctgtctctactaaaaatacaa

SEQ ID NO: 3644 - DNA, 1048 bp, Homo sapiens
ttttttttgttgtttttcttgcttgagtgagaaatttgatagaaaatgtgctacctttatttttacaaaaataaaagaataatgttcatacatgatggtctactgtttacctgaggaggcatgaagaaaacagaaatgttctcagtattgtctaagaacttgttacaagaaatagtaatattaatagaagaagataattaagacctgagcatatcattaaattctctgagctttaattttgtcactaatttgcagaactattatgaagataagtgataatataaatacagtacctggctcatagtagacactcagtaaatgagtcgacattataattaagataactgcaaaaaaagttattgtaattacagattacaattacaggcaagaattggctggtttaaagaaatgaagtgatgtctgagacttgcttcagaataacctatgtgtggcagagtgagtgaggatagagctaatttagattaggcatctatcaatcattgttgaatctaggtgatacatatattgggtttattatactgttctctcaacttttgtatatatttgaaaattttcataataaaaagtttaaagcaaaaatagttgtcttgtttaagagcagggacataagataatagagaaactctggaaatgtggggcttcacagggttggaaaagccaactgcttttgcaccccacccttgtagaaaccagactgaaattggcttatcaggtacaagttccaagaatgataggcaaagtcgatgaaatatgatcaattcttctgcctgtaaaatagtgccttatacattttaggtgctaattcattgaattgagttggcatggtcttttatgagacccatgttttaatggtttttataacatttaattttttgccaaagagttgtcatgcagtctaattactataggaaaatatggaaagcagctaaaactgtttgtttccaagactgtaatactacttggtgctcttaagtcacagcaaacacaagagggaatccctattaagaggcttgattcttttagcctc

SEQ ID NO: 3645 - DNA, 1051 bp, Homo sapiens
tcaaaaaaaaaatgtgtaagacaaaaaggcccttaggaaatgttaccctgtgaagtgccacttgtccttaactggaatttaacatactctaaagatgaaactccgtcagaagcaacacaatattggcagctgggcatgccagccactgcaccccagcctgtgcgtgtgttctttttacttctctaaagtgctctcaagtcccaaatcaatcagtgtccttccccctctctttctcacttccctctcttctttctttccctatcatctatttctccctatctctttaccctccatcttcctctcttctctttcctccttttcccttttccccttcttctccctttcccttccccctccctctttcttcctcatatttcttcatcttccctccttctctgaaagaactgtgtccttcatctgatccatgatgactttaaattcatctgtatcattttatacaaagctgtattttatcattgaggtttcctagaatactaacttttttcagaatcgtttttatgttttgtgtacattttggatttttttcttccctgcaggattatgatttcaattttttattaaatataaccatcaataaagaaaatggaattgtaatctattagtaaaatccccactcttttgatgcttttgctatcttatcacttgtgcttcatccatatactggtaacatctacgtatggtaacagcattggtatgcatggaattatttttgaaaaacactaaattgttgtttagtgattgtggttcaacataagattcttttagtttaaactcagaatactctgtgaatttagcctttgcattggaacaatcaaacattagcctaatatgctttacatgggactctctcagccaagttctgtctgcattagccagtttattctatgacaagttgcttaacagatgtcattctggggagaacaatgaagccaaatacttgtgcaatggctaacattactctgactttgatcacttttgttcagcacatcagtctggcgttgtgcttaataccaacataacactatagcca

SEQ ID NO: 3646 - DNA, 1045 bp, Homo sapiens
atggtggtgggcacttgtaatccctgctacttgggaggctgagacaggagaattggttgaacccaggaggcggaggttgcagttagccaagatcgcgccactgcactccagcctgggcaacaaagagcgaaactgcatctcaaaataaaataaaataaaataaaataaaataaaataaaataaaatagtacaaggtgacaggggtttagcattgctctagcaatagctgttctcatcttttctttttcaatatagagtatgaagcatgagtgataatgttggggaattgagagaatgatgctctgaaataagtgactttcattggctatgattgccaggctgtgacaattttcaaggatagacaacctcaaatttacttattactgtcataatgcagtaaaacacgccaaaaaataaaatatgatcaaatgcagttaccgtttattttggactgcatgacaatattcacttgcacaaaaccatataaacaacacccacctgtgtttgaaggcaaggtatctttgatcagaatctctgaaatatccctttgagttagctatcactatagcaaactttattaatttgtacctgacagtaatttaggatttatgattatttagttgaactaaagcataaatatatgaaggaagagttagccaagtaagtgaatagtgtgagtaacaatttctttggcaaggagtgaggggaggggatgatctacagaaaaagaacagagttttccagtttcagtttttagggatgtgtcatggtacaataaaaaaaaaaaattgccttggggcccggagcaatggctcacgcctgtaatcccagcactttgggaggcccaagtgggtggatcaggaggtcaggagttcgagaccaacctgaccaacatggtgaaaccccgtctctactaaaaatacagaaaaattagctgggtgtggtggcggacgcctgtaaccccagctacttgggaggctgaggcaggagaatcacttgcacctggctggcggaggttgcagtgagccgagatcatgccactgca

SEQ ID NO: 3647 - DNA, 1049 bp, Homo sapiens
gtggcatatatttattttgcctttattactgtttcgatgggaaaatactgcaaatatttccgaaatcgagttggccatactgacaagttgaaatgtttaagcagcgttaatgcaatctgctcacacctgatatcctatgcagaatgattcaaaatgactacatcaattattaaaagaaatatttaaaattctgtaaatgtgccattgtgtgccacagttggctgaaactgttctccgtggcctgctatgtagattatcaaatatatcttaagcttcaaggacttaaaacagtaaatcttttttataccattttctaaatgtcattttaaaaatgttccagaaatatttttgcaaagacagatattcttatgtatttcttgtcaagaatttggtttcttctcctttttcctttttttccctttaagttaatttaaaataatatttttaaatgctagtttgccaggaacaaataaatgcagttgctacttatgtcacttgcttctctgtgagtagacaggtacacataggctgttttattctgtacaacttagataaaggatgtgggacctctctgggcctagttctgtgacttttctgcttcaacttgtgcaacacctgtgatggagggggtagtttcaggtgaaggacaaggtgcccttatctacagctattcaatccacaatgacacttaagtatgtacattttttcttgttgcatgattggaaagttagtttgattgcatcaagataaaaatataattgtgaaactattttgtagttttattttataatgctagtatttgtcttttattaatgtgaaagcttaatgataccatatgtgctaaattgtaaattaatctatctcaccagtttcaggaatttcttttcagtattaataggtccaagaataaatcctgactaatataattgagggaaaggaaaaaatgttcaaaacacaaaggttcctggtcatttttttagtgtattttatatatatattttttttaatttttgaaagccttgcatttttaaaagaaaactttgcactat

SEQ ID NO: 3648 - DNA, 1025 bp, Homo sapiens
acctgaactttgaaatcatcatgaaaaatgttattagaaattatgtgaaaccaaatgtttatttatctagacatgtttaattgccagcaaagaaagcaattaaaagtagctgtagagtaagaggccaaccttcgttaaacatggttttaagattgttacagaacttgtggtgatgataacatggtgtcttggaggatgttaacaactgtagcagggtgttaattaagaatgatgtaatctgcagctcagaattattagtatatgttagtttagctggacaggagcaaaacctagtttcagttgtgatgagagctcaaatcatatttatagtggaaagattaacattttatttttatgctgttcctgagacaatttaaaaatcctgaatgaaatacaatctaatgtaaacatcaaggccctagctcatttacatatgtgccagattttcaaactgattgctatttgaacctaatctgtcattgctagctgcattagctacaacaaacattacatttacatattgatttcttattttgttttagtgtaaataacccataattatggtaaatttggtcttttgttgacaagaactcatatgactctgtaagtttagaatggaaatttaaattgccatgtgtcacgctttttaatttaaaatcttgatgtagctaaagagataaaaataatattgtagatcacaaagtattcctaaagagacaaaagagagaaaaaatgttagggcatttggaaagatataaatggtaaagtattaatgaaaaattcaataccacattttaaaattattacatttttataattaaaaaaatcacagtaatctcaaataaagtctttgttcttgcttcactatcaggccatatttagaaaataaaatctagtgaagatgaaccttataagccaattttaaattgttatttttgtttaaaatatacagtgcaagaaaagaaataacatatgcacataacaggaatgaaatgagatttcaatcactgtattgatgttagtac

SEQ ID NO: 3649 - DNA, 1048 bp, Homo sapiens
agtctgtattttaaaaacataaatctaaatataagtgttataaataaagagaataaacactaaaaaaaaaaagaagtaaataacctgcatacatctagaagaaagaaaggaatgaggaactcagtcaatacatcagcaaacagcaatttgaaactgaaacagaaacacaggaaaacaagtataatagaaaacagaaaatatgatggcaaaaagaaaaataaaatttatcagaattctccatgaacaagaaagtactaaactctcctattaaagacagaaactctcaaatagaatttacaaaaatagccatatgttgtttaccaaagagacatcttttaaagaaatgacagagaaaataaaggaaaagaaagtgaccccagggaaatattaactgtaagaatatactatagtaataatatttatatcacataaaattgaatttaaggcaaatagcattgaaagacaatttgccaagaagatatgacaattgcaggcttgtatgcacaagtctacaaaattggacagaattacaagaagatatagaccaactccacattgaacacaaaatctttcagaaaataatgtatttaaggccaggtgtggtggctcatgcctataatcccagcactttgggaggccaaggtgggcagatcacgagatcaggagattgagaccatcctggctaacatggtgaaaccccgtctctactaaaaaatataaaaaattagccaggcgtggtggcgggcgcctgtagtcccagctactcgggaggctgaggtgggagaatggcgtgaacctgggaggcagaggttgcagtgagctgagatcgggctattgcactccagcctgggcgacagagccagactctgtctcaaaataaataaataaataaataataataataatgtatttagcaatacatctttgtcagctatagaagattttaataaccccgtaaagcactcatggaatacttagaaaactgaccatgtagtagaacacaaagccagtatcaaagaatcactatcatattgactgcattgtctgg

SEQ ID NO: 3650 - DNA, 1100 bp, Homo sapiens
caatgccaccaggttctttgctaacacataacaaaagtgacttttgctccagttcccaataagttccttatttccatctgagctctcctcagcctggacttcattgtccatatcactgtcagcattttgttgacaacaagttgataagtctctaggaagttcctaattttccctcatcttcttgtcttctgagctctctgcactcttccagcctctgcccattacccagtttcagagacgcttccacattttcaggtgtctttatagcaatgccccacttttcagtagcaattctctctgttagtttgttttcacactgctataaaaaatacccgagactggataatttgtaaagaaaaagagtttaattgtctcactgttccatggactttataggaagcaaggcagcatctgcttctaaggaggcccagggagcttttactcatggcagaaggcaaagtgggagcaggccagagcaggatgaagagagaggaaaggtagcacacacttttaaacaaccagatctcctgagaaccctaccacaagaacagcatcaaagagggaaatcagccccctatgatccagtcacctcccatcaggcctcacttccaacactgggaattacaatttgacatgagatttgagcagggccacaaattcaaaccatatcaacattttttttcttttctgaaattcttgttgctcttctctttaatacagtttaaattgtctcctatatattattatctatatattagctttattattttttgtttttaattttttgagatggggtttttctcttgtcacccaggctggagtgcagtggcacgatctcggctcactgcaacctctgcctcccaggttcaagtgattctcctgcctcagcctcttgagtagctgggattacaggtgtgtgccaccacgcttggctaatttttttgtatttttaatagagacagggtttcaacagagtttcaccatgttggtcagaccagtcttgaactcctggtctcaggtgatctgcccaccttggcctctcaaagtgctgggattacaggcatgagcaaccacacccagcctagctttattttttagtt

SEQ ID NO: 3651 - DNA, 1049 bp, Homo sapiens
acacatgcacacgtatgtttattgcggcactattcacaatagcaaagacttggaaccaacccaaatgtccaacaatgataaactggattaagaaaatgtggcacatatacaccatggaatactatgcagccataaaaaatgatgagttcatgtcctttgtagggacatggatgaaattggaaaccatcattctcagtaaactatcacaagaacaaaaaaccaaacactgcatattctcactcataggtgggaattgaacaatgagaacacttggacacaggaaggggaacatcacactctggggactgttgtggggtgggggggaggggggagggataactttaggagatatacctaatgctaaatgacgagttaatgggtgcagcacaccagcatggcacatgtatacatatgtaactaacctgcacattgtgcacatgtaccctaaaacttaaagtataataataattttaaaaaaattaaaataaaagagagatttaagaataataaatacacagcactttgggaggctgaggcgggcagatcatgaggtcgggagattgagaccatcctggctaacacagtgaaaccccgtctctactaaaatcacaaaaaattagctggacgtggtggctggtgcctgtagtcccagctactcggaaggctgaggcaggagaatggtgtgaacctacgaggcagagcttgcagagagccgagatcgcaccactgcactctagcctgggcaacagagcaagactccatctcaaaataataacaataataataataaaaaatacagacttctatcagaagcagcgcacaccaggaggcaatgcagtaagtgttgaagaaataaaattttcacctagaatgctatattgaacaaaataatctttcagaaatgaagactggagatagttttcagataaaagctataagagatgttaaagtaagcacccaggcagcctgaaagaaaacgataacagatggaagattaagttaatacagagaaatgaagagcactagaaattgtaaatatttggttacac

SEQ ID NO: 3652 - DNA, 2065 bp, Homo sapiens
ggacattgtaggtatgtagaaatggtactgattttcgtacattgattttgtatcctgaaacattgctggagttgtttatcagagctagtagcttttggacagatattgtggagtttcctaggtatactatcatatcatctgcaaacagagatagtttgacttcctctcttcctatttggatgccttttatttctttctcttgcctgattgctctggctaggacttccagtgctgtatatgttgaatagagtggtgagagagggcatccttttcttgttctggtttcaaggggaatgcttctaacttttgctcaattcagtatgatgttggctgtgggtttttcatagatggctcttaatattttgaagtatgtttcttcagggcctagtttgttgaaggttttttgtttgtttttttaatacagagtctcactttgttactcaggctggagtgcagtggcgtgatctcggctcactgcaacgtccgcctcccgggttcaagtgattctcttgccttagcctcccaagtagctgggactataggcatgggccaccacgcgcagctaatttttgtattttttgtagagatggggtttcaccatattggccaggctggtctcaaactcctgaccccaagtgatccacctgccttggcttcccaaagtgctgggatcatagacgtgagccaccacacccagcctgttgagggtttttaacgtgaagcatgttgaattttattgaaagccttttctgtatctgttgaaatgatcatgtggtttttgcttatagttctgtttatgtggtaaatcacattaattgatttgtatatattaaaccaaccttgcatcccagggataaagtccacttgatcatgaaggattagcttttggatgtgcagccggatttggtttgctagtattttgttaaggatttttgcatccatgttcatcattgatactggcctgaagctttcattttttgttgtgtctctgccaggttttggtgtcaggatgatgctggcctcataaaatgagttagggaggagtctctcttcctcaagcatttggaatggttttagtaggaacaataccagttcctctctatgcatctggtagaactcaactgtgagctcatctggtcctgggcattgtctggttggtaggctttttattattcattcaatttcactttactattggtctgttcagggattaaatttcttcctggtccaatcttgggaggttgtatgtttccagaaatttattcatttcttctatgttttctagtttgtgcatagaggtgttcatagtagtctctgagggttttttgtatttctgtgggtttggtggtaatgtcccctttgtcatttttgactgtgtttatttggagctatctctctctctttctctcctgttttttttttaagtctacttagtagtctatcagtcatattctttcaaggaactaattcctggactcagtcttttgtatatttttttatgtctcagtttccttcagttcagctttgattttggttatttcttgtcttctcctaactttgtaattggtttcttcttgtttctttagttcctctaggtgtgatgtgtgatgttagattgttaatttgaggtctttctaactttttgctgtggacatttagtgttataaacttttctcttaacactgcttaagctgtgtcccagagtttctgttacattgcatctttgatctcattagtttcaaagaattgctttaattctgcctttattttattatttaccccatagtcattcaggataggttgtttaatttccattaaattgtatgcttttgagtgattttcttactatcaatttctatttttattgcactggttcagtagtgtgattgctattgtttttatttttttttaatttgctaaggattgttttatggacaattatgtgatggaatttagagtatgtaccatgtacagatgagaagaatatatattttgttgtttttgggtgtagagttctgtagatatctgtcaggttcttttggtctaatattgagttcagatttta

SEQ ID NO: 3653 - DNA, 1053 bp, Homo sapiens
caatttttcactattatacttacctacacgtaatctttttctgtatttccctacaacttatccataatctctgctttttcccaagggctctacttctgtcaattttttttgcatttagaagagaaatttcaaaattaaacatagttggcattttgtttgtttgtttgttttttggagacggagtttcactcttatcacccaggctagcgtgcaatggcacgatcttggctcactgcaacctccgcctcccaggttcaagcaattcccctgcctcagcctcttgagtagctgggattacaggcgcccaccaccacgcccagctgatttttgtatttttactagagaaggggtttcaccatgttggccaggctggtcttgaactcctgacctcaggtgatctgcccacctcggcctcccaaagtgctgggattacaggtgtgagccagtgtgctgggcccattattttttgtttttaataatagccattctgactggtataacatggtatctcattgtggttttgacttgcatttctctgataattagtgatactaagcattttgtgtatgcttttttggccaaatatatggcttctttcaaaaagtatctgatcgtgtcctttgcctactttttaatggggttgtttgttttttgctcattaatttaagtttcttatagattctggatattagacctttattggatgcaaatatctcctcccattctgtaggttgcaaatattttctcccattctgtaggttgtgtgattactctgttgatagtttcttttgctgtgcagaagctctttagtttaattgggtctcatttgtcaatttttgtttttattggaattgcttttgatgtctttgttatgaaatctttgccagggcctatgtccagaatggtatcttctaggttgtcttctagggtttttgtagttttaggttttacatttgagtctttaatccatcttaagttgatttttgtatatgctgtaaggaaggggtccagtttcagtcttctgcatatgactaaccagctaccccaacacca

SEQ ID NO: 3654 - DNA, 1050 bp, Homo sapiens
aatatttattgcacgttagaagcctctctcattcctcctactagcaatttaatctcccctctgaaaccactgttttgacctttgtcaccttggattgcatttgtgtattttgaccttcgtataattgaaatcatacattgtatactgtgtttaacttctttcactcaatattatgtctttgagattcaataattcattcattctaattgctatgtagaattctattatatgaaaataccataaattacccattctactggtgatagatatttgggttctttctagcgttaccaagctgctgtgaacattcttgtacatgtttttggcatacataaacattcttcttttgaccttcaagtggagctgctgaatcatagcgtgaagatatatgtttgtttagagttagcaggtgtagcaaaacatttttataaaatggtcgaaccaatttacttccaccagtagaacagggttccagttactccctatccttgccatcacttaatctggttaatcttttcaattttagtcatattcctgatcctttctgaatttcctttttttttttttttcttaaaatgaattcaggttccaaagttcattttgaatttagccctcataacaggctggaaatcttttttctaacttggtagccatctgcattcttatttcagattgattgtccaaacttatcaaattttcttagctgcattgaggatacctctggtatagtttaccgtatctgtgttttttcatttttttccagtttaaggtccccttgaaaaaatatttttatagtgttgacttaggaaatatataataatgaaatgcagttacaaattcactatggcatttttgaattcatgtgacttgaaatgatttttttctcttaagtgacagagtcttgctgtgtcacccaggttggaatgcagtgatatgaccatagctcactgttgagcttgaactcctaggctcaagtgatcctcccacccacctcagcttcccgagtgctgggactacaggcgcacgccaccatgtttggcaaattttttt

SEQ ID NO: 3655 - DNA, 1035 bp, Homo sapiens
catgtatctttatggtagaacaatttatatgcctttgggtatatacgcagtaatgatggtggggtcgaatggtaattctttcttaagttctttgagaaattgccgaactggtttccagaatggctgaactaagttacattgccaccaacagcatgtaagcactcccttttctctgctacctcaccagcaccttttatttttagagatttaaataatagccattctgactgatatgagatggtttctcttgtggttttgatttgcatttctctaatgattagtgatattgagcattttttcgtatgctttctggctgcatgtatgtcttcttttgaaaagtgtttgatcatgtcatttgcccactttttaatggggttgtttgttttttgctcattaagttgtttaagtttcttatagattctggatattagaccttttttggatacgtatatcttctcccattctgtaggttgcaaatattttctcccattccattggttgtgtgattactctgttaatagtttcttttgctgtgcagaagctctctagtttaaatatgtctcattggtcattttttgtttttgttgcagttgcttttggcgtgtttgtcatgaaatctttgccaggacttaggtccagaatggtatctcctaggttatctttgaggttttaggttttacatttgagtctttaattcatcttgagttgatttttgtatatgctgtatggaaggggcccagtttcagtcttctgtatatgactaaccagctaccccaacaccatttattgaacagggagtcctttccccattgcttatttttgttacctttatcaaagatctggtggttgttggagtgtggcattgtttcttggctctctattctgttccatgggtctatgtgtttttgtatcagtaccatgctgtaatggttactgcagctttatggtatagtttgaagtcaggtaatgtggtgcctccagttttttgcttaggctctttttgcttaggattgtcttggctactcaggctccttt

SEQ ID NO: 3656 - DNA, 1052 bp, Homo sapiens
tcagtcagtcggtcagtcttgctctgttgaccaggctggagtatggtggtgtgattatagctattgcagtctcgaactcctgggctcaagtgatccttctgcctcagcctttcaagtagctgggattacaggtgtgtaccaccatgcctagctaattttttttttttaatttttaaattttctacagacagagtcttgctgtattgcccaggctggtctcaaacccctaggctcactcgatctcccttcctcaatctcccaaagtgctgggattacaggcgtgcgctactgcaatttacatatagtaaaacatacggattttaaatgtagatagccctatgaattttggcacacatatatatcatgtggccaatcccccctccctcaatcaagatttctatcatgtcagaaaatttcttttttggttagtaacccccagctctactctaggcaagcacggatctaatttttattaccacatgttagtagtcttgtctattctagaactctatacgggttgagcatccctagtctggatatctgaaatccaaaatgctccacaatctgaaactttttgaatgccaacatgatgccacaagtagaaaattttgcccttgaccttatgtgatgggtcacagtctaaatgaagccaaaaatttgtttaatgcaaaaaattatttaaaatattgtatgaaattaacttcagactatgtgtataagatatatatgaagcataaatgaatttgtatttagactggggtcccatctccaagatttcttttttttttttggtggggggatggagtctcgctctgtcgcccaggctggagtgcagtggcgcgatctcagctcactgcaagctctgcctcccggcccccgcctggcctccaagatttcttattgtgggtctgcgcatattccaaaatctgaaaaaatccaaaatccaaaatgattctggtcccaagcattttagataagggagactcaagctgtatgaaggaaatcatacagtatgcactcttatacctggcattgttcactcaacataatgt

SEQ ID NO: 3657 - DNA, 1031 bp, Homo sapiens
gcttaagaatgatctaaaattatactggtttggattacaaaatggttttctcttaatatagacctcaaatggcaagctaaaagctaattattgtttcaaggaaataattacccagacccttgactctttttcttggtatctacctacctcccttacaccatttgggctgcatcaacctaggaactcaaaatctagagtttttacatgagaatgaaagtattggttttagttagtcaacatgaaagggtcagtactcctagttagtgaggatccaacactcctgcttagggtaatgactcttaatatacttacagtataacagagtcttaaagtttttgttcagtaaggagaaataaagttcagaattccaagtaagttagaaagtataatgaggcccttgcattcctggtcagtcaggaagtgtaacagagtccaaaactcttagtttggaaatgtaatgatccagcattcttagtcaggaagtataacagtccagcacttaggcagctattgcttagcaactggtatgaaggtttatggaaaggaaacaaactgatggttaaagtgaagttttggaatcattaatttattcaggccatgcttttaattgatctccttaaaattttatgccccatatgtgggtttttctttttaccttaataacttaaaaaaaattttactatctggctttttattttttacaattatcttcatttcttgccatgttaacagattggctacttcaaaatgttgtttttcagataacttcatatctttcttttctttgctagtcaaaggcctaggcctttatcttcctttttgctacaaccctaaaggcaaagaaagaaagggaaaaaaaagcttggtttatcctgtatttcttctgagtttactaatattaattattttttcaatgtattttgttttaatgcatgaatatacatggatattattgaaaaatttaaaactatatggaaacacaaaggagaaagtcaccatcttacactacaacttttggcactttggtatgt

SEQ ID NO: 3658 - DNA, 1188 bp, Homo sapiens
tttaaattattttttggtataagtttaagtttttgtctggcatattctttctgggtgaactactttagcatttcttgtagagtacatttgttggcaataaattctcagttttttgtttggggaagtttttatttcttcatttttgaaagatgctttcactggatatggaattctgtgttgacagccttttttaagatgtttctttgtgtttgtttttcatagtttgaatatgatatgcctaaaggggtgtgtgtgtgtgtgtgtatatgtgtgcatttgtttgtgtgtttctaaagccttacagccttgggtgctgttggtgctcttggatctgtgattttgaaatatttttcttttttattgaggagaaatttatataatatacagttaaccattttaaaacatacaattcagggatatttagtgtattcacaatgttgtgagcccaccagctccctctagttggttttgaaaattcatgattaattttttcttttctttctctctcctctttctaagattctgactatgcatatattaaatagtttgttttttgttctacagcttttgtttgttcttttcagtgtgtttcagtttgagtaatttctgtagctctagtaatttctatagatctatcttcaatttcacttattctttccttgactgtgtcagttctactgatgagactgttgtggacattcttcatctctgttactgttttttttttttttttaatttcaggcatagtttatctttttttgctgtaattacccatctggcttaggtattgtctgtttttctatttgagcctttagcatattaatcatagtcatctaaaatttcctgttctaacatctgtgtcctatctcagtctgtttttttttaatttctaaaatcacgtttattatcaaagccaaaattgcccatataattaatacattagtcttcaatttttatttctgcatgattatgcagtctgaatgactaactcacaatcccaggtggtattacaagttttgctcttcagaatggtgttactgttgtaaggggaaaagtcctcactgacaaagaaatgaaaacaaaatcaagaatgatccgcttgtatcacagattacagagaagctgtcagtgagcagttcctcacctcttgcagcaaaggggatcaagggctaaaaatatctcagaaaa

SEQ ID NO: 3659 - DNA, 1050 bp, Homo sapiens
cacacacaattctgcatttaaagagaatgtgtattgttgaaaggatttaaatgatttccagctagggtgtgtaaggaagagctgtattgataaatgtacactttgattcatagatatagcaggggaaatgcattatatgatacctttaataaagccatgactagtggctgtgtagatgtctttgaagatatttaagtagctctaatgtaatgctatgttgttaccaacatgttggcattttgactcttttttttacaaggatatttattatgttttacttatgccaaaactgacgtatagttctagaggttagtagtctatatagtctagaggttagtagcctatatagtcagtcattctgtatagtacactatagtctatatagtctgtatagactaaaatatagtctatattttaggagtgtggcaagtccaatagcactctcacaaattctatgcttgaattttgggacttatttttttcttagtaattgatttactgcacagaggattaatattttaaaatgtataatgagtgatagcagtgtgtttagaatgcaaggatatctaaaaatgtaaaggaactacagaaaaattgcaaaatagtgtagagctctaaataccctttttcaaacttctgctaatgttaacatcttataaatacagtacacaacaattggcatagtgctactggtaattttcttttttcttttttttttttttgagacggagtctcactctgtcgcctaggctatagtgcagtgctgtgatcttggctcactgcaacctccacttcccgggttcaagcgattctcctgcctcagcctcctgagtagctgggattacaggcatgtgccaccactcctggataatttttttttgtgtgtgtatttttagtagaggcggggtttcaccatattggccaggctagtctcgaactcctgaccttgtgatccacccaccctggcctcccaaagttctgggattataggcatgagccactgcgcctggcttagtacaatattattgactaaactactgaccttatctg

SEQ ID NO: 3660 - DNA, 1882 bp, Homo sapiens
tgaacattataaattctaatctgggccccagaattgacccacgtctcactttctgttttcactatagaagaatttgggtcaggggagaataaaaatctatatggcttgtgtaattttgactaatcaaaatgttagctatagtggtaaacacactgcattaattgaatgaagagccctggcttttcagacctcttagtaatttattgagtatggccttggctaagttacttctctctaacttctgaattcctcatataaaatgaagggtttgtaccctagattatactcaagcttccatgatatatgaagtatttctgaaggatctattttgtcctaattttttgttaaaattcaatgaatagcagtcaattataaatagtagtacagatttttaatagatcttcataagtttgaaacatttgtatacatactattaaaaattattttgacaactttatagtgtagatgatggcaggagaagatgctctgccacttattttacacacggtctctagatatgaaactccttcaataaattaaaatttccaataatctgtagcagatccagggaaagatatctgacatatacttgataacccaatgttaagtgaaataaagtgaaagtaaacattaacctagccatactacgttttaagtacttgatactcttaggaaatgatttttgaactttgcactcaatttctgctgtagtttgctgcctgtgctgacattgctgttttgctgaagaaagactctattcagagtgcttatatttgtctttaactacatgtttcaacctacaagagtgaaacaaatccgcatatgtgtttctatattgtcatggaatttttagtcctcgaagataattttgtactaatagaagcttatagtacagtcatatacactgaagagtcaaaactaaggaaaattgtactgcacataatctgcctcattttaagatccattgaggtactttgagaaatttcctccaattttcacttttgaaggaacatatcttaatgtttgccctaaaatttcatgtagcagttccactactctgctcaggatgtggctgtagaggtcctcaaatgtgcactgcttttctactttatacagtgttatgaacacctgcagttttatgaatgaatagactaaccattgataataatgagtctctgtcctcatccgaaagcagccaagcattgagcactgcccttcatcagtggctatcagacactggtttatatttgcacagatgcttgctacaacaaaagataagttactgtgaaagaatagctcatcatatcaatttctgcttctttgctacagcccattatttacaaaatttttcaatttctctgttttttaacctgacaaccattccatcttctattgtctcttctttaattgagggtttattttgtgttaggcatcatatccagtgatacacttacattatttcacttaatcctcacagcagtccccaaaagtaaataggtaaatgttagttttattatatagatgagaaactgagggctaatgaagttaagtaaactgtccaagctcacatagctgttaaggggtaaagttttgaacccaggcctgtcagttcatgaggaattgtcatagcggtaaaccacattttaagattacttatcacattttccctacctagtatgcttttcttctctgtactggcttttttcttcctaccacttataaataatatcatattgagctttggctgtaatcacatagtagtgctttactctaaatacatttctgctttgttttcaaatagattctcagttctagaggaagggaattgtgtttcttattaattttgtctgtgacatatagtaattgcctaatgaatacttga

SEQ ID NO: 3661 - DNA, 1047 bp, Homo sapiens
ttctttgccaagattgatgtccagaatggcatttcttaggttttcttctagattcttatagtttgaggtcttacatttaaatctttaatccatcctgagttaatttttgtgtatggtgaaaagtaggggtctagtgtcattcttctgtacatgggtagccagctatcccagcactgtttgtttattcaataggcagtcctttccctattgcttatttttgtaggctttgttgaagatcaaatggctgtagttgtgcaagcagctttatttctgggttctctattctgttccatgagtgtttatgtctgtttttgtatcgattccatgctgttttgattattgtatccttacagtatagtttgaagttggataatgtgatgcctccagctttgttctttttgcttaggattactttggctatttgggctcttttttgattccatatgaattttagttttttctagtttgtgacaaataacattggtagtttgataggaatagcattgaatctctggattgcattgggcagtgtggccattttaatgatattgattcttccaacctgtgagcatggaatgttttttatttgtgtggtctctgatttctttcagcagtgttttgtagttctccttgtagagatctttcatctccttggttaaccacattcctaggtatttcattttctttgtggctattgtaaatgggattatattcttgatttggctttcagctggagtgttattggtgtgtagaaatgctactgatttttgtacatcgatttttgtgtcttgaaactttactgaagttatcggttccaggatcctttttgcagtctttagggttttctagatacagaatcatattatttatgaagtgagatagtttgacttcttcttttcctatttagatgccttttatttctttctcttggttgattgctctggccaacacttccagtactatgttgaatataagtggtgagagtggacatccttgccttgtttcagttctcaagaggaatgcttccagtttttggccattcagtat

SEQ ID NO: 3662 - DNA, 1046 bp, Homo sapiens
aacctgggaggcggaggttgctgtgagctgagattgcgccactgcactccagcctgggtgacagagtgagactccatctcaaaacaaaacaaaacaaaaaaacaaatgttttagctttggccattgggagttcagttagctttatatccctttgacgtattcgtttgtcgtatccccatcattagtgtacgtgtgtatgtatgtgtggtgtttacatttgaacacttacttgcattctggcactacaaggtgttccaggttcgtcttgtatattgccttcctaatatcagtcctagaattagccatttctacaaggaacactggttccttttattgaacagtggtattagaaaataagatctgggtactaggtattcttgatttgacctacttttactttccagaacgtaccttaatttcatacatctgtgtctttggccataatgttttctctgtatggaatgttctccaccttttatttgcctgacgtactccatttcatcttgagaagcacgaagcctgctcaagtactgtgtcctctggaatgcatacctttattttctgtaggtcatttactgtctctttttagtcgttttacacattttacatactattatagcacatatcctactatagtattgtttacatgcttttgtcctcttagacagtgagctgcttcagggcaatagttggagcattcttatttgttaaaacacaaaaacacacatacgaaattaaaccagttgtctttttgaggaaaaggatggtagtgatagttaaaggaggatttgaatgactggttttatcaaaactagagtctggggagttggggaggtattggtcaaaggatacaaaatttcagttaggggggtaagttcatgagctgtattgtataacatgatgacagtacttaataagaatgtatgtattagaggctgggtgcagtggcccacacctgtaatcccagcactttggaaggccgaggggggtggatcacaagatcaggagttcgagaccagcctgaccaacatggtgaaatcccgtct

SEQ ID NO: 3663 - DNA, 1050 bp, Homo sapiens
aaggagaactacaaaccactgctcaatgaagtaaaagaggatacaaacaaatggaagaacattccatgctcatggataggaagaatcaatatcgtgaaaatggccatactgcccaaggtaattcatagattcaatgccatccccatcaagctaccaatgactttcttcacagaattggagaaaactactttaaagttcatatggaaccaaaaaagagcctgccttgccaagacaatcctaagccaaaagaacaaagctggaggcatcatgttacctgacttgaaactatactgcaaagctacagtaaccaaaacagcatggtactggtaccaaaacagagatatagaccaatggaacagaacagagccctccaaaataatgccacacatctacaaccatctgatctttgacaaacctgataaaaacaagaaatggggaaaggattccctgtttaataattggtgctgggaaaaccggctagccatatgtagaaagctgaaactggatcccttccttacaccttctacaaaaattaattcaaagatggattaaagacttaattattagacctaaaaccataaaaaccctagaagaaaatgtaggcaataccattcaggctataggcatgggcaaggacttcatgtctaaaacaccaaaagcaatggcaaccaaagccaaaattgacaaatgggatctaattaaactaaagagcttctgcacagcaaaagaaactaccatcagagtgaacaggcaacctaccgaatgggagaaaattttttcaatctactcatctgacaaagggctaatatccagaacctacaaagaactcaaacaaatttacaagaaaacaacaaccccatcaacaagtgggcgaaggatgtgaacaggtacttctcaaaagaagacatttatgcagccaacagacacatgaaaaaatgctcatcatcactggccatcagagaaatgcaaatcaaaaccacaatcagataccatctcacaccagttagaatggcgatcattaaaaacgtcaggaaactgcaggtgctggag

SEQ ID NO: 3664 - DNA, 1053 bp, Homo sapiens
atggaaaggggagggaagtatgggaaggactgtagtcttgtggtttgagtgccagttcagccgcagtacaatagaataccaggtaggtttctaaggtgtttgaccctagtctggcttctgtgcagtatccctggacctgccctaaggcctagggggaaattttcatgctttagggaaggatataagcttggttggcttcaccatctgctgatttttgagacataggaccttgtgcgaacatagttggtagccaggtagtagttacaggcagcctgggatgtgactcagtactgtgctggcatcaggtctgacccagcacagtcccagtgtggcagccataggagtacttgtgtcaccccacccccagctccaagcaactcagtacagagagagagagagagagtctccatttgtttgggagaaagtgtgggaagataacaatagtttctatatgctaatccataaaattcttccagatcttatccaagaccatcaaggcaatacctctagaagtctgtaagagctacagtgttactgggcttggggtgccccctaatgcaggtatgacttagatcacaacaccgaagttctttccaatacctggaaagtcttcccaaggacagatacaaagaagccctgaatgcaaaaattacagtaaatacctaactcatatatatgcccagacaccagcaaacatccataagcatcaagattatccaggaaaacgtgacttcaccaaatgagttaaatgaggcaccagggaccaatcctggagaaacagatatgtgacctttttcagacagagaattccaaagagctgctttgagggaaactcaaagaaattcaagataatatggaaaaggaattcagaagtctatcagagagactgaattaattaaaaaagaatcaagcagaaactctggagttgaaaatgcaattgaactactcaagaatgcattttaagtcttttagtagcagaattgatcagacagaaagtattagtgagtgtgaagacaacctgcttaaaaatacagtcagaggagacagaagaaa

SEQ ID NO: 3665 - DNA, 1111 bp, Homo sapiens
agcccttcatgctaaaaactctcaataaactaggtgttgatgggacgtatctcaagataataagagctatttatgacaaacccacagccaatatcatactgaatgcacaaaaactggtagcattccctttgaaaactgtcacaagacagggatgccctctctcaccactcctcttcaacatagtgttggaagttctggccagggcaaccaggcaggagaaataaagaaaggggattcaattaagaaaagaggaagtcagattgtccctgtttgcagatgacatgattgtgtatttagaaaaccccatcgtctcagcccaaaatctccttaagctgataagcaacttcagcaaagtctcaggatacaaaatcaatgtgcaaaaatcacaggcattcctatacaccaataacagacaaacagagagccgaatcatgagtgaactcccattcacaattgcttcaaagagaacaaaatacctaggaatccaacttacaagggacgtgaaggacctcttcaaggagaactacaaaccactgctcaatgaactaaaagaggatacaaacaaatggaagaacattccatgcttatggataggaagaatcaacattgtgaaaatggccatactgcccaagataatttatagattcaatgccatccccatcaagccaccaatgactttcttcacagaattggaaaaaagaactttaaagttcatatggaaccaaaaaagagcctgcattgccaagacaatagtaagccaaaagaacaaagctggaggcatcacgttacctgacttcaaactatactacaaagctacaataaccaaaacagcatggtactggtaccaaaacagagatgtagaccaatggaatacaacagagccctcagaaataataccacacatctacaaccatctgatctttgacaaacctgataaaaacaagaaatggggaaaggattccctatttaataaatggtgctgggaaaactggctagccatatgtagaaagctgaaactggatcccttccttacaccttatacaaaaattaattcaaggtggattaaagactcaaatgttagacgtaaaaccataaaaaccctagaagaaaa

SEQ ID NO: 3666 - DNA, 1016 bp, Homo sapiens
tcaactaatgaggaaagtaaccagctaacatcatgaagacaggatcaaattcacacataacaatattaaccttaaatgtaaatgggctaaatgctccaattaaaagacacagactggcaaattggataaagagtcaagacccatcagtgtgctgtattcaggaaacccatctcatgtgcagagacacacataggctcaaaataaagggacggagggatatttagaaggcaaatggaaagcaaaaaaaaaggcaggggttgcaatcctagtctctgataaaacagactttaaaccaacaaagatcaaaagagacaaagaaggccattacataatggtaaagggatcaattcaacaagaagagctaactatcctaaatatatgtgcacccaatacaggagcacctagattcataaagcagatccttagaaacctacaaagagacttagacgcccaaacaataataatgggagactttaacaccccactatcaacattagacagatcaatgagacagaaagttaacaagaatatccaggaattgaactcagctctgcaccaagcagatctaatagacatctacagaaccctccaccccaggtcagcagaatatacattcttctcagcaccacatcacacttattccaaaattgaccacatagttggaagtaaagcgctcctcagcaaatgtaaaagaacagaaattataacaaactgtctctcagaccacagtgcaatcaaactagaactcaggattaagaagctcactcgaaaccactcaactacatggaaactgaacaacctgctcctgaatgactactgggtatataacgaaatgaaggcagaaataaagatgttctttgaaaccaatgagaacgaagacacaacataccagaacctctgggacacttttaaagctgtgtgtagagggaaatttatagcactaaatgcccacaagagaaagcaggaaagatctaaaattgacaccctaacatcacaattaaaagaactagataagc

SEQ ID NO: 3667 - DNA, 1029 bp, Homo sapiens
gactatccatttttcttagcaccatttattgaagagactgttgttttcccaatgtgtattcttagcacttttgctgagtatcagttggctaaaaatatgtggatttattaatatttttaatttcaaggttctctgttctgttggtctatgtatctgttttgttttgttatgttttttgagatggagtttcattcttgtcacccaggctggagtgcaatggcacgatctcagctcactgcagcctccgcctcctgggttcaagtaattcacctgccttagccttccgagtagctgagattacaggtgcccaacaccacacccagctaatttttgtattttttggagagacagggtttcatcatgttggccaggctggtcttgaactcttgaactcaggtgatccacccacctcagcctcccaaagtgctgggtttacaggcgtgagccactgtgcctagcctatgtatcttttattataccaatactatgctgttttggttactatagctctgctgtatattttgaagtcagctttgttctttttttctgattattgctttggctattcagggtctattgtgcttctatatgaacttaaggattgctttttctatttctgtaaagaatgtccttggtattttatagagatgatgctgtacctgtagattgctttgggtagtatggtcattttaacaatattaattcttctaatcaatgagtatgggatgcctttgtttgtgttctcttcaatctcttttattagtgttttgtaattttcattgcagaggtcttttaccttcttgattaaattgattcctaggttgttgttgtttttgatagctattgtaaatgggattggtttcttgttttttttttttcaaattgttcctttttggtgtgtagaagtactgccgatttttgtttattttgtgtcttgcaacttcactgagtttgtttatcattatcagttctgagttttttggtgaagtgttaggttttctatatgtaagatcatgtcgtctgcaaaca

SEQ ID NO: 3668 - DNA, 1087 bp, Homo sapiens
gcctttttaaggagcaacaatactctgttgtgtgaacatactacatgttctttatttatggatggacatttgagttgtttatacattttggatattgtcaacaatggtactatgaacatgggtggataaatatgtcttgactccttgcttccttaaaagtcttttgggtacataaccacaagtgcagttactggatcatacggtaattttttcccttgtatttttagtttacatgtaataattgtgtatacttatgggatacaactgatgttttcataagaatatgcaatgtgtagtgatcaaatcagagtaattagcatatccttcaccttaaactttttttttttgttgagaacatttaaagtctgcttttttatctttttgaaaatatacaataaattatagttaaccatgtcaccccacagcgctgtagaacaccagaactcattcctcctatctagctgtaattttatatgttaaccaggttctccccattctccctctcactgcccttcccagtctccaatatctacagttgtatactctaattccatgagctcagaattctttttagctcctacatatgactgagagcatgtatttatctttctgtgccttatttagtttaacatagtatcctccaggcttatccatgttgctgcaagtgataggatttcattatttttctttgtagttttgtttgtttgtttgttttttatgtttagagacaggatctttctgttgcccaggctggagtgcagtagtgtgatcatatgcttcagtaatgttaaactctggggcttaagcgatcctcccccctcagtctcccgagtaactgggattacaagcatgtatcaccacatctggctaacttgttttactttttatagagatggggtattgctatgttacccagcctggtcttcaactcctggccttaagcgaccctcctgcctcagcctcccaaatcactgggattacgtgcatgaggcacactacatctggcccaattccattctttttcatggaggaatagtattctattgtgtatataaaccacatttttctttatccatttgcctgttga

SEQ ID NO: 3669 - DNA, 1013 bp, Homo sapiens
aagtccaaaagcagcagcctcatttctgtcctcctttgaatttcatattaaattgcttacatagaatgaaggtcgagttcactggcaggctaacaaagctccttgtaatttggccttatatgccctatgccttctgctgtagtaatactttgatgcttgtaattttcttgaacttacgtcattttgtgtctctgcttttgtcagttctcctgactcttagttttgcctgactctgtcttcatagacttgtgtgtaggcattattatctcctgtgaagtcttctctgacagttacttactccctcctctgtatttctcattcttcttcttttttaaaaaaatagatctgcaatacccatatgtatttctcattcctatatatccatctgtcattatagctatcacattactttgtaaatatctgtttgtctttcttactaatttgtgagttctttacagccaggaagtatatgttacttgttttgctatttctggtacctggcatgcttcctggcacatagtacgttctcactgaatattaaattgagctgaactagttaattttgagcttgttgaaataagaaggaaaagataatggttgggtctttggatgtttattttgtcatcagaatgcagctgttttagctttctgtcatttgcatatgtaaatggacattagtttgttagttaacactgtctgagtgccctgaggtttgggactgtgtcatgttcatctcagtattactagtacctagtacattgcctaggaaatttcaggatgtcagtacttattaaaatggggcaaatgaagttgaaatcagatgaaaacattgatgctgcaaatataccacatcactagtagcgttcataattacttctatgtgttagctttaagaataaatctggctggacgtagtagctcatgcccgtaatcccagcactttgggaggctgaggcaggaagatcccttgaggtcaggagttcgagtcagcctggccaacatggtgaaacccc

SEQ ID NO: 3670 - DNA, 1038 bp, Homo sapiens
cctgctgcttggagtcttgttgatagtagccttaattaaatgatgtatgataccaattgatcagatttagttcaagcctctgtcagttggattaatcagagtgcctgatagtggcatacttgtgagaaaatttatcagctgccaagatggttagaaatgaggagtggatgttgttgggacacaattctctatgtctcgtatgtttctgcacatcttgtgaatagggtactgattgttctagattttcttctcaaggatgttatattgctaccagactagatagtgtttccccagagggctggttgcttgcaccttgaaggtaaagatactttctccctccacagcaaaggtcaggtatgcttacagtccattatgaaagattcacattccctaagcacagggttcctctcccgtaacgcaatccatgatgtatggcccactctgtgtcaccctatgggaaattggccttgggaattggtgtaaaaattgctgatactctgtaaaaaaaaaaaaaacaacgacaactaaaactctggctgccgttattgtgaggaataaattgctttgtccttgtcttaggagtcctgtatcttcctccaatatccatgaaattgtaacaggccaggttgttagcttgccagtaagtagggtggattcttagcttttttgtagttgttaccaccctgcaaggtaggtaatccctcattttgcatattgatcttagagatagtaattataataactacaactaacatttactgaacatttaattcccttcccttccctttcccctccctttccctcccctccccttccttaaaatacagtgtggtttacaacaaagtttacatgtgatgtggtgcagtggcaccatcatggcttactacacctggctaatttatgtgtacatatatatacactttttgtagagatggggtttcactatgttgcccaggctggtctcaaactcccgggctcaagcgatctgcccacttcggcctcccaaagtattggcattacaggcatgagccaccgcat

SEQ ID NO: 3671 - DNA, 1059 bp, Homo sapiens
tacggacctttgcctgttgctaatggcctagctctttggtctgccacttggaaagctatagactggcaagttaaagatagctcttgttaaagctgtgaactatgaaaacaaattatacttgctgatcaaaccatctggatcactcatctagatgcccttagtaagggcctgtcttctgatgaagcccactggaatcaagcttctgattgagtgtacactgcccagagccatattcattatattggatatgacgaatatcaactatcataaactgaacacaaagcaaaggactgtgacacagagggtgccattacatgccagacttgtgcctcctgctaaaagtttaaccgtttgtcacatgatgagagaagccagtggcatgggatgtggctcctgcttgctcctggcagattgaatacattggacctttgacctgcctattcagccagcttcctatcagtggtgcctcactcctgttgccatttttttttatggttttgatgttgctgttctagtccaatcagctggctctggccacgccatcgtgaccctagaaaccaatctgtgttatacttttggctttctggactgtttgcagtctaacagtagtgcaccttttatcgtacaagccactcagcaatgaactgattgtcaaggtatttgatgcttccatgctccctgccgttcataggcatctggtatgtggataaacattgaatattggaacagcttcttcaaaaattgactcaacgatttctgattctacatccttcacctcctcttgatccacacaccttacttattagaaagccagttttgccactgattgtagctgtccccagaaaaggattatctcgtcttgatcactcctgagtaatgatcagaatggaaggggtgggaggttatatagccctattttgagaattcaggattccaccctgaccaattttaggcatgatgtttctttttaccccctagtaacaacccaaggccagcctggttggtatctatcttctatgtggcagctaggccaaaagatggcttaaggaattcagactt

SEQ ID NO: 3672 - DNA, 1658 bp, Homo sapiens
gaccagcctggccaacatggtgaaaccccatctctactaaaaatacagctgggtatggtggcgtgcacctgtagtcccagctacttgggaggctgaggcgtgagaatcgcttgaatctgggaggcagaggttgcagtgagctgaaatcgcgtcactgcactccagcctgggcgacagagcaagactctgcctcaaaaaaaaaaaaaaaagaaaaagaaaagaaaaagaaataagagtctgagatcttcaccattttctctctgtctggctccctctcttgccatgtgatagtctgggttgactgtgagaggctgtctcccgctttgccttacaccatgattgtaagctccttgaggccctcaccagaagctagcggatgctggcaccatgctttctgtatagcttgagaaccatgagccaacaaacctcttttctgtataaattacccagcctcagattttttttatagcaacacaagaatggactaacagagtatatttcagtatactgatgcttgatgcttaggctgtttcatgacttcacatttttggatccttacttttcatgttcctttggaaagtttctatttctctttcaaaaaccacctcctaccttttgcttgtaacattcataccttgtacccagttagggttaatagtttcttttctattttgtacatctctcttcttttgagtcttatgttagattgtcagtgatcaatttacatgtttctttctcgtactgtcagctctgttggggaaacaactgtctggatcttaaccatctgttcctacagtatctagtaaaaggtgctcagtgactatttactgaaggaatattcttagtttaggctgttatggtacaaatggaatagaattgtaaatgtttatgtatttttgatatctatcattgacatgattttgaataataaaatctgtcattgagaaaataaagatttgactaaattgagggttgtaactttaaagtgatgcatatatagagaagtacaaaacacttctgctcttgtttagcttttattgaggggctcaataagatgtgataaaatataggccttgaggccaagaactttgtaaaatttgaatgctgctgctgaatttgctgttttattcactcttcctgattataatttcattctcaaatggattttaaggcatacattttattttcaagtcaaaattgttcaccatgttaaatcactagtcattgactttaaggtgagtttgagttaatttcaaaaagcagtctggtaaaattaacagaataattacacctggctttatatttacttgtggttatgggggaataatagagataggaagaatgagatgtcaggttgtggtaaaggaagaaggaggagttttcaggttatgtgcaccttaatggctttcaggtggggtttgagtcacctagtttttctctttgcagttcatccaggctccctggattctttaatgattgaactataatagaagagtgttagtgagaggaaagcttcttctcttttgccctccccatcctctttttccctaagggaagtagtggttgaatttgttttttaaaatcaattttagatgtatcctttctttaatagggaaagagtaatagcagtaacttctagcttttggttactttgtata

SEQ ID NO: 3673 - DNA, 1032 bp, Homo sapiens
aattggaatctttggagggtaagaagataacaaggagacagataagactatatattccagagtatctctgcaatgaattcacaagcttaataaattacctattcatatttgcggattcccctcccctacagacttgaattgcttggttggtgtcctttctccaggaatactttaaaggataagtaaaggctgttctcttaataaacccagtcgtagtgccactgacatgtaagtatcttaggaaggccctttgaaagtagaactgtatgcattgtgaaagacttggagctagaactaatatcctgtgagtgctacctttgccttttgatgtttggtgaaggaattattttagtgagatatttttggccattttggcatcaacttagaagctactgtcaagtataggcagacttttccctcttttttaatactcacattgcacaggttctaacactagcttagtaggcagtatttttccttgctgaaattttgttgggcttttctctctctctgttctattaagttccttattttttttaaaattaattaatttttttttttttttgagacggagtctcgctctgtcgcccaggctggagtgcagtggcgcgatctcggctcattgcaagctccgcctcccaggttcacgccattctcctgcctcagcctcccgagtagctgggactacaggcgccggccaccacgcctggctaatatttttgtatttttagtagagacagggtttcgccgtgttagtcaggatggtcttgatctcctgacctcgtgatccaccctcctcggcctcccaaagtgctgggattacaggcgtgagccacactgctcccggcccttatttttacaaattaacgttcagataaccattttcagagtttgctgttttggttacccagtgaaatctgatatacaggtattaggaatatgcatatatctacagtttgattaaaccataacctccaaactaataaaggagtgtccttataataaaagttgaccataagattttgatgtttt

SEQ ID NO: 3674 - DNA, 1066 bp, Homo sapiens
tgccaaggtggttccgacctcagggcctttggacgtgctgttctctctgtcagaaacactttctgcaccgggctttctgtaccagatttcagctcaaatgtcacctcctcagggaagcctttcctatccccagactaagtcaggcccaaggactcttctccttggagcctgtcatcaccctcatagtgactcaatcggggggcggggggggggggtctgtcccttaaagtgagaatgctgtgggggcaatggcttggtggttttggtccctgctgtcttccagtgcctggcacagagaagcttcaagcttgctaattgaaagccttcaaaatgctgtcagcccaggaaggaggcagacacatcattaaaagcctctgtcctgccccaggtggctgggctaggggctctgtgcagttggtaaccaggagaaatagagttgaattccaaccaggagactccaggaagacttcctgaaggaggaggtgttttggttagcccagtggttttcagctaggggtgacttccccctgtgagacttttggcagtgtctggagacattctggatgtccagctagggagacgatgctactggcatctggtgctcaggggccatggatgctgctaaacatcctacaatgcacagaacagctcccctgccacccccaccaacaaagaattatccagcccaaaatgtcagtagcgcggaggctgagaaaacctcttttagataggatgtggaatacgaacaaatgtccagaagctgcccatggctgagtgtgccagggcccatacggctgaaattcagggggtgaggagtgtgttatcatggtgggagatggggttcgaaattcctcaaataccagctctcaggattaccagaactgtatgaatccaccaccagggagtttacctgaggcccagctggaaggggtcccagcccctaccccccacccccagcagtggctgaaacaggacttggcatctctctgcagggagctggacagccttgttcagtcctcacaatactgcaagggtgagaaccacccgcactttgaaggaggagtga

SEQ ID NO: 3675 - DNA, 1063 bp, Homo sapiens
cagggtccagcagggaaatggtgaaacaagcaataaggggtgccgagaacgacccagggaccccatttcctgtgggaaaggggctggtcaggagggctgcctcattccctggggctcattgccaaatagaaattcagggtcatttgttcaaatattattaaaatttaaaaacagtgacagcagagaattaaaccaaacatgggccctttttaggcacaggccctgtgcaacagcatagaccacacacccgtgaagctgccctggaaggcttactggaaaaagtgacatttacactgagatggactggatgagaaggagtcagccagatggagggcgtttctaggcagagggaacagcctgtgcaaaggctcagtagtgaatgagggtctagagtatctgagagatggagacactcaccttggctggagtgggaggagctgaggcaggtcccagaaggaagaaggcagggtgatggacagcggactggggatggggagtccatagaagcaacttgggctggagaggaagacaatgaagtggggtctgaaaggaccagaaagtggagtagggggagcttcagtgagcacgaagaggaagagacttggagaggccaaggggctgcctctgccttccagtgccctccctatcctgacagccggtctgggcccaagaaggtgggaccccagtagacatgtcccagagtgagaggacagctcaggaatgaggggactagcggcctagatgatatatatgcaaatacaaacttgggtacaagctaaacttggagtgcctgaggtttgagggttgtcatacctctgtacttcatttcccagttcagactagagttgggggcttccaggaggtaggctggggaggggctagtattcttagccacaggtgcctgttggggccttgggcctcagactagaaattccacatttctgccagctgcccgggtggggctgtccctctttctgggcccagcaccagacaagtttccacaggtggggctgggcaggtggtgctgagtcccgggcctcagacctgcagtgggagaggaaga

SEQ ID NO: 3676 - DNA, 1005 bp, Homo sapiens
agcattgcactccagactgggtgacagaacgagactccatccaaaaagaaaaaaacaattattgaggatcccttctgcatgatgagtcagttttctctcactactttcacagtgctatctttgtttctgtctttcagcagtttgattataatgtaactcagcataggactcttttgagtttatcctacgtggagtttgttgacctttttatatatccatgtcttccctcaaagttggggagttttggccattatttcttcaaataagctctctgcctctttctttccggtataaagattagtgtgggggtgtctccattgttcttttttttcccctcaaacttagagctggaagaaaccttagacatcctgtgggccagaatttcatattaccttccacaaaactaacttccagagaggtcttcaggaagttggcaaattttagttacgtatttttaaagtgtctttgaacttttaagaactacatctcgttaattatatgtattcgtatatattattatccaaattttaacaaattagagtgcattggtgctttaaagtgctgtcaactactctgagaatgcaaaattcttgttttaaaatgtgtatcttacaactccttccttggatgaattagatttttttagatggagaaaccaaaatcaagtacagccataccttggagacattatggtttggttttgttttaggaacccaggctggtcttgaattcctgggctcaagcagtcctcccacctcagtctcctaaagtgctaggattacaggtgtgagccgctgcacctggcccagcatgggttcttttccataccaccacaataaagcaaatattgcaataaaagaagtcacatataaaagttctgttttcactatactctggtctattaagtgtgcagtaacatgtctaaaaaatgcacgtgtcttaattagaaaatgcttcattgctttaaaaaaaaaaaatgctaatgatcgggcacagtggctcaca

SEQ ID NO: 3677 - DNA, 1049 bp, Homo sapiens
catgtacttttctgaatagatgttatatttcacagttaagattagaaaataatatgtattatttccagttagtaagattgcagatcactatggggaaacatttgttcctaatgtctatattccttaattaattaagaatttgtaaagaatatattctttggagtggtgatgaggtttcagctgtgaagtgttgcctctctcattcatggttttgtatgctttgtttaggtagaaacgttgaagcacaatgatccttttgctcctggtggaacagttgttgcagcaagcgattcaggtaaataaataatttatcaacttcattgaacattaaacattttttttaagattcttttttctttgtctctaaatatatttgtcctgttatttatagctttaaaattattgcataattatatccaatagtaatttaccaataataagcatttgtatatcactttctacttatctttcattctttcatttattattcatgttgaatattacactagaatatgaactctacccagtatcagtaaaccaataaaaatgttttgctttataaaatgctgtgttgcttggcagcttcaaagtcagcattgactgttacggatcttggtctaagttaaaagattagtggcttccagtagaaaatgaaaattgctttacaaatacaaatgggttctgttaataatacagagaaaagctaaatgttattttagcatccagtcttcatacttcatttatggtataaaattttttatttattcttttaataactttttaaatagtaatctcattttaaacataaactgaggaccagaatattaagcagtgttcatcaagatcgtacagtttaatagatttgaaccaggtaaagccaagattcaatattaggtctgacaaaaagctttttcaacaaagtaactctgcttcttttctactgttcatttaaaacaaaacagataaacagaccagctatcatttgggatgggagagcagaaaatttgaggaaagtaaactcaaatgtgtaaatactctaatattatgct

SEQ ID NO: 3678 - DNA, 1051 bp, Homo sapiens
tgggattgcaggtgcctgccaccacacccagctaacttttgtgtttttagtagaggcggggtttcaccatgttggccaggatggtctccatctcttgacctcgtgatccgcccacgttggcctcccaaagtgctgggattacaggcgtgagccaccgcgtctggcctaatttttgtatttttagtagagactgggtttcaccattttgaccaggctggtcttgaactcctgatgtaaggtgatccgcctgcctcggccttctaaagtgctgggattacaggtgtgagccactgcgcctggcctgctttgtattttcctactgactaatgttgaacatctttctagatgcttattagccatttgtgtatcttctttggaaaagtgtttattcaattttggtgaagtccagttatctattttttcttctgtcacttgtgcttttggtgtcatctaagaaactattacctaagtcgcaaagatttaatgctgtctttgtctaagagttttatagttttgctgttacagttagatctttgatccattttgagtttatttttgtatatgatgtgagatagaggtcgagcttcattcttttgcaagtggatatccagttgtcctaacaccatttgttgaaaagactgtcctttctccattttgtgttcttgatacgcttgtcaaaaatcaaatgaccataaaggtaaggatttatttctggactcttcaatcctgtaagaatttttttttttttgcttcagtaaagctcagtacctttatttctgaactggtgatgataataccctcccagtactcttgtggagagtagagattttgttagtaaaatttttgctgtaatgtcttcccctccatccgtaacctcaacttgtgatcaaggtaagtatagttggctgtatatttcataaggtcaatgacattccttattttatctactgtgaagtgaagttattgaaataaactttgctttgcttttgtttgaaagttactctttaagtagtggtgtcaccacagtaaatattgttatttggatttcttt

SEQ ID NO: 3679 - DNA, 1026 bp, Homo sapiens
tgctttggtataattttctcactttcctttatgctggagctaaatggagcctgagcttacattttgggttatgtctgagatggaaactgaaatgtagtcttgaagctcgaaggagaaacttggctatactaatctggaggacttgttaaatgctgtcttcccttctccatgttgccgccttttacctttccctgcgaccccagaaatgtactgctgcagaattctttgagctttttctctcattttgtagaaaagaaagtgaagggaggtgtgtgtgtttgtgtgtgcgtgtgcacgcatgatttcagtacaactacaaatgggcagttaaattgttacatcaaaagtgacagctttattttgcaattctgaatctaaggttgcttgggattcgttcatagccactcaggcctgattaaagcatataagaatttaggtaacgatgtttcaaagtaaaagcggagcccagcatgtttgatttgaagagcagaagagataaatgctgctgtggttctttttttactttatatatactgtttgtatatttgatcaattggatttgatatatggtcctaaaatagctttttttgagatgtaatttttgatagagcaaattgcctgtgtattaataatctttcccattttctctgttgtttcattctaaaattgatgcacaccagtgatttaaggggaaattaacacttcagtaaatgtctttttccttagtattgttgactgtttttattagccattttcatttaatttgacagtggtacctaagggttaaccttacagagctgatgcaacccctccttttctttaccagcaattttcattggacactatttccatagcaacagtgacatcagtgaaacctgagtgtttcattgattatttttctcctcttccttttttaatctatcctcttttcaccacattttagtgagaaagcaattttttttttacaaatggagcttatattgatttttatttcataaataattgaaagagggtagaaaaatctgc

SEQ ID NO: 3680 - DNA, 1019 bp, Homo sapiens
agaatataagaaatatggtcaagtatcctaagtgcacacaaagatatgtttagatatttttatttgcctgaaatgagaagaatagttataaaggttaagaatcattgcaagacaacagaataacatttgagcatctctgaaactgtaaactaggtcaagaaaattacttgattttcagtctgatatacaggacaagttttcagtcataatttttttaatagaaagtgatataattgaacatttaattctttttaagttttctgtttagcaatatatgttatactacttggttgtgctaataaaaggaatattgtaagaccagaattttattagataaacatgaatcaaaagttaaatttaattgatcttcttactaagaggaattaatgcctaaagatctccatattttttttttagttgggaatggtcttcaggatatgattagagataacaccatcctttcctccccttcctcttcctcccccatagaccccaaattatgaagagaaatttgtagtcctcaagcttcctccattttacccaaacatagactgtgtttgctgtttagagctgagtcctttgtaatctgttttggattttcaccaagtgagcttccttcctttgctctcccatctttctgccttggctactttgagtcagctcactggcttcttgtagccctgttttcctgcatgcacacttgatctgagcagacactgtcagtgacagcagttagcagcagagcagaaagaattcagtacaaatgtgtgcactgctgatctgtgacactgtagtgttttctatttttgttattatctactttcagaaaccaggagctgagttgatactgaccttgtgtggaatgcctctgaggatttgggatggggggagggtgctagattttcatgtgacttatctctaacatgctgcagcaagactgaaaacattcatctgctcacataaggaggaaagaaaatttccaagattgagcttgcagaatttgttgggtattttcagaa

SEQ ID NO: 3681 - DNA, 1031 bp, Homo sapiens
caagagctttcataattgttacttgaccctcacacaaaccttgtaatttgagataggtggtggtgtttctgttttacaggtaagaaacttaagatgcttagatattttgcccaaaatgatacaagcttgtcagctgcagagctgatacctgatcccaggactactttattctaagttgaatcttctttcttatacataggtactatgtagaacagactcaaatacaatttgatttgaatctgagtatagcagatattattggtacttccttaatttccgtgttccctggaaactttatagtaatactgattgtaaaaatgactataaaattactttttaaaagtgagataatttttctgtctacagggcactgtatctaaatattcacaccagtctttttctttttttaaccctcacaacactttgaagcagataatggctgatatactttattttactgacagtattgagatataaggagattaaatgagttaactgccttatatggcaataatttggcaatgatcttaaccttatctgtgagactatgttgagatttctgtagaaaaactggttgttagaatttttcagttgtaagaaagaactaaacccaaactaagagtgaaatttattgacttgtgaaactgaaacctttcagaggtagggctggcttaaagcattccttgatattgaggctcagatgatataatcagttctcttgctctccatttcttgtttccatttccactgggttgattccattctcagatagactttctccttattttggcaagagggctatagtacatctagctacatgtacttataatttcaaatttggtgaagagtgcctctcttctggcatttcctggaaaagacctgaaattcagtctgattggattggcttattggccttttcctatgacataaaacttctaatattgaaatctgaccagggcaaaaaacacttcgtggtgattgtatagtttaattttgtccttactcacggaaaaaaaaaaatcaaatccaaa

SEQ ID NO: 3682 - DNA, 1044 bp, Homo sapiens
ctgggttgtccaaggcttttttttttctgcccccagcctgcctcttgtcagattgagtaaaggaagataatgacaggatatgcaaatcagccagtttggctatggttaacactgctgggtcaaactataaaaaataaagattgagaattatctgagtattttgtttatacagactttcagttacctatattaatgtgggcattagtcaagagttaactatgtttgaatttactcatttcttaaaaaaaagtaaaaatgtgcacctatggataagtcctaactgacctgtattttcttctgttattttctcttccccacagcattttgattgagatgtcatatggaagtgatacattgttgctctgagttagtagggtagaattgttcagaatttgtgatggatattgtaatggattgaaagagtgacacttcaaagtttgtttcattttggcagaaatactgttttttttcctccctgtagtgggttgtatcccctgcagaaaaagctaaatatgatgaaatcttcctgaaaactgataaagatatggacggatttgtgtctggattggaggtccgtgaaatattcttgaaaacaggtttaccttctaccttactagcccatatatggtaagactttatttgaattgattttttaaaaatatggttttgtatcaattccagtttctgcattttgatttttagtcatttgtaaataggacagtttttgtttcagaattttttatagagaaaatcagaatctgaagaattcttctggctaatggacaaaagcttgagaatgggttacctgaagctttataagattgacagcatccgctgggcatggtggctcacgcctgtaatcccagcactttgggaggccgaggtgggtggatcacctgaggtcgggagtttgagaccagcttggccaacatggtgaaaagctgtctctactaaaaacacaaaaaattagccagacatggtggtgtgcgcctgtagttccagctactcgggagggtgaggcaggagaattgcttgaacctggga

SEQ ID NO: 3683 - DNA, 1032 bp, Homo sapiens
tgctcatgatttttgtagatttagagtttgacaagatcctgtaatttagcttctttaagcacagcagttcctggcttacaacccaggctaacctgagccttctagagtcatgctcttttttttttttttcctaatgaactttaaattttggagtgattttagatttatagaaaagttgcagagagcacagttttccattccccttcgctgttttccctttttaccatattacattaccatggtacatctgtcaaaactaaaaaaccaacattggtgcattattaactccagactttatttgggtttcgccagtttttcctttctgtcacaggatccaatctagggtatcacgttgcatttagttgtcatgttttcagtctctctggtatatgagtttgtcagtcttgccttgctttttatgaccttgacatttttgaagaatactggctagatatcccacagaatgtctcccaacttaggtttgtctgatgctattctcgtgactagactggacaaatgagtttttgcaaagaataacacggaggcgtaatgcttttgtcatcacattatattgggggtacatgatatccatgtgacatcactattgatgttaaccttcacttatttaagataagtgtttgccagatttcaccactgtaaagttactttttcccttttcctactctattctctggaagtatagactcatgccctttttactttgctgtttgtctgcatatctatctattggtttttacattcttactaagccttaaatttttctatcaggtaagttcttagactgaaagtggcttaagcttttgtcagtaatatttgtttgggtcttcattatgtgaagagtttttggcacttagagatgtatagaggagctgtttttgtgtgtattagtgtgtatcacgttgtattaaaattaactgtttacatatttcctcctcctattgggtcgtaaaactgagcacgatcttttccctttttttttttttttttttttttgaaacaaagtctcactct

SEQ ID NO: 3684 - DNA, 1043 bp, Homo sapiens
aaaatccaaaacacttctggtcccaagcattttgggtaggggattcgcaccttgtgccccttttcctgtactagtacttatttctcctatgttgaaaacaagattttcaaccattactctagcaaaatgagtcctttagattatttttatttattttcttccccatcatgttcttttttttagttttaatttttattttttttgagatggagtctcactttgttgcccaggctggagtgcagtggcgcgatctcagctcactgcaagctccgcctcctgggttcacgccattctcctgcctcagcctcctgagtagctgggactacaggcgcccgccaccacgcctggctaattttttttgtatttttagtagagacggggtttcactgtgtttgccaggatggtcttgatctcctgacctcgtgatctgcccgcctcggcctccaaaagtgctgggattacaggcttgagccactgtgcctggccccccctcatgttctaattccagaagaccttagaacattttttgtgactcaaattctagattttgctcagttaatttatttcttttggttttggtatttttcttccagttttgttcaatattaataactagtattcttttggttagaatttgtctgataaatctttctttatccttttactttaataaatagagcaacataatctgtactctttttaaaaattataattactgcaagatagcctgtgtaactacagctgcaagtcattgatttgtttttatttacaagcatcaatattttacaaaactgaattttgagagctgatatcattcttccttgaaaattgaagtaatttaaaaaatacttttgcagtagtgacgtagctaagatctgaacattttaaattatcctcctaaataataaaatataatgttcttatttatatgatcagtccttttggcctatggcagtttatactctgccaggattttggtttgttgaagtataatacaagtttaggtcttattttactagataatcaaaactgacttgaacata

SEQ ID NO: 3685 - DNA, 1045 bp, Homo sapiens
gtgcaaatttcctcttttagttcatccttagaggaaaactatattctcatcagattattgggtgaactttttttttttttctttttgagacagagtctcactctgtcacccaggctggagtgcagtggcacaatcttggctcaccacaacctctacctcccaggttcaagtaattctcgtgcctcagcctcccaagtatctgggattgcaggcacatgccaccacgcccagctaattttggtatcttttgaagagatggggttttgccgtgttggctaggctggtcttgaactcctgacctcaagtgatctgcccacctcagcctcccaaagtgctgggattacaggcatgaaccactgtgcccggctggttgaacattcttatatagaatttatatttattttctaaacaaatggataacagaaaatgtgtgttctgccatcttcattttatttggctttaaggtacataggaacgtatactttgtataattactgtaaagatagtatcttttgtatcacaacctgaccaggtatcttagtacctgcttctaatatggaataattttgcttcaaatgtatctcccaaatttcacatttccttttatttcatttaaaggaaacatgaataacacttgagtttcacttcatttatgaaggcagaaaagttttgacattttatctgaagacatgtcatcttagtaattgaatagttaattccaaatatggttgtattcacctcttccttaaaggtttgataaaactttgctgtgaattcatcagtggtaaatttctaatttcccttttactctcagattttctctttttattttggtaaggaattactaatttcttttactttcaaacttgttgctacaaatttgtgatactctctttcgtggttgttctctttactcactccaagtcttgggagtactcccacttgtatttttacttaatctgattttgtctagtttattgatctgttagaagaaccatcttttgaatttacttatcctttctattatattttgacttttaattta

SEQ ID NO: 3686 - DNA, 1040 bp, Homo sapiens
tgaatattatattttgatgaaagtgaaaaatgttttttaaatgatagtttaaaaacatatgtagtctattctttaaggacttgatttttataactgcagttaaatccttttctcttattatttaacttgtgattttgttttttattgtagcctgaagataaggccaaatatgatgcaatatttgatagtttaagcccagtgaatggatttctgtctggtgataaagtgaaaccagtgttgctcaactctaagttacctgtggatatccttggaagagtaagatattatttactccgaaatgtaatttttatgtattttaattttatatctattatgccaggagcatgtataactctttgttaaaaatatacaaatcttattttaaagttgtatcattataggattttttgttttctgacttaatgtataaaattattgccagcatatttctgtatttggttattccctgtaaaaatgagtggttgaaatgaattacatatgtaagccccttaagtaggtccttttttagtttgtgctgtacactcttgacctcctatttgcttgagttaatttctagagaccatcagtattttatgtctgccacttactctgtggctgtatcatggtgtcttgttgtaaggaatagttttatctctgaaatcataaattcttctctctaacttgtacttcctgtctttatagagctcttttccagaaactagcaagactaattctttgactggttttactaagacctttaaatctgacttcttggctgggcatggtggctcacacctataatcccagcactttcggaggctgaggcgggtggatcacgaggtcaggagttcgagaccagcctggccaatatggtgaaaccccatctctactaaaaatacaaaaattagccgggcgtggtggtgcgcagtctgtggtcccagctactcaggaggctgaggcagaagaatcgcgtgaacccaggaggcagtggttgcagtgagccgagatcgcaccactacactccagcctgggcgacaagc

SEQ ID NO: 3687 - DNA, 1051 bp, Homo sapiens
caccacacctggctaatttttgtgtttttagtagagagacggggtttctccgtgttggccaggttggtctcatactcctgacctcaagtgatctgcccgtctcggcctcccaaaatgttgagcttacaggtgtgagccactgtgcctggccctaagtattattttaaacatgagtattctgtatgatttccactatctgtatgtattttcccatttatgttattattagcgattcataaatactaggaacatctttctacataggatttttctgcaagatatttttgaagcaaatatgctacttgttgctacataagacctctgtagtaattatgaattgttttatatttttagattgtaagtatttgtgcaggtaggtaagttggtagagggagaatgctcttaacattcatacttttctttcttaggaattctttgttgctttgcgtcttgtggcatgtgcccagaatggattggaagtttcactaagtagtttgaacctggctgttcctccaccaagatttgtaagaaatgcttttagatttaaattgtatttaatttttaaaaagtgacaccacgttatttgaaaattaaaagtaatatattaaaaggaattctccctttggccctttcactcagctacttggcttttttccccctactggctcctgctgtttttagttaatttcttgtgtatccttccagagtgattatatatgtatatgtgagaaactataggctgggtgaggttgctcacgcctgtaatcccaacactttgggaggcagaagtgggaggatcatttgaacccaggagttcaagactggctgggaaacaaagcgagacccccatctctacaaaaaaatctaaaatttagccgagtgtgttggtgtgcacgtctggtcccagctacttgggaggctgagatgggaggatcatttgagcctgggagctcaaggctgcaatgagccgtgatcacaccgttgctctccagcttggttgatggtttaagaccctgtcttaaaaaaatatatatatataaatacttatttt

SEQ ID NO: 3688 - DNA, 1028 bp, Homo sapiens
gattttgaacagtatgcaaccaatttctagaggacttatttttaaaaagactcactattgagacattgattggatttataaagtagttttttgaaagtactagcctcggaagtccgatgacaggttgcaaggagaatacacatattgctctgttgcactattttattgtattcagtatcagtcttatccttaaaaatttaacagtgggaatatgaaaacatttataaatgttgacgtttgaagctgactcattaatagtgatgtcactagagctccatgataaatagaaactgcctcagtggttctctgcaaattgtctgcccatctattttctggagaaatgaaaatttagagcttagtttttattggatacagtgatgtctttatagctcattgctcctgaaaaggcttatgaaataataaaatggttaccaaacaacaaaataaataaacagttgtagacttgtacaatacaataaatgacaaaaccatctaagagttttcatactattgactttgcacatacttcatttgcacccaacctgcaatttcccactgacatagccagctggtggcctagtgtgtcttgtggtcactgtacatgccactgcactgcctggcataccaggtaaccaacaggagcaccagtgtcaaatatttctcctaatattttgcaagaccatacagagttaattgcccatggttgcttaagtctgaggatacttttcagtaagtctatgcactccccttgcaaagaagttgttttgttgaatctgtaaagaatcagaacaagaaagatggaattatcactagttctcttccagatttcatcacttgtttatgtggtgaaagcacttatagactactagttgataacttggccagaaactagatatacacagtagagatacaaaatccattctggttttagtgtattttgatataatgattgataatagtttttttaaaatttaaaatttaatttaattttttatttaaaaaatttttttaaatggagacaagatctc

SEQ ID NO: 3689 - DNA, 1033 bp, Homo sapiens
attaattgattgtgtgctttatagtttaagccctaatgtgtacagatattttatatatgtccactataatttatgctgttgcaaataacctttgctctaccatttgataaatttttttctgtagagttatatgtggtacttattatattattgaattatttttctatgtatacatttgagttttgaaatcaaatgagtgaatttttagtttatattttaagatcttgaatggtaaagcagacagcagcaagggttaactcgagcaataatctgaaaaatgctattctgaagggattaaaccgagcatatttaatttggttgcaagggccatttatagtttgtcagagttcacttagcataggaaattggcattaaaagttgtgagcttgaagaagattgaaatatttcagtttgtatatacagttttcacccttctctgcagtctgtattgctttcattcttagtttgttctctacattcttagtttgttctctacattctgttctgttctgtttttttttttttttctggcacacttttatgcggcgccttgtaagatctgggggtggattctggaccatctggcacttcagaatagctcaaaaccttaactctcttgactctactttgagccatacttgcttgaaatgtcctggtttgtctctctgcttggcacgttttctgctttataccctcagagctttttatgactaatttcttccttaggacaggaattttaagagtaccagtattcataagttaaagtggacaagacttatttcactgtaaaattcaccaaaaaaaccctcataaactttgcaatctgtttttaaatgtataattgacatgagcacttatgtctgtttgataaatatttaaaatattcaaaaatggaattttttaaggtactgcttatagtttttctttgattatgaggccagttaggaaagtgtaattctgcaaattgtaaatctactgagttgatttctagtcctagctttaaaatacttcatatgtccaaattaataataag

SEQ ID NO: 3690 - DNA, 1068 bp, Homo sapiens
gagggaagttgtggaagttaggggagacgcccgcccgcccgccccggcctcgcctgcggccgctccctccgcctcctccccgccccgagccccagtcagcccgtcttccttcccctcccttgcatgatggaaacaccatggctgcggcggcccagctctctctgacacaggtaacgccacacgcccgtccgccgggcttggccggccggtgccccctcccccaccgccctcagcttcgccgacttcttggcttgtgggccaagcaggcagcttcttggcttgtgggccgggcggccggtgtgtgtgagggaaagcgggtgcgactgcgggagggcgccctccggagccggagcccccctgcggccgccgcgacctcgcccagggtcgtcgggcgcctcctgccccgccccgcgcggccctcgccgccctccgcgccgctgccgagtggactgtgacccggccgcgctctgccggtgccgggccggctcccgcggggcagctttcacctacccaggaagtttcctcccacagggccgcacgcatcccaggtgagctcctgttgagctcgcgcgggccggccgcacccccgggccgcacgaggctcgcccgccaggccggctgcgcgccgcccccagtaggagttgccttccagagccggacgcgcaggccccccaagccagtctttcctctccagacctgcctttctcccagggtccgacggaagccctcccttcccagagtttaatgtagttagcctcgcctccaaagaagtctcatcctactcaactacccactctgccggccccttcctccgttcagcctctcccccctcctgatcaggtttccttctgggtcagacccccaatgcagccttttgccacccacgtctgcttccacttcaacttcccctcggggggctcacgcctgatcgctgtccaggtggatccctttaacgggtgtggtggctccgccagtcttggtgccaggaacggcctcccggggagcacttttcttggggggaatcctcagcaaaacctgttctcgagcttccctcttgcctcgttgctt

SEQ ID NO: 3691 - DNA, 1050 bp, Homo sapiens
gtgagagtctgtctcaaaaaaaaaaaagagttgggagtgaaaaatattgaagcctgatgttaggccaaataaatgaaaaataattgcttaaggctggacatggtggcttatgcctgtcatcccagtactttgggaggctaaggtggcagaatcgcttgagctcagtagtttgagaccagcctgggcaacatagtgagacaccacttccaaaaaaattaaaaaaaattagctgggtgtagcaatgcacacctgtaatctcagctacttgggggctgaggtgggaggattgcttgagcccaggaagtggaggctgcagtgagctgaggtcatgccactgccctccagcctgggcaataaagcaagaccctggtgtttttttttgtttgtttaaagaagtgcttaagaaatagaagatgatggaaattcactcagtgggagtgagagagaaggcagtctagaatgatgcccagatttctttcttgaagcagtgggttggtggaacaggaacagtagtaagagtgggagcatatgaggagtttgttctgatacgtatttagttggaaatgtctgtggggccttgtacctgactaaggccttttcctcagtcagatgcttgttcaagattctctccctgaactgttttgttattaaccatcctcctccatgccttcccagtttctcagggctggccctttgattggaatatataaatggccactcttgaaattgtggctgctatcctcccctttctctctatcttcattctgcaaccccagaaccagccttagtttctgtcttggccaccaaaagaatcttaagtctcagtccacaaagggaagagaagaaataggctgcctgtttttccgagcaccgttgaagtaccaggcaagggcttttgatacagagtccttagtaccatgaatttcctccagtagaaatcactttagagaagagctaatccctccatttatcccttattttatagataagaaaacagaattcttaagaagggaagaggatgtattcactcagtattaaatgttattttct

SEQ ID NO: 3692 - DNA, 1021 bp, Homo sapiens
tctggaattgccatagttctttcctaaaggggaagctgtagttttggcaggccagcattatcatattctgtttagaagggaacctgacccctctgatgctgggcagctttcttcttaagatgaagactgctgggctgggaatgatggctcacgcctgtaatttcagcattttgggaggccaaggcagaagcattacttaaggtcaggatttcgagaccagtccaggcaacacagtgagaactcatccctacaaaaaataaaaaattagccaggcatggtggcacatgcctatagtctccgctacttgggaggctgaggtggaaggatcatttgagcccaggagtttggggctacagcatgctatgattgcaccacagtattccagcctgggcaacagagtaagaccctgtctcaaaagaaaagaaataaagaaagagagagagaaaaatagattgctggtaatagactaggattttgagtgaaatgggtttggcgtatctatactgtttgttacctttgttgaagattgtatgtggaaaccatgaacagtttagtatagaggctaaaatgggaggaaggaaatggtgagggatgtgtgtgcatacatacggatacatacatagatacatacatacatagccagaactagtatgtcaagcctgtttgtgaagctaaggtgctgggctttatcctgtagaaatggagaaccattaaaggatttaagaagatttgtggttaagaaatatccagagagacaagttatgaagctgttttaaagtacagatatgattccactcataggagttatctaaagtagtcaaattcatagaagcagaaaatataatggtggtttccagtagttggggagaagagggaagagacaagttattttatgggtacagaattttggttttgcaagatgaaaaagttctgaaaatctaatctactgcacaacagtgtgaatatagttaacattattgaactgtaccccttttttttctgagacagagtctcgctctgt

SEQ ID NO: 3693 - DNA, 1026 bp, Homo sapiens
aaaatccaaacttaaaatgacaagcagcactagaatttgttaatattcactctaaaaaatgcattcccaaactcatatttttaattagtcagaatgcctagacttggagggtagacagagccttcaggccagtgctgctgatgcctattccatttacctcattgtacaatataaatattatcattttgcatgtgtacatgacatgaaaaagattgggaaacactgctgaaggtaggaattctgtaatacacctctgaaactgaatcctgagtaagctgtattaccttttacattctggagtagagaatttatactttctaaaaatgaagctgcttactctaaattgaagcaaatctatttcatgtgtctttcttaccaattaaagatgccatttgcattttgtacttcttagtgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctgtaagtacaagtactctgttttccttatagagagcattaaaataccatatttatttagaggtttgtgcatgggatgctgtatagagaaataaatgtttattaatgtggattatcttgaatattcttggctgatgacagctattctaactgtgactgactatccataagaacaacatatgtttcattaattactggcagtgcatgggattatagcccatgctttaggattgatttcacttccctttgctgtcagtttctccacaaccaacactggcatttaggattggttctagctaaattttttaccatacaggaataaccttttttttttttttttttgagacagatactcactccatcacccagactggaatgcagtggtgtgatcttggttcactgcaacctccgcctcccgggttcaatcagttctcatgcctcagcctgctgagtagctgggactaca

SEQ ID NO: 3694 - DNA, 1099 bp, Homo sapiens
cagggtttcaccacattggccaggctggtctcgaactcctggcctcaagtgatccgcctgccttcgcctcccacagtgttgggattacaggcatgagccaccacgcccggcctccagatttctttctgattttctaataggtatattttcttaacaaagtcgagattataaagtatatatataattctgtctcctgctttgtttcatttaatagtatacctgtaataactacataatgagttgtgtgattacattataatttacttaacaatttgcctacagtgaatattgcagaaacattcttaattcaccatctctctttattctatcacggcagatttttttttctgtttttactaattgccttaggtattccctccttcttcaccccgttaccagtctcttttgctttcccctaatcagtgactgttttgttacacgcttctgctgctggctccattctgttaatattaaactaactctttccagagacaacttactttttattgtattctttctggttttaggtttcctcttcatagaataatagcattgagaagaatcctagagatactttaacccaactaactcattttactatgagtaaacagattcaaaaagatttaaatgcaagtgattttctcaggtcatgtaagcacatatagcaagatagtggtaggactgaatttcagccatgggtctcctgactcctagttttgtatcctttcttgcaagaagagatccatacacagcagcatttcatatcctcatagttcttttatccctgctttctctacctctgaaaccaaataaaaaagaaatttacaaaaattgcattattcgagttggaaaattggcaagttgaaacaataactgcattgtacttaacctttccttgtttattggaggataaatatattgaattttaaacattcttgtagtaaaagtcatagagaaacacttacatctgttcttctggaaaatatttttgtttagttgttccaatcagaaaaattcatgctctgaccatcacatgggcacttcctcctcaacagcaacattacaggtaagagtttaagggaaaatttacttcattaga

SEQ ID NO: 3695 - DNA, 1040 bp, Homo sapiens
tatgaagcatagaggatagaatgaaaacatcccatgtattttacttgtagttgtagaaggaggagagagaaaattgaagtagagacaacagttgaagggttgatcactggaaaattttcagaacctgttgtaagacatcaaatcagaggttaaagtctaataacttccaaaaggatacattagaagaaatatggaaaatttttgccagataaagagaaaattttcttcaaaggaagatgagttacacttacagatgactactcaacttcgtgctctgaaggaaaataactaccaactaataactagaatcataaattgtacactaaataaaaatatcttttaagaatgttagtaggctgggcatggtgactcatgcctataatcccagcactttggaaggccaaggcaggtggatcacttgagcccagcagctggagaccagtctgggtaacatggtgagggaaaaaaattagcagggcatgatggtacatgcctgtagcctcagctacttgggatgctgaggtgggaggatcacctgagcctggggagttcaaggctccagtgagccgtgatgtgccactacacactccagtctgggtgacagaattaaataaaattagtttcattatttaagtcaacagaaattatccaacccatcattaatcataccaagtactgaaaagaaaaaaaatgccccaatatatctagcaggtagttaagttaaaagttaccttattgcaagcaaaagttaaaagttttttaaagaagcctgagcaatatagggagaccctgtctctataaaaaatttaaagatttaaaaaaaaatggtagtgcacacctctagtctcagctacttcggaggttgaggcaggaggattgcttgaacccggcagtttgaggccgcagtgagcagtgattgtgccactgcattctagcctgagtgatagagtgagacactatatccaaaaaaaaaaaaaaaaagtttactaaacattttaggaaattaattttttaaatcattctattttgctggaaaaaca

SEQ ID NO: 3696 - DNA, 1080 bp, Homo sapiens
gaggatcacctgagcccagggaggttaaggttgcagtgagctttgattacaccactgcactccaccctggccaacagagtgagactttgtctcaaaaaaaaaaaaaaaaagaaaaagaaaaaaagtggtcacccttaaaggtgggaagagttgaggtataagtagtagatatgatttaatagttattcttcttggaaaaaattattttttaaaaagaaagattgtaccagttttttactaagttgttggattgagtaatatttttaagaagctttttcctgtttactactcagattattagtgatcctgtttttgggtagcatgatagaccaagtattaaatagttttaacttggaaggctgtagagatgaacatcaaaacactgggggaaaaaaaggtatatatatgtcacttgatagtctgtatgctaaggtctctatgaacagattggaaattaatagattcacttttaacttaaaatagatctcataattccaaatagagcattaataggaagaaattataaaagtcacaaaaaaaaagaacactgacagtcaggaaacctgggttctacttctggctctgttcctttctttctgcgtgattttaggtgttttcattttctttcttttttttctcagttttaaaacaagaatataaaattctgaggcctattttagctctaagccagaccatgttataacttcttaactgaatacttcttatctatactttttttctatatctttccatctatctgtaagtagcttttcccatgatctgacttgtttatatttcctattaactgacaaagcatttaaaaacagttaaaaattgtctcgacaggcattttaaatgtcaagacattataaaatactttagatttatacagcaattgtgaacacctttgacaaatgaacatgtctgttcagcctttttggtacccctttttattttgcttaggtagatcaaattctaagttgatcttttctagcagcagggtcagagtctagtgatcgtttttaaaatggcttagatgctacctttcttttctgagaactcagtgtgatataatcctta

SEQ ID NO: 3697 - DNA, 1033 bp, Homo sapiens
aagtcttttaataaagcaataaaaatattgaaatgtttttagaagcttctgcacatcaataggcatccttgaagactaattcaggacccctcatttttaagtgctgtgttgttcattaggaacggtccattgtaattttaagttacaaagattttgccatttctgtaagtagttatttcttctgaggcctaatatttatacattctaccttatagctagaaggtagaatacggtgttcttcagatactaaggatccaatatttccctagaatcctggatttggtcctcagatccccttcatcaatttagttaatgatttttccctacctaagggtacaagaaaaagaatgtagaacacaaaaatctctgcaaatttctgaagtctgcacccactgtaatattaccatttctgctagtttctgcctgatcctggacatctgcagcctcttaactgaatccaagtcagttaattatcagatccaatccaatcatggatccagtccagtttctgttgtgacttccaaacccagttcggatcagaagtttgctcaaactcggttccaaacagaaatctgtcgagcttcagaatctcagcgagaacttaccacgatatcagttgcttccagaaagcaatggacatcgtgagtctgaggggtaccttgcttggtcactccatgctcctgggcatgacatctgttgaaaaccttagacatattaaatttaacagagtttaactgagcaaagaatgattcacaaattgggtagcccaggaaccagaataggttcagagaggctctggtgcagtcccatgattgaagatttatggacacaaaaaggaaagtgatgtacagaaaacagagatgaggtacagaaacagccagatttgttacagttcgggcatttggagtatttgaacatagtttgaacagttggctgcctttgattgactgaaactcggtaattagcacaaaagtaggttacgatctgtttatacatctagttaagtttcagttcactgtgtacagagaaacct

SEQ ID NO: 3698 - DNA, 1051 bp, Homo sapiens
ggggaggcggaggttgcatgagccatgatcacgccattgcactctaacctgggtgacagagcgagactccgtctcaaaaaaaaaaaacaaaacgaaaaacttaaaaaatttgtatttccccttattactaataagatcagacattatttcatagtttgtagacatcaggatttctccttttataaattgcctgcttttctattgggttgttttttctttttataaatttgacttgtaaaaattcattttattttgaatgctaattttttgtcgattatatgagttgcaaatgtattctctaagtccatagcttatgtttgctccttgtttataaagtcaaacattgaatcagttattgatcttttatggtttgcactttttgtatcttattctaaaaattttattatagttttttacattaagaaatctaatttttttttttttttttaagaccaggtctcactccatcacccagggtggggtgcagtggcatgatctcagctcactgcaacctctgcctcccgggttcaagcgactcccacctcagcctcctgagtagctggaactacaggcatgcaccaccacgcctggctaatttttgtatttttagcagagacagggttttaccatgttggccaggctggtctcgaagtcctggcctcaagtgatctgccctccttgtcctcccaaagttctgggattataggtgtgagccaccatgcctggcaaaaatctaattttattactatttaaaaaaaaatatggataaccagttgtccagtcatacttttaaaaaagtataaatcccagagatcaccaaatattttctgtaaaagttctagctaataaatactttgggctttgtcagtcaggaggtgaaattgaggatattaagtaagtacttgtatatcaaaaaagaaaacaaatttctgcaaatttttggtgaaaatttttatgaagttcaaaatatagtatgttttttggtaatacagttctactagtaagaatgatggaattgtttttattgggataacattttgctttattggga

SEQ ID NO: 3699 - DNA, 1083 bp, Homo sapiens
ttaatcttaagaacatacccagagaggctcattttagagagacgagaaaatatcttcacttaaagtgaaggaagtaacgagtatggatgcaggcagtgaaaacttgaaagggtgactttcccctcttatttgtaaagtagtcattgaaatgtacttaggtggtcctctggggaactctaagggaaatagtgggatgcataggggaagccttgagtgtgaaggtttgaaatagctaatgtagaaaatgggtgaagtgtatacgtggtaaatactaagaaaatttgtgggttcttgagcatgaaaatgataaaagtaaagcagtattttaagaataaagcagtagtttaaatctataggatgtggaagactggcttaagagtcagttataattgtgtcagttgtgttgacacaaatggtactagtctttctgtagctgatgtgttcccctcttcacttttctttttgctttccacttaattcactttaaatgtttgctaggctaaatgcccgtgagtacggagatcatgtctgttttattcactcaaggtccagtacattttaggttctcaaataatatttgtagaatgtatgaatgtatgagtgcttacatgccaggcattttcacagaactcatggggatattttgccagaaatttcttagattaaaattgtattctgaagctgggcacagtggcacatacttgtaatcccagctacttgggaggctgagatgggaggatggcttgagcccagtagttcaagaccagcctgggcaacaaaatgagatccctccatctcttaaaaaaatttttttaagtgtattttggccagttttaaagcaattgattttcagagaaaatgaatatggacaggttacagaagtgcaaatgatacaaatactacaaatgcgtatgctgatattgtatattttgtgtggaagcttgtgcttggcatagtaagcactcaaatgttagctattactgtttatatattggataaggccatgaataaagctggctttgtagcattttttgtagtagtaaaaagttggtacaactttattttccattggttgaataaaga

SEQ ID NO: 3700 - DNA, 1007 bp, Homo sapiens
gccctccttggcctcccatagtgctgggattacaggcacaggtgagccactgcacctggcctggctgtggtgcattctgaatagtaaattttaacaatgaagaacacttaacgttaggtattttggattgactaaaacaagtacagagcactttccatgtttaacctgctcgtaaaaagacctgtatttctatggagaaggaaagaacaaatgaaaaggtatgtaaacttctttttttttttttttaatgattaaaaaaaattttgagacaggatttcaattcatcgcccaggctggagtacagaggcaccatcacaacctgccccaccatgtccggctaattttttgtagaaatggaggtggtggtgggggcaggtgtctcaccaagttgcccaggctggtctcgaactcctgacctcaagagatctgcctgcctctgcctctcaaagtgctgggattacaggtgtgagctaccacgccctgtcgaaaaggcatataaacttctgaagggcaagtccttctaatttaaattttggtcagactgttacaagtgaggagatggttatcttaataaattttcaggctgggcgtgggggctcacgcctgtaatcccagcactttgggaggcggaggtgggtggatcatctgaggtcaggagttcaagaccagcctggccaacatggtgaaaccctgtcgctactaaaaataaaaaaattagccagttgtagtggcaggtgcttgtaatcccaactacttgggaggcagaggcaggggaatcgcttgaacttgggaggcagaggttgcagtgagctgaaattgtgctactgcattccagcctgggcaacagagcaagactctgtctcaaacataaataaataaataaataaataaataaataaataaataaataaaaattccatatattatagaaaataatgggtgggtgtgtgctgaataaggtacaggctatttctgaatattatgttgtttactattatatgctgtgg

SEQ ID NO: 3701 - DNA, 1027 bp, Homo sapiens
acactgtaacattgtatacagtgtcatggataattactatttttttctggtcattaacactcacctactctagtactaggatttcagaccaaggtcctcatgacgcctggatattttagtatctatatccaataatcttttctctcctactgaatatccaggcaaagatgaaatcgttttctttaaaactgtcaaattctgtaaaactcaggagccagttcaagggaacaagcatcttcacaatagatggaatcaagagttaaatgttatagtggcaagcttgtctactgggcaacagacaaccagacctgcttgtgagatggcagctccccagccctgctctgtgacctcatttctgtcaaatgaaaggcagcagcttccagctgattgcagcatagtgttcatcaatcacagtaatagcgcaattagccaccaaggttcaagctgtgtaatatgtgttagtggcaacttgtcctggatttaatcttcctcaacaatccaaataaaatatttaaaaactcttgacttctggctgggcgcagcagctcatgcctgtaatcccagcactttgggaggccgaggtgggcagatcacctgaggtcaggagttcaagaccagcctgggcaacatggtgaaacccccatctctactaaaaatacaaaaattagccaggcgtggtggtgggcacctgaaatccctactcaggaggctgaggcagagaatcgcttgaacctgggaggcagaggttgcagtgagccgagatcgtgccactgcacttcagcctgggtgacagagcgagactccatctcaaaacaaaacaagcaaacaaacaacaacaacaaaaaacacctcttgacttctaaagacgcaaaagtggccaaaagtgcaatacagtattgtgtttatttacatctattttaaatgcatgtgtatctgtaaatacaaagtgattcgtgactcattgtctcctcagtctatagcattattaacttctaggagcagcagtggagtagagtgtactgaatgg

SEQ ID NO: 3702 - DNA, 1032 bp, Homo sapiens
agaaaactgctattattatgttttggtacattttcttttaggctcttttctctgtacatattttataattaaaaccagactatagatacatttgtatcctagttttttatataagctaccaatgaaaaattattttcaatgattatataacaataatcatttagaaatactgtaacattttgtttgctttgagacagagtctgttctgtcggccaggctggagtgtagtggtgcggtctcagctcactgcaacctctgcctcccaggcttaagcaattctcatatttcagccaccccagtagctgggactacaggcacgtgccaccacgcccagctaatttttgtatttttagtggagacagggttttgttatgttggccaggctggtcttgaatccgtggcctcaagtcatctgcccacttcagcctcccaaagtgctgggattacagacatgagccactgtgcccagccctccctaactttaaagcccaagtttgcagaatttacagaagtgttagaacttaacaataattttgttacagcaattatctattattattgaacatttgtctaaagattttcccaattgaaataatactacagaaatgtcttcacatattaatctttatcattaaatttcaagaagtagaattactagattataatttctttgttttgcttttaagtggactgcccctgatggtgattattcataaatcctggtgtggagcttgcaaaggtaagtgcaaatgctcaatctaaattcaaaactcagatgtgttgttaaatattaacatttaacaaatattggcactgactctggcccagcactactgactgtttaaggaatactaaagaaacatatgacatagatttcctgccttcatgaaatttgcaattatatttggaggggattttagggaagttaaggtgattaagatacagttatgtcacgtatgggattaagtgctaaaatgtcaaatgaacaatacatgttagaggaagctgaaatgtacggacagagacatgaga

SEQ ID NO: 3703 - DNA, 1042 bp, Homo sapiens
cgcgcaccccgctctgcctggtctactgcgtacggcccggcggcccgatcgcgggacctcaggtggcgggcgcgaacgagaaccctggccggaacgtcagtgtgagttggcggccacgcgctgaggaggacgggagagcccaggcggcgggcagcagcgtcctcagggaactgcatactgcggactctgtagtaaatggaagtgcccaggccgacgtacccaaggaactggagcgagaagaatccggggctgcggagtctccagctcttgtgactccggattcagagaaatctgcaaagcatgggtccggtgccttttactctcccgaactcctggaggccctaacgctgcgctttgaggctcccgattctcggaatcgctgggaccggcctttattcactttggtgggcctagaggagccgttgcccctggcggggatccgctctgccctgtttgagaaccgggccccaccaccccatcagtctacgcagtcccagcccctcgcctccggcagctttctgcaccagttggaccaggtcacgagtcaagtactggccggattgatggaagcgcagaagagcgctgtccccggggacttgctcacgcttcctggtaccacagagcacttgcggtttacccggcccttgaccatggcagaactgagtcgccttcgtcgccagtttatttcgtacactaaaatgcatcccaacaatgagaacttgccgcaactggccaacatgtttcttcagtatttgagccagagcctgcactgaccagaggaggtaggggggaagccatggcttctgatctccactccactttatttctctgggaaaaataggctgcaggtctccagagcatatcgatgcagtactgtactagagctgttgtgactgattcactcaaactttcctgcatacccctgtgccaggccttgggtttacagcataagttcagactaaagagaatggagaactattgtggtgcaacctggcaaatccctcagaggacagagctaaggtggacagggattacctagatt

SEQ ID NO: 3704 - DNA, 1050 bp, Homo sapiens
ccaacatggtgaaaccctgtctctactaaaaatacaaaaaaattatctgggggtggtggcgggcgtctgtaatcccagctactccggaggctgaagcaggagaatcgcttcaacctgggaggcggagattgcagtgagccgagattgcaccactgcactccagcctgggtgacagagcgagactccgtctcaaaaaaaatacatatcaatgacataaaagatcaagatgagtcatgacagccatagccatgtctgattctatactggaaggtttactggagggaaaaaatgctacaaagaacatcactgggcagatgccaggttaaagtatcaaatccatgtttgactgaagtagagaactgtcctacagttgtgtaagagaatatccttatttttaggaaataagcatttaggaggaaaggcctatgatgtacgcaatttactctcaaatgcctcaattttttatggagaaggagaaagggagagagaaaccctgacaaatcaaatgggacaaaatgttaataagtgaacaagaggggaatctgggtaaagtgtgcgtggggttttttgtactttcaacttcctagaagtttaaattatttctcaataaaatgtatttttaaattcctccagtatttataactaaaaatgtcctgggtgtattccatcagcattcacagaaatacccagttgaatacctgccatccacacgggcagatctccagcaatcctgaactcacctctgctctccacatgacatttacactgagttgcccttccgaaactggaagagtagattaagcccttgagtcttcgattcacttcaatgaataatctggtaaaaacaaaaatctaagtgtgacttctacttgataaacagctgtgatgtaactgggacaagatcagtgtggaattatcctttttataccaattctgtacaaagagtgcaagaactgatgctttatattttatttcccctctgccctcccatcccacccttggtgatggttgtacccatttgagcatttctgagcacatgaccataagtaa

SEQ ID NO: 3705 - DNA, 1072 bp, Homo sapiens
agcaggtaacatccagttatagaattctgtaatagtgattttaagggggcttctggcccagcctgtgactcatttgcatttcaaactcatataccttctttatcttctctttcggtgccttctcttgtccttccaagtaaaggttaagactagattgggaggcagaatataggataccgaagtcctcaggttaaatgcctccctccatttgcagatttaactttaagcccaagggagtaagacccttacagttcctcacaactgtgtttctcctaatgcagaagctaacaggccaaaaagcaacagccaaccatgcggcagaactgctggcaaagcaattctgcacccgagggtcacctcaggaaaccaccgtcctgcttgtggatgaggtgaggtgcccatgggcggacaggagaagaaacagggctgtacctcaggagcaagtgctggatgggagggaggaaagtcctggctcccttctccattcatatgagcccattttctggtgctgagaggcgtgtgtcaatggattgttttggtgctatgacttgggaaacatgcagctaaagcagtggttataggtcttcattttgaagcaccagctcagtctctgtgattgactctgcacctctctcctttgccctggcagctcgaccttctgtggactcacaaacaagacataatgtacaatctctttgactggcccactcataaggaggcccggcttgtggtcctggcaattgccaacacaatggacctgccagagcgaatcatgatgaaccgggtgtccagccgactggtaggttctagggcagttcccatgctgttcttgcagatctgtaagcttggccaagaagttctgcaaaaatggtccaggtgtggtggctcacgcctgtaaaccccgcactttgggaggccaaggcgggcggatcacttgaggtcaggagttcaagaccagcctggccaacacagtgaaaccccgtctctactaaaaatacaaaaattagccaggctaatttttacttaggaagctgaggcaggagaattgcttgaactccggaggcagagtttg

SEQ ID NO: 3706 - DNA, 1073 bp, Homo sapiens
aggtggtggctcatgcctgtaattccagcactttgggaggccaaggtaggcagatcacgtgaggtcacgagtttgagaccagcctggccaacgtggtgagacctcgtttctactgaaaatacaaaaattagccaggtaggatggcaggtgcctgtaatctcagctactcaggaggctgaggcagcagaatcactttaacccaggaggcagaggttgcagtgagccaagatggggccactgcactccagcctgggtgacagagactctgtctcaaaaaacaaaaaacaaaaccacacatgtcaagggttaagcacagtgtctggcacataggaattgctcagtaaagtgtccttgagttgtcttaacctttccctttccaccaaattctttctagactctgatcctcctcctaagaaacgtgctcgagtacagtggtttgtccgattctgtgaagtccctgcctgtaaacggcatttgttgggccggaagcctggtgcacaggaaatattctggtatgattacccggcctgtgacagcaacattaatgcggagaccatcattggccttgttcgggtaggtgatgccaccatccttggttctaccttgaagcttatttctgtctgcctcctgaacttcatgaccccagaaatattaccggctctaataccccatagggaatgcattatttcctgtcatcttctgtgcttgcctgtctgtttcatctcaacagatatttattgagagcacgtatcatgtgttaggagcctcctacaagaggtgacatttgggttgtgacctgagggatgagcaggaattagcagatgtatctcagggggatgttatatttagctatgactgtggcatgcataaagcattgtgaggctgaatatgctggcttaaacgaggactgcaccttgagtaaatcagtacaaagagtgctagttgctacagacaaatttgtatgacaggatttcttaataaatcaggtgctaatgagcggctggtttgcaggctgaagtaagtcactggttatgagtttttcctgaagtgacttcaggctccccagcatggga

SEQ ID NO: 3707 - DNA, 1035 bp, Homo sapiens
gagccttagtgaaggccaggatctgggagtgaaaattcatgaattcagtaaacatttactgagaaattatactgtgtgtcagatggtgctaggtgcttgtaaaacaaaatctccattacttgatgcacactttattaggaaagccagacatgttaaatagaaaaggagtttagatgaatcagttaacattgccctagcaaatccaaacaggatgtggatttaagattattacatcacaagattttgacagttgagctagatcttgaaagagatgcaggaattttttttttgcctagagatgagagaggaggaggagtatgcttagctgagggattaatatatgcagtcactgagttttgcctggcataatgaaaaagagtagaaaatattagggctagaggacggaggtatatgggaaagatggtgataaggctagagagggtaggcttagaccatattatggagtttggacttggtttactgagcattggggacctaattaaaggtttttagtggaacgaagacataatcatatttgtttagtaaacgtaggacttgaatgaccttaaaatttattatgttctgctggtgctattgtagtactaataatggctttgactgggtaatgaatattacaaacaaagaattcctagaaacttggagcattttatctaacctacttgcctcagaggtatttgttcttataggcattgtctgagtctggccttcagctctttgttaacttagttcagaacacttgggtcagagtcagtatagttaaactaggagttcaagaagttaaaacaggcactcaggaaatgctgattgaatgaaatgataacttaaaggggaagtgcctggtatggtctcaggcttgttatatttaagccttcttaaaccacccatatactactggggcatccctgtattgtagagtggcagagccttgactgtggttgagctcttctcttgagcaaagaactggggctgaaggaagttactattagtcataagcccttttaggaggggagagtc

SEQ ID NO: 3708 - DNA, 1115 bp, Homo sapiens
cctgagtagctgggactacagactttttttttttttttttttttttagatggagtcttgctgtgtcacccaggctggagtgcagtggcacgatctttgcttactgcaatctccacttcctggattcaagcaactctcctgtctcttcctcctgaatagctgggactacaggcacacgccaccatgctcagctaatttttgtgtttttagtagagacggggttttgccatgttggccaggctggtctcgaactcctgacctcaggtgatccccctgcctcagcctcccaaagtgttgggattacaggcatgagtcactgcacctagcctacaggcaattttgtacagagaataattcctttccagaagtagcccgatatagcagaaagcatgagttttgttgtgagacagacttagctctacatcttttatgtgagacttaacctgttttttctatgggcaaatgacctgaactcctgaatcagtttccccatctgtaaagtgaggatgaaaatagtatctactttattgagatttttcttattcatctgtagcatctttgtgtaatgtcatatggatgtaacttggttagtactattagcaactgtgatgatgatgattgtgaatcttattttcatatcttgggttttcttacagtgaaatatttgttgctgttattttctttgtaaaaataaaccatgtttgcatcttggtcttctttccatttggattcaaaagttttatagtgattcctcctagtaaaattgcattttctccctaggagtacttctttgattccagagtattaacagatggagaactggctcccaatgatagatgttgccgtgtgtgtggaaaaataggccactacatgaaagactgccctaaaaggaaaaggttggcaaatgaatatatatcaacattttgaggaaaataaatgagaggccaatttgtagctataattatgttcagaaatgtttaactgagaaagtttagggtatttaattatacctaaggtaaatgttcatttgagtggaattttgtaatagggtaagatttgcatgtggtataatagtatcttctaacattcatttgttcatttattcattaattcact

SEQ ID NO: 3709 - DNA, 1049 bp, Homo sapiens
tttgataggtcaagtagataacatcaaatgtatcatttggagtttaatgctcttaaaagacatccttttccagctttggtctttcagatacgttttattcattaacttcttggcatcaaattataccatcatcctgacatgttctttttggaagaagtattttagtatgtcttataggtaaattctaaaatggtattagagtatttggacctttgggttggatcacttgaaatctaataatacaattaatttttttatgcagatctttgatggaaaacagattccacagagaatggttgatggatggaatgctttcttctttgataaaacagaagaactggtaattttaaaatagtctttatgttctagaatgctcactgatatatgttagcatctgtataatttaataattttacttaaatttgctgtccatgttttggatagtactgtatagacattgttcttttctttttttttttatatgtagaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaaggtaacatttaagctgatattaattcaggagcaaccaaaatttggtcaacgaaattgaggggaaaactgaaatacattaggatttggaagattcttcctcttttatcagttttcctcctttaatgtgtaattttagaggaagagtttgctgatttgtatagtctgagtacatataagtattagacttcagcggtgacttctaagtatatttttatggtacagtgaatgtaattcttaatcattgatatatttcttttgtagacccttttgacttgaatcataaccttggtgctggagtttccagaaaaagtaagttttaaatatagagattctctgattttaaaactctgacacattaatgtctgcatctttattgttttcttct

SEQ ID NO: 3710 - DNA, 1132 bp, Homo sapiens
ggcgaggtggaggttgcagtgagctgagattgtgccactgcactccagcctgggtgacagagcgagactctgtctaaacagaaaaatgcaatgtaaatataacagtacatattagaatatcacaataagataagaattttggaaatgtttagggtcattctttacataaatatgattgacttatttggtgatccttataatatgattgacttgtttagagggaggactgagtgctaagttgaagatgattcgtgttgaatgagagagaacagagagacagcagggagagagagtgtgtgtgtgtgtgtctgtgtgtgtgtgtgtgtaaaagtgtatagcattagtgcttctgggggctgaaacagagtggagagaattaaacacagtgaaacatgagaattcaaaagaataggcaaaatgagtgatgattaacgttacaaggcccacagacctactccactgtgttatcagccaacgtagttgggctggatcatggatattactgagaagtatgaaatctcttaaaaacaatcatgatctaaagagttggattgttgttactcagaagtatgaattatctcaaaacagggttctaaagaggtagtttatttcaatatctagcaaataaatctgtgtttacaaaacatgaaatacctataatagcgtctgaatctttaaggataaaatattacatgtcagccccttaatatcttcacttctttcttgaggtcagaaatcctatgtcttttgtttcagatattaatagctgcaattgcctctttttttttttttttttttttttttgagacagaatctcgcttagtcacccagtctggagtgtagtggcacaatctcagctcattgcaacctcaatctcctgagttcaagcgattctcctgcctccgcctcccaagtagctgggactaccagcacgaaccaccacgcccagccaattttttgtatttttattagagacggggttttgccatgttggccaggctggtcttgaactcctgacctcaggtgatccgcctgcctcggcctcccaaagtgctgggattacaggcatgagccactgcgcccggcctcagtctttcacttttgttttatgaaatgtcggaatatgtgctag

SEQ ID NO: 3711 - DNA, 1061 bp, Homo sapiens
catttacttaggcttactggtttattataagggatattacaaaggatataaatgaagaaatacataaaacaaggtatgggagaagggatgaggagttttcatgccctatcagggcataccaccatctaggaacctccatgtgttcagctatcaagaagctatttggaccgagacctttgggtttttatggaggcttcattacatatgcaagattgattaagccaagctgttcgccattggtgatcaacttaacctttagcccttctccgctccccaaaggttggggtatagggctgaaagtcccaaccctgtaatcatgccttggtctttctggtgaccaacccccattttaaagatacctaggggctgtcagccagtagtcaacttgcttgcatacaaaaagacttctctttggagattccaaggatgttacgagttgtatgtcaggaaatgggtttggaggccaattataacatcacaattacatcagttgagtttgagatgttgaacctgctttgtataactctcttttgtacattattggatttgatttgctaatattttgttgaggaattttgcatcattgttcatgagagattggtctgtagttttctttacttacaatgtctttgtctggttttggtattagggtaatgctggccttgtagaatgagttaggaagtgttccttctgcttctgtcttcgaaagatgaggcagaaggaacacttcctaactcattcttcgagaattggtttaatttcttccttaaatgtttggtagaattcatcagtgtacccatctaggcctagtgctttcttttttggatggttattaattattgattcagtttatttaatagatataggcccattcagattttctgtttcttcttgtgtgagttttggcatattgtgtcttttttttttttttgagatggaatctcactctgttgcccaggctggagtacagtggcgtgatctcggctcactgcaatctccgcctcctgggttcaagcaattctccttcctcagcctctggagtacctgggattacaggtgcc

SEQ ID NO: 3712 - DNA, 1118 bp, Homo sapiens
aactctgctgtctctggtttttacaagagtaacacatttaaatttacagaggtaagaatttccttggagaaataggtgctggtgataataggagtatctttcttttccatatcaacataattataataaataactcacagatttaaaggcttattttgtgccaggcattctgctgagtgctttacatacatgtctcatgtaatcctcccaacagctctgcaggacaggagtttatgattatcttgattttatagaatagtaatgtaatgctcagagaggttaaacatctggttagtcacacagctaatcaatacttagtttaagatttgagactgggtgcagtggctcacgcctgtaatcccagcactttgggaggctgaggcgggcggatcacgaggtcaggagatcgagaccatcctggtgaacacggtgaaacctggtctctactaaaaatacaaaaaaattagccgggcacggtggcgggtgcctgtagtcccagcaactcgggaggctgagacaggagaatggcatgaacccgggaggcagagcttgcagtgagccgagatagcaccactgcactccggcctgggcgaaagagcaagactccgtctcaaaaaaagaaaaaaaaaaaaaaaaaaaagatttgaatccaggtttgtctcaatttggagcctatgtacttaatcagtatattgttttgccctcaccaaactcacctctagttgtttattcacttattgaaaaccatattcttctcctgtctttgtgcttctcaaactttaatctgcatgtgaattaccttgggatcctgttaaaatgcagattatgatttagtagactggggagggtcctcagattctgcatttctatcaagtttccagattatgctgatactgtaggtctatgaatcacttacttggagtagcaaggttattatagagctttatggctggaaattgtaaatgctactattaaatgcttagattaaagtagaatttgcacaaggtgaaattgagtcaaacttatttatttgatttgttttttagaaattaaattgtaaggaaataattgaaaatttggcaaaaattcttaagagacatccaggtatgaattttgaa

SEQ ID NO: 3713 - DNA, 1211 bp, Homo sapiens
tggggcaaagttgatagttcagacgtgttgaatgtatgatgtctgtggaaaattggaaaaagcagttgggtacatgggtatgggaacttgggcaaaagcttgggctcaagatgttttggaatttctcagtatttcttccagtggtaggtaatttaaatcatagaaatggacaagagcatgttgtattaggtcatcagcagatagcagaagactcctcctctctgcttataataaggccttggactttgttttcctttgcttagaaaaggcaaggttgtgcttatttggctcttctaagaatggatttggatttcgtgatagtgatctggatatttgtatgaccctggaaggccatgaaaatgcagaggtaagagtgtttggaaagcgttatgtaagtttattttctcccaatgacgattctatgtttatttttgtatgtgatattgataaaaatgtggtatcactctttgtataaatatattagcaaaataagtgtttgaaatatgaaaacagtagcattttcagtttagaagacattgaactcttaagtaaaagtgtttcagtaattttatgatacaaaaaccatgtcactgagagttacagtgatttgtaatgaattttgggaaaaaatatatcacgaagttggaattttttcactagaaccaatgggaagctgatgcatcagttttgtagtgaacattgatctttcatactttgtcttctcatatctctttcattagatgatgtctttgtgttactataggtagtaaatataggtggtcatctaatttataattggttttgttctaaaagttagttataatttttgaccactcacataaaattttttccatagaagcaatgttacagatgatatgctaagggctgggcgtggtagctcatgcctgtaatcccagcactttgggaggccaaggtgggcggatcatgaggtcaagagatcaagacactcctggccaacatggtgaaaccccgtctctacgaaaaataaaaaaaattagctgggcatggtggcacgcgcctgtagtcccagctactcaggaggctgaggcaggagaatcgcttgaacccaggaggcggaggttgcagtgagccgaggtcacgccactgcactccagcctggtgacagagtgagactccgtctcagaaaattaaaaaaaaaataaataaataaaatgctaagatagctttta

SEQ ID NO: 3714 - DNA, 1047 bp, Homo sapiens
cccagatgagttatcaccaccttgttctgaacaacacaacagggagcaaattttaattggcttggaaaagtttattcaaaaagaatatgatggtatgtcataggttaaaaaatttattgcgtttttgctgtagtcatgtagtcttgagtttcatttatttaaaaatatttattgaatgctatgtgttaagtactgttctagttgctgggaatacagtgctaataaaagagatgaaacctcatgaagcttatgtttcaaatggggagacaaatagttgactaataaatatataatattatatcagcaaataatacatgctgttaaaagtataggagataaaagaactgaagtgatggagtgttatgataggcctctctcataaggtagcatttgaggagaatcctgaataacatgaaggagcaagttatataaatatccaaggagaaaacattgttgatggaacaagaatagattatgtttggcatatttgaggaatagccaggaagtcagtgtggctggagtggagtattagaggtagattgtaatgtatagaagaggtcagagagggggtctagggattaagtcattagtgccttatggatgttggtagaaagcctttgaattttattttgagtacctaatgagaatcttttagaggatttttagttaataaatgacatgatctgagtgaatggtttgctgggctataagactggaagcaagcagaacatttaggaggctgttgtgtgagtccagagtagatgagaagtggtcagatttgggatatattttgaaggtagaaccaataggatttgctgatggaaaatgtgaggcatgagagaaagaaagaaatcaaggatggtttcaaggtttttgctataacagttacagtaggtggtcctatataactgagatggcaaagagcaggaagagtaagttttgggcatggggatgaagaatcaagatttttgtgactaaatattttagaaaaggataaaagttgactttaatcagaatgaatttgtacttttacaagatgacccatta

SEQ ID NO: 3715 - DNA, 1076 bp, Homo sapiens
tgactcaaaaaacttttttgtagctaatactgcattttaacaacatgtttttttttttaattacctcctgaaagcacaggttatcaaaactgagttacataaaagatttgttttgaattcacttcctaagtgatgaagtccctcaaaagtttattagattagatttctttttatctttgtgtagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttggtaagtctttcattactacaactattgggactagattccttcttagatattaaatattaattttctgatttaaaaacagtttgtttacgttttgttttgctagaggtttttgaatagatacccaagcacagatatttactaaatgactattatgtgcagggcatcatggtaaatgccaaggggaattgagagtccatatatattgcttttaaggagcttaaaatatggatatgagctgtctaacatggtagcttctagcctatgtggcttttaactttaaatcaattaaaattaaattaaaaaccaagttcttcagttttatactagacatatctcaagtactcagtagctacatgtggctagtggctgctgcattggacagcattgttgatagagaacattttcatcactgcagcgttcttggataacactatagatgagttaatatggcatttatgtaaattgccataattggaaatagaatgtgttacatgctatagtagtggtaaacaaaacgcagtgtaaacacaattttatctggggtggattagaggaatcaggattaatgatgtgatatttgagatgaaccttgagctgcatttttaaacgtcaaagattatgcataaaagcatagagtggccgggcgcagtggcccacgcctgtaatcccagcattttgggaggccgaggtgggccgatcatgaggtcaggagttcgagaccagcctggccaacatggtgaa

SEQ ID NO: 3716 - DNA, 1060 bp, Homo sapiens
ccttgcacaaagtaggcactcaatgaatagttgtaaaatggaatgtgagaatgattgtttcattgtgtttatgctgcctagtggttacttttagccaggtttcatctagctaattctttggaattcaggtgttacctcttctgttatgattcccctgattagaggcccatcttagcatgtagcccttactataattgttaaattgtctctcccctcctaatagtctatgaagtaggaccttatttaggtggcagtatagtatagggattcaccgcatggacccagtggccaggtggtcttgagtcaaatccttgacctatagtatccacttcatggaatagttagaattgttaatatatgtgccgcttttagaagagtgaatggtacatggtaaaccttatgtataagtgtgagctttctttattttatgatattcctaacaatgtcagggacataggaggttctaaagaaatgtttgctgaatgaaggaattagtttttttgaaagccagggcatttacttatattttaaaattaattattggaaaaacgagttgtagtagttatgcagtggtttgcagctttggctgcacatgaaaattacttaagggagctttaaaaataccattgcctaggctgatagcctagtcagttatcagaatcttgggaggggtgtagaaggtggggttggtgtggaattcaggtattggtgtattttactgctctccacatgattctaatgtgcagccaaggttgagaatcactggttcagtggaaagaatgcagaattcctaggagtcagtaaactgggactttgttcccagctttgcttcaaactgactgctttttggcaaattactccttcatgtctcagtttttgaaaacgtgatctccaaggtcttctctaactgaaaatttgttgatttttatggttttgttaagcttaaatgaaaagtattttttcttttccagtctcctttagcattggaaacaccaaatcgggtatccttgggacagttatggttagagctgcttaaattctacacactggattttgcttt

SEQ ID NO: 3717 - DNA, 1067 bp, Homo sapiens
ccatgcattcagcaaacattcgttaaatgccttctgtgtgtcagacactgttctagaggctgggaacatctaacaggacatacagagtcctgctttcatggtgctcacatacttctggaagagtcaaacagtaaagaaatacataaataataatatctgctagagcttagtgctacaaaaatgaaatgatagaatgaatgacattactctgaatggtcaggaaaagactctgaagagatgatatttaagctcagacgggtaatagctagccacatgaaaatctgatggaaaactctccaaggcacagttagtccaaagcttccaaggtgggaatgaactcaggaggagcaaaaaggaaggctgtaaaactgctttaatcaagagtatgctattggcatagaaatagaaaaatagatctgtggaacagaatagaatgctcagatgatctagtgtacagattttattaaatagtgctttcacaactgtatcttactggaagaaaataatgttggactcagcatgctaaatgcaaaaataaattttacttaaatgaaaatttaaaattttagaagaaaaatgtaggagtatgtatatgtaaataatgggatggggagatcttttactatgataggatacctagaaggtgtatagttgtcctcagtatccagtggtagggggattggttccaagacccccaaggataccaaaatttgaggacgctcaagtcccttatacaaactgtgtgttatttgtatctaaccttcacatagactctaacatactttaagtcatcactagattacttataacatctaatacagtataaatgctctgtaaatagttgtactgtattttttaatttgtattttttattatattgctatttttagtttttaaaatttaacattttaatttttttcagagacagagtctcactctgttgcccaggccagagtgcagtggtgccatcatagctcactgtaaccttgaactcctgggctcaagggatcctcccacctcagcttcctgagtagctaggactactggtgtgtgccactgtgcctggc

SEQ ID NO: 3718 - DNA, 1076 bp, Homo sapiens
cagtcagttaagtattcattttttgctattatcatgtagaaagcaagaggattgaactaggaaattaccttgcactatttgacattgaagagatcagtgccctgtctctcatgtatatcagttttgataattcataatgctgcttttgaaattaatttctcattaacttaaatactaagtttggttgaaatttatttctgaagtacaaatgaatgttaaaaacatctttctttaattcgtatggaactctagttatggaatgacatgtagttttcagttagctctaaatttattaaaacatttgtttttattagggcttttacggtactatgttacaatatgataactagaaagaaaatagccacaggatttgaagtattctgcttttaagggtattaatacaatgaaatttgtttctttctcattcacagtggtttactttgtagagtgagtgcaggaaacgatatggcatgtctcactactgatttacttactgcccttggcaaaatagaacctgtctttattcccttggtgttagcctttcgctactgggctaaggtaagtgaaagagaggaaaactacttatttatatttttagaaggaaatgtatttaatcttcaaaattaggccttttcttgtactgacatgtaacatcaatcataacatgtgggagaaagtagttttctgtgctagacagaaagttggtgtggcaggttgtaatttatggacataaaaataaatttttgtagacacacttatggatatattttagaatttttaattgtcatgctatattctccttttatgtactatagaaatgttctctttcatatcagcatatgaggctcaagttttcactcttactgtaagttaaacttgtaaggttttaagatgtatatacattaagattcttttgttggcatatttttttccccagtctctaagaatgctattctctttcctctaaatcattgataacatgtaccaatttctgattgggcaactgctgagcattagttatttaagtttcctaaattagtcttaatttgtatgtctaaaggctgtggttgccctgt

SEQ ID NO: 3719 - DNA, 1496 bp, Homo sapiens
ctcctagctactcgggatgctgaggcaggaggagtctttgagcccagaagttcaggctgtagtgagctatggtcatgctgcagcctggacaatacagggaaacctcatctcaaaaaaaaacaaaaaaaaaacacgattctgttttcactatttaaaacacaaagcatgattatatttaaatgttattctttaatgaaattgagttttccttaatgttctgctgtccgaactttgaaattagtatatcgatttatttttgaaacttttttagatgaatcatccagatcttctgataaaagtacttgggattttaaagaaaaatggtgagtttcttttctttttcttttcttttttttttttaatttgtctttctaaaggtacatgtgttgtttatatatggctaaccaagttaaaactaaactgctggcatagttgagtcattgcattacaaatggagatacatacacacacttgtttatagatatactagaaaatataatttaactgtaacttaggtaaaaaaaaaaatgccatattaaaattgatatgtaggctgggcaccgtggctcacacctgtaatcccagcactctgggaggctgagatgggtggatcacctgaggtcaggcgtttgggaccagcctgactaacatgctgaaaccccgtctctactaaaaacacaaaattagccaggcgtggtggcacgtacctgtagtcccagctactcgggagactgaggcagaagaattgcttgaacccgggatgcggaggttgcagtgagctgagattgcgctgctacactccagcctgggcggcaaaagtgaaactccgtctggaaaatacaaaaacaaaaaaccttcatatgcaaaaaactactgccttttgggtaattaaaaaatatttgctttgaatattatgggcatttcttatgtaaaagaagacaaaacctataatcattatgaggtcattactgaaagaagattaaggagagacttggaataaaaatgtatgcatgcattgagtaaatatgttttttcccacctaaagcatctatattaatttaatcatttatattacatcagttgaatcatacctagttgagtttttcatgtgtgctttttctgtctggattgcctttgtaaacacatcattcatataggtaagaaaaatttaaaaattacaagattctcaaaccaggctccaggtcatgtgttacaatcttcaagatttgcttggtttttacttactgtttttcttgttacaaagtgaatgcttaagattaagcttgggagctggagctagactttctgggctcagattttagttctgccacttactggttgtgtgtcctttgacaaattatttgtgttaataccttagctttcccatctgtaaaatggtaatattacattgtatctttttgatgagaaagttgttgtaagaatgagataggctaaactatagtttagaaaagtgtgggatatacaataacttctta

SEQ ID NO: 3720 - DNA, 1084 bp, Homo sapiens
ctataaactcttgagaaccacagtgttttgggttttaggtttacagaattaactgacttggcttcacttcgtattttataaaagcattggcattgaatgtttatgatcctttccccaaagtgctcttacataaatatttaagagtaaataaatgtagtttgtgacagtagccatagctaagttggtacattagttactgttatatattgaatgctaaacatattgtcagtcatttctaaatgaactattactaaaattttgtttaaacagtaagcttctgtgagtagtttctctctcccttctctgttcctacactccataactgggaaccatttttttattctatagatcagttagaaagggtgttcttcttgtataattgtcttactagaaatggaagacgtagaactgaagtgtgtgaaattttcccgtcgctgtttttttacatctctcatatttgcatgctatttcatgctttgatgtttttcctttattccagaatgttcacttaggttgtatggctcatctctgactagatttgctctgaaaagtagtgatgttaatatagatataaaatttcctcccaaggtaagtaattagaatctttcctgtgtggttcttaactagtacttagtaatttttatggattatctttgtagagaaaggatagggaaatataaaactctggtttgtatagtgttaccatcgtgactaaacagtgcttttggaaattactattagatttcagacaaaggcaggataaaagaaataagggacaagggcaaaaggaagcagaagaggaaagctggaaaaaggaaaaatgtttatatttgaacatgttgaatagttaatacttctggtaagcagtatagaaggtgggaagagttttgaaatcagatacctagattcagatcttatctgtgataagcaagttgcttgaactttttgagcttcagttttctcatttccaaaacaggaataataatttttatattaaatgagataatattaatatatgtcaggtgtcttaatatagtatctggtacatatgggtacttttaataagtagtacctagaatcatta

SEQ ID NO: 3721 - DNA, 1024 bp, Homo sapiens
tgtatatatatgtatatatatgtatatatatttttttaatttagtagagacggggtttcatcatgttggccaggctggtcttgaactcctgacctcaagtgatccgcccacctctgcctcccaaagtgcttgtaggcatgagccaccacgcctggcctgggctctctgtttgattccattggtctacatgtctgtctttatttttattttatttttttgaaacaaggtcttgtttgttgctcaagctggactgcagtggtgcaatctcatttcactgcaacctccacctccggggctcaagccatcctcacctcagcctcctgagtaggtgggactggaggtaggcaccaccatgccaggctaatttttatattttttgtagaaacagggtttcaccatgttgcctaggctggtctcaaactcttgggctcaagtgatcctcccacctcagcctcccagagtgctaggattactggcatgagccaccatgcccagccatgtctgtctttatgctagtacacatagtggtttgttttgttttcttttgtgttttgagacagagtcttgctctgttgtccaggctggagtgcaatggcacgatcttggctcactgtaacctctgcttccgggttcaagcagttctcctgtctaagcctcctgagtagctgggattaccattgtgtgccaccatgcctggctaatttttgtatttttagtagaggtggggtttctccatgttggcctgtctggtctcgaactcctgacctcaagcaatccacctgccttggcttctcaagttgctggaattacaggtgtgggctacctgacctggccatgttgttttgattactatagctttgtagtacgttttgcagccagtaagtgtgaatcctccagctttgttctttgtcaggatcgttttggctatttggggtcctttgagagtctgtgtacatttaggattgatctttatatttctgtgaaaaatgtcatatatatatatatatatatatatatatatata

SEQ ID NO: 3722 - DNA, 1050 bp, Homo sapiens
gatttaaatggagcatttcattatgttggaaaagaaagatattaagggttcgctgaatatttgacttttaagctgtaacttgaaggatgattagttttaccaggtggatacacataggggacaaaatgatttaaaggcatggagacccaatggcacatagagtatttggagactggtgactgtttaaatgtggatgtctgtcaaaaatattggagagggtggagggaatggttggaggaaggcctagaaatgcaaattgagaccaaaatgctttatattccatgttaagaacatgttgcattgtcttaccggcgcattgaaggttttttttttttttgaaatttttttattgtggtaaaatatatataagataaaatttaccattttaaccatttttaagtgtacagttcagtgacattaagtacatttacattgttttgcaatcatctccactgtccaccttcattcagaactttttcatcattctatactgaaactctgtatccattaagcaataactccccattcccctctccctgcagcccctagtaaccaccattctattttctgtttctatttgcttgtctattgtaggtaccccatataaatggaatcatacattatttatcctttagtgttatttcacttagcatgtcttcaggtcaaccgcgttgtagcatctgtcagaatttctttcctttttgaggttgaataatattccatcgtatctgtatgccatgttttgtgaatcatttcatccatggatggacacttgggttgtttccaccatttgactgttgtgaataatgttgctgtgaacatcgatgtacaaatacctatttgagttccttttttcatttgttttttgtatatacccagaattggaattgctgggtcaaatggtaaatccatgtttagttttttgggattgccatgctgttttccacagtggtgacatcattgtacatctttaccagtaatgcacaagggttccaaattctccacattcacaccaactcttgttttctgcctccccccgcccccccataa

SEQ ID NO: 3723 - DNA, 1034 bp, Homo sapiens
caagtgattctcctgcctcagcctcctgagtagctgggatttacaggtgcatgccaccacacctggctaatttttgtatttttagtagaaatggggttacaccatgttgatcaggctggtcttgaactcctgaccttgtgatccacccaccttggcctcccaaagtgctgggattacaggcgtgagccactgtgtccagctgtcttttttttgttgttttttgagacagagtcaccctgtcacccaggctggagtgcagtggcgcgatcacagctcactgtaacttctacctcctgggcttaagtgattcttgtccttcagcctcctgagtagctgggactgcaggcgtgtaccactacacccggctaatttttgtatttttagtaaagatggggtttcaccatgttagccaggctggtcttgaactcctgacctcaagccatctgcctgcctcggcctcccaaagtgctgggattataggcatgagctaccatacatggctagatcattatctatttggacttgataggttatatagaaatttgattgatctcagtcttctccattaggcctaacttcagctcccacctggcacatcatttttctttttgtcatttattcattcattcaataaaattttgttttttggtgtccactacatgccaggaactgaactagtcattaggaatatataagtgatggaaccgataattccactcttatggagttaatcttctagtgggatgaaacagataacaaacacaataaataagaaaaatatgtagtaagttggccgggcacggtggctcacgcctgtaatcccagcactttgggaggccgaggcaggcggatcacctgaggtcaggagttcaagaccagcctggctaacatggtgaaatcccgtttctactaaaaatacaaaaaactagccaggtatggtggcgtgtgcctgtagcaccagctactcgggaggctgaggcaggagaattgcttgaacctgggaggcggaggttgcagtgagctgagatcgcgtc

SEQ ID NO: 3724 - DNA, 1050 bp, Homo sapiens
tgtggttttgactttagttttcattataataatttagaaagaagaacctaatacatttttaaagtaaaagacagtattactctggaaaagcaaggcagagaatgtagaggactgcactataaagaagaattattggccaagtgtggtggctcattcctgtaatcccagtgctttgggagactgagatgggagggtcacttgaggccatgagtttgagacaagcctgagcaacatagtgagactttgtctctacaacaaaaaaaaattagccaggtgtggtggtgtgcgcctgtgttcttagttgcttgggaggctgaggcaggaggatcatttgagcccaggagttccaggctgcagtgagtgattattaaagagtgaactctttattttaggtaggatttttttgtttatatgatgtaaagttatatgatagagatgtttacctaaatttgtaatttagtaaatcaaccaagtaaaatcaaagatggtacattttaattctatgcagtttgcttttgctggcagaaggactctaatttttattcatattattaatgtttgtttagaaacggatctgaatttaaggtgtatagggcaaagtgaatagtaaaaaacatcctgattttttaataaaatcactttttttttttttttttgagacagggtctcactctgttgcccagactggaatgcaggaatgcaatcttggctcaccgcaacctctgcctcctggtctcaagcgatcctcccacctcagcctcctaagtagctgggactacaggcgcatgccacagtggccggctaatttttgttttctttgtaaagatggggtttcaccatgttgtccaggctggtcttgaactcctggactcaatccgccagcctcggcctcccaaaatgttgggattacaggtgtgagccatgtgcctggccttgacattattattattattattattatttttttcgagatggagtcttgctctgtcacccaggctggagtgctgtggcgcgatctcagttcactgcaacttccgcttcccgggttca

SEQ ID NO: 3725 - DNA, 1050 bp, Homo sapiens
gtatttttagtagagacagggtttcaccttgttagccaggatggtctcgatctcctgacctcgtgatctgcccgccttggcctcccaaagtgctgggattacaggtgtgagcctgtagtcccgcgcctggcctgttttttttgtttttttttttttaagacggagtcttgctcttgtcacccaggccaaagtgcaatggcataatcttggctcactgcaacccccgcctcctggttcaagtgattcttcttcctcagcctcctgagtagctgggattatagacgtgagccaccactcccagctaatttttgtatttttggtagagacagggtttcaccatgttgtcaggctagtctcaaactctgacctcaggacctctgaggtcatgagcatttcaggccgcctcggcctcccaaagtgctgtgattataggcatgagccaccgcgccctgcactgccatctttttttaaaactgaaaatttgtaagagctccgggactttttgtaggaacttgtggcattgttaatgtgtcttgaacattgctttcccccccatacctgtttcctcaaagccaggaaattatatccatagtttactacctactgtctattcttcgttctcttgtgagactggtgtcctgctggctatatttcttatctgtcattgtcatttcaatctgggaatctgtaggtcacccctttatattcactgatactttggtgtaattcctgacatccatattgggcagtgggaagcataacattgaatgttatctgacactttatttccttaatttctatcttctagtgatattcaactctactttccttgatagctcctattcatatcattcaaaatgattcttcccaccaaaattttctgaattatctgtatatgtatttttaatgtttctttagtttttttaatctatccctaatttcactgtaaagcctctttttggctttatcctttcccttcatcggcatgattactgttgtgttccttaccctattgaaatagtgattctgtaacttcgcaacccagtacaa

SEQ ID NO: 3726 - DNA, 1026 bp, Homo sapiens
gactaggaagtatgagtcctccacttttgtttttctttgtcaagacttttggctatttggggtctcttgagattccatgtgaattttaggattgattttggtatttctgcaaaaaatgtcattggaattttgatagggattgcattaaatgtttagattgctttgggtagtgtggacattttaacaacagtaaggccaggcacagtggctcatgcctgtaatcccagcactttaggaggccgaggctggtggattacctgaggtcaggagttcaagaccagcctgaccaacatggtgaaaccctgtccctactaaaaatacaaaaattacctgggcccagtggcaggtacctgtaatcccagctactcaggaggctgaggcaggagaatcgcttgaacccgggaggcggaggttgcagtgagctgagattgcgccattgcactccagtctgggagagagagcgagactccatctcaaaaaaaaaaaaaaaaaaattaagtcttttggtctgtggacatagaatgtgtttctgtttatatatttctaaatttctttcagcaatgttttatagttttcattgtacatgtctttcacttctttggttatgtaattccttagtactttattctttttgatggtattgtaaatggaatttttaaaatttccctttagattatttattgtgtttagaaatgcagctggtttttcgtgtgttgactttgtgtcctgctactttgctgaatccattttttagttgtgtgtgtgtgtataatctttagggttttctacatataaaatcatattatttgcaaactgagataattttacttcttcttttccaattgagatgcgttttgtttcttttgcctaatggcgttggctagaacttccagtactgtgttgagcagaaatggtgaacacaggccgggcatggtggctcacgcctgtaatcccagcactttgggaggctgaggtgggtggatcacctgaggtcaggagttcgagaccagcctgacgaacatggag

SEQ ID NO: 3727 - DNA, 1050 bp, Homo sapiens
tagccaggcgtggtggcgggcgcctgtagtcccagttactcaggggactgaggcagaagaatggcgtgaacccgggaggcagagcttgcagtgagccaagatagcgccactgcactccagcctgggcgacagagcaagactccgtctcaaaagaaaaaaaaaaaacaagcctttcgttgcctgatcgccgccatcatgggtcgtatgcgtgctcctgagaagggcctgtcccagtcggctttaccctatcgacgcagcttccccacttggttgaagttgacatctgacgacgtgaaggagcagatttacaaactggccaagaagggccttactccttcacagatcggtgtaatcgtgagagaatcacatggtgttgcacaagtacgttttgtgacaggcaataaaattttaagaattcttaagtctaagggacttgctcctgatcttcctgaagatctctaccatttaattaagaaagcagttgctgttcaaagcatcttgagaggaacagaaaggataaggatgctaaattccatctgattctgatagagagccagattcaccgtttggctcaatattataagaccaagcgagtcctccctcccagttggaaatatgaatcatctacagcctctgccctggtcgcataaatttgtctgtgtactcaagcaataaaatgattgtttaactaaaataaaacaaaaacaaaaacaaaaaaaccatatatgtaaatggttcaaaatagctaaacattatcatcataagacaacctattgtttagccaggacctactacgtgacttgccctttacatagattattattaatcttcagaattctgcaaggtaagaataatatctattctacaaataaataaaaactcgaagtgacatcatagcttgttctgggtcatgaagctgagattttaattaggactctaagcctttcaactatatgcagccctgtttcatgaacatgttccatatattacagacattcatctttaatagagtcttatgcaactaagatattggtcagcctgacaaaataa

SEQ ID NO: 3728 - DNA, 1046 bp, Homo sapiens
aggtgagggagggtgtgctttggatctgtttgtttaaagaaagccagttatatgtattcacctattccttatttggtatttatttaaagtatcttgagttgtgccaaattcttggctttgtcctgaagttaaagagaaattaaatgaggactcgccttcacgtacataataatctagtggaaaatacaaaaaacaagaatcgaactagggccctaacagagaagtgccttaccagtgccagagatgtggtcagtgtgcaggaaattactttacagtgaatgacaggatgagactgaatgtagggcatggcacttgtggtccctaagcccataggtcaggtaggcatgaatttcctggccacctgccccccaagaggtgccccctccacatacataaccatttcaaaggctataagacagccctctgcccttactgcatggcagatggtcagcaaaaggctatggttaagtgtactgggtctgtttggatgatctagagactttggagcttaacattcttgttcatatttttggtgttgataattttatttactatttattgagcactgtgctgggcactttatatgcatttcaaaatctgacagtaaaattgtagaggtttcctcggctctatttgacagtttaggaatcttgggcccagaggggaagataggcagagcttaccttacatccaggcaggttgaccccagcatccacgctcttctgcagcctccatgtctgctgtctacagaaagcttcatagggagcaggtgcccaaggcaggcttcctctaagaaggggatgagttcttcctgggtctcatactaggcctccaggggcagtaagtgcccatttggcaggaaggagaggggccatggggtcatcctgagagctcatttgggcctgcctcctcaacacacttcctttctaggctgaagacaatgagaacttcaagacaatagtggagtttgagtgccggggccttgaaccagttgatttccagccgcaggtgtgtgtgtatctttctggggaatctttgtctttggg

SEQ ID NO: 3729 - DNA, 1031 bp, Homo sapiens
tcaaagccacgctggagaacatcaccaacctccggcccgtgggcgaggacttccggtggtacctgaaggtgcggccggggcggggcccggggagaggaggcccgtcctgatctcagtgctgaaccggagccttctctccggcagtatgagaaaatatttaaccaggcacattaagtgttcggggttttcctagttagaattttacgtttgctttctattaaagtgtattggtttatctctaattggcagtcttggaaagcttcattttgtagttcttccctgtgttaaatatttcgtggtctgtaaatggacactaaacgaaatgctacttgaagggacgcttgtgattatttaataaggtgaatagttcgcctttcgtttattgatttggttttctttattgtgaaatagtttaattttgtgcgtaatccacccttccttagccctcccacactggtaaagctggtaccctagtggcatggtctacagaggcctccccttccccagcagttcgaggctcttcactcttccagatcccagagcttctgctctgttttactcctggtcaaaaatcccagcatccttctgtacctctcaaaagccctgtttttcgggaagctgcctccggactacttttgtttcccaggattttgaagcctgaataccagggcttacttgggagaatctgttctttggcttgaagaagcggaatcgagtgaaggagacagaaaaatagagtaacaatagagtgataagtgcttataccagtgacatacagggcctgtgggaacataaagctaaccaagcagagtgggtcgggggcctgctgaggccatttctctttttttttcttaattgacacagaattgtacatatttatggggtatatagtgatgttccgataaatgtaatgtattgtgatcagatcaaggtagttagcatattcacctcaaacgtgtatcatttctttgtgttgggagcatttaatatcctagctatttgaaactatatattattgtcagctatagtca

SEQ ID NO: 3730 - DNA, 1085 bp, Homo sapiens
tcgtagcagtatctttgcattctgattgtccattcagagctttatctcccttacttggctatgagtacttcaaggacaggaactttgtccttttatcctgggaatcttcagtatgccgagttagtcagcaaatgttttaaaaacttctcccctgtgtaagacactgactgtgccaagtgccaaggatccagggaagaaaaaaataaagactttaagagctttcagtctttaatcaggcaaaaataaagtcctttaaggtagatgttaatacatgtcattatgtgctatgataggggcatgttggatatagatagagacagaggaacaatgtaatagtggcatgatactcttgtgaagggatggtagaaggaaaggtaattccagagtaaaagtggcgcttctggagaagacagcatttgaattggccttgaaaggcttcaccaggaaagatgatggtgaggtgattattccaggattattttgattggagtggagaaagataaatctacccctttcttgccatcctttgccctatagaaagaggcagatatatgctgttttgctgacataactcactctgaaatattcaatatttttaatttctgctaatctgaggagtgaaagatgagtattatttccctgacatttccctgtgaggtagagtatattttcgtaagcttatcagcccctttacttatattttatctgttatgaatcgcccactcacagtcttttcttatttttctattggctatctttttcttatttatagaaatatttatacatgacaaatattaaacctttaaaatatatgttacaaatattttcttccagtctgacatttggttttaaagtttgtttatggtatcttttgccatgcataaatatgaaacttttaagtatcagatttgtcaatcttttaagatttctgggttttgtgtcttgcttaagaaggccagcctcactctaacttattaaaatatctcctgatgtttttcttttctactttaaacttttttttagtattaggatattaatctatttggaatttaaattttagagtatcgtatgaggtagagatttaa

SEQ ID NO: 3731 - DNA, 1099 bp, Homo sapiens
tgtgccccagctgtctccctctctgccattagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgaggtaagcagaccttccaggagggatggcccctggcagtgtcagaccctaccctgctgaaatcttcccttggcttctgggacacagtatgctgctggttttcttccatcttccctggttacttgttgccttttgggggtttctcttttttaccttccttgaatgctcatgcccccaggatccttccaaagctttttctcactcccaaggaaaaaatgcacatatacataaaacattttaaattcagtttcagggagtttctggaacgctttaaaaacctcaagttaagaacccttaatcgccgtggcttcaggtacatgcagataactatatatttgcctgtttctcacctagaacttaacaaacactacacagcagcccttttgcaatataattgggactaatagttaatacttcaaccgcatacacagattcatgtcctaatcttgatgtatagccaaggcctttcatttgagcctaagtctactgcattattaatgatttacaggttcaattgtttaaagtggaataagaatttcaatctattggtataacaatatatgagtgtaaaatccttctagatttatctgatttcccctccctacagtctttttattgctgatcttacaactaattccacagcaatgttttaatgactcatctttattgaatcaaagtgaagtgcttagcattcagctaaagaaaagatcatagcccactggggagattaggaaaggcttcacagaagtggcatttgagctacgccatgaagataagttcctaagtatatctcagaggcaataccttaggcaacaaaattatctgtccaagtgacctccatggtatttcccctccagcacctcaatctacctcaactacgacgttagcttctaccatgacgaggacagtacctgcca

SEQ ID NO: 3732 - DNA, 1046 bp, Homo sapiens
ctcttgtgactcagaccaccccggtcatgtccccagcaagaaggcaaattgggttattttgtcttttaggttcatgtattggtctgactggggggaccaggccaagattgagaaatctgggctcaacggtgtggaccggcaaacactggtgtcagacaatattgaatggcccaacggaatcaccctgggtgagccctgcctttcctgggttgggggcctattctagtgccttgtcctgatcactgtctggaactccatgagtcttgtttctgggtcctctcatggtgccagtgactttgtttcctaatggttgccgtaggctggcctcagtgtgaggcctagaaatgtgggcagggagaggtacaaaggaacagagctccagactggggtcccaggttcatgacctgatcctgcttccttcccaagatctgctgagccagcgcttgtactgggtagactccaagctacaccaactgtccagcattgacttcagtggaggcaacagaaagacgctgatctcctccactgacttcctgagccacccttttgggatagctgtgtttgaggtgagtcctgtaaggagaggcaagggcccactaggaagctgaagcctagaaaatgcttgttcaaataggatgagtccctgagacttgttcaaatgaaaacaggaacagggaaaccaactgatttgtttgtaaacaatctgtgagctgcctgcacacaaaggctctgcagcccactctccacctggcagcctttcccacgctctcttcccaagacccctctcccagagcacttctcacaggtgagctgctaggcatgtatgtttcctctctgtgccctcagcacccagcactgtaacccatatacaaaaggcacccagtaaagggaggaaaggaagaaggaacatacatatccttagaatcatttactggaggaaatggcctgagagatgctgttcaattctgcacacttttattgacctctgccagaccctggggtcatagaagtgaatcagacactatcctagtctcaagaagctccca

SEQ ID NO: 3733 - DNA, 1033 bp, Homo sapiens
gctttccataatcacattgtattatatctggctcaccctaatgggcagagctgtggagcagccccaccttagaaagccagagaccgtggcccatgtaagtctgtacccctaccctggtaccccagggaatgtgtagagtggaaattatccacgttcctctaaaaatctattgccatggcccagatggaagagaggggaagggtgcacaggtagctccagatgggcccatgggtggaacatctgccccatggtcatctctgttttctcttaagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggtgagtgtcccaactgaacttcccattctcccaccataggtgctcagtcctcttgtgtctgtcacaagggctatcttgagggttctagaaagctctgggccactcagacacaggccatggggaagaaagtcttgttaatccccaaccaaggttctctgggcattggtcaccaaagttctccctggactctcccacccactcgttatatcgtagaattggagtgtctcagagcagagtagggctctagagatggcctgatagaagctcctgggggaggaagcctttcttcaggctgctgtaggtgagcatctgacagctgctcacatacttccaaagacaggtagctcattacctcccatagggcctgtttcaccgtggggcagctctgctcattagaaagtgggtcttttcccctcataatgccaaatctatctccctgcaacttcctccattggcctctggagttacataaaacatgtctattccctgccctgtgagagagccagcaagatttgaggaccaagatcactggt

SEQ ID NO: 3734 - DNA, 2008 bp, Homo sapiens
ggtcagtccctccctttcctgccttctggcagactgtttccccagcacctacctcctgggtgcttagaggaggttcatcctcctgagcttcccaggaagagcatatttccttccccttttgaagattaaaaaactgattgtgaaaggaagagtagttgagtgaaagtgactcagcttctacctgagctggcaggagatagacactccctctgcctccaggccctgccaagagaagtcccagaagaaggaacttgtggaaaaagagacagggaagccagaactactgagcctagctcccccaacacccagatttggagtagccagggactactgtcctactaatccctctcttctctctcgtcgtttgcatgacacaccaaagaggagtacgtacacacgtgcttgtgtctgtgtgtggcctctgtctctgtgttggtgagaggccggtgtctgtatccatgtcttcttctctgagtaaagcaggggaactgcattcatgcatctatgtgtgtgaccccatgtatgtgtgaatgtatctatggagtccatgggactgtttgtgctctgcacataagctggtatgtgtgcatgtagttgtgggcatgctggtgtgtgcatgtaggtgtgtgcagtgacaccacttcttccttccatggaaggaagccgcaaatactactctggcctctctgcaccactctaccccatccccctcctctcctggctccccagcggaatcacacccaggctaggtagaattaagaaggactgaagacttccctgcaggcatttggggaaaggttacagggacagacaggtgcagacctgctctcctttctcttcccctcacccacctgagccctggaggactctgtgccttccttcatcagaagccagtcactttgagttctctcctttccccttccccctttcagggccatcccacctacacatgccacttcatcaagtgctcagtaaatagaattgttgagttgttgctagctgcaaaaggagaggaaggaggcgagtggatgcatgatgggggcagtgggtgagtgggaggacagatgaatgaacggtgctcagggaataacacaggaaaggagaggtcagggagggctccgagcgactgaaagattcctagaggtgggagctgccgtggctcagcccacctccaagggtctgaggcttcccagggctgggcctggctgagtcatccctgggtcccccagtcatggagttgctgtggtcttgttctttcagttccgccaacattcctgggaaacaggaggaggcccaggggtaaaggggttattccctaagcatggctcaggctggaagtgggggcaccccatagctgtgcatggcctggggtgggcagctcagaccagctatatgcatggccatggctggctcagctcagcactgcttggcttggctggagtggcagtgcatgagcctggggggcagagggggagaggggcgcggcacctctccttggcttgtggaattaaccttctgtgactctaaagctcaggagaggctgtaagagcattggtcctggattccctgacctcccctaagaccctgccagaaggtagtgagggagtggaggatggggaaccagaaccagatgacctctgggcatcccttcacctcttgcagcaggtggtaatcctggaaccgggcccatgacaagataggaggaacagggacaggtgctgagaggagaggagttaaaaaacccatcatattagttcatgataggagagaattgatttagcaatggctccatgttaaaaaaggcccaggagtcttaaataaccacaagcacattagggggggcatcctgtgttgttcaggttccttctgggtggcaaactagctctgggccctgtccagacagggacatggacagatggagtgagtccagagaaaggcacccaaatggcaggagaccagatatcagtgctttaagggagcctgtgcaccctggccaaccccacacagc

SEQ ID NO: 3735 - DNA, 1034 bp, Homo sapiens
catctgtaaaatgtggtaatggtacctgccttagagggattgtgagaatcaaatgaaagaatgcaagtatcatcgctggagtaaatggcagtgttatttgtattattatattttggctgcaagccccctctccccaacacaacagtgtgttagatattaagatgttagattcttacagtgttaaaatagtgtcagtgaagggagttgcattgagcgggaaagggatttgagagaaggtcccaattcttgtgttttccccgattatgttgtctgtccctagctggctggggtttctcccagctctgtttccctctggttctgtgttctgtacctatcaaatgtagccaggagtcacaatggaaaagcccagaacatttgcctaatggcaatagcatttcagctctaattatagctcacttgattggggacggcttctgacccaccttcaggcttctgttgggaggggtgagggtgggggaggggaggatggttcaaggtgagttatagttctggatgctatttatttgaatatggaggctttttcatgcatcttagaacctttccacctgggaggggggcctctctgattaaccaggctcatcttgctattatagatcagaaaatggaggcccagagattttctgagctcactcagtaagttagggactgacccagctagcagcattttgcctggccttgactgaaggaacttggtgtaactcccccttctgcaccttgggtggccccatgctgtgcttcctgtggattgagtgacactggcagttctcaccaccggagcctctggtcccttagagctggcagtccccatttggaggttatctgcccctgaaactcacgtgggttgacactgtagatgcgttccctcaatgggcagccgccaagtactttcattctttaacagacattgcccttttcgttaatttgtgaatttatgaattggagaaagtaccaatggatttgaatttctggggcaggattctctgggaatttaaatgcctttaaatgccgtgagc

SEQ ID NO: 3736 - DNA, 1050 bp, Homo sapiens
gcattcttctaagcaaagtgtgaagaaaactcatcttagaatgcagatgtactgcaaagattccactgagaaggacagacatggaacagattcagagacacagtctctctcaccaaatccttgccaggctccccagaggagggggagcaggcctgcagccccagaagcacccagagggcctgtgggtagatttgaataaaggtggtccatgggagtggcttcccagggagaaggcaagccccagaactgtaagtatggagcagaggctggggggctgtgctcgcatttagctcagtgtcccgcactgagacctaccccaagctggattcttgctgaatttgacagtctctgtgctgcagggacagggaagaaagcaaaccatgttggactcgcaatcagtgatgatctagagcagaggtcatcaaaatacaggccacaggcctggcctgtcaccagttttttgtaaataaagttttattgaaacataaccatgctcactcatttatctaatgtctctgactgcttctgccccatagtggcaggattgagtggtgtgaccgagaccatttggccctcaaagcctaaatagctactatctggcccttcacagaaaaagtttgccaacctctgccctagaaggacattcaggggattgtaggagctcaggagaggctactgatcaagactggaggtgatacttaagcccagtgtgtaatggaaagaaggtgagaggtgggggaaggggctttcagactaaagacagcttgggcaaggtatgatggtataaaaagcatggagtatatgaggacccaccggcagttgaggtggggctagattgggaagtatgaggaggggaagatgagggagcggggcaggctggggccacgggacttctaagcccctggggagaggccacatcctagtggcccctgatgttaaatccatcccaagctcattccaggggaggactttggtggtctgagcgccccaaggcctggggtaagtcactgctgtgctgaggtatcctcttttaggctgaaaagagacccc

SEQ ID NO: 3737 - DNA, 1030 bp, Homo sapiens
agccctcactgtgctaccctggatgtttcccaagccccttttcatggcatagggcctcctgcatttcctccgggctctgaagcatgtgcagggctgggcaggcatgacccggggtcgatttggcacctttgtcatctcctgtgtctttatagtatggctttcttcaggcaggactggctttcatgcactctttcccaaccccccagtgcccatcacagggcccagcacagaggaggggcccattgtatgcttgttgaatgaatgaatggatccccctgcttgcatacctcctgggatggaggcctcactcctttatacaacaattggttccaagattttcagaaacgaagttctttctggttcttcccgagaggctccatggctcccaggcttgccacaggggccacacagacaccctggctgatcctgcgtcctcagagcagcgcagaaaagaccagagacctctgagccagcccagctcctcacaggctcctgcacggctgggtctccactgcactaacctctgggttgtcagtaatcataggtgtcacatatggagccctcactgtgccaggcagcatctcattccattcacatcagcctgtaaggcaggtagttctcatcccccatttacagaggagaaaaatgacttcctccaggtcacacggcttagcaggagacagaacatctgagtcaggagggtgggaggtgggctggggtgggctggaggaagacctcctggagcatgggattgtggcagggcttggggatactgggggcttggcaggagggggcaaggctgaggaggggcccaagggcttttctggaggtggaatctgcccctgcccctgccccagcccgtctcttccctctccccatgctgtctccaaatggatccctgacaccaagactccaactggggtagtcccagaggtgagacctgtgaacctggggcccagagcccttcctgtccccctgaaggccagggtgtgggtatgctccggggcagagctcaaggccgctaaactga

SEQ ID NO: 3738 - DNA, 1085 bp, Homo sapiens
tgctcggcggccaaggtgcgtgcagccggtctctgactcggctctgctccgccctagccaccaacaaagcgcggccgggaggccggagcggggaggggtccagaacccggggctatcgggggctcccgggcggacaggctccacgcgaagcggctattcctgaatttgccctcggccccccgcccccgcgggcctcggtgttgagggctctgccctctgggcagcggatcttgggggaggggtgcaggggggcttggccagcggggaactttgccggaggggcggccattcatggttccggatgagctgtgtgattctcgccgttggggtttatttgacacgcgcgctccgcggcggtaatgagcagagccgggcggcttctccgcttgacaatgcgtttccgcagacccctgcgcgcggcggagagagagggggctgcctgccagggtgatgtgcctgcggctcccactgcgcctggcgcgcgggcgcggggactccctatgggctgtatctgagcagatctctgactatgggtcgcgtgtgcgggtgagtgcgtctgaatggagggtatacccaggtcgtgtgacactttaagtaggtgcctggtctcgccgtgccaccgagcggcccgacatccacggaacccctgccatcgtgccctccctttggatggagtgtgcctgaagcccccggggtctccataatcgccccctttcctcctccccagcgggtccttccgggtggcccggactgcatggtggggagtggggccgagtccgctgatccagctcacgctccctccccctcgcagggccggccaaggattgcgaaaaggaccaattccagtgccggaacgagcgctgcatcccctctgtgtggagatgcgacgaggacgatgactgcttagaccacagcgacgaggacgactgccgtgagtggcgggccagggagctcagacccggggagagaaaaggaacggtggggggcaccatgcttggcgcgcacgtggctgcagccgccgcgctgccacctgcgcgggacttgccgccggagcctgcgaccgggaaaccgcctgggcaccgcct

SEQ ID NO: 3739 - DNA, 1027 bp, Homo sapiens
aattctatctgggatcttagacaaaccactttactcccagagcctcagtgtctcttgctgtaaaatggaatattgatccctaccttggtgcttgttggaaagattaagtgatgatatgcagctcgtggtgcctcaacctgaggttgggcccaagcagtgtggataaataaacaggtgtaacaagtaaaccagcacaaggttattgcctgcctgctgtgtgccagacccccatgtaggcaagggaaataagatgaataagaaagatgtggttctcatcctcgagttcactgtgtggagcagcgatggctcagctgggggtgcccagaacgtctgtggggtgggggaagaaatattagaatgcgattcttatctggtgcatctcactcttggtataataatggtgatgagcctccatgtgaggcactgttctgagcactgcacatgtttgtaactcacttggtcttcacaatgactgtatgagatatgtggtttttacaaatgaggaaactgagacacggagaacttccttgcaccccaaggccatataactagcatgtggtagaatgcatttggttatatatacatagttaaattatcaatgaatacattttctccagattgggatatgagatcaaaaaagttggagacaactcgtctagagcagtgattatcaaacctcagtgtgcataagaaacatttagggaaggggttaaaatgcagattcctcaccctctggggggttacaggaggtttttaagtaaggtgtcaggtgagaaaggaacacctgggcattcctacatctgaaggtacaggttagccattttcagcctcagtttcctcacctaaaaaatgaggacaggtcctcctgcctggccagcctctggggtgtgtgagcgtcacactggccctgtgcactaggccccgtcacctgctccaagacatagctcctcatcatcagcatttcctttctgttgagtcatccccatccccatgtaagcaagctgatgtttctaccattttacaaacc

SEQ ID NO: 3740 - DNA, 1031 bp, Homo sapiens
atttctattcatttttaattgttttgaaaaatattgtctctgtgctctgtggttcacttaatatgcttaatgtaaaataaagcttatgctttgaatttatgtttcatttagtgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttacagaagcattgatggcagtcgaaatgtctctagctcatataacttaatagtaataactaaaaaacttttagaatttacttttgaaaggagggaagccagttctgaaatgagtataggttgatttcatagtcttcttaattaagagtttagctctttgtaaactcaaaatacataaactttttaagtgtagtttcatttactgaaggataaaaatggtaacagtgcagcaatattcacaaaaaatattgtctaacggacatattttgttaatctgttaggttgggtttttgtttccagggacaaattaaatttgtatgattacccaaaaaagggtctcagtttacagatgctaactctatataaaggaatgtggaaaaactcagttcttaagttacaagattaaaaattcacatttggtctttaagaaacaattgactgacatctatgaatttattttgtatcatgctagtaaacacgaagtattaatgtatgggtattttcccagctagttttgctttctttttctggagcaaaacattaagtgattgcagagtttttcaagcaagagaaaaaggtttgcaaaaaaacccaggaaatgttcccttt

SEQ ID NO: 3741 - DNA, 1034 bp, Homo sapiens
tgagccaccacacttagtctttttgtttgtttgtttgaagagatggagtcttgctgtgtctcccaagctggagttcaatggcatgatcatagctcactgcaaccttaaactcctgggctcatgcaatcctcctccctcagcctcctgagtagtttggactacaggtgcatgccaccacgcccagctaagttttatattttttgtatagagacagggtcttgctaagatgcccaggctgttgagcctggattcttttatatctttctctacttcaaaaaagtgcaacagatagattgtttttaacttatgttaacttatgttaaatatgaaaacttagttgttaaagagctgtttcttttcatcttatagatacagccgtctcagtgcttaaatgttgctcagaggcctttcctgaccattctctgaatactgtatgcccttaccacatgtttttttttttttttttaatttcctggcacatattattacgcaacactatattatttttaaaattttcttcctaatagaatgtaaagccagagactgttattttattcattactaatgcaattgagtacttttttcagtgcctattccaatttttttgcccgtttttctattgaattgctcctccctttatttatttatttatttatttatttatttatctatttatttattttactttttattttcgagacagtcccactctgttgcccaggctggagtgcagtggtgtgatcttggctaacttcaacctctgcctcctgggctcaagtaatcctcccacctcagcctctcgagtagctgggactataggtttgtggcaccacacatggctaattttgtagagagggggtttcaccatgttgcccaggctcgtcttgaactcctgggctcaagcgatctgcctgcctcagcctcccagagtgctaggattacaggtgtgagccaccgtgcccagcctttatttctttttatattcagaatattaatccttcctaaaatagatgtatttcaaatagttttgccta

SEQ ID NO: 3742 - DNA, 1075 bp, Homo sapiens
ctatgagaaataagggaatttttaaaggaatggggacacagtagtttaagttaaataataagataatctgtaagctctctgagtgtaaagtgtgatcattattaacgagtcattcccacagatgtaacagcaaataggggctgttatatacatgaaaatgtaaggaagcccagggggtcagacgcaaaagtttagaggtcactggggaccatggaggtgcatctcactggacatcgtagtgttcattgtcttagttcattgttcacagtcatagcagtctgtttaatactgctagtgaagtaaccctggtctttctcgctcaacctatgatctagtgtttggctttattttagcgaccaatttgagaggttttttgtttttttttttttttggtatgtgtgtggtaaaatagcaagtttttgcttgtagacttttgggaaacttaattcatccaagtattcattgaactcctgctgtgtattagatgtcatgagtataaatagtagcttcactaagaaaagtgggtcctgatgccaagcataatgtagaatttcttactgactttttcccccacttcaagaggggaatgtaagattatttacattttaaaagctggtgtttggacctcctaggtggacatccccacaattggacagccatttcaagggagtgtttgaatcttttaaatggtatgactcagaaactgattctctatcaagaagctgctgctacgaatgggagagtgtcttcatcttacccagtggaacctaagaaattaaattctccaggtaatccctaggactactaagaggggaaaacatttacattttatttcctaagaaagatgactgtagtagactgggcgctgtggctcacgcctgttatccccgcactttgggaggccgaggtgggcggatcatgaggtcaagagatcgagaccatcctgacccacatggtgaaactctgtctctactaaaaatacaaaaattagctgggcgtggtggcgtgcacctgtagtcccagctactcaggaggctgaggcaggagaaccagggaggcggagtttgcagtgagc

SEQ ID NO: 3743 - DNA, 1059 bp, Homo sapiens
tacactgacaattttagggcagaaaaatacagcttaagaattctaaaagtttggctgggcgtggtggctcacccctgtaatcctagcactttgggaggccaaggtgggtggattacttgagcttaggaattcgagaccagcctgggcaacatgatgagaccgctcttctacaaaaaatacaaaaaattagcccagcatggtagcatgtgcctgtagtcgcagctacttgaggagctgagctgggaggattgcttgagcccaggaggttgatactgcagtaagccaagattgtgccactgtactctagcctgggtgacaaagtgagagcctgtccccctccccaccccaaaaaagaattctaaaacttttaatgctacaaaggatcttaaaaattaggtggtctactctctagatgggagatttaagtctcagagattggcttaaataaagttaatgtcagaattggaataagagtcctgtcatttggctccatgtacaggactcctccttctgctatgctactctgcctccttttaaaaaaaaattaggaagaaactagattcaatggtgactcaaggatgctctcagcaactctgaaacacttacagtgtatactgttcttgccatgctgttcaagactgtgactttgccagttctctgttgttcctagagggaaaacagtccagtcccaggcactggtgggaaacagagaacctgggtagcctttcttctgtattttaagagacagggtctcactgtatcaccaggctggagtacagtgtcatgatcacagctcactgtaacctcgaactgctgggctcatatgatcctctcgcctcagcctttcaagtagctggtattataggggcataccaggtgtgcaccaccacacctggctaatttttaaaaatttttgttgaaacagggtcttgccgtgtttcccaggctggccttgaactcctggggtcaagcagttctcctgctttggcctcccaaagtgttagaattacaggtgtgagccagtacactcaaccagcttttcatcttttttttaatgat

SEQ ID NO: 3744 - DNA, 1082 bp, Homo sapiens
tattaattataactaatttgttagagaaacttaaaagtatcagttactcatttggttactcaccaaatatttatttagtggtacgtcagtctctgctagttgtttgtggtagaatgatgaataagacatagcacagcctagtagaaaatacagacgcccaaaataactaaaatgtactgtggcaaatacattgggacctcttattcagcttgggaccaatgcaagaaaacttcagagagggatggtatcttgaaggatgagtaaaggggtttgcctgggaaaagatgaagattttcagtaaagaaaaaaaaaaaatagggtggccgggcatggtggctcatgcctgtaatcccagcactttgggaggccaaggcaggtggatcacttgaggtcaggagtttgagaacaacctggccaacatggtgaaaccccatctctactaaaaatacagaaatcagttgagtgtgctggtgtgtgcctgttgtcccagccactcgggaggctgaggcaggagaattgcttgaacccgtaaggcggaggtagcagtgagccgagatcacatcactgcactccagcctgggcaacagagtgagactttgtctcaaaaaaaggaaaaaaaaaattaggtatcacgtgctaggcactgcctttggatatggtagcaagtaagattttccgttttcttgtgggccgcacagtttggtgggtggaatcagatgggacaagtaaacattcaattacaatacatgatgttagtgccattgttgagagctatgtgagtgtatgtttgtgtgagggaaaccagggaaaattccaggaggaagtgatgtttcaatttcccaccgcagatatatgaaagagcacagagaattctgtagttccttgtagctagaacttgtagtaggtagggagggtagaggcaggaaagttctggaagtctagaaaggaaggttatggttctgagattttttttttcatgaaaaagtttaattaatttcctcttggatatataatgatgaacccaattagtgagattttatgtagaggttaaaaaaaattaaataatatgtgttttttccccc

SEQ ID NO: 3745 - DNA, 1048 bp, Homo sapiens
caggctggagtgcgatggcgcgatcttgactcactgcaagctccacctcccgggttcacgccattctccttcctcagcctcctgagtagctggaactacaggtgcccgccaccacgcccggctacatttttttgtatttttagtagagacggggtttcacagtgttggccaggatggtctcgatctcctgacctcgtgatccacccgccttggcctcccaaagtgctgggattacaggcatgagccactgcgcccagccaaaaaattttttaatttccatcttgatttagtttttgacccagtgctcattcaggagcagattatttaattgccatgtatttgcatggttctgaaggtttcttttggagttgatttccagttttattccactgtgatctgagagagtgcttgatataatttcagttttctgaaatttattgaggtttgttttatggcctatcatatggtctatcttggagaaagttccatgtgctgttgaatagaatgtgtattctatggctgttggatgaaatgttctgtatctatctgttaagtccatttgttccaggtatagtttaaatccattgtttttttgttgactttctgttctcataacctatctagtgtcgtcagtggattattgaagtcccccactatcgtgttgctgtctatctcatttcttaggtctgttagtaattgttttataaatttgggagctccaatgttagatgcatatatgtttaggattgtgatattttcctgttggacgagaccttttaacattatataatgtccctctttgtctcttttaactgctgttgctttaaaatttgttttgtctgatataagaatagctacctctgcttgcttttagtgtccacttgcatgaaatgcctttttccacccttttactttaagtttatgtgggtccttgtgtgttaggtgagtctcctgaaggcagcagatggttagttggtgagttcttatccattctgtggttctgtatcttttaagtggaggatttaggccatttacattcaatgttagt

SEQ ID NO: 3746 - DNA, 1060 bp, Homo sapiens
aactggtagcagtttaccagttaaactgctaccagtttagtatatattcttccagaccgtttagtgtacatttacatgtatgtacctataacattatatattttgtgaagtggggtttatataagtggttttatcttatatatattattcagtaactacttttttcatgtaattatgaaaatttgaggcttttttttgagacggagttttgctcttgtcgcccaggccggagtgcagtggcacagtcccggctcactgcaacctccgcctcccaggttcaagtaattcttctgcctcagcctcatgagtagctgggactataggcgtgcgctaccacgcccaactaatttttgtagaaaaattacggctttttaaagatctactaattttaaccaatttgccattagtccattagttttttctttaaacttgcctacactactaaaaccagttctattgcctttatcagattctttgttctgtgagttaccaggagtgtaaaaaatacaaataataaaaaagatgaaaacaaaatcacccaaccaaaaaagaacaggaacaaaaataattcttaatgatggacccatagggaaaagcagactgttagtatgaagtagggcacaaagaaatggacatcaagacaactatgccaacaagactgttgaaagtattacatttatagagcatttagcatagtgcctggcacacagtaaatatttagtgaagggtagttcatagctacatcacagaagaaatccaacagagaattgaaaaacacttcagcatgggagcaagaggtgggggaaatggtgttttctgcctgtctgctgaaatgtcgacctgcttccctagcctctctgaacctttgtgaagaatggttgaggtgaaagctatagtaggaatagcataggaactatggcgtttttattggggcaggtgtgtggtggtggtagcacccagtggctacacagaatagtgcaattccacatcttgtactttgaaaatatttgaacagaccaatataattgaagcaatatgattagtgaccaagtatttatat

SEQ ID NO: 3747 - DNA, 1233 bp, Homo sapiens
cacctaactttgtactaatgcaggcatcagctcactgatactataaattctttagtggtacgtaatgttattactagtagtgaatgtttgagttacggattatgatctgagttagtggttaacatcctgtatgaaaagataggatttgcataactgaaataatttaactgacttcatgagtgagggtttttctttttgtttataggttttgggctggaggatagttgcaagtattgtttggtcagtgctatttctacccatctgcaccacagtatttataattttcagcaggattgatttgtttcatcctatacagtggctgtctggtaggtgatactcaacttggggagaaagttataggacctacttctcaacataaaaattgcattatgtttcaagcagtttattttcaattactgcctatgttatattgacacatcaaaacattcactttgagataattttaagatgtctccttcgtaacataaatcacctttttattatgtaataagattaataagcttgtcaaagactgtgatcataggaacgaaaagatcattagaagaccccataaatgaaaacttagtttcatttgtttttcctttgggcagctttattgagattgtttgtctctttaaaatacagaatggttcctgtcatcgattcgaaattgtgggtagaaaatatgacatgtacctcttttaaaaatacgtctaaaattaagagcacttgatttctttttttgaaacagagtcttgctctgtcacccaggctgagtgcagtggctcagtcttggctcactgcaacctctgcttcccatcttcaagcaattcttgtgcctcagcacgcgccaccacgcccggctgatttttgtatttttagtagatacggggttttgccacgttacccaggctggtcttgagctcctgacttcaagcaatccacctgcctcagcctcccgaagtgctgggattacaggtgtgagccaccgcacctggcctaaaatgttccttaaattccttagagactaagtaaaattactaaatgtattaaaattaacttgttttctgttaataactacccattattgcctgtttaccgtgtgccagctccttacatatattacttcttatccttcctgtaactctgtgtagttaagaggtactttctactttataaatgggataactgagattcaggttaaataatccatgcagagacacccagctagtg

SEQ ID NO: 3748 - DNA, 1060 bp, Homo sapiens
taggttcttctgtaagaggagctcctgcctttggtcccagtagaggggactctcttctccctgaaccctttcctagaacacaatatgggtttgttccattttataacaatcctggtggttttttcttttttctttttcttactttctttttttctttttgagacagagtttcgctcttgttgcccaagctggagtgcaatggcatgatctcagctcagtgcagcctccatctcctgggttcaagcgattctcctgcctcagcctcctgagtagctgggattacaggtgggtgccactactgcctggctaatttttgtatttttattagagatggggtttcaccatgctggccaggctggtcttgaactcctgacctcaggtgatccacctgcctcggccacccaaagtgctgggattacaggcgtgagccaccgtgcccggccatttatctggtcatataatttatctggtgatcccattacactttgtattaagtatcactctcatggtgcttgaaacactaatggctgactaatcatgtgtccatctgcctattcattaatttgttcggctatttattcattcatttgtccactgtatactacaatgtctccccagttaggctcagctcgacaagaacaaggcatggtgttactctatatcttcattgcctaccacataacctagtatacatagggcactcagtaaatatttgtggcatgaataaatgaagccacactctgcacatgatcttgctgcaggacaagaacctttactttgctgtgtaatcacagactgtcctttctgtccaagctgctctctcccagaggcatgagatgtgtgcaaaaaccaggggcttagaattaaataaaattacaattaaatcccaggtcagctatggtggctcacacctgtaatcccagcactctgggaggccaaggcaggcagatcacttgagctcaagagtttgagaccaacctgggcaatgcggcaaaaccccgtttctacaaacaatacaaaaaattagcttggcatggtggcatgctcctgtagtcccaac

SEQ ID NO: 3749 - DNA, 1032 bp, Homo sapiens
tttgtattttttgtagagaaggggtttcaccgtgttgcccaggattgtctcaaactcctgagctcaagcgatctgcccaccttggcctcccaaagtgctaggattacaggcatgagccaccgcacccggcctttacttttatttgttctggcttgaaaacctcagagaagggttagaaacacataatcttactttttgttgttgtttttgagataaagtcttgccctgtcacccaggctggagtaaaggctggtctcaaactcctgggctcaagcaatctgcccacctcagcctcccgaagcattgggtttgcaggcgtgagccaccacacccggccctctttctcttatttaagaatactatttcttaagtccatgaaaagatctagaagcagtgacatccaagtatcagtgagcacatcaaatacccagattgtgatctctaaatacctttcccattaattggaaccaagactctttggaggaatggccaattccaaaagtgtgacaagaaatagacaagattagcctgggacattttgttgtgccagaaagtagactaatggataatgtcaagaggatacagaagctaacatgaaggtactcttattagaaaaaaaaaaaaaaaagggcaatttgagcaggaaaaaaaattttacagttgactacaaccatactgaatatatttaaaagtgaatccatattgatagaagagaaaaaataaaagaccaaaacaaaaccctcattggactccatgggatgtaactagggcagaattactcatttgaatatttgtatttaaaaggaaagaattgggcatctatcatgtacagacataaccctggtagatgagagaaagtgctttgcagaagaattcctgctcattgatgtggaagatatgatagaattagagaatcatcattagtccaggcatggtggcccacacctataatcccagcactttgggaggccaaggtgggaggatggcttaagctcagaagttcgagaccagcctgagcaacatagctagacc

SEQ ID NO: 3750 - DNA, 1048 bp, Homo sapiens
catgtattttgacccttaactcatttcttctgttacatttatgttttagatttggtacacacagaggggcagcttcaaaatgaagaaattgtggtaagtgaatatactttatagaattaaaaattaacctgcacaatgtatttagactttaacctatctccatagtcatagttaataaatttcctcatgatattataggtttgtacctaaatcaaccggtagagaaagttattctcaataataatataagctaaatgtacattcataaattaggttcttacctttcatagagagtgacggcaagataaaacaattcatttattttttgttttatttttctcattcatttactttgaagtatttatttggtttgctttctttcatttgattctgtaggcattttagaataggaatgaaaaaagggtcgcgatgccaaaattgaatgttaatttaagcatgaaaggacaagtgagattcatataaggggaactagagcataggatcagcaacaaataagccaaagagagatgaggtggaaagacaaccagtatttttcgacaacattccattgggctttgcttgtcaagtgaaatgaatgcccgttgatgaggaagctgctgcctcatcaggagttccgctattcctggtagttggtcaggccctggttttagacaaacacaaaacaactgaatatctattaggtggtcatgctttgtttaattaaggtttccctaaatgagggttaaaatagtaccttatccattaagtttacttcttcacaacttgccagaagctgctattaaatcagtgtttcaaaaaattctgtaggaagtttttgaatcccattagttcctttctctcccaccaaaattcacccaagtactggggaggccagtgaggtcctgaaaaatgattaatgttactgaattttatcttcctgtttttttctgtctttacctagtgggttatgattagtaagcccctgctacctttcgtatattgtttcaggactccactgtggagggttacagcattatagaaaatttgg

SEQ ID NO: 3751 - DNA, 1054 bp, Homo sapiens
ggtcagaaaacaaggatgattagttgaacatctatttacagagtaatcagactctaggtaccttcttccgtcctacaaaactaggtgaccactcctttatcccacagacctccaccacaaccctcaagagacaactgcaaatatagaatgttgaggctcaggagaccagatatagtagggagtgagtgagacatggagttgaaaatacgatactagtggaagcctacatattgaatagtgggaacaccagcctccttcctgtgttctggtattaacttcagcagccaagaatataccctcagctgggagactggaacattcatctttggagaaactaaatggccctagaaaaaagacctatggatactgacaaaggccagctcatttctggtcaccttatttaagtccagtaatcaataagtgtggctcatgcacacagttttcaaatgatgcacagttttcaaatgatccacaagtaacaaaagaaagatcacaagacattaatgaagacctcaaaccctgaatataatcaagcttttagctctaatttccaatctataagaaatgtagaggatagaggaacaaattaagtgaaaccacgaatagacaagatgataaaatctagaatgtggggcctgggcacagtggctcatgcctgtaatcccaacactttgggaggctgagggaggaggattgcatgagtccaggagttcaagactggcctaggaaacatggcaagatgttgtctctacaaaaaaaaattaaaaattagccagggatggtgacatgtgcctgtaatcgtagctacttgggaggctgagatggaaggaccacttgagcccaggaggttgagactgcaatgagctgtgatcatgccactgcactccagcctgggtgacagagcaagaccccatctctttaaaaaaaaaaaaaaatctagaatgtgggacattgtacaggacaactgacctggtctcttcagtaagtcaaagacattaaaaaatgtgtgtaggggagagaaagcagttgaaggttaaaagagacttaattctga

SEQ ID NO: 3752 - DNA, 1027 bp, Homo sapiens
acgctggagtgcagtggcgcggtctcgcctcactgagcctccgcttcctgggttcaggagcttctcctgcctcagcctccggagtagctgggattacaggcacctgccaccacacccagctaatttttatatttttagtagagacgaggtttcaccatgttggtcaggctggtcttgaaccgctggcctcaagtgatccgcctgcctgggcctcccaaagtgctgggattacaggcgcctgccaccaggtccggctaatttttgaatttttagtagagagggttttggggtttcaccatgttgcccaggctggtcttgaacttgtgagctcaagctgttcgcccacctcggccttccaaagtgtcaggattacaggcgagtcaccaggcctggcattgtatggatttctctaaggttggttgcctcttctcattaactgcaacaaagaaccttaaagaaaaccaagtctctgccgtttctacttaagtaattctacccaaaacaggaaataggaagggtaatggtgaatatagaaggtgtgaaatgagttttgtattaaagcatgtgtttgcttctctcagaaaacttaagaatgtgaggtaagaaaagaactgaacatttggagagtacattctttcctattcatctgctccatatcaaccctaaagtgtaactctcttttaaaaaacaagttatccgccggacacagtgactagcttctgtaatcccagcactttaggtggccaaggcaggcggatcgcttgagctcacgagttagagaccagactgggcaacatggcaaaaccccatctctacaaaacaaaaaaattagccggccgtggtggtgcatgcctgtagtcccagctactaggaaggctgaggtgggaggatcgcttgagcccgggaggcagacgttgcagttagccgagatcgagtcattgcactccagcctgggccatagagcccagaccttgcctcaaaaaaaaaaagttctctccctacatctccaaccctcacatttccaccg

SEQ ID NO: 3753 - DNA, 1017 bp, Homo sapiens
ttcttctgattgattttttccgttctcttttccattgatgttcattatagcatgatttattcttgatgaaagcattaaagatgagaatgatacgatttgtcccttcccgttctacccttaaggccttgctggtccttatttaattacatcttaagagtcttcttatttttggacttaattcaaaagcctgttattctgatagaggtgacaggtagctagtaagtgtgtttggtggcaaattaaagtatccttggtttttaagctttaccataatgtgcatagataactaagagtttactctaatgctattgattatggtagatgtatttaattgtttgtatcctgtcccaataaggattggagtaatcttgattatattgttcttttgaatatacatatataaaaataatatatttctcattatttattttatttttagcttatgtccctgatgccaaaaatgcacctactctttcctctaactctggtgaggtcattctggagtgacatgatggactccgcacagagcttcataacctcttcatggactttttatcttcaagccgatgacggaaaaatagttatattccaggtgacaactgagcttcatggattcatctaaatactaacaacagtaaatgtatatgtcttaaatgagtgtttcagcatagaaccatactcagtcacttacaaatatttatcatcaaataataattacttatttggccctacattaaaatattagacatcagttttattacccttccctttgcccgttagaagcctaatctaaagcccattagtttttatgtaaccagaactcttgagtcttttaaattttatggtggttaaattgataaaatgaaatttttaaatatgagagacaataattaatatacttcgaacataaatagtggccatatatgattacatatggatatcagataaaagcaatatgacataatttttagttttttacagtgcttttactcatgactctaataagagaacttgttg

SEQ ID NO: 3754 - DNA, 1047 bp, Homo sapiens
gccggccctcgcgcctctgggccacagcgaaccacattccccagaatgcactgcgaagaaatgcgggcggaaggcgcgctgagggcggctgtagttttccgagaccaactttcccgacagcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggtagggcccgtccggagcgggctgcgacccttcccttgcagcccatttctcggctccccacacgtatgtcggctctggcaacctggctgttaaatcggcccttcaatcgctgtctcccatctgtgtagctcctgttttcctccctaatcctgcctgcaccccatttctgctgtcattaccggaagtttgtcctgcactaccctgtgataggctgggggacacaaagatgagaaagacgcgatccctttcctctgggagcttgccgggctgcaggggagtcgagcactcggaggaggataggggaggatatggatgattaatgcggggtcctcacctaagggagcgtaaggggggattgtagaaagggaggcgcagatacgcgagtccacaaatgattgattgataacccttgtttactaag

SEQ ID NO: 3755 - DNA, 1050 bp, Homo sapiens
aaattatacttaccactcttacactgaaaatattggtttctattgacattaacttacttatttgctctattctaatatataataattgcaaaatgatattgaatattattactaatagtaagtttactgaatatactttaagatgttgttgtggttcattttgtccttgagatatatcccactaggactgtgtggtcaaaatactgtctttcaaagtcatttgaaatcatttttcctcatgtgactgtgtctccaagttggtaagattcagtttatttgtttcagtttgggatatttaggggttacttaactttgttttgatctcttaaaattatataaagtattttatatgcttacacagtgaaaattatgaaacagggcacatttaaggagatccagccatcatgcctgcttcctcccctctttttactacttcccctgacagagaattattcttattagtttccttccattgttttcttttgtcaaacacaagcaaatcagcacatataaaaatgtacttttaacatcgtagtagactgtgcacattttcacttggggaggttattattattattaatttcaaaataatgttttaataattaacttaaattccctactgcataatgttttaactaaaattctcgggccctgcctgacacttcctgtctcttttcctggcttgctttttctccatagcttctcacagtgtcatatactatatatgtatttcttttattttttatttatttattttttgagacagagtctcgctctgttgcccaggctggagtgcagcggcatgatcttggctcactgcaacctccgcctcccgggtgcaagcgattctcctgcctcagcctcccaggtagctgggactacaggcgcgcaccaccacgcctggctaatttttgtatttttagtagagatgggattttactatattggccaggctggtctcgaactcctgaccttgtgatctgcccacttctgcctcccaaagtgctgggattacaggcatgaaccactgcacctggccccataaactct

SEQ ID NO: 3756 - DNA, 1064 bp, Homo sapiens
agatggtgtaggataatgcagagactgcagatgggtggcctgaatctagcccatagatgtatttggtattggccagcatagagttttaaaattttgaattaattgcagacatttcaaaaatgggagattttaaataaaaatatggatttcgtgcctcttttggaaaatcaatagatttggccaattaggccccacaaactatggactgaaacctgcaaactggcttccctccttagaaggagcactcgctcaccaatttatcatagtccccatcactccctattgtctccctgatgctgagactgtgtgttaattgccattaatcatcacccagttcttcactcatttatggtacctgcatggtccctgtgggcatttgggtttgggacctctatgctgaaggctttaggtcctatggattctcatcccagcctcctgtctgccttctgtgtaagcttctgggcctcatctgaaaattgggaatggctgtaccaactttgtaggataaggaggacgattaaatgagataacacatgtgaagcacttagcatacagaacgggctccacattaatggttaatctggtttgtgttggcagcatgtacctgtcccgctgacgtctccctgtgtttgcttccagtgctaccagatggggctgatgtcccggtatgttgagtcctggagagtaggagacacagctttctggcgaggacctttcggagatttcttctataaaccaaaccaggtcagtgccagcaccttaaatcttcaggagatccctgttgactgtggttttcatgtttcggcccatagcatctcactgtgccattctccttgagctcaaacacaatcccaggtgtatccttggggttggacatgggagaagatggaatagacacttatttatttatttatttatttatttatttagagacggagtttcgctcttgttgcccaggctggagtgcagtgacgcgatctcggctcaccgcaacctccacctcccaggttcaagcgattctcctgcctcagcctcccaagtagctgagattacaggcatgtgcc

SEQ ID NO: 3757 - DNA, 1035 bp, Homo sapiens
gaacaactaaaaatccagggattggaaagacagacgctgagcacccccaggcagacggaaacagcaggtgctaaatgccactttgtaggccaggtgcggaggctcacacctgtaatcccagcattttgggaggctgaggcaggaggatcacttgagcctaggagtttgatacgagcccaggcaacatagtgagaccccatcaatacaaaaaatttaaaaattagccgggtgtgacagcgcgtgcctgtagtcccagctcttgggatggctgaggcaggaggattgcttgaacctgggagttcgaggctgcagtgagctgtgatcacactactgcattccaacctgggcaacagagcaagcgaccctgtcttaaaaaaaaaaaaaaacaaaaactaaaaaaaaaacaaaaacaaataccaattctacttcgtgaacatcagatactccctatgccctcacacaatcctctcgtaccttaaccacacatacccgctcccctgttccattctgaagctagggaaatcagtgaacagtctgtcccttcgctttccaccacctcgttccaaaaccggtttgaagttcactattgagctcaaggcaggagagctccccactcagcctcccccacagcagcacagcctgggctgggggcccttgaggacagacccctgtcacagatgcccagcctttgatcagcactgacacctgcagatgaggaaagatgaccagccaaaaggcttttcctctcgaaggcaaaagctcatatttataaagccctaagggatgaggtcctagaagcaaacttccccccagcaactcctactctctttttccagttgcagctgaaataacttcagtctcaagtaaattgcttttcatagggtttcacagcgggtggggcaagtgttcacccaggaaacccgtggcccccgtgtttaccttctcattagtaaccacaccagcaccgccgatggccccagctctggagccgggttctcgtctagtacccctgcccctctcctagtggccacctgt

SEQ ID NO: 3758 - DNA, 1051 bp, Homo sapiens
aatttttctaaaaaccaacctctaaaaaacagcacagtcatgggtggggaagagcgaatggaggcctgtctcctcatccctggcatcagcatcccacgctgggtgggctggaacgtgcttccgaggcagccctccgcgcttactgactgtgacccatggtaggagagtcctttggtggtgtgacccagtctacacacacatgaatatttacacacaaaaccggggttcatgaaagacacctgccttaaaatacacaaagctctctgacttttttttttattacctcggatttttaagagataattattgcagcttgctgaattgctgagtgagtttctacccatagtttgtaaccccaaggttgaagtgaattcatctgcccatgtcttctggggcggggtaggggggtcgaggtcagcatagcccagggttgaggcggtgggggtgggggtcagcttggaactgaggtatgaaaaggatagcccacccagtcgcccagcagtccggggtccccacccttcatgcacttccccctgtccccagctctgcaccggaactcttgggtttcagggctggagatgggccttggacccatggggcttctcatcccagctctgccactgaccagttttatggccatggccaagttccttcatccctcgagacttagattcctcatcagtaaaaattggaatgagaaaccccgcctcacagggctgctttgaagtgcaggtgaattcacggtgtgcgagtctgtgctgcccacaccgtgtggccctcactcactgtcccctcactccctgtgtgttacatctgtggtgccccttgctcctcttgcctctgttgtttatctgtcggtgcccccggccctcctgcccccaggaaacccgtcgcctgggcctctccctgacacttgatcagtactgcctcgagtcacccatagccgtgtcactgtcccccagactgtgagctccttgagggcagggcccttcccgatctttccccacctcccgtgcaagcggcacctacgtgctttgcacctgggtccctg

SEQ ID NO: 3759 - DNA, 1025 bp, Homo sapiens
gctgctgctcctggcgaagccctcactgggggtgtaaactgactcccgaatctctggcttctgtggatctgatactggaaggatgggtgtcagtagctgcgttcacctcatgcttattaagagcttgggctggtttatcctttctcctttggacctgagtttttactttgcgttttcttagaatggagtgatttttccctgtgcctggaagctgctctgccgcaggtcggcagttctcccagcactgtaccgtggctgctccctctgcccccacgaggtccttctgtccttcatagggggatgggagtggagacccctgcggggctggagagtatttttgttttgtctcttcatagctgactgaggggtggactctcttgctcctgtccccacctaccttctcagcaaattgtactgaggtttttctccctttttttttttttaaaaaaaaggtcaaattccttagcccttgtagcagaagaggtttgaggaagagaattccagcagaatcctgtaataacacgcctcggcatgacatggatcaggatagaccccctgagtaagctcatgccacagtgggaggaacctccccttcaggggagtctgggctgggctctgggcccaggcactgccctgggggtcagaggccattccagcatctagctcagtgtgaggcactgttctaagtgcagggaaccacagtatggggtcaggttcatgtcctgtttctgcctaagttaactcccaggcaacctctccctgaaacacttcctctcccaaagagggccttagaatccatgaagctcctaggccaggcccacctgtgatcctgtaaacttttctctcagaaaagccccatctcaggctaggcatggtggctcacgcctataatcccagcactttggaggtcaaggtgggcagatcacctgaggtcgggagttcgagaccagcctgaccaacatggtgaaacctcgtctgtattgaaaatagaaaaattagccaggcatggtggcatgcgactggaa

SEQ ID NO: 3760 - DNA, 1049 bp, Homo sapiens
ctgtgtccttttcccaccatcacctgcaactccctactcagcctcacctggcttctcttccctggggagccccttcactcctgctgcgtgcagctagccctgtgcccagaagacgccctggtccttggaggagagcccccctccccacccccatccccccaagagctctttaattcaggaaattgaggcattgttgtcatgttctggaaggacactaggtgactggttccaggccactgttgtctcatggaggcatcattcccagctcccttttcagcatggtaaacagcctcgccgcctgttcacattgccaaagactctaggtcgaaggctgccctgctgtcctcatcctgtgtcgtttggttccaacatgcccgacccaagtgctccccagttgtgttcagaactcgtcatggctcccttgtcctgcacaggctcaggagtaccccctttgccacatcttggttcaagtttccccttgtctgaaacttgacaagggccaccttctccggtctcctgtcctctgtctccgtgctacccatcattcgttctgcaaacacgtggaggcagtgctgtgtggagcagcgctgtctggtagaaatgtactgagggccttgcaggttatttcagagctccttgtagccacataacaaagtaaaaagaaataggcgaaattagttacagtaatatactttaattatgaccaaatatattcaaaatagcactgtaagatgtcatcagtgtaaaaatcattaatgacatcttttatatttttttcccccaaactgcctttgcagtctggtacgtattttatgcttatggtgcgtctctgaaccgcccacatttcaagtacttggtagctgcttgtggctagggcttccatgcaggaccgtgtgagtgtaaagatttaagagcacgagatttgtagcatggtggacctgtttaatgcagtttcttgactgctgtttatgggcattgtggccttgggtgggtgacttccccctccgagcttatgtgcacctcatagagttgtcgtcaggattgaacgg

SEQ ID NO: 3761 - DNA, 1062 bp, Homo sapiens
tcctgagtagatggtactacaagcacatggtgccgcgcctggctaattttttttttttttgagatgaagtcttactctgtcacacggctggagtgcaatggcacgatctcagctcactgcaacctctgcctcttgagttcaagcgattctcctgtctcagcctcctgagtagatgggagtacaggcgtgtgctgccacacttggctaattgtttttgttttgtttttttttttttgtatttttgtggagacggggtttcaccatgttggccaggctggtctcgaactcctgacctcaagtgatccacccgcgtcggcctcccaaagtgctggaattacaggcgtgagccaccgtgcccagcctaattttttgtattttggtagagacagggtttcaccgtgttgcccaggctggtctcaaactcctgagctcaggcaatctgcccgcctcagcctccaggattacaggtgtaagccaccgcgcccagcctcagtacagtaatcttctgttaggaatctgctctgtgccatggtcagggcttggtcaggcacagagactttgcttggcgtttggggtgagacgctagttacttctgtggaaaccaaggattttaaaggaaatcttaaaaggagatgttcatgcaagcacttcagagagggcctttgaaatgcggaaggcttttcttttctgccctattacttttgaggccagctggctcaggtgagattactcttccttctctctgaaggaaggtgtggggaaaggagctgggaccatgggcttagaggttcttccagtgccttggtcttttccctggatgggagggctgagactcgggtggtttttagagtgcggctcttggtgtcctctcttccaggctgccttggtagctgggaactgttttattggaagggcaaatattgcgtagtgtcaataaggatgttttttatgggggctcctgtgtttctgcagtggataagcatgaagaagccaagtgtaagttagtttctaacggctgggttcagccctttttcttcccttgcagaagtttcccatccgagc

SEQ ID NO: 3762 - DNA, 1013 bp, Homo sapiens
tggaacctgtaggatctgaaagtagaggtgatcttccagtttaccctttcagcttggattttggcctgcagtttttcccctcgcaatgggcctgatttcgacggaaagaatgggtctgccctattccaattagagtgtcagggccttgttagatgcaaaataaataaaacaaacttgtgtatccagctctaaaactggctggggccctctgagagttgtcctccctgtggcaggggtgtgtggggacctgtccagggagcgcctgcagctggagcccccgtgcaggcgaggaaaccaaggggatggcatgacggtctgaggacacggcgctgtccggtcgggccgcctccccgcgtcacctactgcctcctgtctctcctgcagttctcgggtttgccattcagaatccgttgaggggcccggcgtcggctcacattttttgggactgggtggcttttgtgctctgttgagagggatctggcttgagccccatggattgtgttgaggttcctctgtcattagtcatcctgttttagagtgggaaaaacatgacagtttactctcagattgaagtttccgagcagttgattgagatgggagttctgaggttttgtgttgtctgcacgtttctgttagcattgatgatggcagtgagcacagtgctgatcacgctagatgctcgcatggtcaaacggcaagacgcagcttcttcctgctgcacatcctgcaaggtgaggctcatgagatgacggccatcccgccctccccttgccttgttccattaacattactatagtaagaccccatatggatgactttctcttctggaggctgggaggtgaaggcaggggaggaaggggtttgaagctgagatgaagcctcataggaagtgggatgacccagtggggaccgtttctgacagaaggttcctcaggggtgttttatggagaagtcacttgaagaagccaccttaccagtcagccaagaagtttggatccatttggcctctctgg

SEQ ID NO: 3763 - DNA, 1107 bp, Homo sapiens
cttaacacagagttgtgtgttacattaggcccaggttcacagggatctccgattggttggcttcctgggtttcttgttttttgaatttctttcccctggagaggttagtgttcctgggatttgtgagggagcggggagtgggctggagaggagcttagagtacttactgggacttcaggtggctcactccccctccccatctcggttgtaagctcctgggggagaggtctgtgtgttagaggcccagcaggtctttgtggaagttccttgctcccacgttagatgtgaacgccgagaaccacatgacaagagtggtagtgtgtaccctcctggggctctaggatccagcagggccacctccccacttcacccactgcctcgtgtctctcctgtagttctcgggtttgccgttcagtggggtgaccctcagagtccattgagggtcccagcattggcttatgttttgtgggattgggtggaaagacttgcctcactgtaccgtgtcattgctggtctgtccacctgccctgcatgtggcaggtgcctgggaaaggctggcatgtggttttgatgggtaggagtttgaggggctgggaggtgcactgatgctgcagaaagcagagcagacaggcagccttgtaaggctgtagagtctgcagacagtggtatgcgctggctccaggctttctagataagatcaggttgcagatagtgaaatgggagtcccatcttttgttgggcatcctggtgcagcattgggatgtaggagtgctcttgctgagccgggggagtggtcagtcactgacagccctggatctgggtccagttcggtttctagtccctgtatgatttggggagtcagtcccctctgtgctgcagtctcctcctcatctgtagaatgaaggtgctgacctgatcatctgcagtccctctcagtccctcagcccatgtctggatggaaagagagatctcagcagagtctatgcattgctggacctcagactggtttcttggtatagaaggtggctttagggtttatctggcttgtgtgaattttgccccattcagtgtagttccacagggtttgctgaatgccactccccttgc

SEQ ID NO: 3764 - DNA, 1027 bp, Homo sapiens
ctgactttgtaagtgagcccctagctttttgtcaggagtgggggtgtggatctgtgtgtagcagggtggcctcatttgtcgagtgcccaccctgggccactgtgttaggcagtcacgattgctgcaaagcctttaattagcgtcccaggttgcctggctgccttcctcactcgcactgcctttttccttttctcccttcccctcctagcccctttggccttctgtctcctctcactggggactcagacctctcttcctgtcttccctccctcccttcctaggggcctttccttgattctctggggaaaccagataggcctctgttacccctgtgagccctgttccctccacccagaagatgtggagtgaggtgaggggctctacccccagcggtgagactgtgtcaggcctttctctgcgtctgtgtgattttatgaagtctgtcttgtcaaaaccaagaggctgaggaaagtccctacatttattctttgaagatctcttgaacgctggttgctgagcacaaagcaggtggggcgggtggaggaagacttcctgaaatggagagaaggcgagtggacacccgatgacttgtagatatgtgggtagaatgctggagggagaagcggctcctggggcacccgtgcttggccccctttggatgtcggctccctttgcagctcctaagctctgtgtttggggtgggagcggctgcgaggcggtggggggcttgtttggcagacggcgcccatcagacaactggaaagtgccagtgcctgcgtggccatctgtccccgccgcctagctcccggccgccttctgcttcccacagaagggcccgcgctgttctgtagcacaagggcacggggcctggccgggaggggcaggcacagttccattttgccattgtttattcccatctcctttgcagctcctgcgcttgggagttgccaggtgcgtgaaaagtttgctgcgccgtggccgatcaggttgtttggtggggcgctggcgggaaggaaaggtggaagtg

SEQ ID NO: 3765 - DNA, 1064 bp, Homo sapiens
taagcaaagctgttacctaaacattttgggctttaaatttgggttcttttttttatggcaccacactgcctcctagtttctttggtggaaacacttggggggacccatgcaggctttctgtgatcaaagccattcccaggccagtttacctgggtcacaggctttcagatacattagaactggctggggacccctgagccccttccagcgctgttattctgtagttgagaagagatgttttagagagtgaagtgattgccaagattggacagagaatttgtttgctaattcttttaggtatttgttgagtgcctatcgtgtgccagtattagaacacatgataaagcaatgaacaaaagacaaacattctgatcttcggggagctcaagtggaggtttccatatttctgtgctctaactttcctcttcctccctaagcttctagacagctcttttgtccctctgtggactcagggaatgcaaagtaattttagtataatgttttttgggttgaactgaaggagataggtgaatcagcagaggaagagaagttatgtaattgattccaaaaccgagagaaaagatacttggttggcttatttgtttttaatatgtattctttttatttctttgagcacatggtatatgtcaggtactgttctaggtcctaagaattttgcaagtgaacaagactctgaaggtgttggcggttgagtcacacacccagtagtggtgggaggtcatggtttgactccttggtgattatcaacccatgatctgaacatttcttcaaggtaggtgagtgttaactggtcacggtggtccccatttatcctcagcctgtcaggccagtggtgttgctgtggggtaccaagatggcatcgcaccctcctgaaatgatgaatgctcacctgctccatttctgctctctgaaacgtattttctgattctttgctccacggaagtgccctaaacattggagtttttacataacagcttttcttacttatccagcatttctgtcaccacctgcagcttttgccacaaaaacacagtgacctctac

SEQ ID NO: 3766 - DNA, 1229 bp, Homo sapiens
ctccctgtgtaaatatggagtcttagtaagacaacagtgtctaagtatccctctgccccgccccccgtgagacagttcatctcccaggcctccatccagtcagattgcaactcctgggcagcacccagctcttataaatgcctgtcctcgccgttatctgggagagaaaacgaggggtaaaacaacaacaacagcccaccactgaaagcaggactaatccccagggcagtctagcgtgtggctcagatgctcagacaaatgtttagacagcttaagaaggtaaactagaacttacatgaataaaaccatctgcctggtctaagaaaaaggttagatttgggggcctgctattttcagatgctttcaaggccgggagcttatagggtgggggatataccactgagtgttccttcctggtctaatatcttgcgcctatgtaggggctgcccggaggagcccaggtcgggtagaggcttccgccttctgggtccttactcaccaagtagactatctgtggccataaagaggatttgacctgggtacctctgatcccatttgctcactaagtcagtctttccacaaagcaacccctgggggcccttcactctttgccaggccctttcttggggaagagaggatggtttgtggagagagagaccctggggactgctctgtctcaaaggatgctggctgatgccacatattgggcatgtggagatttgctcttagttgagcagctgcttgctgccaggatggtccactgctggcagggttactgagctcgctcttgggagctctgggtctagcatgaggagatgaatgaatactgagaaaagggagagatctttcttgctgagatgtttgtgtgggtgtgtttatttgtggtctcctacgcttgtccttaccatgatggtaaagatgggcatgaagataattaagatggcaggctgggaatgaaaagatacaaattctgaattttgccttaaaccacccaagaaatctttgccaggtctttaatacctctccttcctgaacttttaaaattacgcctccagtctctttctgggagagctttctgtggttgcaccctctttcagtgaggaagggagaactgaacccatggcggaaggacgatgacaacacctcccagtcagggacagttaaaaattagggcttttgccattaaatgagaatccacattgaccagtagtatcatcgtggtggtgggg

SEQ ID NO: 3767 - DNA, 1501 bp, Homo sapiens
attgggagccaagactcccacagtgacggggtggggtgttgtgcatcttcccacgggatgctctcgtcccctccccctctctggcccctggcctcctgcccacctgagtggtgcttgtgcttcggctgtatgaccttttcatgaaatgaaaactaaagaatgtttttaagcaagttcatgctctggaagtcagttagctcacgttgatagccctgatatctcacgttggattaggtggggtctgcattttacactctgtctgggttcttggggtcagggttgtgtgtggttagcatggatttgctttgcattctgtcccctgccaggtggggtgggggatggagggagaaagggatggggacagcttgttccacctgaacaggcttcactgattgacttgcttcttcaccttggcttctgtgaaatggggataatgtaagcatccattataggatagttgagggtggtttgtgaacaaatttcatcctggagaatgtgaggtgtttggtgtcagttctcctggaaaggcttggacaggtcaagaacttttagatgggaaggagcagggccagcagggcctcaagaaagtgtgatgcccttttggggcttactgaagagattaatgacaaaggtggtgtgggatgacctgggatgtttgctcagagtcgtcttcccggagcctgtgctccttgtgagtagcggcaggaaccagggctgcaggctgcaggcctcctggctacccagtctctggatccccaacacgccgtgggctgccggccacctgcctccgcacacattcccgcgcacctgcgtcttacctgcccagcctgccttccaaggctcagtgtaagccctaacttctcctaagaaagctgccctgggctactttgccattctcaaagacaggcttccagccagtgcccattgggctctttgagccctttagtcacctcttcccatgatgtccttgtgcacggctctggagaagcctctgtaataacctgcctttcctgtccagcaggaaagagtctagtggggataacgggatgaacttcacactgaccgcagctctggtggtccagacgtgcacaccatgggaaacaactcatgtctcccacggtcagcccagggcactcagctcagacactttcctcaagcagcccctgggtgtgagtagggagttgggggcaattctgagctggtgtgccgagaggcattcctgtttttttttttttttttcttgaaacagggtcttactctgtcacccaggctggagtgcagtggtgcaatctcggctccctgcagcttccacctcccgggctcaagcaatcctcccccatcagcctcccaagtagctgggactacaggcatgcgccgccacatatggctaatttttgtatttttttttatagagatggggtttcaccatgttgtctagtctggtcttgaactcctggtctcaagcaatccacccgcctcagcttcccaaaatgttggggtt

SEQ ID NO: 3768 - DNA, 1078 bp, Homo sapiens
gccccagccagagggattgggggctgtggctgaggccaggagacctggccttacacccctttccctggtaaagggccctgggttctccaccacagcccctctttgtcctgctctgagtggtttggagttctttgtgcagtggcccagaaatatggacgcgcaaactgtaacagagccccacccacacctctgggtagcgaagcacccatatttgttacatgattgtcttaatcctctttaagcaaggattagcgataactagggggttaaacaaaaatcagaaggaaaaactgtaagttggggaaaatctatccatgaaagaaagttgatgagaatatgggaaagttgggctggattcagttcatttgttataaaaatgggaactctggcaccttgtttctaagctgatggccagaggtccgagggcatctgctttttggggttgtgtggcctgcacgtcaggagagtgcaggggaccggggcctgtagaggttccgtagacttggtgtggatttgtgctgtgttgaggccgagcagaattgtggtgaatcggcacggcttcattattgctggaagtatttttccttacttaaaatatctaatttatttacccatacatgtttaaaataatatagcagataacatgtaaatttagagatactatgttccaccctaaatttacatgatatattttattctaggtcttcatatgcgtttttgttatcagtgtcttaaatgctgtcatcaaagccagtttttatcttctaacccacctttctaggacgtatcaccaacactccaagttgtttgacatatattatttttcagctttgtgtatgatgcttcctctgggaattttgtcccaagccacaggaatccattagaacatttaaacagtggctttgtaaaaatgtgtcttataggtgtctgtcgctggaaatgctccagcagatctgagatccctgctatgatgctggggggatgggtagggaggcaccacccttcctgagtgttaagagcctggctgctggcgtcctacctcaagccacctgtgtgaccctgctcttttctgcaacct

SEQ ID NO: 3769 - DNA, 1159 bp, Homo sapiens
attacaggtgcctgccaccatgctcagctaatttttgtatttttagtagcgatggggtttcaccatgttggccaggctgatctcgaactcctgacttcagatgatccacccacctcggcctcccaaagtgcttggattgcaggcatgagccaccatgcccagcctaactgcacatcttaaaatataagatatatcctgttggttccagctgacttgtcccctaggaaggcacaggaatgcttcccagcatcccctcaggggattgtggggtcacccttccctgggcttgccccagcaccctgtctcactgcgctggccagctctgtcatttttggacttgttgcttggactcacctgagttttgcttcctcctctgtaaagtggtggtaaatgatacctttgtggtcccagcgtgggtgggtgtggacttggttgagccaagtcatttgagggcctcggcaaggtgccccaccgaggtgggggtgagagtttggagaaagtggtgatcaccttggtgagagcacaaactggagatgtagctgaaacaaaaatgtccttataaggctgttattctagcaaaaatgtgttaaaaattggttattggaaacacaaatctacaaggacataaactaaaagaatgaagactctactgacatgctctctctctctttttttttttttttttttttttttgagatggtgtatcactctgtcgcccaggctggagtacagtgtcacgatatcagctcactgcaacctctgcctcccgagtttaagtgattgtcttgcctcagcctcctgagtagctgggactgcaggcgcacgccaccacgcccggctaatttttgtatttttagtagagacggaatttcaccatgttggccaggatggtcttcctcacctgacctcatgatccaccagcctcggcctcccagagtgctgggattacaggcgtgagtcaccacttccagcctctctctcttttttaaaagtattggggtcttaccttgtcacccaggctggagtgcagcctcaaactcctcctgcttcagcctctgagtagctggaattacaggcttgtaccaccatgcccagctaattgtcagattttttttttttgtagagggggtcttgctgtgtttttcccggctggtctcaa

SEQ ID NO: 3770 - DNA, 1164 bp, Homo sapiens
cagctctctggatccctgggtttcaggtacccctgggggattgtgggggcaagtcacattatgttctccctgccccagtgattggaggagcaagtcacatatgccgcttccaaaccagccctggtgcttgtgaggatgagaaaacagtggacgcacagatgcttctggcctgtgcctggcctgaagttgccccatcactgtccattttcttctctcctagtgacttctcattttctaggaatctggaacaggtgctttctccagccactttggcctcttcaccatgattcccgcttggtaccataccacctgagagggttttttcctcccctgccaattattcttctgtagagccaatgctagcctggaatgtggctgcctccaccaggcctgccaggacgactcctatgggaagacatccctcttctgttttttccccaggaactaactctgtaactctcctagtcgtttgttaccagctgcctggaaggagagttatttcagttaaggttgtgtctcttccttcccctttctggaatgaaagctccttgaggggaggaactttacttgccctttctgccaccccattcctggggcctattgcaggtcttgaatgcattctggggtctgtgagcaaggctctgagccttgagaagtgagaaggatttgattcctgcccaggcatcaactgtgctaagtactcgttttaatgaagatggacaaggggcacgtggtgaagcactgtttgtaaactgtgagctgtgacccattaatacatcatgaaaccaacttagtgggtcatgactggtaattaccaaaaaagaaacaaccgtattacacagagtaaacacaaatattgtttctggaaatgtctgttttcagtgatttatgtgtgcatataaaagtatgtgtgccctgggtttgtgttgtagtatttgccttttttgggggctcaacgcaaagtcagaaggccactagcccagagacagctgagactgaatcttagttcctacaagttaagtgacttgggtcaagagacaagcaattgctgagcctcagtttccagatctgtactagaaggaaatgatccataccttagagagttctcgggaaattgtttccccaccacatgttgtgctttcagagtggtgcctggcgggcact

SEQ ID NO: 3771 - DNA, 1087 bp, Homo sapiens
aaaacaccagcaggggagtggagaagggatgacagccaataatgggttcattctcaagcaggttaccactgggggccactacagtgtaactgcactgggaaaactggaaaccagtgtaaaacatgcgtttcaaaggtacatcccacaagggctgagggagctggtatttatacaccaacttccctcagtgagggtagctccagagggatgtggagttcctggcacttctagccctccataggcagcaaagccggccctggcagccagagagccttttgctccattatagatgaatgtccctccccagcacacattatttttgtaacacacatgaactcattcttatctcatggcaaaatatttaaaagaattgcctaatttaaagttgtggccaggggccagacacggtggctcacacctgtaatcccagcactttgggaggctgaggctggtagatcacttgaggccaggagtttgagaccagccaaaaccccatctctactaaaaatacaaacatagccggtcgtggtggctcatgcctgtagtcccagctacttgtggggctgaggcatgagaatcgctagaacccaggaggcagaggttgcagtaaactgagatcccaccactacactccagcctgggcgacagagcaagactttgtctcaaaaaaaaaaaaaaaaaaaaaaacaaaaaaaaaaacttgtggccaggctcggtgatttatgcctataatcccagcaatttaggaggccaaggtgggaagacagcttgagcccaggagttccagaccaagctgggcaacatagcaagaccctatctctgaaaaaacaaaaacattatccaggcgtggtggtgcagcctatagtcccagctacttgacaggctgagaggtgtgagcatcacttgagcccaggaggtcgaggctgtagttagccatgatgacaccactgcactccagcctgggctggacacagcaagaccctgcctcaataaataaataaatgaagttgttacacaggtttctcttataaaaaggcaagcatcacaaatttgctgaccttctctctcttttttttttttttttttt

SEQ ID NO: 3772 - DNA, 1434 bp, Homo sapiens
gtgatttttattttcttctttggtcatgggggccaaggagaaaggcatgaatcttccctgtcaggctcttacagccacaggcactgtgtctactgtctggaagacatgtccccatggctgtggggccgctgcttctgtttaaataaaagtggcctggaagctggcgtttgtcgtttcttgcttgggggaccaaaatgtggagtcagatctgggctcgggtgcaggctgtgccattccccaactcagttgctctcactgaacccatgagcccatggccgagggctagaagaacatgcaggaactgacaggtttatttctatcactgtcagagtgtgattggagtaagtgttgaaaggatccctctgtgtgcagggtggcaagcagaccagtgagaaggccaccactgcagtccaggtgagacgatggtggctctggttagggtggaggcctggctttgtcacttggttgtgaccaattaattttagcaagttaatcctgttgagactgttgtcctcatctacaaactagtggacccactagctgtccattaaaatgcattcctccattctttggacacatagctagactacctttcccagccttccttacagtcagttgtgtccttgtgttaagagctttccagtggaatgtaaacagaagtcataaaaacctatatgaggtctcctggctctccccttcactcagtgcagatgacaaccaggccataggtggttggagagtcttatgtcagaaggaacctggattcctgagtcactgcaggagaagcgcttgtggccagaagtgcaagaccaagcctgagaaacatagtgagaccccatctaaaaattagctaagtatggtggcaagtatctgtaggcccagctactctggaggctgaggcaggaggattgcttcagcccagaaacttgagactgaagtgagctatgatcgtgctactgcactccagccggggtgacacagagcaagaccctgtctcaataaataaatataaggcattacctgggctggtgcctgagagcccaacccagagctccttggtttgctgagcttaggcgctagactggactgggtttgctgagcttaggcgctagactggacaatctgtatgttgctcctcccagttccaaatctgaatcttagcagcagctgccttacaaacctcaagccatgaacctggcatcaagacctatgagaagaagcaagagggccacgtaggggccttggcttggtttaccaacctccttacaggagggtgtcaacaatctgttcactacctgacctaatggaagctgaaagtagaagagaattcacatgcgtatccttggaacttctagttaccccactggcagacctgaggtctgatccctctgggggaggggtgagaaaggtgtttgtgggagggggtcagtggtg

SEQ ID NO: 3773 - DNA, 1050 bp, Homo sapiens
agaggggcagaagcccagcagtctgagctctactcctgactctacctccactgctaagctacctaacccccaagccccaattccctacctgcaaaagggggataagaatacctgcaccatcttcttcaccaggttaacggggttaaacaagagaaatcctccaaaagccttttctgggctgcagaatgagcagttgggtttctctcacgcctcgcgttccgtgtgcctcctggcgtcctcacccacttctctgcctctgcagcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctc

SEQ ID NO: 3774 - DNA, 1103 bp, Homo sapiens
cctctcacttccaccatattctccttattagatcagagtcactaatccagcccatactcaggggaggggcactgagctccacttcttgagaaaggactagcaaagaatctaggggcatatgttaaaaccgctacagaaggccgggcgcagtggcttacacctgcaatccagcactttgggaggcggaggtgggcggatcacctgaggtcaggagtttgagaccagcctgaccaacatggagaaaccccatctctactaaaaatacaaaattagccagatgtggtggtgcatgcctgtaatctcagctactcaggaggctgtggcaggagaatcacttgaacccagaagcggaggttgtggtgagctgagatcgcgccattgctctccagcctgggcaataagagtgaaactccatctcaaataaataaataaataaaaataaaaataaaactgctacacagagctaggattcaaaatgaggtttgtcttacatatttgttctgttaagtaaacactggcccacactgccttcaggtaaaagaagaatctggaagaataggtgtgttcagcctacatttgcatgcaggaagtgaacgttcagacctctagggatctgtcattgtgctgatctgtcattgtgtggtagtagggaagtgggactgggaagagggagaagtcaagctgtggtgcagtcacaaggaagacctcagctaacccacaggcagccctggggtaagatggccctccagagttgtgtcacctttaggccagtgggctaggactttataccaaatgctgccccatcaaccagtcattgtgcagactgaccttggatgaggcagctcccttctgccaagggcagttctccctgagtgtcagcagtcagcaccctgtgcagctgggggaacgggtgcctccctggagcgggcatctgcgcgcagcatcctctacagtagaaatgcagaagacaagacatttctagaggggaggaataaacaatttcaaatgcatgccttttccccccctctgctgggataactcttctcctcccattggcggcctttcccccaggttcctccctgatgagtaaggccctggaatga

SEQ ID NO: 3775 - DNA, 1008 bp, Homo sapiens
tgaactccagcctgggcgacagagcgagactctgtctcaaaaaaaaaaaaaagatggtcctattttttaaaaacagtgggcatatgtatgtaatttctaatagacaaataactcccacaaagtatgtatttttattgtcatgttacatgtgaagaaacaggctcagagatgacctgcctgggtgtgtccccagctgcccaccctaaagcttgtgcttttccaggatcccccctgcctctccccgagagcatctgccagaattcatttatggatgaggaagctgaggccaggagaagctcagccatcccaaggcacacagcacattgagtcatgaccatttagggctgcaggagacatcagctcaatagaagatttgggtgtgggagcccccagggccagggaggtatgagccttattcatgtgagcatcctccagacgatggtggctgcctggggagtgctgtacccggaggactgtggagcttggtccagggacagcagggaaagtgccatgaccagttggtgccatgagccctgggttgcactgaggggctgacccattcccagagttcgtgcttccctggccttggggaaggtgggaagggagggagggagggaattcccctgcatggggcactgcatcagggcagttaaatgtttaactctgttaaacacttgcaccaggctaggcggggtcgctgagttctctagactgtcggggactcactgtttggccctgggcacacaccacttaacctctttgagctcctgctctctctgctagaggatacccgctgtgcctaacctcaccagctttcaagagtctcaaaggcagtaatagacatgaaagagctttgaaaaggccaggagtgctgaacagaagccgggtgtcgctgttacaccccgatggtgctgggcgcttgtctgcaggctgatcacaatgccctctgtcatttcagctgaatagcattggcaattactacaagccgtggttctttaagcatgtgga

SEQ ID NO: 3776 - DNA, 1456 bp, Homo sapiens
aagaggtaatgtaggctgggcacagtggctcacacctgtaatcccaacacttaaaagaggtaatgtaaacttccacaagattcgagtaatcgatttgatgccttggaatctagattgacattccttccacatataccatgcaatttttattagcagttttttctccatttagaaaggatttgtgcttattgtaagagacttggaaaggatttgtgcttattgtaagagacttggaaggtacaaacaagtaaaaaggaaagaaaagactccacctgtaaatatgtcccaaagccagtgttgctaatgtgtttggtacacagttggccccttgtatctgtgggttccacaacagtggattcaaccaactgcagattgaaagcgttcaggggccaaaaaacggatggtttcatctgaaatgaacatggacagactttttttcttgtcattattccttaactgttacatagcatttacattgtattaagtattgtgagaaatctagagatgatttaaagtatacaggaggatgtgcatagggttatatgcaaatactaaatcattttatgtaagggacttgagcattcatggattttgggggatcctggaacaaatcccccatggatactgagagacaactgtatttatttcctctttctctgtatggatttttttgaaagtttttaaattataaaagtaatgtaacaatgctgaaatatataaagaaaaagttaaagtgcatctctttacgccagggtgtaaccacttacgtataacagttttgtgtgcattcttcgagacctatttatttttatttatttattttcttattgtttttttttttgagacagggtctctgtagcccagactggagtacagtggtacgatcacagctcactgtagccttgaactccagggctcaagcaatcctcctgccttagcctcctaagtagctgggactacaggcgtgtgccaccatgtccagttaaaaattttttttttttttttgagatggagtctcactccgtcgctcaggctggagtgcagcgcgtgatctcagctcactgcaacctctgtctcccaggttcacacgattctcatgcctcagcctcgtaagtagctgggattacaggcatgcaccaccatgcctgcctaatttttgtatttttagtagaaatggagttcaccgtgttggctaggctggtctcgaactcctgacctcaggtgatctgcctgccttggcctcccaagccaagtgctgggattacaggtgcgagccactgtgcccggcctggttaattttttaatttttaaaatttttttgtagggatggggtcttgctatgttgccaaggctagtcttgaactcctggcctcaagcagtcttcccacctcagcctcccaaagtactgggattacaggtgtgagccaccacacccagccgagacctatttctctgt

SEQ ID NO: 3777 - DNA, 1026 bp, Homo sapiens
atggctggactttttcaaaagagctttctttactagaactgaagaatcccaatcagaatggccaaggaaaagtcagttgtctgtgtccaagacaaatgtcaaaacaataaaatgatgaggttggacattgatttatggaagcagatgaggtgttgtaggaaaaacgctggccggggagttaggtggtcttgcctgagccctggcattgctgcagctgacttttctgggaagactttggtgagtcatggcagctctgagagactcagtttctttacttgtcataagggggtgctagcgctctccctgggctctgtcgggggtggatcccacaagccgatggactgggaaaggccttgtaaattttagtaatggttcagaagggaggcattttaatgttccccagctacactgcctgacacccactaaagggtgtcaaggcctggccttggactcctgcccttgtgcaatgcccctgccattgtgggtcgttgggcagcagtgccagtcccagctttttcctgaatagcctctgggtcaggggctgtacctagatgggagaaggaggatgctctctcagtgagggtccctgagacagagggcagtattaggttccatgtcatgtcgaagctgcagggaggaaactaaagcccagcaagcacagtttgtaaagctcattgtttgggtttatacaagagagtgagagaatagggactctcccaggctttgctcccccactgactgcatgccacaatgtggggcccaaggtttcagctcacaacacatcaattctgtctcacagtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattat

SEQ ID NO: 3778 - DNA, 1035 bp, Homo sapiens
aggtataacggtcagcatgtccttgtgtgcaaagggcagccttgctcttaagctttccaaaaagaatttccacagctgagggaaaacaagatgcttcctctggaatgtgagtccaaagagttaccagcgctgccctctagtgatctcagctcagcatatgcactaaccgtgtgtttacagggctgagtagtgctgcagtgtgaagtgaatggaaggcctcgaggtgtttgtggctggccaccctgatcagcctgcaggtagtcccgatgaagccagggcacagggggattcgttccagcttgttcactttattctgccttgccaggttactgaaagtccctcgtttgctctcaccagccttcctggaaatgtggactcttgaaagaaaagctcccgtgctcttgaagtatacctgcttgccaggggagtccaagaaaattttgacatgtatttttaaaaaaagaaaaaaaaacagctttaataccaatcattatagtagaaaaagaaaataaatatgtattgaacacccactgtgtgcaaacactgaactaagtgtcagttaatcattacgtctttccaatagtctgtaactttccttaacagcagtctcctctgtggtcccttcacagtacttggtacagaataggccccattaaatgaatgttactgatgtagtaggtgtcatttttttttaagtgttatctttcggatcctcataagcactatgtgaggcagctgtcaccctgattttacagaaaggtaactgcagcccagcacagtgatgtgacttagcccaaggtcactccacacattacctcatcacctacttcatttgcagagaaaataaaagctgtcacaggagagctcctgcggccactaattcccaagcatctgcactgttcttgtctcctctcctgtgacagtgggaagtttgcctctgtccacccaaagcccctagcgctcatccccgcccaccttggcagagctttgcgttctaatgtgtatgtaactcttcaatatccagaacgctccacc

SEQ ID NO: 3779 - DNA, 1019 bp, Homo sapiens
cattttcttatggatgtgtattttgtggagtaacaccaggtgagacaggttctgttttgtttctttggtctcctaaagctcctggcatatttaagcaacgaccacccattagcattgctccctcaagccctctgttgcccctccatgaggaggtagaagccttgttgttcatgtctgaagggaaaccttacctgttagaggtatgtacttgttattctaaagccatttttttccctcctgtttgaggaaaattgctttttgttacgagttatgtttggcatgaagagtattgttaagaaatggttctttcaaattaagttttcttatatgtcaaaaagaaataattagtggaagagaatgttattagtcttctgttcagccaaggtccagacctccaggtccagcccagccagctacccatcagggccccagagggaggtaaatggcacttcatccatcaaaatcatttcgttaattgtagagggtttcatccccaatctcttttgtgtgttcctggtcctggaatactacaactctgaaccacgtgtgttgttaaacctcaggagtgtgggtgggctgctctcagctctccatcatggtgcctgtgtggctcatcctcaatccaaccttccccttccagcagagccgcccccagctgtggactccatcttccagtccttcttccctacctgatttacagatatgtgaatctatgaacaatataattctggtttttttttttaaattaacagtgttgtgctatttaatacatatcttttttttttttttttgcttaatattttttggatctgttggtgattattttaattgtgggagcttttgcctttgaaaaactgatggaaacgactcctgaaaaagtgcacatttgcacaaaattgtgtaaaatttcagacaggcttagacaccctgaagtctatctatagacttctaacagttaagaaaccctgttttcaggcagtgttaattatcttaaaatctgggtagatttcagttaaagg

SEQ ID NO: 3780 - DNA, 1034 bp, Homo sapiens
gtctcttcccacaaggcgatcacagtctgctggtaagttagagatcttttcagaactgctgatccctgatcctcttcctctctaggtctgagctccaaacatttatttgcctacttgatatctgcacttttccctctaatctatttcattcagcaacagacctgttctttttcaaacaaattagatcacattacctctctggttaaaaattcttcagcggaatcctgttgctctcagaataaaatccagaattttcaccattacccacaaggccttgcttgatctggtttttgtccttccaggctttccttgactcactctctgcttgtcaggctttagccatactggctcattggttccttgaacctgccgagcttattttcctgcctcaaggtccttgcacctgttattccttatctggaacaccatcctcccctcttcacatagtaagtggcttctccttcagacatcagcgtgaatagcatttgctctgagaggctgttcccagtcacccagtctaacggatgttgcctgctagtctgctcccttttttctgcccatctcctctactacaacttcagcttcttgagggcagaagccaggttcagttcattccctactagacacaaagaggctggcaaatagcaagcagtcaaatacttattcaggcatgcatgcatatatccatataattcataaaaagaatcagtaagcatttctttgaagtgctgtgtgctgtacgcctgtccctttagagtttgcattagagataaccatttttctagtttgattccaaaatatctttccaacgggactcctgagcattgtgcaagcattagaatgttatagaaagatcatccatttggaaggaacatggcaaatatgcaaatattttattcattcccttatgtccaagcagacttgcttttaaatatctccagagaaactgtaacgtcctttgggtagtatgtttggtttcttggtattcctaatgctcaagaatcccagtgaattacttctacattcttcctgat

SEQ ID NO: 3781 - DNA, 1003 bp, Homo sapiens
cacaatctcagctcactgcaacctctaccttccaggtacaagagattcttgcacctcagcctcccgagtagctgggatcacaggtgtgcaccaccacgcccggctaatttttgtactttttggcagagattgggtttcgccatgttggccaggctggtctcaaactcctggcctccagagattcacccacctcagcctcccaaagtgctgggattacaggcttgaggtaccatgcctggcctagaattgcatattttcttaattcatctaacgctcagtaaagtatgtaactcttaatctctactacatagtaataaccattcctacctacatattctttctgtgtgtctactgaaataatctggcctcagaagagtgctgcagtcactggtgagctgatggccctgtgcagagcagagagtgctctggcacaggggagaaaggagccagattaaaaagttattcgtggtgctgttgaaacccaaagctctctacctctaccctgtaagccatgtggcagacttcctaaacggtattgccttctcagatcccgctgtcactgccagcattggcctctcatcagtaggcacaattcttccattttttaaagtaacttgcaaattgatggcattctatccacaagaaaaaagaaaagattgctgagagttgcccctaacttggtccttgtagcacagggagaaggattcagaatcaccctggagaacactctcttgtcattagctctacctgacccatccctcctcctcttcctcttctgatcgtctgcatcactctgacagtggggccaataatgggtttagcctccattcaccacagctgatactaccagaatgacgcgttttgttttggtccttaaattgcaatgtgttaataaaattctgtatactcataagttcaggaggcatcacttaaaactgtaacttttcattccaacagaaaatggggagagaccaaatttttaagaatacatttcagggcatct

SEQ ID NO: 3782 - DNA, 1072 bp, Homo sapiens
cattcttctcctctgctgtttctattcctctcttttccagtaccttcccccagtggatagcaggtccagttcagggtttgtggggctgagaaatggtggtgcaacttgttatatgaatgcagtcttccagcagctgtatatgcaacctgggctccctgaggtgatttcttttttctatcctttttggtacgatagataatacgtgcgttacttgaaaattgtttcatagttttttattgcttttggggtttcctaaaacaagacataacttgcaattctttagtagctcctgaaatgtgtaaagacatgttgtgtataatcacacatttttataaagttgctgttgtaataagctgcctgtattacagatggacttgacctaatgtgatttttgaactccaaagttgtttttaaattatattccataaagttactgacagttttagtattttagaaatatatagggtctaccatgagcactttacaataatatggtcagtggttttgagagtattccatgtgtactgggctacgcttatttcctgtagagaacctggtattactagaccagtttttcataatcagagtttaaggacatgattttttcataattacaccagctaggaattattaaagttaaatatctgcagcattatagccatgtccaaacatacataacattctaaaaaagcaatgtgggtactaacatgtacatatgtcagagtttcctgtgaagcattttaaatatttcaagcttgatatgtttcttttctgtgcagtcattactttcagtggatgatgacacagacaatccagatgatagcgtgttttaccaagtgcagtctctctttggacatttaatggaaagcaagctgcagtactatgtacctgagaatttttggaaggtatttcacccagtaactcttgagatttaaagatgttaaatatttggctacattctttctctaatggtaatggttttttgtttttattaactttagactaatctcttgccaagaaactgtaaaaggatttggtataccattgttgaaattggtacttggtttcaaat

SEQ ID NO: 3783 - DNA, 1009 bp, Homo sapiens
gataggtgctttagtgcatgaaccttgtcgtttgctgagtgctggctgtgttctgttaactgcaactgcttgtgatttattacagtagtaattttggaatcaaattttgtattagttttatgggtacaaatttgaaagatctctttgtaatgttgaccctccttgagtggtatttatactcttggaggtaggaagaagaggcagagctacaagctgctatttcatttgctccaaatctaactaactttgttcctttctcatgaaaaccagagttaattgagtaatcctgaagaaactatttgctgtttatagtgaaaagggttcctgtacaatttcagtggttattgaaatggacaaggcataataagcagtattttgtggaatcctaagaggtatcttatcacatataaatatttctctacttaaagttgcctcattagcaaaatctgttttaggtaagaaaaaaaagtaaaaccctttattagaactcttggggtattcctcaggctgtgactcccatcctcattgctaccccagccctgttttggaagatttggtgctaggtctatggtagtcttttattaaagcagcagaaacaagtgaatattttaattttcagtaaacacaaaagatatatctttagcagttttattattaataaaagtagttcctccataaatgaagaaggaaggagtgtttttgtaaaaatcatatacagtgccttgattaaaaaaggaaacatttgtttcatccctccccattgtactgaatggtgttgatttatcacagtaattcccagtcttttcccaccaaaaccttcaaggaagaaagagatttaaaatacacagaaactcttttcagaagtaatgctattttgtatcacagtaataaagcaacttttagtgtttagcctgtgtaaatggcacctccctattcttttcttactgtcctttgcaaccctgaagttcagataagaagcaaaggacagtgccagctccatggccattgt

SEQ ID NO: 3784 - DNA, 1097 bp, Homo sapiens
caccctatgaggacaccaaaagccttacatagccatagctgagttgcctctacttaccaaaacacgtaacagaaagtaaaagtagcaagatgtcctcagtacagatactttcacatgatgtggttagtacaggaggaaataacttttagaaattgtcctcccaagcaaaaatttttgctgtggtcctagatagaaggataggtctggaaaaacaagacagatgaggaagtggggatgttcaactttgagaagagagaactcaagaaaatgtgaaagctttttttaaatacttagagcattgttatagagaagtttcattcaacttactttttatgtctccaaagaagttatgcagaagcatgtttcagtatcaatgaacttttatatgagaacagtctgaaaacagaattcagtcccttctgaggtagtgagttcctcatcagtggaaatactaagtcagtcattgtataaaaaatgaataaagagaatttaggcataggtttgcaggctaaaccaactgacctctaaggcttcatctaatgttgagtccaatttagacatcccatcaggtcctacttatgaaatctccactctgtgacattatcagatatcttcattgtaattggagaagagtaatttaaatttttcttataacttgtcaccacgtcatagataagatgaaataaacaacatctttcctgtttgctaaactttaagaaggctatatcagaaataattcttaaattttagttttatagactttttctttgaattttattgtataacaagttaccttcaaaggataattttcaatattaaataaaaatattgttaccataattgacttaattggccatcatgatactttttaatatatttgcttcttgctgaagagttcatatttatgtcccaattttgtaatccttttgggaaggtatctgtttggatataaaccttacagtttttattactgtcattttgcaacttttatagtgtagccagaagtagtctagctagtctcacaagtagttgacctttaatatataccttatttctgtgattctaagatgccagtgattgcaccctgcatctcagat

SEQ ID NO: 3785 - DNA, 1032 bp, Homo sapiens
caaatattgtttatctctttcttcatcagctaagttttaaatattttcttacttagatggaagtggtaatttagatgtattaatagctaatactttaccattctcacatactcttcagagttagttttctggttgtgttaccattctggagcagtgtattgtatgaatttcatctataggcctcattcacatcagtaagcaaaaatcgttcatatgacagcataatttccatggtctgtgtttatattcagttttaaaaatcaagcacaaaatatttattataaaaacaattcatgctgtgttttaaaagttagactgtgtgtcttgagtcactcttcaaaattacctttataagatagtaatgacagaaaatgtactcatattatagtaaagaagctgaggcacctaagattaagcagagtcagttaagggtttatttggcagtattagctagttagtagctgctctgatatgaaaatttttatcttttcattgcaccttctcctttgtgaattgtagatgaagaagtattctctctctacttttgggacagcttcgggagttcttaactgtagcattttatttctacagcccatgctagacccagtcattcttactacaatccaggatgtacggagtgtagaagagaaagacctcaaagacaaggtaaatgccttctccagccagataggccccagtgccagttagttcacagaagcagagccaggacttagcagggttcacacaccatgctctttgaattctggtcacatgcattcacatcgaattaactttacatttcctaattaaaaagtgctgtttctgaagcaccattggtggttgttacctctagtcaatagagttaatacagtgttctcagtaagtgataccattcagaattttactaacatgattttgatggtatcacaattggcatagagaaagttttaaaataatacagtgttacaacttacccagagttgtttaaagcaattttaccatttaaatttaatatgacttattttgtctacc

SEQ ID NO: 3786 - DNA, 1030 bp, Homo sapiens
caatacctagagaatgagatttctgagttgaagattacagtcattccttggtatactgggggattggttccaggattctgggtataccagaatctgtctatactcaaatcctgtaggcagccctgcagagctcacgtatatgaaaagtcaaccttcaatctgggatgcagattttgcatcccaggaatattgtattttcagtcctcattttgttcaaaaaatctgcatgtaagtgaacccatgcaattcaagcttgtttgttcaagggtcaactgtatatttgttttaaaattataattgacagtgctaaatgtctttctaaaaagcttttttgcccatcagtactcccacaaacccatttcataatagtctcattagtgctaaatattttcaatctttaatgttccagtatgatggacaaaaaatggtattttattatttaatatgtaatactctgatttcttgtgaacttgagcattttgtcatatgattattggttatttgtatttcttctgtgaattgacctagtttatttaggtctctttgggtgacgtgttttgttaatttttaggaattatttttatattaagcttatcaatgctgtatctattttgcatatttgtaaatcttttctcctagtattttgcttcttttcatttttattgatggtatcttttgctatatagaagtttcagacttttacgtagtcaaatttttccttggtgtcttaaaagttttctaacttgcttagataatgttctcccacctcaagtttataaaaatatattttttctttttatactttcatatttttatttttttaacttagtccttgaattcatttagaatttatttttgtatatttgaaaagatagggatttaattttattttcttccaaataggtagccaattgttgttagatcctctgttgaataatctctcttttccttattatttgtagttgctggcttaataatatcaaaggcccgtgtgccaatggatttgtttctggacctctgttccagtcat

SEQ ID NO: 3787 - DNA, 1106 bp, Homo sapiens
ttctctaatggatttaaatgtcatatttatgccgatggccctccaatttatatctctgtggcccaaacctcttctctgagtataccagacttgaagagtcaattatctccttttggttgccatacagagttctcaaacttagtgtgtctgaaatggaatttcattttgcctctccagcctttattctcctttttagtaaataacatcatcatctatctagatgctcaggccagaaacataggagtcagccaggattcattccttgaataaagaataaccaaaccataaacaagtcctttgatttaatctctaatatgtctccatttgacctctctcggcgccttctgctgccatccttctccacacacagctgtgaactatctagacactgcactggcgttctgactggttgtgtctgactatgtctcattctcccattcatctattccattccattcttcacagaactgcaagagtgaccttaaaatataaaacactctcttcctgaaaacgcttctgttgctttctttctaattatggtctgtaagtgtctccatgatctacattctttgcctctctgtacaacctcatctctgccactcctggctcaccgtgtcccagctgggagagttttttaaacacagcagagtcttttctgccatcccccatcaggacctttgccattttagcctctctgcctggactgttctttaaacggctacatctgtcttgtcctttaaagattatgttttcagagaagtctttcatgaccaccaccccaagtagaggaaggtcctatttttctttcgaggcctttttgtttttcctttcgtgggacttagcacaatttgaattgtcttctgtatatgatgctctacttggttttgttgaccctgctagaatgagcttcataaaagcaggtacaacatctcttcgtagtcactgttctgtatctagtccctagaacagtgaatgctcaaaaagaaaagaaaaagaggagaaaatagagcttgcttaagagcattaattaatgatctaactgggactaaaacttttaatctctgctgatttactgcttcttatgttaataattaagttttaatttc

SEQ ID NO: 3788 - DNA, 1048 bp, Homo sapiens
cacttactatgtgaattgtgccagacacaaatctgtgtaatggagttcattggtttgttttagggaagaagagtaatttaggcatttattgcaaatatttgtgtggttttttggtttttgtttttgtttttgttgtttttttttttttggtttttgatttttgagacagggttgcttaggctgcagtgcaatggcgtagtcatgtctcactgcagcctcaacctcccaggcttaagtgatcctcctacctcagcctcccaagtagccgggacaacaggcaagcaccaccacacccagctttttattttttgtagggacggggtttcactgtgtcgcccaggctggtctcaaactcttgggctcaagtgatcctcttgcctcggcctcccaaagttctgggattagaaaatatttgtgtttctatagaactttttagggaaataataatggctagtaagtagctgctgttggtgttttattagctatttaatcagatcattgaagttactctgacatggaaatgtaagttcaatcatttcagttcaattggtatttatttaatctaatgctatggttatttctcagcctttccttcatcaaaggtatatattctacttttaataatttcgtaagaactaaggttcctatgacatagttccatatgtatggatttagaatgatgtatatgatttttacgaactaccaaagacctaaataacgtgtattatttcattcattttactaaggtctttctgagtctgacttaaataaagtatattatttcatgcattttactaaggtctttccgagtctgatgagaattgtagaaggtttatggacaggtgtatgcctgaagcatttaaaaaggtaagaaaaatgtgctgctgtgatattttgtgtgtgtcggggtgggggcagggtgaaggaagagaagctttttgttttaattttagttttttatgtataagaccagtttatgaatcttgtttaactgaggaatcctctaatatgaaaaacggaactctgaatttggggcttataaatgatt

SEQ ID NO: 3789 - DNA, 1048 bp, Homo sapiens
gattggcttatttcacttggcataatatcttcaagatcttccatgttgtaacatgtatcataaacacattttcttaaagtttggataatccatggtatgtttatatcatattttgtttattcatttgttgatggacacttgggttgcttccaccttttggctattgtgaataattcggttatgaacatgggtgtacaaatatctgctcaagcctcttctttcagttttttggtatgtgtgtatccagtagagttgctcaatcacatggtagttccatttaagtttttgagaaacctccatagtgttattcattgtaggtgcacagttttatactcttatcagcagtgtacaaaagttccagtttccccacatccttaccaacatttttttctatattttttataataaccatactaatagatgtgaaatttccttgtccatttttaatatcagggtaatacttgcctcataaaataagttgggaaatgttccttgcttttctattttttggaagactgaaggattgatgttagttctttaaacgttttgtataattcactggtgatgccatctggtcctgggctttcctttgtgggaagttcttgattacaagtcattctttttacttggtacaggtcttcagattttctgtttcttcttgagtcagttttggtggtttatgcttttctaggaaatgttcattttacctgggttatctaatttgttagcatacatttgttagtagtatatcttaccatatttatttctgtaaggtcagtggtaatgttttcttggcctggcgaggtggctcacacctgtgatcccagaactttggaagcctgagctgggaggttcacttgagcccaagagtgtgagaacaggctggacaacatagtgagtccctgtctctacaaaaaaaaaaaaatcagaaagatgaaccaggtatggtggtgtgcttctgtggtcccagctactcaggaggctgaaatgggaggtttgcttgagcctagaaggtcaaggctgcagtcagccatgattgtgcctttgc

SEQ ID NO: 3790 - DNA, 1050 bp, Homo sapiens
gttgtggaaaagtacttagtaaaatattagaaaatggtctgctacaaatttaaactgggtataatttgatttgatacttgataaagtttggaaacctctgtgtccccacccacatctcatcttgaattatactcccataattcccacgtccacgtgttgtgcgagggacccagtgggagataattgaatcatgggggcagttatccccatattgttctcgtggtggtgaataagtctcacaagatctgatggttttatcaggagtttccgcttttgcatcttcctcattctctctttgcctgctgccgtccatgtaagacgtgacttgctcctccttgccttctgccatgattgtaaggcttccccagccacgtggaactgtaagtccaattaaacctccttcttttgcaaattgtccagtctcgggtatgtctctatcagtggcatgaaaatggactaatacaatactagatatattttttccaagtttttatgttgaacaatttatagtctacagaaatcaaaagaacaatacagtgaacacttgtatacccttcaccttgattcattatttgcaaacattttgtcacatttgctttagcttctctctctgtctgtctctctctctctcacacacacacacacacacacacacacacacacactttttctgaaccatttgaaaaataagttgcaaatgtcaagacatctgactcctaaatactttaatgtgaatctcctaaggacaaagacattctacagaactgcagtaccattatcctaccaaaggaatttaacattaatacgttaatattgtctattatttagttcatattcaaattctccacttatactgcaatatcctctatagacttttataaaaattgtaatctaggattgaatcaaaaagtatgcattgcatctgttaatcatgttttttttttgttttgtttttttgttttttggaaacagagtctcgctctgtcgcccaagctaaagtgcagtggtgcaatcttggctcactgcaacctccacctcccgggttcaagt

SEQ ID NO: 3791 - DNA, 1058 bp, Homo sapiens
tgacaggatcacaggaaaactgttggggttaggagtgaggttggggttttagccaagggtcggaaagggggggcattgagtaggatttaaaatgaagagggaaggggccgcggccaggaatgaggacttgaataaaatcaggtatgagagcagtggggattgcactgagagggcagaggtgggaggcctgggcaggggtgggagctgaggagggtctaggcagggatggggactggaattggaagatagagctggcaccaggtctgggtaaagagggagtactggtcatcgataaggtcagaaatgagagaaaattagaccggggaaagagatggtagtcatactgagggtgctatgcagaggggcgcggaacagggtgggagcgcagtgggggtggaggaggagtcttgaggctaatggctttgatcagagacctcaagtctaggtggagaagactatgcctgtttagtttggggtgtgagcaaggaacgtgggggaagaaaacggactcttctataataaagaaaaaagatcgaccagaagcagcagtgcttttgaataattactttgcagaaacatagtagctcatggcaggaattttggtcagattcgttgggtagttcatttcaggggccagtagagcagcttggcctgaccacagaaaagcacagatctcaaattattgggattgcgttattaggtagagatacgaatttggttcgttcttaatgaagaattaagcttagtgaagctaagccttttgaaacactttttcctgagcagtgttatatccttttaattgtatgcttttgcaacagttcctcgggctgaagtagcttgaacaagaaggtggcacttaaaaagaacaggtttctgcacaagatttctttggcttccacacttagacacagttgctagattgccctctgtaacccactaacttagctgtatcgttgactagtatatggaaataaagattgttactattcctagtttgggaatttttttaaattcccatataattgagtaaccatacttaagtcattttaagaaatcag

SEQ ID NO: 3792 - DNA, 1028 bp, Homo sapiens
aggtctctaaggaatcaaactgatccacaaataatttaactactcgtcaaaataaaacacaacactctttcaaggaaaacagaaaactccagaacctcattgacataatagtcaaaatgtctagaatctagtaaaatatttacaagacataacaagacagaagaaaatgtgactttcagctggtagaaaaaaaaatcaaacaaatgaacactaatccattagtagaaacagacccagaaataacagagacaattatgagctattagagaaggacattaaaatagctattataagggccaggcacggtggctcatgcctgtaatctcagcactttgggaggctgaggccggcggatcacctgaggtcaggagttcaagaccagcttggccaacatggcaaaactcccatttctactgaaaatacaaaaaattagccgggtgtggtggcggtcacctgcgttcccagctacttgggaggctgaggcatgagaattgcttgaacctgggaggcagagtttcagtgagccaagatcgtaccactgcactccagcctgggtgacaaaatgagacttggtctcgagaaaaaaaaagcaattatatctatgtacaggtattaaaagacaaacatggagttaaggagagaaagagaagatataaaatagacccaaatgaaatttctaaaagttagaaaaaaaatcccaatatctaaaatgttaatttcagtgaacatgattaataacagattaaatattagacaaaaaagatgtcaacttgaaacgaacttgaagacatagcaatagaatctaagttgaagcacagagagaaaaattctctgaggaacaaaaaccagagtgttaataaattgtggaatattattaagtaggctaataaatgtgtaattgtagtactggaaaataaaaggtggggggagggacaaaaaacgtgaagaataatggtcaacattttccaaatttgatgacaactctaaatgtttaaattcaagaagatcaaagaaccccagcgcacgag

SEQ ID NO: 3793 - DNA, 1027 bp, Homo sapiens
cccccaagcaagagggaactcttcagcagatggccttcagccttaaactgcaacattggctcttctctggatctctatcttgctggccaaccctgcatattttggacttggaagcctccataatcctgtacaccaattccttgaataaatctctctctatatatttgtgtgtgtgtgtgcgtgtatacaaatcctattggttctgtttctaattaagaatcctgattaatacaaagtctgaaacaatacaataccgtgttcttgctcaccttcctcactgatatttacatctcccatcttttacagtgagaatcatggtttccaattaaagtcaatatatttactcattttttgtcctagtccaaatatacataacaagacaactgtcttagaatctttaaaacagtcaatatcatgaaaaaaagaaagtaaaaaggcaggagaaatgttctgtgttagatcaaactaaggagatctggcagccaaatgcagggtgtgatacttgtttggattctgaacattactggggaactttgaatatggaatgtatattaaataatattttatgaaattaaatttcttgggtctgataatgatattgtaaggaagaatatcattgtaagagatgagagattcatgttgaattatttaggaatgcaatgtcttgatgtttgcaagctattcttaaatggttcacaaaaacatatgtatgtaaatagatatagatatagacagattgattaatgagggagggaaagactgtgtgtgatggggggaacatgtgaagacatggcaaaatactaacagttaagtaaatctaagtttaggaaaaataggagttacttggattatcctttcaacttttctgtttgaaagttttcaaaataaaaagatgggggaaacagtagcaagtgttatgtatcaagtatttatatatccttgtgcaggtattatataccaaatgttaactttgttttaggcatgtgtcaaatactttatgaacatcattcattaacttgtttccgta

SEQ ID NO: 3794 - DNA, 1026 bp, Homo sapiens
caatcatagtataaatcaagtgcagtaagtcctggtaaaaaactaggtttgatcttacctgaaccacttactggctgtgtcacctgggataagacatttcacctttggagtcacagttactttctctgcaaaatccagaaaataatactatttactgcacagcattgcaatgaggttgatgcattcattcattcattcattcattatctattaagcacctactccgtgtcaggcactgtgtagttcattctccagtgtttctttagtgcctgggcacagagtaggtgccaggcactaaagagacactggagaatgaaatggacttgattgtgccccacccccaccaccccatgaagcttacaagggaaggaaggcattaaacatatgcttgcacatgtaagtattgcaagaagaaatacagcttgctacgagacaggacttcactgagtcttggctgggggtgggacaatcagggaaagcgcccccagaaaagcgatgctcatgttaagatttgaaagacatggataaaagagcctggtccatgagagatggtctgaaaatattagttcccaccccctctgccttggatcagatccctcaccaacacctgctgggtgtgaatgggcttaagaagctccccctcccctctagggaacttagctgaaaagaagtggattctgggaattgcttccaggggcctggaaattgatgaagacacatacaagggaatgaacatggggccagctgtgacattttctgtgtgccttaatgagaagtgctggggctgtactacccggagctgaactcttggcccagcttgccaggctggaggaggagggggagttgcttcacagactgcagggctttgtgaggggaaaacaaatgggtctgtaacttgatggaggcagaggggaggctgccagagctgtgagcctgaagaatagctttcagaggagtgtcaggggaggaggcagcctcttccctcaagctaggggatgtgcagagcagagctggctcttggatcat

SEQ ID NO: 3795 - DNA, 1029 bp, Homo sapiens
gaatgacaggtgaaaatcagtgtggtttactgaaaacacaggtgtggaaacaagctgagcatgatgagtgagtacctttaattttaaaccagttttgagatattataccccagaatgctttgtaagcttgaaggatgtttttcacacagggaatggggctgactgcagctcctggatctgaccttgtcctctgggggttgaatccatacccttgaagtggggacaaaagctcagggcagaccgtagactattaagcaacgtggacagccaggatcgaagtcacagggactgtcagactgagaggagcctttggtaactttgcaggccggctgtgctgggcctcctgcgctctgcctcttcccgctaggaatgctgggatgtttaggttacacaacaaatccccctctacaccagaagggggaggaaccttttgaactctgcccatccgtgccttcattcccctccacttccacgtgcttctcattaaacgactgatagaaggggctggggttgttggtagatttatcatcactctgtcctcctccaactcaatcctccagaagagcttatggtcttaaaggaaaaggggctttgaagaataaagtgcagctatcagggaaaaatggattttagggctatgtctagatattggtttccttttctttctctttttgcctctttattttgttttaaagggcaggtgttttctggtgttttggggcagaacagcatctctggtatttctttggagctagtgaaatcctgagacacctcttcctggtctggtggaggttggactagatgaagttgaaggtcctctcggtcctgagcatctaagatacggttctaggcgtcagttagttgaggaggcaccacatgctctatgtgactgctttgagaccctgggaaattcattttacctctctaaatctagattttctgatttttcaaatgaggacaattatcctgtgtgtatacattgtaggctgttgtgaggatcaaatggaaatgttaaagtttagtctgtaa

SEQ ID NO: 3796 - DNA, 1085 bp, Homo sapiens
actaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgactttagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccaggaatgagcaaggcatggtctgccaccagctgacggaaagcagccttctgtacaacagatgggagggtgaagggggcagaatgaaaatcgaaccaaccttttagctgttgcaaatca

SEQ ID NO: 3797 - DNA, 1046 bp, Homo sapiens
acagagacatcacctgaggttaagaggattgataaaaaagcagcatgtatggcacaaaggccaccacttgaggtgccaagaaacacagaatccattttccagtctgccagataacctcctgagccaagcctttacggactccctgttaattgagttgtaatcttcgctgacatttgctgagagcccaagcactcagagagaaggtagcaaagctggagttgaccccagacagcctgacacagagctggcactccaagacccaggctttggcaggtctcctctcatctctccaccccttcacctcccggcatgtcaaacatttcaatattttccaacacctgagtttctgtattagatacctgtcccctttgatggaacacagttccagtgtcacctcatctctgatgaaaccttctgtattagctgcctctggctgctgtaacaaattaccacaaatttagtggcttaaaagaatgcaagtttcttttcttacagttctggaagttgggagttggaaaagggtctcactgagctaaaatcaaggtggaacacattccatctagaggatctaaggggagatctgttttcttgctttttctagctttctggagctacctgagttccttgactcatggccccattctccactttcaaagctagcagcatagaatcttcacttctccctctctctctcacacacacatatactttctctggcctttgcatccattgtcacaccttcttctgtgacttttgtccttttgcctccctcttttacagatgctgggaccaccttgataacccaggatgatctctccatctcaagatcttaacttaatctcattttatcatgtagcatcattcattgcttctgggacttaggatgcgggcatctttgggggacattgttcagctttccacaacttccccagtccctggagacagtattgtctcacttccttccagtcccccatggccttttgcactttcttcctaccatggctttaggcctcatctactcatggcctgctcatatgtctgtctct

SEQ ID NO: 3798 - DNA, 1013 bp, Homo sapiens
catttggcagtagtttcttaaaggtggactaaggatctttgtgtttgaaaactgaaaaatgaaaggtctagttttcctgtgtgctccaaattgacagttgtgggtttgagtttctaggaagaatggctttccctgaaaaaggtgtttgttgtggaaagcaaataattgcacagtatcatgtattgaggtttgaacaggtgtttttgaaagttggaggatcagttaattgaacgcttcaaaggagcccgctatacccaagagtgtggtgagataagaaaagcacagggacaggaatgtcacatgctcgtcactctctgtggcattattcccagcttgcctagtgggctgctcccagacacagggcagtggaaagagacactcttcagagcctctcgtagctatgtgaattaggtggatcattgatttctttaaccttcagtttcctcatctgtaaaatgagattgctgtttggattccctcaagaggattgctgtaagaatcaaatgaatgccataatgcctggaattgcactctgcagcagtgggctcactggaacgttgagagtcttttagttgggaatggttctggttttctgacctggccccaggatgggcaaaggaaaatgctaaagtagcttctttagagttcatgtgtctcctcccatccttccttccccaagcagagcttcagatcagcagctcttcgcttgctgcttgccaaggccaatccctttctccttaagggatgtcagcatttcttagaaaaaaatgtgctattgagagcttcattgtggcttgcccctttccttgtgttatgttgatattttaattacaatgcttcctgacctcccaggttttcttgaagcagtcatgtgctgtggcctcattatacaatgagcaacagcattgcttccccaacccatacaatggcagcaaaatggattagatagtgctttcctatagttccggagaaacacaagccaagaaattactgcaataattgttatctcttgt

SEQ ID NO: 3799 - DNA, 1081 bp, Homo sapiens
tgtctacagcatcacctttctcatagattctcatatacgtggccaaataaacaactccatgttttctaacaggcctagagaacatctatcgggtgcctctcctctttccctttgtgtttgtcattttggtgaattactggaagatggcagttccagctgaaaggccactgtgtttttggtggtcttccctagttccaagatttgtaaaagaactggtccttttactttgcgaagtgtcattggagcttggtattgcagttgggtagttggggaggaagaggtattttggtctaagagaatagcatgaatccacagtctctgtgtactggtttcttggaggcttactgaagaggagcagcagagcatgaagctggagagatgtccaggtcatgggaactcctaaagtcatacttagggactttatttcaccctgtgtcatggggagccattgaagaggctttagcaaggctttgacatgctcatggtccaagcccttcaggaagcaaactggtggctatctgtagaagggaatgggggccatgagcctgattaggaggctcttgtagcatccagacaagagttatcatgggcctttgctttttaagtcaaggttgtgagggacttttcttggcaggtgatggaatccatttgccatgacctttgagagaatagtatctgagctggccactgataaccagcagcaactgcaagagtcacttggttctcctgggtgccctgggccctctatccaggtctgcaggcagcagggccaagctcagctctgctcactcttattggtagttctttgaacagtgaaagaaaagcctggaaaatggcattcatgaagcagctactatgtgccaggcactgtgctagaggttgtgtgtgcgttgatctcctttagtcatcaccacaactcattttactgtgggaaaaaactgggactcagggaaatggagtgggaaccagaggaagtgctggatctggggttcacatccagatttttttactccaaggccttcactaccccaggcagcacagccttagtgaacttctcaaaggggaaatggttaagagctaa

SEQ ID NO: 3800 - DNA, 1052 bp, Homo sapiens
gaactcaaaatctagttcatcaaaactggaggattgaagtaaaggagacaatctttctttctcttcctttcctttcctttttcttttgagaaggagtctcgctttgtcaccaggctggagtgcagtggtgcgtctttggctcactgcaacctctgcctcccaggttcaagcgattctcctgcctcaacctcccgagtagctggggttacaggtgcctaccaccatgcccagctaatttttgtatttttagtagagatggggtttcaccatgttggccaggattgtcttgatctcttgacctcatgatccacccgcctcggcctcccaaagtgttgggattacaggcatgagccaccgcacccagcctctttctctctctctcattttttctttctttctttctttctctctctctctctctctctctctctctctctttctctctctctctctctttctttctttctttctttctttctttctttctttctttctttctttctttctttctctctgtctctctctctctctctctctttctttctccctccactcccctcccctctttttctttcttctctcactatgttggccagtctggcctcaaactcttgacctcaagcaatctatccacctcagcctcccaaattgctgggattacaagtgtgagctactgcacctgcctgcccagggacagtccttcttgataaatacttcacactacattcacctatactgtccctccctgaaccacccagaccagtttttaaatttggcctttcctgaagtgaaacttttttttttcttttgagacagggtctcaaaaacccaagtcatttttgacactagcataacaatgttgctttttttctaaaggtaaattaatttatcattattgatgctttaaactataccacctaagatttggaaaagacagggaacatcactcataatctaccataaatactattgccattttggcatatttctttttactcatgttgattttctttcagttattaggtatatatacatatgatcttctatgttct

SEQ ID NO: 3801 - DNA, 1048 bp, Homo sapiens
aaagtcgaggaagtagagaggacttgcgtcatgggaacctggtctgcgctggaaggtcagggaaacttgcaaagagaagagacatctctgctgaggtctgaatgggagaaaggagttgagctttctaggcaactggaacagcatatgcaaaaacctgagcgtggtgcatttgagagactgtaaaacaccaaggtggtggggaacaagggggcctgtagtgagtcagcatggggaagcagccaggtcctacagggggctctgcaggccctggcaagtattttggtctttatcctaagagccatgggaagcttttgctgtgttttaagtactagaaagatgtatcagatttgccaggttttcttctcaatctcttcatcctgtggtgtgactgtcagaggagaggccagcataagtggatgaggaaggactgaggatactgcggtaatccaggcaggaaatgatagctgtgtgacctggcatctgctggtggagatggagaggagtggacaagcaaaaggtacttggaaggtgaaattgacaagatggacttgtttttgggggataagaatgagggagactgaatgggctcaaggagggttagtgacagtgcaggcattaaattcgaatatgaaagaaaaaaccatcttattaaacagcattttgattgtagcaaaaattagcataaataagaagaaaattactagtaattccaccactcaagagagaactcttgttatgtacacatatatggatatgtgtacattttttcaaaaacaggatcatattgaacatagtattttgtaatatgcttttttcactcaacaggatgttgtgaatatatcttcaaagcaaaaaataccacttccacaagatcattttttcggtactgcttgctatttcatcttatagcaaatccattttcttcagccagtcagctaatgctcaacatttttggacatttctaacttttcaccatcctaacagcactgcagggaatattttgtactcaagtttttgcccagatattacattctttctggataagtaa

SEQ ID NO: 3802 - DNA, 1046 bp, Homo sapiens
atttagatgaagaggaaccagtgaaagggactgagaaggagtgagcattgagggagaagaagtctaggagaatgagaggccaagaggagaggtgtttcaaggaggcaggagtgattggctgcacccattgttgtgggaatgtcaaataagatgacaaccagaatggaacaatattaggtgatatgtaaatttttttacattattattaaaagttaatgatgtagtagagcttgactcagcaaacttctgaaaaaccattttataaaaaaaacaaaaacaaaaacatcactacctccatggtaatgtctaaaatgttaatgccccatgcttttcatagagggttgatttacagctagacacacttgaattaactatcaattagctttgctttttaggaatgtatctctatcactctgtctgtacagtaatacattgcaatcttgtatcatacccattatgactttatattgaatttatctgttgtcatctcttaccgtacaccgtgagcttcttgagagcagggactgtggctgctatcctcaaaaaagctgtattgagcagaactgaagtcagataggcctggttgtgatgtatgctgtgtctttggtggcatgggtgggtggtgaaaggtggaatttgtgattacatttcagtaccaattcttcagcaccgttctctgacactactgaattgtgtccttcaattcagttcaattcagtctagtccaattcagtccaatctgacattacacaggttaagcacagaccccacaacttaaggatttagttctacaagactgtccccactccagaccccagtgacaagtcttgtgtatcacaaaactacctgcacttctacccagctgactacaaatttgtgagttcccatgaccccattctgattgtagaattccctggaatgactcacagaactcaggaaagtgccacacttagattgtggttccttttatcacaaaggatacaaatgaacagcccaggaaaagatacacagagtggcaagatcttgggtgggtgggccacagtagc

SEQ ID NO: 3803 - DNA, 1032 bp, Homo sapiens
ggcaagttttgaatacaattttgtctccttcaggctcatgctgatatgttattcgaggtaaatttatattcctgtgctgctcaaatacccttgttgatagttccaggtcatgatgatcaaagagccaactattccacctagaaaggaacctggaaagtttcaagtttaattcattttcttgaggttagaatgaaagtaaatgaattttcttacagttttagaggggtgatggaaccccaaagctcatccctaaacagcagtgtagtaaccccctcatcttacctgacatctcttgcctactgtgcacttgctccttttagcagtaacttagccacagtactattgggaagacaaatctgccgcttaaaaaaaaaatcttgaaatacagcctaaaaccaaattagaataggcctttggattagctatgccatttcagtctttcattagtgctgataattagcagaatttaggatgggcatttaaattatggcttggacaacaaaacatctctaggaatgaaattaccattcaacttacattttcaatgagatcttgaaatcacttaaatataaatgaggctgaagagtgctttgatgctgggggctctgaaccctggaaccaaagtggatcattggaataatgataaaagtcacaattgtgctgaccattatctcatacatttgtgcagcaaattagagtttacagagctctttcataccattagaatcttagcaaattagaacgggaagagatcatagaaatcctgtaataccaccccttaatatattgggtgagaaaaatgggatatttcgctgctggtcacagcaggcctattttgcaaggtaggcagggcaagtattattattcttactgcataaagtgaggaagctgaagattgcagatgagaaatgtttgggccgtgagaaatgttttgccccatttggggcaggactttgccactgccctgctgaccccaaatcctctcctagtttgtataagcatatttgttgacagcttcacctccccagaagt

SEQ ID NO: 3804 - DNA, 1032 bp, Homo sapiens
cctaaccccaacagcaacccagtgaggtgggagccattctgtttcccatgttatcctgcagaaacagtcactgagtagcccagtcactcacccaaagctgcacagactggggagtgacaccatttggatggaaacctttgctgttgctaactctataacccatgctcttaactcactcagctgtgcctcttccaagaggcagctaaggacacatttaaataccttccaaggggagtgatcaatgaacaatcattcctttgtaagcaaaatgagatcaatgataaagtgcagcacgatttggtagactccatggtaccttgccattctggggacattttaatgagtaacactaccacatggctagagttaaattgcattttgttctaacacagtaagtttttaggccctttctccctagatccttgccttaatgcctatatttcacccttactgaactgtttactctttctctgagtatgtcatgctgtctcttgcctctggactctgcacttcctgagatgtaattacaggctttcttttctgactcctcaattcaactgtgtctccttcaaggcaggggctatgtctcattttcctacatatcaccaaccaaggctagcatatggtagttgctaagtaaatgtttgctgactgaatgcattacagatgatccagaaagtgatttttatcctgcccagaaccacacagaaagactacatggagctacttcctgccacacgtcttcttgctttacacaggctaacacatgcatatgcctatgaagttctctgagattctgaagcagtaaaaggagctaatacaaattcaagaaataattttatgtgaaacatctagactcaaggttgtcctatttctctttttccaaaatgtagtaacatattttatttgcactgattggcagtgtttgaataatacctaatccctaagtttttatctgggcaatgggagtatatggtctgccctggagactgagcagctgtgtcctgctgctgctgttgatcctgggcagac

SEQ ID NO: 3805 - DNA, 1034 bp, Homo sapiens
taacagtatagacaatttgatgtctcacagtaagcaaatatttcttttaatgcctcctgtctgccagatgtagtgcaggtttccagagatattaagatgacatgggacacattttgagagcttcctgtgcataaaggtactatatgcactattctaagcatttcacattaactcatttaacccttgcaacaatccggtgaagaccctgttattctcatttatggacagctacgataagacccccctgcaacccagggcttcactgttttcactgactaaatacataagtagagggtactaagagcagaaaagagaggcacccaattcagctgtaagattagggaggacttcctggaaaaagtgacacctgagcgaaatcccagtggatgaaaaggaattatgagcaaaatgtgtacagtagtgtttcaggatgaagaaagaccttgagtaaatacaccaagaagtagaatcccctaccaggtgaggagaagagtaagcagtgaaatattgcccggcagggcatgagtagagttgaggttgagaaggaagacaagagactaagtcttagagtatgtgtctattctgctggatagcttggaccttggacagggaaagagggagtgatatggtaagatctgagttatgggcagacatgttgacacagtgcagatgacagatgggaagtgtgaaatgaggcaataagactagttaggagggaacagcaaaggtccaggggagatttttagggtcccaaactaaggcagaggcagttcaaatgagagaaagtcatgtgtgttaactggcaggacctagagactgagaaacaacaaggctactgcatttcttttctttcttaaatgtatagtctgagccccagggcaatgaaagagaagggatttaaggggaatgctctaaggagaagatcatgagtttggctacagtaccctatgatgtgaatcttgggaacttgagtttgccaataaagcaggaaagatagaagaaccttaccctttattgtagcagcattcatctgc

SEQ ID NO: 3806 - DNA, 1070 bp, Homo sapiens
aaagctttactggaaattcttttagaattataccagtgatgaagcacaagcaagggggcaatgcatttctctctctctctctctctttttttaatatcttcacagcatgttggttgtatgaccagagaacagatataaatttacacatgggagagaaaatcatagattgtcagagctggaggtgatcttacttttcagctgaagacacttacccagagaggttacattgtgtatgtgtgtgtctgtgtgtgcattcaattttaatatatttatagtctgttttgtatatattttatattacatgtcatatgtgtatgtatatatatgtgtgtgtatacacatatgtacagtcatatctcccagggggtgggaggtgtagcctagagtatagagattttttctgggtatgtgcatgcctgggtcttcaggtattataagctgcatatgggagtagaggaagaagaaagggcgttggctgtccagcagttatttttgccccatgttgcatgctctgtcttacctggcaaatctgaatgctgacccctctgtggttctgcctggctggtgactatgcttgtcagctgaatctactccactcctgacagtcattactggactgtttaatccaggacctatcacccatctgccttcagactttcttaaatgtgcttacttctctcatgtgctgatgggccctctctcatttattatcccctctgtctttttgttagttctttaattttaatgacatcatgggagaaagaggaaataaatgtgtgtgatgcaactaaattctttacataaacaagattcatttgagtggtaaaataaaatttgaactgggcggtgtttaacccaaaccagaaagacctaaagtaggagcaatgcaatggtcaggcgagagatgatgaggctgacatagggcacaggcttttgtataggatgcaaaggaatacattttaggtatgtttccaagatcaaattcaaaagatttcacatgactgggtagacaataactcttaaaaatagggaaggcagaaggaaaaacaagtttgaagagaagataaaga

SEQ ID NO: 3807 - DNA, 1068 bp, Homo sapiens
tcagagtcatgttgggagcaagccccccaaaatcctgccataaactggccccaaaactggccataaacaaaatctctgcagcactgtgacgtatccataatggccctaatgcccaagctggaaggttgtgggtttacgagaatgagggcaaggaacacctggcccgcccagggcggaaaactgcttaaaggcattcttaagccacaaacaaatgcatgagggatctgtgtcttaagaaagtgttcctgctgcaattaattcagcccatcccttcatttcccataagggatatttttagttaatttaatatctatagaaacaatgctaatgactgctttgctgttaataaatatgtgggcaaatctctgttaggggctctcagctctgaaggctgtgagacccctgatttcccacttcacacctctatatttctgtgtgtgtgtctttaattcctctagcgccgctgggttagggtctcctggaccgagctgctctcggcagagtcaggtgaagctcggcacacacctgtaggccctgctcaaacacgttctccatgggtgatacctggaaagtacccagggctggcccctggatgacctcggtcaaggtacctttcacgcgcatccgtgtggagagaccaccaaacaggctttctgtgagcaacatggctgtttatttcacctgggtgcaggcgagctgagtccgaaaagagagtcagcaaagggtgatggattatcattagttcttataggtttggggataggtggtgaagttaagagcaatgttttgcaggcaggggtggatctcacaaagtacattctcaagggtggggagaattacaaagaaccttcttaagggtgggggagattacaaagtacattgatcagttagggtggggcagaaacaaatcacgatggtggaatgtcatcagttaaggctatttttacttcttttgtggatcttcagttacttcaggccatctggatgtatacgtgcaagtcataggggatgcgatggcttggcttgggctcagaggcctgacagtaccctttctgaatgacacccttg

SEQ ID NO: 3808 - DNA, 1037 bp, Homo sapiens
gtgattcctgcattggtgcccccatgcctccacctgacatccaacagaaaggcaaaggctgagagagcccaagaggaaaaaggtagtgaccatgtccagtgctatttcatgacctcaaataaacttggcccaggagctttcacctgctctcagctaccttctttcaaggggacattcagcccagggagttcataaatacgatgactttaaagtccattcaagggaaagaaggaagggcacagcatgttaaacacaatcctgtgctcattttctgctattaaaagaaagccttcaaaactaatcttaaaaataatacctgtcatttgtggagtgcttcctctgtgcagacactgtgctgccctcataagagctctgtaaggcatgcccgaatcatccccatttacagtcagggaaactgaggtgtcaagaagaaaaataacttcctctgggttagatagctggaaaacactatgctgagaccctcagtcctgctctagaattgtactcttcactaaggtgctgtactgaaattctgtctccatagaagaacatgaaccagcactcaaagaatgacaaactacagatacatggcctttaggaaaacccaccacacaagaagaaatggagagcattaatttaccccatagttacttattgaaaatccactatggtcagacatcgtgctaagttctgaggatgtaaatgaataggagagatggtctcggagttcaccctgtacctgtgaagaggagcggtaacagtaacaacagtgacagctgctattaggttggtgcaaaagtaattgtggtttttggcattaatgtacagctaatactatactaattattttgtatacgttattgcatttagtcttcatcatcaatgaagaatgagtcataattatctgcattttataaatgaagaaatagtggcaagaaaagtttgtgtccccacaaaattcatatgttgaaatcctctgctctcatgaatgggatcagtgcccctatgaaagagaccacagggatctagctggctcc

SEQ ID NO: 3809 - DNA, 1038 bp, Homo sapiens
aaacctgatggttggaagtttcaggacaggttttagttctattttaaaaatatttttgtaactatcagagccatccaacaaaggcaatatagaacagttagtgcatgggccctggggtcagaaaacctgatgtgacattttcagcactaccccttacaagctgagtgaccttgaacaattcatttaaagtctctgacctcgtatacttacctatgaattaagggtaataatagtaactatctcatgtggattttagtgagaaataagacaacgaatgtagggcccagggtccagcctgtaataaacagttaataaatggtagctaattataatttgaataataatggttactaaagcctttgagagatagaacgttctctgtggagagtcatggagaggacgtggctttggagttagtctcaagaaatgactttggaagacactttcctgataaggtcaaaaaagaggaagccttcagttctgtttcacaaaccaaaggacttcctgaattgcggtttctcatttaatgttagatgagaaggtaaagcagcggagaacacgtggtcctctgtaagggagactgcagagaagacagaatgggtgtcttagtccattgtggctgctatcataaaataccatagactgggtggcttagaaataatagaaatgtattttgtacatgtctaaaggctgggaaattcaagatcaaggcagattcagtgtcttgtcagggcctgatttctggctcatagatggcacatttttgctgtatcttcaagtagtagaataggtaagggagcactctcgggtcttttttataagggcattaatcccaatcaagaagactctaccctcatgacctaatcacttcccaaaggccccacctcctccaataccatcacctcaggggttaggatttcaatatatgaattttgcaggcacgcaaacattcaggccatagcagtgagagtcaaggctaggtgattccttctcctcctcccccttttagctcccaggttgagggcagagctgagcaac

SEQ ID NO: 3810 - DNA, 1050 bp, Homo sapiens
tagtctattcaacatgtatttgctgagcatctagcatatgtccatcactggtcaaatgtatagtggtaaacaaagcaaacaaaattctctgccttcaaggagcttacattctgataggaaaagtagatagtcaacaaataaagaaaatatactgactgtcagaagatgattaagtgctatggataaaaacaaagcggaaaagggaaagagggagtacgaggggtggggttgcaaatggaaatagagtagaatgaaggtgatatgtgagcacagatctaaatggagatgagggaagacaccattctgatacctgggggatgagagtttcaggtagaaggaaggtcaagtacaaaggctataagccacagcatgcctggagcatctgagaagaatcaaggatgtgcatgctaggaactgagtgtgatgagatcagagaggtaacaggagccagatctgcagatcctgtgatctttgaaggtctgtgttctgcatgatacaacagcatattctgaaatcctggctgtcccacatgaacattgctctcccatctgttaaatgggaataagagtcctcattttgcttatctccagtggtgtttgtaagggtccagtgaaaagatgggttatggtatagctttgaaaatcattaagtatgaggtaagataatgtttgtattgcttagtaattttgcctcaggccacctgctgctgagtagaaaggctgcccatgccttcacgaatgtggctgtgctggaccattgcttgacagcgggttgtcatcttttcacacagaatctcatcttcgtcctctcctgggcctccaactccaaggcctcgtttttaaaacagcaatttctccccactgtgtttcatgccccaaacctcctaagtggaattacagaccagtaactcacagtggcctgttatttatcctatatgcaataaagactttctgtaggttataggaaataaatgtgctttttactatcatctgtagttcttattaaacttatccccatggtgaggaaatatctttgtgagaccaagcagtt

SEQ ID NO: 3811 - DNA, 1026 bp, Homo sapiens
tcccaaccccaaaccacaggccatgctgaataaatactcccattcctcatgatttcccctacccctggctggtgtgtttaacactggaattgtgtccacttccttttctgtatcacagtgtctcatgttattcatttgttgttttgaggatctgccttttgtccactcctggaagagatgtccccctgtgtaggctgctttgagcctctttcatcacttgctcttccccatcttatttaggaatcagcttagttgtcactgcctcagagattcctctaccatcacccttgtggtggacactgtgaggtgccatcaagaaatcccttcaagatggtacttgttggtccagcctctgagagtgcagtgggcagacagcttgcacttgctaaccttccctgggattgcctcggctacagggagctgccttgcccaaggtcagatccttcctctgatagccttcatccaataacttgttgatgtggaggttatcaggtcaggacaagtctgcatgactgttcaagctccaggactccctcagggttggccaagactgtccctggcctacactgcagctcgacatctccctctgctgacccctgcttccttttccccctccacagatgtagattccaaaatcaccacgcatcctaatacacatcctgcatactactctgtcttggtgtctgcttcaggggagcccgccaacttgaccatggccactgcgcactctccgctgggaggggaccatgttgttccattctcaccctttgtatcgactcatgaagtacattttcttttcagtacaaatcagagtctgtcatgaactgaatttgttgattgcttgtttcccctcacacccagttccctttactaaaatataagtcttttattttagactcttttttaaaaaatccagttttattaaggtatacttgtatggcatgttgactatagtcaataatactgtattgtatacttgaaatttgctaaaatataagattcttatcttcctcaaaggcattcaat

SEQ ID NO: 3812 - DNA, 1072 bp, Homo sapiens
attctatgaacaactttatgccaaaaatttagacaacttacatgaaatgaagaaattcctagaaagatgcaaatttaacacaattgactcaaagattaaaaatgtgaatagattaaaacaagcaaagaaaatgagttagtaattaaagattttctgacaaagaaaagccccagcctagatggctttactggcgaattctaacaaatatttaaaaaagaattaatgccaatccgttgcaaactcttccaaaatatagaagaggaggaaacacttcacaactctttttatgaggccagtgttaacttgataccaaagtcagaaaaagatattacaagaaagttaaacagtagatccatattcctcataaatatagatgcaaaactcctcaagatagtattaagaaactgaattcagaaacatatagataaagagattctacttcacaatcaagtgaaatttatctcaggaatacaagattggtttaacatccataaatcatttaacataatataccatattaatacattaaaggacaaaaaccttataatcatctcaatacatgccaaaaaagtatttgacaaaattcaacacccatttactacaaaaactttcagtaaattaggagcagaaggaacttcttctagctgataaaccatatctaaggaaacctaaccttctatcttaaaagctatagctaatgtcgtacttaatggtgaaagactgaatgcctttcacttcagatcaggaacaaaataggaagtctggtctccccatctctgtttaacactgtactggagattctagccaggaattggcaagggttaaatttggcctgcattcagtttgtgtacagcccacaaacaagaatggattttacatttttgaatagttgtaaacaaaaaaacagagaagcagaaaacaaaggagaaaatgtgtcagactttgtcttgaaaaaaagatattttctatctgtccctttttagaaaagtttgctcatctctgactataaaacatcagaaagcttctactactactactaatagctaccatttaccgtgcttactatcaacca

SEQ ID NO: 3813 - DNA, 1902 bp, Homo sapiens
catggctgaatatgagacctcataaacttacggaggagatgcaagaaggcatgtcagaaagtaaactgtatcagatttgtaaactgcctgaaggttgaaagtgttctccaacccacaaacagatccattgtcaaagggtagaaatgttactgaatcaagatgtttaagtactgcctctgaccactcaacatgatcactacactatgcttaccaggggtaatctctagaatccaggcttaaaatgaaaagaggagtaaaagaaaaactgattggaaacattagtggctgtgcaatctgggggagacaaattctacagaaatagtcaaacaaagtcactgaacaaaacaacaacaataaaaatcctagaaataatgacaacttctgggaagaatcagaatccagaattcctataatatgttatctaaaatatcacttgtaaaacaacaacaacaaaaaaaacaagatgtgcaaagaagcaggaaaatatgacccatactcagaaaaaaagtagttaaaacatactatatttgacgggtacagatttggacttcgcagaaaaagacttcaaagcagctattataaatctgttcaaaggtgaaagcaaaccatgtttaaaaagtgaatggaaagtattattataataattcactagagaatatcaataaagagatataaattaccaaaaaaaagaaccaaatggaagttctggagttgaaaactacagtaattgaaacaaaaaatttactcaaggggctcaacagcagattcaagatgtcaggagaaagatttagcaaacttgaagatagataaataggacttatccaattggaagaacagaaaacaaatagagaaagatgaacagggcctcagagacctataggacaccattaagcacagcaacatatgtttcatgggagtctcataagcaattgaaagaaagaaagaggggaaagaatatttgaggaaataatgcccaaaaactcaccaaatttaatttaaaaaataatcctcacatccaagaacctcagtgaactccaaataggataaacacacacacacacaaatcacatttagatatatcatagtcaaacgattgaaaaccaaatataaagaaataattctaagatcagcaagaagtaaaaaaacactcactgtatacagaggaatgaaaataagattcacaactgacttcctactagaaatagaggccggaaggcagaattattgacatattcaaagtgctgaaagacaaaaacctatcaaccaagaattctatttccagcaaaactattctgcacaaagatattctcagataaacagagactaaatgaatttgtggctagcagacccgacttacgagaaagagtaaagaaagttttctggactgaaagaaaatgacactaggtgatagcttgaattcatggagaaataaagagcacttgtaagttaattatgaagataaatataaaagacaataaatatatgtttcttttctcataactgatttaaaagacaattgcatgaaataataactttaaaatctattgttgggcttataacatataatgatgtatatgactataataacacaaagaaggagaaagaaaatggagatatattttaacaaaatttccatattttattagaagtaacttagtattaatctaaagtatattatgaaaagttaaggtgcatgttgaaatctctggaaaatttattaagaaaacaactcaaaatgtataaataaatccaacaaggagttaaaatggtacagaagaaaatatctatcttacacagaagaaggcaattaaggaggagcacaaaaatcatgagacatacaaaaaagtatcaaaatgcagatataaatccatccatatcaatagttacattagatgtaaatga

SEQ ID NO: 3814 - DNA, 1026 bp, Homo sapiens
tacaataatcatggcactggcatctgcttcaggtgagggccacaggctgcttccattcatggcagaaggcaaaggggagccagaacgtgctgagatcacatggtgagaacagaagcaaaagacggtgagaaaggaccaggttcttttaaacaatcagctctcaatgaaacagtgagacttactcacttccctcttcccagggagggcactaatctactcatgagggatcttcccgcacgacccaaataccctcccattaagccccgcctccaatattagtgactaaatttcaacatgagatttggtggggaaaacaagccatattcaaaccatagcaaataataaatattagatatcaatttttaaaagaaatttaattggtaaaatacaaataacacaaaatttaccatcctaatcatttctaagtgtacattcacattgttttgttcattaccaccctccatccacagaagtcttttcatcttgcaaaacagaaactctgtacttatttaaaaataccatttaatctagcaatcccactactgggtatatacccaaagggaaggaaatcattatatcaaagagatacctacacttatatatttattgcagcactattcacaatagcaaaaatatggaatcaaaccaagtgtccatcaatgaagtattgtataaagaaaatgcgagacatacatacacacacacacatatatacatatatacacatacacacacgcacacatggaatactattcagccacaaaacaaatgaaatcatgtattttgcagcaacatggatggaactggagaccgttatcctaagtgaaataactcaggaacagaaaatcaaatactacatgtctcacttataacttggagataacaatgatacacatggacacatagagtagaataatagacattgaagactatgaaagatggaagggtgggggagaggtgagggttgaaaaattaactattgtttgcagtgttcactattcaagtgatgggtacattaaaagccca

SEQ ID NO: 3815 - DNA, 1027 bp, Homo sapiens
atgaacaagaaataatatttggtggtgtgaagccactgaaaattcaaggttgtgtgttgtagcaatcaatctaccgtaattaatgtaaggtgatgagaaacacatgactttaagaggcaattctaattacagtaagttccttcttgataacaatgttattttcttttaaatataatttaaaaatatactattagttgtactagtagtagcattatagtaaatatttaaatgacatgtcaggtactgttctgagaagtagacattgttaaactactttaatcctcagaacaatcctataagctggttctcttatcctcattttacaaaaaaggaactaaaaaaagagagattaagtaatttgcccatggttacaaagctagtacagatcataagtttatcttactagaattttatgagattagaaaggtcagacattgttattcctgccaatttatgaatgaggaatatataaactagagctcttcttattggaagttttaagaaacctgactgaaattgacttaagccaaaatggtaatggagagttcacataactaaatagccagccaggaccttacaagacatcatcaagaccagtctttttcacattcttggctcacctgtttttgaggctgcctctttccatagcttcttatgggatcaataggactgcaggcagttccagtacatttgttttttgttttttgtttttgagactgagtcttggactgccacccaggctggtatacagtggtgcaatcttggctcactgcaacctctgcctcccaggtttaagcgattcttctgcgtcagcctccccagtagctgtgactacaggcatgcgccaccgtgcccagctaattttttgtatttttagtagagatgaagtttcaccatgttggccaggctggtcccgaactcttgacctcaggtgatccacctgggcctcccaaagtgctgggattacagatgtgagccactgcgcatggccatccagcatgtatcctttaaattcatccaagctagc

SEQ ID NO: 3816 - DNA, 1113 bp, Homo sapiens
ccagcaccatttattaaatagggagcctcaggttttaaaaaatctactaaatggggattaacaaatcatgtcttgccccctttttgaggttcctgtgagggtcaaatgagatgataatgttaaatttttgggaacactgtggctcagaacatgtcccgtggcatttcttggtgtccccactagtctacaagatcttggaagagattgatagttgcctatattttctcaatgcttacaatattactatctactcagaagatgctcaataactggaaatggagaaataaagcattgttgctgttcatcttatcaataagcatcattgttttcaccccctaaattccctgccaaaaaagtgctgttcctttagtgaggttgcctttaagctttactcattgaggctactgctactgctactacttgttactgcttattaaatacctgctacatttaagctcttgtgctagacacttaatatgaattgtctttagcactcctagcacttctgtgtggtggatgtggaacctaggctcagacaacctaggggaaacttgctcaaggacaaacatcctataattggaagagcaaggatttgaacctggtttgtctgactgcaaattctaggcttgttgcctcataccccactgccactagaaatccagcaaggagcccaattgtcctttaatagcccacagttgaggcaggtagtggcttctcctctgagtggattagaagtaattcccactttgagaacgcaggagacaggaggagcagataggccaaggtaaaaagctagggaagcaattcttctttcaaggggaaaaaatatatgtatttggcttctttttcacacatccaacccagcagaaaattggtttgtggaagatgtaggtcgtggctctggccccagcatctggatgccttatattgtacactatattaccagagtaatatcgtgcactttattagcaccagcaggactggggattcccatggggtctgttctttgctgtcagatgtgtaaggccatttaatctcctttatcagatctagttctgcctccccgatccccacctcctcttgcagagcaataaagaaaatttcttcagattc

SEQ ID NO: 3817 - DNA, 1525 bp, Homo sapiens
atgtgtgccctgctctcgttcacttctgagcctttgatatcctgggacagggtttgttgagtgaatggtggtgagtgacttagagcccttccagctttccagggctgtgattctagcattcctaggggaatagataggtgggcccagcaggaggagggcccactccttccacgctgccagccccctgccttgtccacccttgtccttctcctgatgggtgagcacattgcctgctgggaaggtatttctgccccgcatggctgtttcccactcagtgtgaaatgtcatttttgtggggctctcttgctctgcctctgagcatcctgcatttttcccctcatgtcacctactgcaaggtatgccagtgcctgtttacctgtctgggagtgccagaaggcaagatcatatctgtttttctccctattgtagctccagtccttggcagtcaataatcgatagatatttgctaaatgaatgaaagaatgaatgaattcaggattggatcagtgtcacggaagcagacaagcatgagttaggaaaagaacgtgtggtctcaagtcctggtatatctgacatctctagctcagctgatagtaaactttgggcctagcctttatttttctcattatgtttaaaacccaacagtcacccaatagtataatttcctaagtggtttcatttcagctctgctaattgaagagaactgagctctttttgaaggctgactttgtgtgtggctgtcactggtgagagtcgagactggttgtcaatcactgacaatagcttgccgttctggaataatttaagtttaggtctttctttcactcaggcgttcatactctgttatatgttttcatactgagctgagaacaatctggggtgagaaactgtcatgtgttctaggagctgaaatggagatttcttttttgatttcaaattcttatggtctgtggctcagagtagcttgaagggaagatcagattttggagtcagaccttctggactccaggtttgaatcctttgctttcccacctgccttgctagccaggtgaccttgacacagtttactcagtttctgaacctatttccttatacaattacaggggatgtaaatactttgtattggagattatcatgagaattagagagagaatgaaaagacctgggtaagggcagaccctggtaacagcagcagtcctcaccagctcctcgcactgcaggcagtttcctcaggcatctcattgtagacagcactccaaaggggctccatatggtgatcggagggccctggggagcaagcagacctgggttcaaatcctagccctgctacttcacttaccatctgggagactgcataaatcacatgcttctagtattcccttactatgaattggggataatgatacctactcatcaagttgttatggagattgaaattatgtgaactatcagcataatcaatgctcaataaatgttatttcctttctcctcctcctctctacatttcaatatacttaatttacat

SEQ ID NO: 3818 - DNA, 1028 bp, Homo sapiens
tgaaactctgtattaagtaaacaactctccactccttccccacagcccttggcaaccaccattctattttctgtctctatgaataatctgactacattaggtatcacatataagtggaattatatagtatttgtctttttgtaactggcttatttcacttagcataaagtcctcaaggttcatctatgttgtagcatgtgtcagaatttctcttaagactgaacagtattccactggtgtatatacaacacattttgttatctgttgttagagatttgggctgcttccacctttgagctattgtgcataatgctactatgaacattgatatacaaatatctctttgagactatgctttcaattcttttggatatatatccagaagtgaaattgctggatcaaatggtaattctatttttaacttttgaggaaccaccatactatttctgtagcagctgaaccattttatgttcccacaaagagtacataggctttcaacttcttcactctgttattttctttctttttaaatttgttttattttttgtttttaataacagccattaaaatgagtataagttgctatctcactgtggttttgatttgcattttcccaatgattagtgatttggggtatctttacatatttttattagacatttgtatatattctttggagaaataactattcaagtttttgccaatttatttgtttttttgttgttgagttgcaggagttctttatatattctgaatattaaactctgtatcagatatatgatttatgaatactttctcccaaaagtttgccttttcactcttttgattttgtccttttgtgcaaagaagttttaattttgatgtagtccaatttacctgtttttacctttattgtttcttctttcggcgtaatatccaagaaatcattgccaaattaatgtcacgaagctcttctcctatgttttcttttgaaagttttatagttttaggtcttatatttacatctttgattcattttgtgttaattt

SEQ ID NO: 3819 - DNA, 1052 bp, Homo sapiens
gagtcatcagagcattcacgtttttgcctaaatctacctttgtctactcagtaaatttggtttctaaacgtgaccctttcttttagcaactccatggagctaagccataaatgaagtagaaatcatgggagagacaggaaggcttttatcctgtccttgagcctaggggcttgtgccactctcccctggagagagttgcttgcctctgcctccaggaagcatgtggagggacagggcctaggtatgtggcagatgaaggtatgtactagcaagcccagtacatcacaatcagtctttggtaggcaagaagacaaatgcacaggccctacatactctgagcagaagtgtttaatcctcctgcagtaattctgctcattcgtctcttgctctggctcctgagaagtcccagaaagatgtgttacattccacatacagcatctttaaggtgcatgggtgtgggcactatcacagataaaagaaagctaaaccagtggtcgtcaaaggctctgactgtgtgcccctatcagtaaggcgtttttgaggaatcaccccatatatgtatgtttatttatgcattatgtgtattcatttattcattgcatacatgcacctctgcacctatgcttgtatgccataaacatacaaaaataaaattaagaaatgctgtattaaaataaatgtgaatagaagttctaatacgttccttccacatctgagttgattatcttgcacacctcattgaaagtgcacagcctacttagataccactgaagtaaaccatcatacctcctcgcttaggactgtgggaaggacatactctttggagtcagtcaaatctgagttttaaatctggcttctccaatctctaggcaggtaattttggataagtaatgtaatctcttgtgccttagtttgagcgtctgtaaaataaggtatgatactctgagccagaccctctgctgggtgctacagatttagagatagggtaaaagttcctttatcagtagtccaatacagacagaatttcccaggatctgtgaatgactgccctc

SEQ ID NO: 3820 - DNA, 1047 bp, Homo sapiens
gctatgccctgcccccaggggtggggtctacagaggcagcaggccttgcagagctgcagtgggctccgcccagttggagcttccccagccactttgtttacctactcaagcctcagcaatggtggatgcccctccctgggccaggctgctgcctcgcaggtggatctcagactactgcgctagcagtgagcaaggctccctgggcgtgggacccaccaagccaggcacgggatataatctcctggtgtgccatttggtaagactgttggaaaagcacagtatttgggcaggagtgtcccgattttccaggtgcagtttgtcatggcttcccttggctaggaaaaggaaatctcccgaccccttgcacttcccaggtgaggtgatgcctcgccctgcttcggcttgccctccgtgggctgcacccactgtccaaccagtcccagtgagatgaaccaggtacctcagttggaaatgcagaaatcaccatcttctgcgtcgatcaccttgggagctgcagactggagctgttactattcgcgaatgatgaatattaagagaactctttccagacactgctgcagcataaagaggaaggaagttatgtcagttaggatctaaactggaaaacagaatttacatgtattctaagtgtataaattggaggacatttaatataaggaattgactccatagttaatggaggctctgagaaggcaagaggggatgatgaggtgactcagagatcagtaacaccaggaagccactacaactcctaaactagggagtggaggtggtcttactagagccaagggctaagtcacctgggcagagctggaactatggcatgcctgccaggtgggagtcagagctattaagtaggttcaatcactgccaaagatgctgctccaggagagagggaggaggagaatgagctggctttttttctttcctcctcctccgatctcttgcctcccattggctgaacccatctgaaatcagctgatgtgggatctgggaggaagcacagtctcaggtctcagatcctct

SEQ ID NO: 3821 - DNA, 1020 bp, Homo sapiens
cttatataatgaggggctgcaacctcctgggatgggggtgggtgaggaagcagaggccagaggtcctcttaggcacgagggaagctcaggagaggggattggagtatctctggcctcttaagtacagagaaggtgggggaaggggctgctgattagaatgaaaatgtgacagtcatgcaaatcttcccgttggatttatgcatcctttgccaggattccaggaggaggatacctgacagcccccattagagccagagaaatggggaaagttacacattgttctgttaagggaagcccgaagaccagggaatggaggcatccctgctgaatttgttactgagggaatattgatttcaggagaaaaacaaataatgcagaaatgtttccactttgatgtagcacattctgatttggactgcactgtggtgaaacttccttgtgtggctctcagtattccaaagcagacataattcttttccattgaaggatgttattggtggcatgggggtggtagaaaaaatgagcttgcagttgattttgattcagctgggaaatgggttgttccaagaagtggcgaaatgagactactgaggtaggctaaggtctgggagggccttaaattgtgggctaagagatgtggtcagtgtttcagggtaatgaaaaacaatgaaagtcttttgaccagcagactgataagatcagaactgtgcttttgaggttaattctggcagcccagtggaaggtgggctgaaggggtggaaagggtccttttcctcttttcacttcattgatgagcaaatgcatctataggtgctaggctgggatgccagttagaagcctattacaatggccatataacagagaggctgaaagacctagctgaatttgggaaaggtagtgagaaaaagatagagaataatattttgagtattcaataagagcctatcttgtgcccatcattagatgcctatcacctcatttaacccttgcagcaatcctgcaagctaggcagtaatattc

SEQ ID NO: 3822 - DNA, 1100 bp, Homo sapiens
ttatgcaccaattcctgttagtacttggttgaaggctactttttttttgagacaaggttccatctaggctggagtgcagtggcttgatcacagctcactgcagccttgacctcctgggcttaagctatccttcagccccccaagtaactgggaccacaggcatgtgccaccatgcccggataatttttgtgtcttttgtggagatggggtttcccatgttgtccaggctactgctaattccctgatatttctgcttgtcccatgtgtggacagagaagtttccagtggccccagagaaccatgagacagagttgcagatactggcagttggatagagggcttgtataagtggagatggtcaggctgaggatgctgacaccgtatgctacagtccaccccttacccaggcccattgctgcccaggtttactgcatcttctcactgattcttcaagaatgtggcctgtcaaaattctaaatacaaatgaatgagcaaaaacaaacaattaaaaatactctaacagaagggctaatgggaaaacaagagtctctgctactgtgattgccactaaggccatactgataatcacatcaccctcccctctacttattctacatttcatttatccttgcccagctcttctgctaggctaagttgcttgcccagtggggtaaccaaaactttaaccctgagatgtcagaactctcggttaccacgctttcctcaggctggggtcgctgcaatttctaattcattgttattactgggcatgaaagtactaagagatgtcccagtaaatcctatgaattccagatatcctcctccagcccctaatatgtagctatgtagcaccaacctcattggcttatgataatcataatcaattacccctgccagcccagtaagtacattttaaattctgcttacctactagaatgaggagttaaaaatatccagaaagcaaacattttgtaaaagttccccaagtgtgtcactggggtagttatagtgacacagaccattccttctatccttttgttcttgaatctatgtattgtacctattaggcaaacagtgccatgtaatggcattggttcaaa

SEQ ID NO: 3823 - DNA, 1053 bp, Homo sapiens
tgtacaggttttgttttatttttatacgctttcatttttctctgagtaaatactcaggactaggatttctatgttatatggtaagtgtatctttaattttaagagaaactgacaaatagcttccaaagttctgtagcattctccattagcactggcaatgcatggaaattccaggttccacatctctgccaacacttggaattatcagtctttttatttttaaccatgctatggtgcaatcatatctcattgaggttttaatttacattcttctatgactaatgatattgatcatcttttctttggtaaagtatattcaaattttttgtccatttttatcaggttggttgctttcttattactgagttacaagtattattttcatattttttaaattttatatttaattgacaaataataattacatatatttatggggcatgacatgatgttttgaaatacgtttacataatggaatgattaaatcaagctaattgacaaatctctcagctcacatactttttatgtgtggtaaaaatatttaaaatctactcttttagcaatttgaaatatacaatggattatttattatagtcactattctgtgtgatagatcactaaagcttatttcttctgtaaaactggaatcttgtgcccttttattaacatctcccctttccccatttacccccctgctccagcctgtggtgtttaccatctattctttacttctatgagttttacttctttagatttcacatataagtgtgatatgtatcttcttgtgttttcaaagtaagttcttcatgatgaatataatattttctcctagtctgtggcacttgcaagtccagcaccatttatttcatcatggccagacctgaggttcgttaattatctctctgagcctcagttttttaatatgtaaaacggtgttataaatgtgtctacttcttagagtttgtgaagattaaaaggaatagtgcatataaaactcttagcgtaatgcctagaacttaaataagagcttgaatatcatcaactaactgttat

SEQ ID NO: 3824 - DNA, 1048 bp, Homo sapiens
tccctttacctacttctctcttgccctctctgtttctttttcttttctttctttttttttttttgagacggagtctcgctccgtcgcccaggctagagtgcagtagtgcgatctcggctcactgcaagctccgcctcccgggttcacgccattctcctgcctcagcctcccgagtagctgggactacaggagcccaccactacgcccggctagttttttgtattttgtttagtggagacggggtttcaccgtgttagccaggatggtcttgatctcttgacctcatgatccgcccgccttggcctcccaaagtgctgggattacaggcgtgagccaccgcgcccggactccctctctgtttctttatgtccctgtgctttgctgctttgtttctgcctatttctgtcctactgtcattctgttgctccctctttccctgtctctgaccctttttgtctctctttgcttccctctttctctctgtcgccatgagtctctctctgcttctctctttgtctctgcatgctggtttctgtctgtgtctccctccttgcatatctctgtgtctctccctttgtctctctccatctcttgtctttgtgtctatgcactgcccgcccccaccgccacacctctgtgttttctttctctcctttccctcctccctcctgtctcctgcctctgggaagagggcagagatcactgggcaggattggatgtcattaaacgaaaaaaaagagaaaggactccttttctcctgcttgcctctggggaatgcctaacaatgagaaacactttggtgggtaatcgataggaacaagatgcaactagacatctttgttgggcagtgcagccggcagttccctctgactggagcccctgggaatggctggcctcttgaccagcctcaaacagagtgtatcacagtgcagcggacttgaagtgtgagcccagcacatcctgacctgggggtgcctcatttccatccccccctcccctccctcccctgccctcttctcgcctggtaatacttcacaaatatcatgaa

SEQ ID NO: 3825 - DNA, 1049 bp, Homo sapiens
gtggagagagggaggtggcggggagtagcaggaaatgatcctgaagtgttaaatgtgatggtgtgtgtgaatggtgcttcatagactgaccacaggggattaggatgctcaatatggctggaaagcctaatagggcacagccgggaccaccagcccaattggaagattactgtgggctgaaaggtcttggaaactgggggaagaaggaaaaacaaggagagacagggaagaaggaaggagagtggatggactcctcctccctggacatgactgtttcctgggcactgtgctaacagtgtttcttctcttcatcttcctagccaccctgtgtgttacatatgaggaacttaacagtggaaagggttagtgatttgctcccatcatacacaccatttgaacctagatccttagggtccctgagagtgggcttacaacttttgtaacacacagcttcccactttgaatctgtggctcttggtcaaagggggttggcttttcctaacagtccgctctgggccaagcactctcctgggaaagctctgaaggagacaaacttaatctaggtaagccctgaaggctgacaagggatgctgccctgctggtccccagctgccctgtgaggctatgtgatgatcacatgatcggtcctgatgattagagagatgagacctatagaatccaggactcacatcaaagatgacaaatggcgcagcctgtctactttgctctgtaatattccactaaggccacaacttttcgacaaggattcatctgcttgtgaaagctgatcctcgaggcacagtgtcttgtcaggcaatctcaagtacatctaagagtgtacctaagaggctcttagactcttagactcacagggcttggaggaacttaggttccatgcctgcattctgagtaggtccccgagttggcttgctcagtgccagtgacatgtctcaccactcccctggatggctgcactgttggccctgaaaaagttctttatactaaacagaaacccagtaacttggctctagttctacctctgagaacac

SEQ ID NO: 3826 - DNA, 1032 bp, Homo sapiens
tataaataaatcaactggctttgtctaacccagtgttctggtgttcatttcaccaaggaaacccttattttaaaaaatgaatattaacagcttctggaaggaagatattttaggaaatgctgatgtgagcaagggtggttactaggtactcttatctaatatttactgagaaatttatttattcattcatttattagagaaagatatattgagagactcctttgtgtaacgtaatgggctgggagcaacgaacacagatttggccaatgcctgcctgaagcttataatctagtgcacaagacgaaatcaatttcccaattaatttcttttttattactgtggtgagtctacaatgaggagcgtaagatatatgtaaatttaaataatggtataaaatagatggttaggggtaaccagggaagccatgctggttgtccgggaccggggatgtcctgtgatgggtgactttcagttctaaaacaaagacagtcctgggcaaatcagaatggttgcttaccctaatagaccatgactcctggagtgccatctgaaaatcttattatggcagagagaactctgccaggccggagacctgttctctggggttgcttcagctccctgagcctgactttctgtctctggggagtggaggtgatgaagtctcctttctcttatgttttttgggaataacaagtggagtgattcctatagaaagcctttaccagatatcacacgcttcctaagcacaagggatgagtattcctttagggaaactgtagtttgtcactccttgaaggaaagcccctatttctccagaagagggttttcagagcacatctctcgccacacatccaggtttctaaatcctccagcaagaagcgtttttcacagatccaagaacagaagcacctgcgtaagttcacatgggaggtgtaaatcatggaggggagccattgagatgcttcaagacagcacttcctccaggccagagaaggcctcagcccaagaagcagcttcctgctgctaggcagg

SEQ ID NO: 3827 - DNA, 1094 bp, Homo sapiens
cagttgtggattggtggccagagcactttgcttccacatttctgcagtgtgccgttccctgctcttcaactgtcctccttacagcccaggctctgcacctcctgtcgttcagtatctggtcttccttgacccctctggctggatgcaagatccatttgcttggagctgtgagctcagcttctctcatgcaaaccttcctatctcttcctagctttggggcattcacccacaatcttggagacccagctccacagatggtcccagtggacaaccccacagtctgtctcagattctcaaactctactgaaacacatgacaaggacatgtacagaattcatatatctgtgatgccatggactcacacaggtgggtccacatggccatccacatctgtaaatgtccaccaggccaagtgcagagacattgaggcacatttttgcccatggaggcagaagcagcatccacatgcaaacccatttatgcatgcaggatgtgcccaggccgtagatacatgtacacacagactctcaagcatgcatatgaccttatgcatatgagactcagtatgtgggtgctcataccccttaggatgtggataccagtgtatgcaaacaccatatgccttgaacatgaagatttacacactgccatgcaagggccaggaaggcagccttagcctccttctccccagggtgccacacacaaaacagatttcatcacagatcatggcctttcaaagacacaggttcacaccttctccttggagccagctcttcccttgtcaagttgtctggccctaggaaggtgacagagcttatgtctaggagtccccaggcactcatacgacgacctgtcacctccacactcagctactcctctcaccaggagctctctgctctcagtggggaaggcactaaggctcaacgtaattaaatctctctcttttcacttcagcaacattgatctgtgcagggacacactcttgactccaaaggaacaaagcttttaatttcttggctggaatacactgttcttagacttgtttcgtatgtgagacataggagtgaaaattgcagcatactttctcatcttca

SEQ ID NO: 3828 - DNA, 1041 bp, Homo sapiens
tctacacttagttgcagaactactttgttcctgtcaatacttttcatgtgcctataggatttagatgataggctggttaacttagttgttaggagcatgatgctaataaatccaaggcacaaactcaacccgatcttttctataattcagatagggtgagactatcctctaaaactaaaggacagtgtgtatatttactgctatatacttataatgctttgcacattataggcattcaattaacattgacactgtacaataattatctgttcaaaggattgaaaaaaaggagaaacaatcatactctgtaaaatctgcttctgtagttgtggaaccctggacaagtcatgcaaactctctaaccctcatttcttaattgtaaaatggggacaaaaaaaatcctcctaggttgaccaatgaccaagtgaaatgatatacttaaagcatttaacacaaagtctagagctgcaaatgtaataaaaattgttaccatatactgaatgcatactttgtactattagtccattttcacactgctataaagacatacccgagactaggtaatttataaagaaaagggatttaattgactcacagttctacatggctggggaggcttcaggaatctcacaatcatggcggaagggtaagaggcatgtctcacgtggtggcaggcaagagagagtgagtaagagcagggaaaactgccccataaaaccatcagatatggtgagaagtcactcactatcaggagaacagcatggaggaaactgcccccatgattcaatcacttacctttcttgtcacatggggattacaatttgaaatgagatttgggtggggacacagagtcaaaccatatcatttatgtgtggtgctaagcatttttcaagcactgttgaaccccacagtgaccctatttatggtaggcattctattctactatgccctattatagatcacggaactgaagtttagaggggtaatggaagttactcaagggtacatggtgtatttcttaaggtttttttacttgtaaga

SEQ ID NO: 3829 - DNA, 1030 bp, Homo sapiens
ggatcaggagaagaggtacggtaacatgcaagaaaactgaaatatttgggagaatgttatttttagttagataatgttaattaatagctcaggtcaaaatcagaagtaattaaagtatatgtgtgttgaggggggaggggaattgctagagtggatgcagctaggagtagaaattatagctagaatgaagcttctcaaattactaatttacaaattacaaattactaaattactttagaaagaagtaaggtataaataaatcaaatttaaaaaactattagaacccatagagtcataataaattagcaaagaaaaggacgcctagccctgatgggatttaatttggagaattttttcagaagttcagagaacaattgcctagttactaattagttctaccttcaaaatgtagaaaggtatgttattaagtttctgattcattttacaagcataaatgattttgttttgacaatttgataaaaacaataactttaaaagaatttatggactggggtcattaattgacaatacgatattatattacagtaattatttactgtgagcaagttaattatcctcaaatgcatgagcagcatcataaaagaaaagctattaaaacagaagaggaaatttaggactcatcttcagttcctctttccttcacttctgtgtcctattcatgaaaaaatcttgactgctttaacaagtacattaagaatctgtgggcttctcaacttcgccactgctcctttcctagtaaaagtcaccatcatctcctcccaagttaccgcagtcatttcctgttgtcacttttcacctcacgatgtcacgtttcacctcaactcctaacaacctattttcaatatgtagccagagtgatcattgtaatgtcctttccttggttaaaaccctctagtggcttctcatctaacttagaataaaaatccagactcttcctatgtcttccaggcacgtaatttggccactgcctagctctccaacttcaccacatgcccctttccttaggctt

SEQ ID NO: 3830 - DNA, 1040 bp, Homo sapiens
tatgtaacaaacctgcacgttgtgcacatgtaccctaaaacttaaagtataattataatagaattaaaaaaaaataaagtagtagtttttaaaaaatcctcaaaactgagctcattgtgtggttttactaattttggttttaggcttgtgcagacataagagccagttcagtgttttggcagcaaatggagttcgttgatagcctgcatggccaacccaagatgccagaatggttatctacacacccttctcatggcaatcgagttgagtacttggatagacttatacctcaggtgagctgacaccgtagaaggcgggacattatttttactgtatcatttatttttaatgctgtcacttcttttgcttagtaaaagagagttctagcctattaactattttgattactataattatggattatcagttgtcacagaatttgactgaaaagcaaaattctgcttgtccacaagtcttggagaataaattactatgtacagttgacttttcttaatagtgaaggtttaactcctttagtatgagactttaattttaactgacttgatgaaagtttaaaactcaaggcatattaagttttttaaacatgttgatgataatttaatctttccttggtgatttaagctttttgttaaaaataccagttaatgagttgtacagaagttttgggtcaagtggatattaattgtagtagtggtactggaatttgtttttttaggaaaaaaaatcttcatgtttgtttctggttatttatttctttatgaagataagagtgaagcatttgctctctggcttttctttctgtagaattcataagtgggtcaagctgaggcggctttctgccaagtagttttcagtatcctctgaaaatcttttgatttgttgacatcattcagaatgtttttatggtttccatatcaggacaaaatggatgttaggcatctctgagccacgttacacgctctcttctatctcacttgtattaaatttggtggcttgttatgaaagcggaacatttttta

SEQ ID NO: 3831 - DNA, 1025 bp, Homo sapiens
tggctttttttttttttttttgctagccatagagagcagctctgggcctttacttttatttaagttgactttgttcctgtctacttaacagggcacctggcagctatttttaatcacctgtgataactgagtgttattagtagcatttaagattagaagtaaaactgcattttaaaaaaatgagtgaaagcaatgccacttcacatattaaattcaagttttaattgatcctttgttatgtttctggtagttattaaaactattaatcattttatttgaacctctcataagttttatggatttaatttcataaatcaaggtattactccttcacaaaagcaaaatcagttctttgaatgttaaataaatgtgattaagtgaattatcagactgcgtgcactaagaagttcccacataagggggccacagattggctgtattaagaatttcctaattttcatgtactccagtctgtcagattttccctatatgttaagtgtgttctgtgttctggttaggaaatctttgtttatctcagtaagttattcctgctttatttctaataaactttactatttttaaaatatataatatgaggaagagggcaacatcttttttttcccctatggatagctaatagactcagcactgtttatggaaaaaagtcacctttttttcaccagacttcagtgtctctttgtcataaaggtgggagtatatctggggtctctttctagacacactattctgttccattggcttgtttatgtttcagccagtaccatattatcactataactttgtagtaagtgttgatacctgaagcttctgtcctccagtgttgttctgcagaattgatttgactcttcttggatctttgcatttctatatacattttagaaatagcttattaaattatacatacatagaaaaacacatggggttttgattggaattgcattgcatttatacatgaatttggggacacttgactagtgtctgtagtattgattcttcccatccat

SEQ ID NO: 3832 - DNA, 1029 bp, Homo sapiens
tttttaaggagagtgtttctcatttgagcattaggaaatgtgaggtctggaaagggacgaaatagtgatagtaatgcaaaccctcatactttttctgtatttaaatataaaacttttcttttcaactagcttttggagtgtatgaggaagactctgagcaaagtgaccaattgctttatggctgaagaattcttgactgaaatagaaaatttgttcctttccaattataaaagcaaccaagagaatggagtaaccgaagagaactgtacaaaggaattgttaatgtgattattttaaagttaagacattttaatcttgacacagtagatcttactttcaaagttataaacttgaagtgattgtagttaacattggcacagctttggtattttttctctatttcacaaaatccaaactttgccacataaatcatgtgaaaaggaagagatacaaatttgttttcatatagtgattatcagagtgttctgcaaaccagggtccaccacggtgttctagtcctttactgagcaatgctgtaggctgtgaaactaagcaacctggtcggctttactgttgtgttcagcttgggatttggactatgtctctaagtcatttcttccctgaactagtcatttatgttccattgtggtatctcctatttcatttaaaagcacttccattctttccatatattctgctgagatttgtttatggctataaatgagatatggatgggtggtcactgagataattaatatggtttagaactactgattaataaatctaacaggagaccaggagaggcatgacaagaaaatcttaaaaacaggaaaaacccaaaggagagaactaaattaccagtttctaatcatagatactatcttccatttcattgtatagcagtagtatcataagatatgccattttctcagctatctgaaaatttttaaccaattttacacacataaaataattagcttcaattgtgagtccacttacattagtaggtgtgataaaacctcatttaac

SEQ ID NO: 3833 - DNA, 1058 bp, Homo sapiens
tttggagaagaggaaaattgagcaattaaataaaaaagatcagtcatcatcatcaggcttgctgtcccctttccttccaaacacctgaaaaaatgcctttttagagcatattgacatttaagctatgctttatttcattgtgaggaaataattgtatttttccccttttttttttccatgccttctgatttgctggcattttatttattccttaccatggtagaaacccagttgaggcagtattatgtataagttaaaagcagaactctcgagcctgactgcctgggttcaaatcctgccaatgccttttatatctgatcatgagcaggttaacctttctatgacgtagtgtcctcatcgaaaaaaaaaaaaggggggggtgaataatggcagctacttcatttaagtgatttcacattaagttttaggtggcacatagtatgcattataagtgttactatgatggtatcagcctttgctagtgaatcagctgagcttttaaaaaaatgctatagatgcatttgcatgggggtcttgaaggatatgtgaaaaattgctaagataactcatcgtttggtattttttcctttctagatgaatatatgatgttcaccccttgggcttctttctttcctccagagtttagtataacaactttgactcaaagcagttgctgcctccccagagttcatcctatcctcttgtctagtcttagattagctcttctagggaggtggaatgagtttgggctcagaagtgaggcaaacctgctgggttttaacatctgtgtcctgccactttgctagcctaaatatgatttttaatgtatctcagcttcagttttctcacctgttaaaaaaaaaacaataacttacagcattgttgtaagcttaataacctgtatatatatatatttttaattatcactaggatggcaatatgtcttagtttgtctaggataatcccactttaaacctgcggttcaggcataattattaatagtaccttctttcattcaaaaagtctcttggtttaggtgataaattacgtgatcatcc

SEQ ID NO: 3834 - DNA, 1042 bp, Homo sapiens
agaatctcatgcttttttaacttacgaattgtgaataataataatacctccctcaaagtattgttgtaagaaagaaacgagatagactatataaagatgctagtactaggtattcagtaagccttgcatgcacaaagtactcaaacttgagttctctttcctcctccgcattccctgccctcaacttctcacctgagtactattctaggcacagtaattagtaattcatccttcccataaggggcttgtatttctaataggaaagacaaaacctatggtaagttcaataaggttggtcccaagaattgtaagtttctcccaaaggctgtgatcagggcaggtttcgtagagtatgtggggtataatctgatctgaaggatctgcagaagaatctcaaaatggagatgaatacactttaggctgagggaacaaagctggagacatgggaaaatactagatatattctggaaaaggtgcatagttcatttggactagggtgtaagttggtcgtagaaatggaatagagatttactttattttataaacacttataaagggcttactgtgtgtcagacaatgtcagtattttataaacattaactcagtcttcacaataataccatgacagtggtattattgtttactttttattattaattttattgttcccatttttaaagatgaggtaactgaagcatgaaagctttagaatttgcctagggtcaccaagctagtaaataactgggccagacattctagatccagaatctgttcttaatcattactctgcactgtctctcagttgtgaaagaaaactcaacacagtagaatatggtaagtagaaatgggaaataaaagactcaggtgattctgacgtttttgaacctgggtgactggtaccattgattgaaatgggcaaatcaagagaaggagtaaattttcagtttgggatggccgtgtcttttgaaacaattttttaaaaatactgtccagtctttctacatgttggtagcaaaaaggaagcccatctatatcaatttag

SEQ ID NO: 3835 - DNA, 1070 bp, Homo sapiens
gcctcagcctcctaaagtgctgggatcacaggcgtgagccaccgcgcctgacctctactcttttattgaattaaaatgacacaaccattcatagctacaaagtgataaggtacataaaaccttgtaacccatggtttaagaagagtatattctgtgtttgtctatgaaagggagacaactaacaagaagattttctgtcagatatgattttcttttatattgagctagatagaatttagtttgcccgggaatctgtccttcatttcagtgtctttgttttcccaaagccttgaatattgagactagcttttcaggaaaactaaaggatttttgcttcctcagccaccaaaagaaaaattaaatcatgttttctgtattagactgccaaagttagcaaactacccattttctaaatattccatttattaagattttcttataataacagcattacttttaatttgaggggtgctcagtagcacatcaaatgtatgatcgtgaaataagagtcatagaagccccactatagtcagtgtacatgtgtcttactgtttaacaaatgagtttcacaaaataatagatggttttatctttcctgaattccaatagaacaggctgtgtataataggccacaaacagttgacaaagtacgaatcagagacagaaaagatgcagtagaagcataccaacttgcccagcgtctgcagtctatggtaagcagtcatctctctcagtgatctctccacattgctgcttactctgtttagtgtggtttacgtacttaccttgagctgtttaataaatgaccatttagtagaaaaacatgtttcctcttgtgtttcaccttagcaattcgcttttctgggtttcattcaatttcatgttgctttctgaggcaaaaacaaacctaaaaacccttaaaatgtactagcaaacttgatgcagaagcataatgttttcctaaagtggtcttgggatgcttcgttttaatttataaatctaatgtgtcttttaaaaatatatagttcagtttttttttctctcattgatttttcttttaaaattcttaa

SEQ ID NO: 3836 - DNA, 1033 bp, Homo sapiens
cacattgcctgtaatcccagcactttgggaggccgaggcaggtgcatcacaaggtcaggagatcgagaccatcctggctaacatggtgaaaccccatctctactaaaaatacaaaaaattagccgggcacggtggcaggcgcctgtagtcccagctattcgggaggctgaggcaggagaatggcatgaacccgggagctggagcttgcagtggcctgggattgcgccactgcactccagcctgggtgacagagcgagactccgtctcaaaaaaaaaaaaaagaaaagaaaaaaaagaaaagcgcattagaggtataatgtaccatttacatgtattcagtttaataacactgtatatttatccttttttgtgtgtaccagtgattaaatttttaaatcttaatattatggggattttattttgatttttaataaggtcaaatgcggtctggataaagaaacaccaaatcagaagaccggccataatcttcaagttaaaaatgaagataaagggacaaaggcatggacaccatcatgtttaaggggacgtgctgatcccaacttgaatgctgtaaaaattgaaaagttatctgatgatgaagaagtagacatcacagatgaggtggacgagttgtcttctcaaacaccccagaagaattctagcagtgatctcttgttagactttcctaatagtaaaatgcatgaaaccaatcaaggagaattcattacttctgacagccaggaagctctcttttctaagtcttccaggggctgtcttcaaaatgaaaagcaagatgaaacactttcaagctcagaaattacactgtggactgagaaacagagcaatggtgacaaaaaatcaattgaattaaatgaccagaaatttaatgaattgattaaaaactgcaacaagcatgatggaaggggaataatagttgatgccaggcagttgccttctccagagccttgtgaaattcagaaaaatttgaatgataatgaaatgctttttcattcttgccaaatggtagaggaaa

SEQ ID NO: 3837 - DNA, 1031 bp, Homo sapiens
ttggtggtacttatggggactacatttgcatggtttaaaattcaaaaggttcctaaagttatagggtattaagtcttctcactctcatcttagccttcagttcgcttcgcccggggtaaccagtgtcttctttgtgttttcttccagagatatttgtccatatataagtaaatatgtatttatttatatagagatatgtagacctctgtctatttacattaagggagattttaaacttggaatgttttcctacacaacaagcatggaattattagttgtattttcagcttttttttaaaccattgataaagtttgcttacagactgaattctctcaggcttgggagtagggacttgggtggtactgattgatgaagaaaggcttttttccttcccttttttgggcatgggactctccctttgctctattttgaaactggtgaatattttctttgctcctttttttatcttctttttttttttttaagaaacaaggtctcgttatgctgcccaggctttgaactcctgagttcaggtgatccccttgcctcagtctcctgagtagctaggaccacatacatgtgccactgtgcctggcttctttgctcctcttgttcgtgttctttccccaatttttctagtgcccaagtccctactcttctactaatcatatcttaatccagatctgtcctgtctccacaaatgctccatgctacctaccaatgttatctatttgtcttcatcccacaataaagataagtagtttttcatcaagttgatctcagctaggtgttaagagcaatcttaaataattaatttatatttactaataattttcagaagcactttgagtttaagaaattgtccatatgtcatattttctaatgagtatcagaaatttacttaaattaaggtttatcacttgggtgagatctttgaaaatgatttgctaccgtaaggcatgactgcctggcctgtaaatctgacaaaacttttcctaagttgtggctagttttttgtttttttcatagt

SEQ ID NO: 3838 - DNA, 1673 bp, Homo sapiens
aaagtttacgaatttgtgttgggccacatttgaagccgtcctgggccacatgtagcctgcaggcagaggattggacaagcttgatttaaacatggaggctgtttcttgtagtcacttctaattgggaagacaagggaactattaataacatttatgtagcacacgttttgtataagtaatgtaaaaattacatgactgtaatattgtttaaaaagtttccttgatagttacacagatattatttatctaaaaaatcacaaccggaaaaagtctggcttgatcaaaaggaagatgataaaaaatacatgaagaggtaaaatcaatttataatatttctaaaagtctggattgtagttttagaaacctcacacgcttccttattttcttttttcatgtgatgcagtctgcagaaaacagcaaaaatcatgtatgtacttatattttatatttataaatctgttttcattagttaaaaattatggaataatttttttttaattatagttggcctgtggaaaagccctcttgaccttaaagtagatataaaaacagtttttttaataaagatgttggagtggcacaagtataattttatggtgttatttacttgccagaatttctttcatggccctatgtaggcaattctttcagattgtgaaaaatatggttgtccaggggtttatggggaaattttgagaagctgttatgtgatatattggaattgacttgatttcttttactctgtcagttaattttcacttattttcaacaaaattttcatttggatttgtggctttcaaaaattatctggagaaattaactattttaaaaatatcctttccctataattgaaaaaacattatttagcatttatgactttggaagtttatggtcctttaaagggtggtttacgtatttgcaattgcccaagaggttgagtactgagcagccttttgcttttgtattttgctgaataaacaatgaaatgaagttaacaaaaggattaatgggttgcttaaattagtgagcttcatcagttttatttttaattccttgagataatgaattttaaaagcaataaatacaatgctgtagtttttgacttcttttctaaatatttacatggatttacatgaaagaactaaagagatagtatttgtggaaccaatttaaactcttacatgcctttcaggatttgggaatgtattaacacctgctgctttgtatccagtctaagggagcctatttgtttgttatcacattgacttcctttgatgtcttttagtgttaccctcactcagacccaaggattatgtcttttggggctcccatcatcctgagctagagacacgtgacagggtaaatctctgcccccaggtagaggctgtagccttcttgttttgtttgtttgtttatttttaattcctagactcaaagtattgaatttagcccatggctatctataacctttagttacataaatatggaatgttccatttcagaaattttttttgcaattcctttttttcccctcagggtacactctcctacaaaaccagccagttactcagtaaagtggacgatagaagaaaaagagctgtttgaacaagggctggtaaatagagcaattttaaatttttagtaaaataattctagaagcaaatattggtaaa

SEQ ID NO: 3839 - DNA, 1035 bp, Homo sapiens
aaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagacttta

SEQ ID NO: 3840 - DNA, 1048 bp, Homo sapiens
caagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcacgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccacagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacc

SEQ ID NO: 3841 - DNA, 1032 bp, Homo sapiens
atgtgggacatatactaaaatattattgttgcttatctgaaattcaaatttaactgggtgacctgtatcttttgttttttgttttgttttgttttgtttttgagacggggtcttgctgtgtcgctcaggctggagtgcaggggcaggatctcagctctctgcaacctccgcctcctgggctcaagcgattctcctgcctcagcctttggagtagctggaattacaggtgagcaccaccatgcctggctaatttttgtatgtttaatagagacaggggtttcaccatgttggtcaggctggtcttgaactcctgatcttgtgatccacccacctcggcctcccaaagtgctgagattataggcatgagccaccacaactgtctgtgacttgagtcttatctgggaattattcctaaatggatccagttgtcttttaagtgcaaagtccctgacgtttggggtattcatttagctaatcgcagagcccagtgttagggcctcttttgatcctaaggttactgaacaatggtagggaagggaatcctattagcaagtgtcccactttgtggagtacccatcatttccagtcgctttacttagacaattactgcttcagtcttgagacttgctgctccaagtgttgttatggatcagcggcgttccttgttagaaaggcagaaagaatctcaggcaccactctagacctacaaagtcacctgcagtacaggtgactaacatgtacgttaaagtttgaaaggcattgggctaggctatttggggtaaggaatagtcaagtattccttgaaaaaaagaatcactagtagacttgatttttttctagactggtttaggtgtacagcggaattgaacagaaagtacaaagttcctgtatactcttctctaccttcacctagttttccctattacaaacatcttgcattagtgtactacgtttgttacaatggatgaaccaatattacattattactaagtcaagtccatagtttacactgaggctcactctttgtgatgt

SEQ ID NO: 3842 - DNA, 1049 bp, Homo sapiens
cacccgccttggcctcccaaagtgctgggattacaggcatgagccaccgcgcctggcctaaattttttattttcttgtagagaaggggtctcactatgttgcccaggctggtttcaaactggcctcaagagattcccctgccttggcctcccaaagtgctgggattacaggcatgagccactgcgcctggcccctattttcttgttgttgagtttaaaaggtttttttgtatattttgtgtaacagttctttatcaaatatgtcttttgcaaatattttcccccagtctgtggtttgtcttttcattctcttggcagtaacctttgcagagcagatattttgaattttaatgatgtccagcttatgaattatgtctttcatgaatggtgcctttggtgttgtatctaaaaagtcattaccagacccaagagcatctagattttctcctatgttttcttctaggagttttatagctttgtgtctcacatttaggtttgtgattcattttgagttaattatcgtggagggtgtaaagtctgcatgtaaattcactttttctatgtggatatccagttgtcccagcaccagtggttgaaaactcatcctcatttttaaacttatttcccccttattcattatgacaggggaaatagcagcacgtccaccaagaaagaagcccagaagttatctttgatgccattttctcccttccttgggtggatcaccaaacctttaattccacctcataaatactctgaaatcattacttcatcctcattgcaaccctgctatttcaggctcctgaatatctctcatctaggatcctctgataaactcctgccttggttacctggccagagctccaccttcctctccgtcacccttcctactcctaccataccagactgatggttccgaaaagaaagcgatcatctctgtctcttgcttaaaaccctcaagaagctacctatgtcatttaagataaaatccagattcctttttctggcttaaaaggtttatcctgattgagtcccagccaccctgccctg

SEQ ID NO: 3843 - DNA, 1028 bp, Homo sapiens
tagtagagacgggatttcaccatgttggccaggctggtcttgaaatcctggcctgaagcaatcctcctgccgtggcctcccaaagtattgggattacaggcatgagccaccgcaccccacctgatagatacatttaaaaggaaaaggtaggatgccatattagaggtctggcatccaagcagcatgggatgataaaagtatagacttattctgagtcctgagtgcattctgtttctcatcccttaatttgtgactgagcacgtaaccattcttaatccctctgtcttcatataaatagaggtagtgacacgtgtcaggtaatgttgaaagattaagtggcagatactaattatgtattgaacacattttaaaataatgggataatggcatcaagtactggtgaggtctgtctggaacttgcaagaggttctgcacaactgggctatagcatggttatttcttaaataaaatgccagtgggctcaaaagtctcttttacaaaaggagggtaagacacttcgtttggacattgtttacctgtttttcttattatctttatccgtatctgtagttactggatgtaatatgggccaaaagtgtctttttttttatgaagaattagtcttattggcaccttcactcttttaagactctatgtaagaaaaagccgaaatgttacagattttgtttttgttgctttttcatctaaagttcgctggagatagttaataagttttaaaatgttgctgtgaggcagctgatcagcctactttcagcctaaattatggttaattgcaagcaatcactatgcatacaacagtgttgcttttaacctgtcaatgttatcagaatatgccaagcatgtggagattaaaacttgaaaaatgattaaggatagagctatttgggctgcatatgccaaagaaaaacgttttaccagaatactctagcaagtgtggtgtttggaactttttatcatgtgagctaattttgtgtttaagaaggtatgattatgaaggctcaagatcc

SEQ ID NO: 3844 - DNA, 1049 bp, Homo sapiens
taataaccatacaagcagcagaaatttagcataatgtctgaaacatttatgaattttataaatacatttaacagactggtaaagtatgtttcatgagtttgatatttattataaaccactctaacactgggttatatactgctttgtattagtttttaacttttaaacaatggatttgacttttcacacataaattttttgaggaaaaatgacttttattaatctgctatagtaccagttatgttaaacagagtatgcccttaaaaatttttgctgatttgaaactgtatgcagtatgccttatacaaagtgtggctttgtgcctagtgcaagcaagatgagatgcaaaatgtagtttttaaaaaagtgattgtttttatgtaggacctgttttagtccatttggggctataacaaaatactttagactgtattatttctttttgttttgttttgtgtttttttttttttttttttttttttgagactgagtcttgccctattgctcaggctggagtacagtggcgcaatctcggctcactgtaatctctgcctcccggcttcaagcgattctcatccctcagcctcctgagtagctaggattacaggtgccaaccaccacacctggctaatttttgtatttttagtagagacagggtttcaccatattggccaggctggtcttgaactcctgacctcaaatgatccacccaccttggcctcccaaactgctgggattacaggcattagccactgtgcatggcctagactagattatttctaaaccatggaaaattacttcttatagttctggaggctgggaagtccagtatcaagacaccagcaggttcagtgtctggtaaggactctctgcttcatagatggtgccttctatatgtgcccacatggtgtaaagggtaaggtcattaatcccattagtggatggtggagccctaatgacttaataactttccaaaggccctacctcttaataccaacacatttggggttagacttcaacataggaattttgtagggacacaaacattc

SEQ ID NO: 3845 - DNA, 1065 bp, Homo sapiens
tatgatcagtttagactgctttcaaattgagggagattataataaatccatttcaagcatagccaaataagatgggtagccttattcttcatgtcatttaacatatttaacatttgatgttgacatcatcagttttagaggagaattcctgggcttaagcgatcctctcatctcagcctcccaaagtgttgggattacaggcatgagtcactgtgcctggccctggctcatctttttgtttatttttctttccttccccattcttgccatgactttctctctttcttttttttcttttctttctctttctttccttctttcttttctctttctctttctttttctttctttctttctctcttcttccttccttccttctttccatctttctttctttcttttttgccattaaatattattttccagtgagtagcaatgtgtttctgttggactgtgatcccataaacgtatcgggcatggattcaagacctataaaaacatactgtagtctagttatagtttgtctttgaacagaaacaatacaaagtataatgcccatattgctaaagtaagctttacatgttgctatgtttcctgaaaatacttttatgagtttgtctatttgttattaaactttggaattttctatcttttgttcctaaaaatatacagataatatgaatgatgatgcatggcatgaaataatacatagaatacagtccagaaaatctaaatcagtgatacatgtatagcataccatctttcagctgtgggtaactattgtatatataactactatatatatatatatggttattcataaggtagttttgaatatttaaagacactcattattttgtgccatatatatatacatatatatatatatatatatatatatattttttttttttaagttttttttgagatggagttttcgtcgcccaggctggagtgcagtggcttgatctcggctcaccgcaacctccacctcctggattcaagcgtttctcctgcctcagcctcctgagtagctgggattacaggcacacaccactacgcctg

SEQ ID NO: 3846 - DNA, 1025 bp, Homo sapiens
taaatatatttgtgtttattgcttgttaccaccagcctgtaagctacacggggatagggatctttgttgcttttattcattaatatattccaatagcctagaatagtgcctgacacacaggaggcatctaaaaaacattaactgagtgaaagaatgaaccaattaacaagtagtagttaataatttttttttctaaaatgttcacattggaaatatgatactcagattttaattttttgcagaaatggctattcctacaaagtggcagtcgcattgtctctttttcttggatggttgggagcagatcgattttaccttggataccctgctttgggtgcgtatgtttcattaaaaaaaaatccttatgaaacctatattttagttcattgtaggtgttcttatggattaaatctctgtgtatttattataagttctatataattggagttgagtagttaatgttcttctgtgagtatagagctatcaattagcccaacagttcagcttaggtaagaaatactgacttttcctatgttttcacctttatgaaaacacacacaagatagtggaggcatttacttacgatagtacactggaactgtcactgctagtgctgggcacacactggatgtttagttaatgttttacgaataaatgtacatcctctaccactccaaaaaatatttccttctgcccaaatctctttcaccattgccctgggattagaaactatgcacttctttcagaacaagttggggttggaactttggtgatccacttgagctggggtgggagcctgacttctatcacccttagcccccctttctatatcttccttctggctgtaatcacatttactatagttactaatgcttatgaaaactatttacattttatgatagcttttgtttaaacagtactttcacatgcctgcccttattgaagacttacaaccctctgagtttatcatcctctttaaatcctctttaacaggtaaggaaactgtcaccagagaggttaaggga

SEQ ID NO: 3847 - DNA, 1031 bp, Homo sapiens
cagtttcttgactttttctgccttcagtttcctgttttccagcacccaacataacttgtaaggattccagtggcaatgaaacacattttactgggaacgaagttggttttttcaagcccatatcttgccgaaatgtgtaagtacattactgaaacttaaattttcagattacttgcctatattatatcttcattgcatgaagagaggagataatttatggggactatcctgaaaatgtatcttttatctttttgcttgtgtcagaaaacctttattttaagtgtttgttttttggtttttgagataaggtcttgcttagtcactcaggctggagtgcagtggcatgatcacggctcacttcagcctctgcctcccaggctcaagcaatcctcccacctcagtcctgtaagtagctggagtacaggtttgtgccaccatgcctggctaacttttaattattttgtagagatgagatctctctatgtttcccagcgctggtctcgaactcctggcctgacatgattctcccatctcggcctctcaaagtgctgggatttacaggcatgagccaccacacccagccaagtgtgtatttttttttttttttataaatgcaattcaccaatcaagtagagctgagtagtccagtatgtgggacaaataaagactataaatggcctcgtgccatgttaattcaggtcagttagtttatgccactaattgagttatgaaaaaattgtcttcaaaatgtgggagatttctagagtacaaacagcaattgtgtacctattgtatcagaaaaatgctaattaattttttgcacataaagggcattttaaacttggttttattctttgtgataaatatggatgatgaatggtaatgttaaacagaattcaaaagttatcagtttggctagccagacacagtagtatatgcctatagtcctagctacccaggaggctgaggccagaggagcccggaagttcacgtttagcctgggcagcatagtgagacactgtcttttataa

SEQ ID NO: 3848 - DNA, 1099 bp, Homo sapiens
tattttttatctttttatttggcgatagtttcaaacctaccgaaaagttagaagaataagagtagtataaagcactccaccctaggctgagcgtggtggctcatgcctgtaatctcagcacttggggaggccgaggcaggtgggtcacctgaggtcaggagttcaagaccagccccaccaacatggagaaaccccgtctctactaaaaaaaatacaaaattagctgggcgtgctgacgcatgcctgtaatcccagctacttgggaggctgaagcaggagaattgcttgaacccgggaggtggaggttgcagtgagccaagattgcgccactgcactctagcctgggcaacaagagtgaaactccgtctcaaaacaaacaaaaacaaaaaaacccacaaaactccatccatataccctttacccagattgaccaattgttaacatactctctctctctctctctctctctgtgtatatacttttttctgccactagaaatacttttgtgtttttctgtagagatgttccaggtcagatgtggtggcccatgcctgtaatcccagcactttgggaggcttaggtgggcagatcacttgaacccaggagttctagaccagcctgggctatgtggtgaaaccccgtctctacaaaaaactagccaggcatggtgacgcacatgtgtagtcccagctacttgggaggctgataactgagtcagagaggtgaggctgcagtgagccctgattgtgtcagtgcactctagcctgggcgacagagcaagaccctgtctccaaaaaataaataaataaaaaataaaacaaaaaaatgaaaatagaaatattttcttaacatgcagttcagttaccaactttagtaaatttaatttattaatacacatgctttaatccatattcttattttatcaaatgacccaaataatgcctttttagcattttctcccagtacaggatcctaaaatcagattttacatttagttttctttaaattggtgcatttccacaactttctttgtcttttatggcattgacttacatgtttgatgactacagcctccctttattttaatagaatgttcctc

SEQ ID NO: 3849 - DNA, 1031 bp, Homo sapiens
ccgctcctgggcggaggcggaagcggaagtggcgagaaagtgtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatcctctgtggagaacacccccccatggaggcgaggtagagttggggtcgcaggtgggtcgctgccgtcaggactggctagggctgtactgagtgaaaacgataatctgatctgtggcttctaatgactgaaggatccctgaaggtgaacagagttgtggagatgggagggccagaggccaccctttgtgatttccttatgattttactagtcattggcgcttcctcttctgatccactttttttttcttttttatcagtgtgcttacttgttcagtaaaacatgtagatcctgaagtatgccaggccccgttctagacactagtaatacaaagatggatagtctcttaccctggaaatgtttgccaactcttcctagggggaagacaagtaataacgatctagccaatgtgttgcccatttatcattaactttatgtatattatgcatattacctcatgtcatcttcaaacttcatgagatggtagactgccagacaaatttctttctgttttctttttttgagacagggtcttactctgtcgccctggctggagtacagtggcacgatctcagctcactgcagcctccgcctcccgggttcagtcaattctcctgcctcagcctcctgagtagctgggactacaggcatgcgccaccacacccgggtaatttttgtatttttagtagagacggggtttacgccatgttggccaggctggtcttgaactcctggtctcaagcgatccgcatccccctcaccatgaaccaccgcgtggggactcagtggataaatttctgttgcactttgc

SEQ ID NO: 3850 - DNA, 1040 bp, Homo sapiens
agataagcagaaaggttacattagacactaaaagctagcttttttcccctccctaattacaccagctactattaaactttgtgttgttaaagaattataaatattccatcatggtccacacaagactccaattttgcttactttcagaactctcctctactttggaaagctcatcttcttgtactggcacactgatgtcttgaaaatcttctcttctttctgttaaactttcacattccaagcaacgcgtccttaataccagctgaccttgaaataatttctccactagctcaaaaccaatttgttcttcacctaaaatgaaaataggaaaatgtaagtctatacagattagtttctcattatagtccaaataaccaattttccatttaaataaagtatatcatgaataacagttccattttcatagatcagcttattagcattattagcttattagaggtaccctattaatgaaatttaaggtccctgtaaagataaaactgactatgaaattactgtctttaaaagaagtcagttgtaggccgggcacagtggcttaagcctgtaatcccaagactttgggaggctgaggcgggcagatcacctgaggtcggagttcaagaccagcctgaccaacatggagaaaccctgtctccagtaaaaatacaaaattagccgggtgtggtggtgcatgcctgtaatcacagctactcgggaggctgaggcaggaggatcgcttgaacccgggaggtggaggttgcagtgagccaagatcatgccattgcactctagcctgggcaacaagagcaaaactctgtctccaaaaaaataaaaaaaataaaaaataaaaaaaagtcagttgtattgtaactcccttcctacagacacctccccatagaataaacccagaataaggatgacatttttggtaaaactattcactatatcaatattacacattttccctgatatctgtagatctggacaaaactaggtaaaaatctagttcaagtatcgtgtaacttacagttatgcaccac

SEQ ID NO: 3851 - DNA, 1036 bp, Homo sapiens
tacaaaagctctttagtttaattgagtcctgcctatttatctttgtttttattgcatttgcttttgagttcttggtcatgaaatatttgcccaagccaatgtctagaaggatttttccaatgctatcttctagttatagtttcaggtattagatgtaagtccttgatccatcttgagttgatttgtataaggtgggagatgaggatccagtttcattctcctgtatatggcttgccaattatcccagtatcatttgttgaatagggtgtcctttcctcactttatgtttttgtttgctttgtcgaagatcagttggctgtaagtatttgggtttatttctggcttctctattctgttccattggtctatgtgcctatttttataccagtatcatgctgttttggtgactatggccttacagtatagtttaaaatcaggtaatgtgatgcctccagatttgttctttttgcttagtctcgctttggctatgtgggctctttttggttccatgtgaattttaggattgttttttctaggtctgtgaagaatgatggtggtattttgatgggaattgcattgaatttgtagattgcttttggcagtatggtcattttgacaatattgattctacccatccatgaacatgggatgtgtttccatttgttagtgtcgtctgtgatttagttcagcaatgttttgtagttttccttgtagaggtctttcacctctttggataggtatattcctaagttttttgaggttgttttttttttgcaactattataaaaggggttgagttcttgatttgattctcagcttagttgctgttggtgtatagcagagctactaattaatgtacattaattttgtatcctgaaactttgctgaatgtatttatcagttctagaagctttttggaggagtctttagggttttctaggtatacagtgatatcatcagcaaacagtgacagcttgacttcatctttaccgatttggatttgctttatttctttctcttgtctgattgctctggc

SEQ ID NO: 3852 - DNA, 1041 bp, Homo sapiens
atggttgcttgagctgcggccatcatgtctgtatttcattcagtgaaaagaaacagcagggacagagtacatttctttttttaagggcatgactcagaagatgtaacttctcttttgttcacctctctctgtagccggattcaaagtcttcagctaaaattcaggatttcaattattaaagaagaaaagaatggttatttgtgtaccaccaacattttttgctctaggcaccactcaatttttcagccttatctctagttattttctacatgaacctcaagtcaattcaaatttacttactaattttcctaaaacacaccttatgatttcttgccattgtatcttactcctgttttttctcatttaaattatatttattctttttcccccttttcttattcaaatcctgcttagctccttcttgaagccatcctagatcttatgttatcatttttttatcttttaaaactttacttatacatacagggaggcctttatttatacatagggaggcctgtaacatccataactaaattgcaagtacatctctattttatttgtttatttttaaattgcagaccgtttctgtaacggaatccaaagagagcattcttggtggagtgctaaaagtgctactacacagcatggcctgtaaccaaagtgcagtttatctacaacactgttttgctacacagagagccttggtttcaaaggtaggttattttgtacctgcagtgttgtcagactttgttttttttattaacattgtctaagatcatttgacacattcattggttaatatatgtagtaatatattaatgaatatgtgtagttaaaatttaaataataacctaagacccttaattcttctttgcctctctactgctgcctgccttttagaatttttcatttattcgaatcacctttaaccagttctggtttgaaaaacagtaacttggatgtggagaagggcctgaaattaatagccaatcttaaatatggggcttctcttgttttctcttcacttggttctgtttttat

SEQ ID NO: 3853 - DNA, 1022 bp, Homo sapiens
tgcatatggctaggcggttccgaacaccatttattaaatagggaatcctttccccattgattgtttttgtcaggtttgtcaaagatcagatggttgtagatgtgtggtgttatttctgaggcctctgttctgttcccttggtctatgtatctgttttggtaccagtacctgctgttttggttactgtagccttgtagtatagtttgaagtcaggtagtgtgatgcctccagctttgttctttttgctcattgtcttggctatacaggcattttttttaaaaaatgtgtatcttatttattcaacttagttgcattctcttacatcttccccaaatggtttcatcttctctctctcttttagccagttagtcatcccttctcatcgcctctaggatcacattgcctactacattctcccttctgtcatctgtgacttctaaattgtgagctgggggaacaagtttatcataatcaataggtagcattttcaagattcatctcagaatgactctgaagttcattatgatttcttcttaggcctttgagctatttaagaagttgtttttgtcttaaattttcagtcatgaaaatttctagatatccttgtttctgattttggccaaattaaatgatcagagagcataactctgtatgatatcagtttgttatgtttgtggaaactagttttatggtctagtatatggtcagtttttgtaaatatctcatgtattctaaaagaatgaatattctttcattgttagttacagcattctatgtcctgtactcttgttgtttaaatctttttggtctttactaaattttgcatgcttattctaatatcccactacaattgtggttttgtaatttctccttgtcattctgtcagatttttgtttcttttgaggcctgattatgaaacatttaacacttttatataatttttggtggattgcactttcatctacatgaactatgatgctttttaaagtagttataattacactaggttttctttgctctgt

SEQ ID NO: 3854 - DNA, 1069 bp, Homo sapiens
gctttgccaaataactggccacaagttttctttaaatagttagctttgactagtgtaattacaactgttcagaacatcagtattgtgtatataaatataattcatagcacaaagagatttttttattctcatattagcgattatcatatattgtagttttaaaggaaattattaaacagtaagttaagtaaatttaagagtacagcaaagttcttattctttttgtggaaattcatgagagaaaagaggacagttataattttgcaaaaatcaaatgctcatgttttgttatttttgtaacatgagtagtgactgtaaaaattgaatatggtaggaagaactttacacttttatacaaaaaagacataattttgggcttggacataattttggagactaatgagaactttattttaacttctatgaaaaacataagccttttggtttgcttttattcgaaatattgtaatgggattctgagaaggcagatattttattttaaacaaatctgattgcataatcttactagtattttgatattgtctaatttactttgatagaaagcattttaagaaaaatatgtatgggaaatttttataaagctgtttttgagagtttactatattcaaggcattgaacttagtaatttacttccattatttaatttgattcttaccatgtgaagggagacactctcatcatttttattttatagttaagaaactgaaaaagaaattaagtaatttatcttagattttacagctagtaagcaggagagcctggattggaaccttaactcccatattagacagtcactgtcaaaaatgattagaaatgggtgattattttaccaccatttcaatttctctatatatttgggaaaaaatgaaaaaaggtggaggaaatattctcctgaaacctaagcccttgagggttgcggtttttctttcttttctttttaaaattttctcttgaagtatttaaaaaatactgatgtctgggccgcactcacagcaattctgatttaattgttttaaggtagggcgctgcacatttgttagttactgtt

SEQ ID NO: 3855 - DNA, 1044 bp, Homo sapiens
cacttgaacccaggaggcggaggttgtggtgagccaagatcgcgccattgcactccagcctgggcaacagagctagactctgtctcaaaaaaaaaaaaaaagacttaagacacacacaaaaattaagtcattatgtcattcctctgagcacaatcttctaatggcttattctctcagtcctttaagtctttactctgaaggccgccttctcagtgaggttgactctgattatcttatttaaatgtataaccagtggctgtgtcctcagccttctaatcctgttattctgttttttgtctttttttttttgtctgacatttactaccttttaatgtagcatatgaattaattattcttatgttgatttttttttagtgtttatctccctttaacagagtgtaagcttcattgtggcagggaatatttgttccaaggcacctgtaatgtctaacttattcaaggtgctcagtagatatttatccaatgaagaaatgttagtatgagttaacaccgcaggactagatcacttgtttaagaacagaattatgcttttgtttgccctcttactattgggattaattatgtatttaaaggtctgcagagatttgactttatgaaagttttggttatattttattccccagtataaaatacagaactcctaaaatttaagaatatttatataacctgaacaggcttttattactccagtggctgtaatgtaaatgtgaaaatatttgtgagacttcttcatacttatattgccaaaactagctgtgctttcttaattctagtaatcgtcttttaacattcagttatgtaaatacatggttacatcaggtctgaactttattgctttttatcaaatgccagtggaattttgcactgatacgtttctttctcatatatcatctttttttaatttctcaaacactgagagcttactgtgtgctaggcactatgctgaggacttgtggatatgaagtaaaatctttgtaatataacacaagtgttgatgtcacatcaaatacagtatgggccttg

SEQ ID NO: 3856 - DNA, 1036 bp, Homo sapiens
gttaagtgagctttgaaggaataattttatctatcttactgttttgtgtgttcactattaacatgttaagttttatacatatatattttttagttgaacagccgtatctttggacatgtaaagattttttctttatttatttttgagacggagttttgctctttgttgcccaggctggagtgcagcgtcgtgatctcagctcactgcaacttccccctcctgggttcaagcgattctcctgtctcagcttcccgagtatctggaattacaggcacccccaaccaagcctggctaatttttgtatttttagtagagacggggtttcaccatgttggccagactggtctcgaactcctgacctcaggtgatctgcctaccttggcctcccagagtgctgggattacaagcgtgagccaccatgcccagctaagatttttaatgtgcaaagtacttattgtgaaaattcaggtatttcaaaaacctataaaaaataaaaatctcgactctattaacattttgggtctatcataccagaccctttgaatgactaaacataattttttataacacaagtgggatcttgttatgtataatagctcatgatatatatatcattcaggatcttagtattttaaaatttattttcctatgaatgtctatagagttaccacgtcctttttaatagctgcataatcctgttatatagatgaaccttaatttaatcagcccccttttaatcatttgtttccaattttctaattataaacagtatgtatagaaaatgcttttatggtggtgatgtatgtatataaatattttcatatacattcatagatgttgacttgtaacttacgattgcttttgtcagattgtccttcaaaagggttgtaccaatttacatccctgccaggagtatatgagagttcctcttttcctatatccttttacaaatgcttttaatgaaaaaggcaaaaaatgttgataaatctaatagacaagtatatatctagtttgttttgctggccatctctgttgc

SEQ ID NO: 3857 - DNA, 1032 bp, Homo sapiens
gaagggcagttttgttcttctgtcctgagaattataatatgttcagttaggaagcgtttgtagagattatttacttaaaggaatgtgaaaaatgacacggaagaacctgtttttaaaaagtatatacatttgtttagaactttatagttcataaagctattcaaatacattatctggcttgatgattacaatcccatgaagtattaatagatttgacaggattattattcccatctattgggtgtggaaactgaggtttgactgtgtattttaagataaatagctacaaccttacatcttcaaggtagtaatttattgctctttcaaattatatacccagtcattttattagatgtatgactgttcttaggactaaacatgaatttaggaaaaacagcctttgtattttagatagaattcttaagtttattttatatttcctaaaatgtcattaaaacctcattttattaagggttataatagaggattgttagtgctactttcatgaccttgaactgtgcaccagttaagtaattttaccctagttgatttgccatgataatactttggactttgataaaagggccaattgttgggtcactttcttttcatttttaaaactgctgtgtttgataatcactcagtagtacatacataagtgcagagtttatggctgttagtgatggggaaaaaaatcacaaggaaatttgattatcctacagcagaaggtagagtatatatgagtacaaatttggaatatgttttttaaaggagacaaatagtagatgctcaataagtgttgtttaatgaataccatttctaaaattaatgaatgagttagttgacttccatgagttatgctattaggaagtaaagatacaagcatgaaaatatgctgattccaggatgacagagtgtatggaaatagattatactacactagattacctcataatgagacatgtgtgtacttggtttcagtaaaattcatactggttcaaaataaactcttgatatagaaatttttcagta

SEQ ID NO: 3858 - DNA, 1025 bp, Homo sapiens
tcattttagctaaagatttgtcgggtttatctttttgaacaaacagtttttggtttaattgatttttctgtatggtttttatagtttctattttccttatttccactctgcagttgcctcttgtagccttctgctggtttcggattttttttctcttcttttgtagtttgtagtttgttgaagtctgaggttatattactgatttgagatagttctttttaaaatagacattaatagctgtaaatcctcccccgagcactgctttagcaatgctttggtatgttgttcttgcattttcatacatcttaaatacttcctaatttctattattccttctttttccattagctattttttaaatgggctattatacttacatacatttgtgaattccccaaattttcttctgttattgatttatagtttaattcttctgttgttggagaacatttttatatgattttaatctctttgaatgtattgtatgttgttttatggcttagtatatagactgttttagagaatattttctaagtgcttgacaagaatgtatattctgctcttgcttagtgtactttagtgtagtgtaaatgtccattaggtctagtttgtttatagttttgtgcaagtattctatttccttgttaatcttcagtctagttctgttggttttaaataataggattatcttgcaagtactttgaatacaaattatcttacaattctctttcaaactaaagagctaagactgagggaagattaacgatgactaaaattttcctgtggtaaacattttgtagtaaatgcatacttcctctatagctgctctttgtggctcatcattggtcatgcccatagatctttgcatgttagaaacttatttttacacctgtgatgttgtaaaaagacaaccagaagatttaggtactttcttactaatctctccaaaagcaaaattctcctactatacttgatatgctgagtgggtaattttcaatttagtagattcttccttgtgtttggaa

SEQ ID NO: 3859 - DNA, 1087 bp, Homo sapiens
attcttaaggctttatataacttattcaagagaaatttaaaacatacacaataaaattaaaaggcacactgagattttcatagtgtcataagaactggacctggtaaatcaggggatgccttgatgagagtatatgaataaaagaggatctcctctgctaaacacagatttcttaaacaaaggaaggcttctttctttcttcagttacttaggaaataagcctaattttgctttcttcaataacactggctttatgactattaggaaaataatgaaatgaaaggttctttttctgtaagatttggatgtgaattttcataattattttaaatttgttatgctgaagacttaagacatatgaccattcagtgggctgatacagatgaaatgtcacattatcatcacatggtgaggcatgaaatttatttactttacataatcaacctctacttaaaacaacttgttacagatattccttagtcaatagatggcattatatagtagttaatattttcagttttttctgaagataattaaaaataccatcgttagtctatgactagtacttccaataaacaaaatgtttttgaaaagaatgtaagcaaattgtagagcagttgccaagatatgaaatctagacacttagcttcagtccaaaacatattttatctgttttgagaataattgtgtaggttgcagtatgcatattttaaatgaaatggaaccatctgaactttacattgttcagtgtttcagctgtttgtaatagaaaatatttcagaatttccaactttggtctgttttaaaaagcataaactacaatgttcctgtattctttagttaactttctgtattcttacatagtaaaattcgtcttggttatagattttaaagttatcagattcttagacaacaggacaaatttaaaactctttctgttctaacactataaaatagtttgatattgcctcttcattctaaccacccactgaagtattttttaaacataaaaatatgttgttctttccccaactcaggcttgaaaaagtattcatcatatcagctgaataatttcactcccagaaga

SEQ ID NO: 3860 - DNA, 1070 bp, Homo sapiens
atttgaagctaagaatggaaaataattgaaagaattgaaagtggccaagataggaagaacccagaactggtacagaatgatagttttgaaagtcaagttacacctgacttgagactgaagaagttaatgtagaaggaaggaaaagcagaattaatggatacatccaatgcttctcatggattttatttggctgatgcacctaatttcagttgtttttcagaataaagactttttctttgaggaatgtgagagaactctgaatttcacaatgcaactcttctaagcaaattggaaaactgcactgaaaatcctgaattttgacatgtagctccctcaagagaaaaactacgagatgctttaaaaaaatgctgctgggtttttactctacgatgaaaaagaaggttaattcaaggaggaccaagacttcagatttcttaggttgtgctacagtagtctttgaccacaatgcagatttgattaaatcttgtaaggatgccgtaaaactggcaacagtcactggatacctggatgtagtggcccattgacatctggatggctcaaagggtcattataagataaaggatttggtccaatttagtctagcgagaggcaaatctatttgagaaagaaatactattctgcaaaatatgaatggcacccaatgatgatacttttactcaccaacttgaaagagccacaataactttgaaattttgtaccataatgaacttgagaaatatattcttcaggcagcttgaaagaaatgaaagatcgttggttttcaggaataaacaaattagtaaaggaacatcaagatgatattaaaaaccaagggtctgtatgcaaaccataatgctatgttagggcaacaaagtgaaatttgaaccatgcattgaaaatacagaaaagggctctcagtagcaatgcatatctacttttcagcacaagtaggatgtttatgagaattccattttgtctaggatgaagaaagtggtagaattatttctcccaaaatctgctcagcaaatagtttatctccaaagattatgaaggcttcttcagtgattcag

SEQ ID NO: 3861 - DNA, 1033 bp, Homo sapiens
cctgcaatcgcaggcactcggcaggctgaggcaggagaatcaggcagggaggttgcagtgagccgagatggcagcagtaccgtccacctttggctcggcatcagagggagaccatggaaggagaccgtggagaggagagaggggagaggggagaggggagaggggagagggagagggagagggtggatcagttttaaatgatcataacattttatgttttgttttggcaatattctttttttttttttttgcaaaaatatcatagctaggagagataccagagacgaagcaaggcatctgcttctagaataattcctgtagcttcagtaccttgatggagtcactgtagattcagtgtttggtcctacactatacaaatttagaaactcaccatgagatgttgaagcataaggaattaatgaatactaatcagccttaggacaaaccgaaaaataatggaaatgccaatttattatgagaactttattgatatcagtagttttctcaggacagcctcttctgaaagtcagtctgttcagatttaaaaaaaaaaaaaaaggttattcactttgggaggctgaggcgggcggatgacgaggtctaggagcttgagaccagcctggccaatatggtgacaccccatccctactaaaaatacaaaaattagccaggcgtggtggcttgcacctgtagtcccagctactcaggaggctgaggcagaagaatcccttgaacccaggaggcggagcttgcagtgagccgagatggtgccactgcactccagcctgggtgacagagtgagactccatctcaaaaaaaaagagttatttaaagatattccacaatctaagaagtagaattaagggagtaagaagttttaacagataccttcatttagctgaattagttgtatatatccttttctctacaaaagatagcactgttatttgttatcagcatgggaaaaattttatctggacccttaccctcacaccatgcacaaaaatcaattccaggtggattggaagtctga

SEQ ID NO: 3862 - DNA, 1036 bp, Homo sapiens
gcccaggctagagtgcaatggcacgatttccgttcactgcaacatctgcttcccgcgttcaagcgattctcctgcctcagccttgggagtagttgggattacaggcacgcaccaccacgctaggctaatattttgtatttttagtacagacagggtttcaccatgttaggctggtctcgaactcctgacgtcaggtgatccacccacctcagccttccaaagtactgagattacaggcacgagccaccacgcctggtgtaatttctatttttgaagcgttataaataccagaacatcttacatacccaaatagggcaatatgtattccaaagctaaatataaattttaaaaaattatctgcattttagtttgtttgtacctctgttttcttcttgcctcattgggaaatcagattaaattgatattaagtagatttctaaaagcataaataattctttaaaccagtttaatctcaagaaataatgttgtgatagggtaatgtggatatagtagcaaaataatcttttagatagattaaatttctgtactgtatatttactgttcaatgattttcttagattgaccatctcttctattttttcttattcctgtcctttgtaaatcaatagttacttacgaatagtcattttctaagatcaatacaaacttttgggggatttctgtaatataacatagtacaatctttttgctttatgctctaattctttaatattttaattctatttctatttctcaagaatcaggaagatacttttaacactgcatttgtcactgaaaaaactagttttaatttatattgacctttttctcctttgaacatttagtctgcattgaataaaatgttgatgactgctctttagaagacagctgtatgaaataaagtattataaatattcagcttccctttctaagcattgtcaccaacagctgggcatccagtttagcagaacagattttgcacacagagagcctggcatattcctgaatcagtttagtgaaggaaacaaaaaatagt

SEQ ID NO: 3863 - DNA, 1024 bp, Homo sapiens
gcatacgtaggtggtcctgtacacgttctgtttattattaccttagagtataccattatgtgtgagatcacacacgtatcagtatatctgtgtcagagttatgtcccactgtagggctttagttactaattgtccattatctccattccatctatgccttagaactgccatagagacaacagagaaaggggacagtgcacagccccaggcagatactgtgtggaaaaaaagaaaatgaactggccatttttagatggtctttttggattcagcttcccagttttgtgtatccatagctgagatttattctttacctttcccgggagcagaggtgtaaaggaagagtgtgccatacttgaagaataagcatggcgttagattgaccttttggaggctcaggaataagtgacttgaggtagctgtacagtgaatgtttacaaaaaaaccacaggccaacaggacagtttcaggttttcctttgctcttcacacattactggcatagatcattgttcctcagaagtttttggaatgtcagtgacctttcctcacctgagagaaacaagatatcccatggtgaaaagaagagaaacgggagcagtgggagccctccatccaaaaaccattaatctgaagttcttcagggaaagagagcatctcacatatgcaggaacacttctcccaggctttgtgcctgccctgctccaagctggagaaaggcttaagagttcacactttagtgttctatgtactttaagtcatttgatgaaaaccgaatgtggctgtagcacggcattgaacagtggtcctggccaggtctagatttaatcccagcctaccacttgctaagccctgggcccccagggtactcaattcttctacttgacttggggttttataactgcctgacgttagatactcctagtcatttattcttttctttctccttagagtggaatctccaggagatcaggaacgtggtttagtttattgctgtttccctagcacctagaataacatctagc

SEQ ID NO: 3864 - DNA, 1030 bp, Homo sapiens
atagattttaatcactgacaaaaatcactttggttattatttattctaatatgcattttgcatactactgccaggaatttgtttgcatgtctgatgtataatcacgagcgtgttagaattgtttaagtgctttctgtaggaaacagatggaagatttccccaactcccagagtgtttccgattagcaaagtgcacatcaggcaggatctgtgaacctctcagataggggtttttttgaagctggatttgataaggctctgtgacggatacctgtaatgagaaatatcatcagagttttatttttaaatgatctaaatttggtttgccaggagctacagtgcatatttctggggagtcatagttcttgatgattatgatcaaaacagcctgaccgaacctggtcggaagtctgtttgccctaagaggatatgagtgacccagattctttgtggatgagagagttccttatctttgcatatattgggtttagaaacagatggccaaatgtatccgccttgattttctgatgtgtttttttacttttcctcaggtatctctcctctttgtcacaacctctttgccctgtatgacgagaacaccaagctctggtatgctccaaatcgcaccatcaccgttgatgacaagatgtccctccggctccactaccggatgaggtatgggaagtactgacctggtacctgcctggctccctctgcactgagggacagtggtcagcctggagccctgagtcacttaccaagaagtattgtagtcatttttgtaatttgtaacttttgtatttgcttgatgtgagaaaggacttcttcagtatttggaatacaattcaagatgagtttgatcaccttcctctgccacattttagaaaagaaatcttgataaggcagaggatattttgaatagaattagtgtcctacagcagagtttttcaaatgggtaatcatagttatgaatttaatttagtggattcacagttatgaattcaatttaatttagtgaatttaagaaaaag

SEQ ID NO: 3865 - DNA, 1002 bp, Homo sapiens
aagaagattttgacattctctgttcaagaaacttttacagtgagagtaatttagtgtatctcagacaatgttggagtgatcgatggttgggtttccttgttccaaggtagaatatcaaatgttcagttgacttgttgatggatcagtttgacctcgctttaaggatatgtctgaaaaactgaaataatgaggtcaacattttccaggtttttttttgtcattctatgatcgactaagtctgctttggttttcagttactaatcagtgttccactaatgcctatttagaaactttattttgaaataattatagattgacaagaagttgtaacagagggcctgtgttgtataattgaagtttaacagtgatacgctcctttctttctagaaaggctttcaatttatggaaaaattagcaaaggtaaaagatgctcggcgttggacctttgaaacttctttcggaattagtattttgaatgactccatacaactagaataatggctgaaatttctatggtgctggtcaggactgtgactgtggcccgagcatgagatgattttcctggaaaccaaaagtactactagaaggagaagaatgctgtggagctctctgggggttggagcttatgcctctggagactttgagttttctgtgggtgtaagttttgcaaatggtcctggtagccctgaagctagagttgtcaaagtaacaggtggtagctgggagccagcttggcagtggatcagctacccaaatagccaaagttgctcaatctacatgaggtcctgtagaccaaactgggggtggggaggattagccccatacaaatagttgatccttttttttttttttttaaacagtcatttgaaatattttctgtaaaaggcctaagctttaggcatttaggatgattgtaaatgcactgctttgtattctttttcacatatatttgatttattaatataaaattgccatttttgtacataaaaatggtcaaatatt

SEQ ID NO: 3866 - DNA, 1035 bp, Homo sapiens
gaggccgagtgcggtcgctcatgcctataatcccagcacattgggaggccaaggcaggcagatcacttgaggtcaggagttcaagaccagcctggccaacacagtgaaaccccatctcttctaaaaatacgaaaaaaagaaaaaaagaaattagctgggcgtggcagcacgcacctgtaatcccagctactcaggaggctgaggcgggagaattgcatgaacctgggaggcagaggttgcagtgagctgagatgatgccacttcactctggcctgggggacagagcaagactctgtctcaaaaaaataaaaaaaaattttttgttttttaggttttggggcagggcagttgggttcatttagctgtcctaaagtaagtttggtatatttttgtgaaatatttagtttaaaagttgtattgctgtttttgacattttaagtcagacgagatttactgttgctttatattacctgactgttatataacacgtcctgtgtttacctgtgtgggtctgagcgtaccagatgtggtgttatgaaaagcgtgctggacttggaaccaggacgagccgatgtgaggctgtcctctgccacttactagctctgtgactttgggctcataattgagccttatttttttctcaattgtaaatggactgtgtagacctgtcacagaggaagttttgtgaagcttaaatgaggtagaacctacaaaatagcttcagacagtgcctgggatccagcagcatttaacgaaagttacccactgctaccccaaatactgaatattgccagaaaatctgtaaatgattacataatgtttacacctttataagtggtaactttgtaggtaaatattattcaagttatgaacctctgatttaggaaacctccttatgcaaatggttggcttcccactacagaaacatcagtaataagatagtggtttagactcccaaatctgcgaccagtctgtatgtttgaatcctggcttatgatcagtcatagctgagtgatcgtgggcaagttattcaac

SEQ ID NO: 3867 - DNA, 1012 bp, Homo sapiens
gtgctaggtaaattaggttttactcttatttttaaggaaaaatgactaacaaaggtgcttttatttaatttaaagtgccatccaaggtatataatttggtaggaatgtatttgactttctgggaaagttaatgtgaagatactgtgttgacctcactgattcagtttacttagcaagttgtgggctattggcagaggcaccatgtatacctgtttgtaaaacggtgtcttcagagttgtgtggaaattaaatatcttgtaaatcagataatactccagggagttttgctggtaaggaattataagagtttaaagggactctcaaatatgtattcagtttctatggaatgcccttttacagtttctgtttccataaacatattttgctttcctaaagcaagatttacccaaaatgtaaaagtgtgcaaagagttggcccttcctcctaatcatagatgtgtgttttaaaatattttaaatgtatttccttcttggtgatgtatatgttggactggtttcttgggtctgggcattatttatactcaagaacagttgttgccacgtgattggaaaagcgctattgatgtcattctcatcccatatgctttgacagcaaaggagttagctgtatcttcccttgtcttcccactctagaatgagaaagacaagaaagctccctaatttgatttgtatggagggggagtgggtaggaaagtccacttcagctgaaaaggctgacctgtaggtatttaaaacataaatttaggtctgttattttcacatacacttggtaactcagactggtctgaatataaagtagaaatagctaagaaccatttgtaatgaatgcaactcttatttgtttttaatggtgttttaaggacttaagggtattagaactgacaacagtttattcagttaagcacaattttatctggaggcttgcttgcacagttaatttgatcaggttgtagtaaggctatataacagtttttttcaattatgatttaaaa

SEQ ID NO: 3868 - DNA, 1047 bp, Homo sapiens
agacccgcccccatgatttaattatcactgggttcctcccatgacacatgggaattcaagatgagatttgggtggggacacagccaaaccatatcaacatcctcttctctttttccacttaaaagagaatggctttaatactaatcttacggccagagattacttcagtttcctgttgtaataggaaaacaaatccaagactttcaatgagtctaaaaacatgttacatagattttagtatgtgaaagccttttgtaaactataaagtagtactcaatgaaagacatttttctggacggtagcttaagaaaaacttgtacaaagggttaaaaactcaaatgcctgctgtgaccatgtaagtatggtaattactttcaacaatgcttggaaattcccagctgttgtctcttttactatttcctctccctcattttctctatctctttggagaattgtgattacatgtgtattagacattctaatatataatccaagtcttgtaatctctctttcatattttgcatctcttcatactctttggactgcatttaggacagttttttaggatctgacttccagttcatgagttttttctccagctgtatccaatcttctttttaacttgtttgactttttaatttctatctttttgttctatttctagaagttctatttcagatctgtttggaaaagtttgtatagtcatttgtttcttcaccatatttacaggcttttatttcttgaaacaaaagttttaaagataagatgagaggctgtctcgtcttgtggctctgggcttccatcagcaggaaacaagagggatccctggggtaacctgtgccttggagaagaacattccttctctatccttcacataagcattgtcaagaatgaagagggaggcccaggactctgtatgttctggagaagagactcctccccacaacagtccccgacagccccacactcccacactcataccaccattctctgcaaccattataaacccattatgccgttgtccttgtttatgtcagtcacacaaaa

SEQ ID NO: 3869 - DNA, 1001 bp, Homo sapiens
caaaaaaaaaaaaaagaatagaataatagattatttattattttctttcaacccatggagtgtgttattgtattgtcatttggcttccattgcagctactgagaagttagtggtccatctcactgccattcctttgataatgatctccacactttccctgacctcaaattttttcctttgatgttcattagttttattgtgatgaatttgagtgagaatttttctttctttttctcctttctttcctttcctttccctccctcccattctctctttctttcttttctttctaccttctttccttttcctccttttttccctttccttccctcctttgttctttttcttcttctccttctctcctgcccacctttcttcctgggatttgtttggcctcttgagtatgtgaattaatttcattaataggttctggaaaagtttaggccagtatttcttcaaatactgtttctgccatataatctctggtcttctagtgctctaattaaatatatgttagactttctcactctatcttctatgaattttaatttctctttcatatattgtatttctttaaatttctatgcttcattctgtaaaatcttgtgacccaaccttcttgttctctaattctcttttcagttgtatgtaatatgctgttaagctgttggtttttgttttgctctcaatctcagtaatggtaaattttatttctagaagtttaattttattgttcttaaaaatttgttggtcactttttgtagtttccagtatcttgaagatattttcaagctcatcttttatttctttaacaatagtaggcataattttataatctgtgtctgataattccagcatctgaaatctttttgactctgtttctactctttcatttcttctagctctcatacgtgatgcttattatgtatgcttagttgttttttttaccagtactgcttgttaaccttgaaaacttatttgtgtaaatacattgaggccca

SEQ ID NO: 3870 - DNA, 1061 bp, Homo sapiens
gtcccccacgatggagggcagtggcgcgatcttggctcactgcaagctccgcctcctgggttcaccccgttctcctgcctcagcctcccgagtagctgggactacaggcgcccgccaccacgcccggctaattttttcgtatttttagtagagacggggtttcaccgtgttagccaggatggtctcggtctcctgacctcgtgatctgcccgcctcggcctcccaaagtgctgggattacaggcgtgagccgccgggcccggcctttattatttttttcaaatgctctcttagcagaatcatgttcatgtttttaaaatatctttataaggtttgttgatttttccccgatgaaattagtccatatagtgtactttgtcaaatggattagatttaagtcattcattatatccttttattatctttccagtgtgtacaacatctggagtaatatcccctttttcactcctgatagcgtgtgtgtgtgtgtgtgtgtgtgtgtgtgttctctctctctctctctctctctctgtatgtatgtgtgtctctcattagtttcaccaaatattttacaccttttttagtcttctcaaagaatcaactattggctttattgttcctgttacatagtttttctattttacacatttttgttcttatttgttatctctttcctacttctttatttctgtttatcttgcagcttatttctaatatcctgaggcagatgcttgacttacttacttttagccttttttcttttctaatataaaatgtaaggctataaatcagctctgtaaacactttttagctattaccctatatgtttttgatatgaagtaatttttaagtcactcacacattttaaaaaggcacagttcacagccaggtgcagtggctcacacctgtaatcccagcactttgggaggctgaggcgggaggatcacccgagatcaggagttcgagaccagcgccggccaacatggtgaaaccccatttctactaaaaatacaaaaattagttgggcctggtggcagacacctgtaatcccagctacttggg

SEQ ID NO: 3871 - DNA, 1064 bp, Homo sapiens
tttaagttctgaaacttgaaaattctatcaaatattttaataaaggggatttttaagagctctcaaatttttctcaagaacttaatacaagctgggcacggtggtgcacacctgtagtcccagctacttgggaggctgaggcaggaggagttgagccaggagtttgaggccagcctgggcaaaataatgagaccccccccatctctaaaaacaaacaaacaaaaaaacttcatatgattttgaacaatatagaaaacacacacacacccctttttcctaccatcacagcttttgatatatttgcatagcttttttctcaattgtttttctttttctttttgagatgaggtcttgcttgctctgtcacccaggctggagtgcagtggcataattacagatcactgcaacctcgaactcctgggcttaagtgatcctcccacctcagcctcctgaatagctgggactataggtatgtgctaccacgccctgctaattattaaattttttgtagaggtggggtcttgcaatgttaaccaggctgtcttgaactgctggtctcaagtgatccacctgactcagcctctcaaaatgttgggattataggcatgagccaccacacccagcttttctcaatccttataagcatgtatttattttttaagactactgtaattactctagttatgcacagtttttatgtccatgtactgtaatgattacataatagtccattgaatggacatagtacaatttattattccctagttattgggcaactcagttctttccaaagtttcattattataaagagcaatgctccagatatttttgcatacacagctcttctttactcttgaaatactttgtagaataattagaactcacttggttgcaaattgcaaagctcattggagtagcctaagtgaaagcagttatgttaataagcacatagggcagtcacgaagatacaatgtgcaagacacatagaaattggaaagttgtcagacaatccccctcacccttctctggtctcttatttccttcagacttttgctgcccatacc

SEQ ID NO: 3872 - DNA, 1034 bp, Homo sapiens
agaaattatttatttagggaccactagatttggaatgctaccaaatcccattactagtctataatcacacaatatttttacctgcatcattccatttgttccaacaacctggtaatgtaggctgggcaacagttcattgttatgttttacaaacagagaatcaaactcagagaaaagacttgcccagggcatcacagtctccaagggtgacagcaggacacagcctgctggagctatgaatcttgctgttgcactcagttgtcctcttttgcttcactcctctcttgtactgccgcccaaactgcgtgtacatctctccccttgccgttggcctgttggctacaaacagccaccagctcagcaaaaacaacaagaccaaattggaactactctttcaggctccacttcccaagccatctggtcaccctgactttccaccacacaggtgcagtggtttgcagattgtcatcaatcttcaccttcacttaaaagtcacgttgactctctacagcaccaagctgccataagcattctttttctacaggcaggtacgtaggtattaatcctaatgtcacactaacccatttgaaaaacttgcaacttcatttactttctctaaggtagacaataagctcagaaattgtcctgaaagccaaggatttcctgtgatgggctcactgaaaaacatctgacctaaagctcactctgcactttgccaaaaagcagaaacaaccatctccacatcaccagttcagggtcccagcctgctgagcctccaaacccagccccatccatatctctaacctttgccaaccactagtctatccttgctttctaaaattatgtcctttcaaaaatgttacgtaaatagggctgggcacagtggtttacacctgtaatcccagcattttgggaggccgaggcaggtggattacctggggtcaggagtttgagaccagcctggccaacacagtgtaacctcatctcttaaaaaatacaaaaattcagccaggtgcggtgactcacgtctgtaa

SEQ ID NO: 3873 - DNA, 1034 bp, Homo sapiens
tggttgatggggtaacatcttttactctggttcgggtttaaaagaatccaggtgacagagacaggatacctgccctaatatggtagccactagccacgtggctattaaccacctgaaatatggctagggtgaggaagagctcaattttaaattttatttaattttagactttgataacttgatttagttattggaaagcttatttatatttggaaacatacttgagcttacgcatctacttttgaaactaagtgttttgaaatccaaacgcaaattaagtattttgatgaaaatttagaattgggatatgtaagtgcaaagtaatcttcagatttcaaagaatgcaaaaaaagtagaatagcccattaattttatgttgattccatgttcagatgataatattttagatatattgggttaaatgaatatgctattaattccacctgtttattagtgtggctactagagaattaaaaattacatgtgtagcttgcattatatacttcattggacagctcaggcctgcattactccttttcatctatgaattaatttcttttctttttttctttctttttttttttttttttttgagatagagtctctctctgtcttccaggctggagtgcagtgacgcgatcttggctcactgcaacctccacctcccaggttcaagcgatcctcttgtctcagcctccagagtagctgggactacaggtgtgtgccaccacgcccggcagattttttgtatttttagtagagatggggtttccccacgttggccaggctggtcttgaactcctaagctcgggtgatccatccgccttggcctcccaaactgctgggattacaggcatgagccactgtgcctagccccatggattaatttcaaaagtggtgactgtatgaaatattgttatttcatgtttgtgtttctattttccactgctgtgttccatgtgatgattggggaccccaagtattacattattactgttatattagggagattagtgtaaaagtccagggttcta

SEQ ID NO: 3874 - DNA, 1030 bp, Homo sapiens
ttgggaaaaaaagttgttcacattggtgaagggaagcagtccgaacatatgttaacagtaatacttcatgggggtaaggcctgaatgctaatttctcagtgcaaaccttcactcaattacatcagacagttgagccattaaaaacaagaccacagaagctttattttaaaaaggcattggctcttgaactgatggctgaaaaatgaactggaagaagcatttggagtatgcctgtgtgagaaaaacaagaataattaatattttataaaagtttggatataggttggtctatcagctatataaaactacattatttaacaagaatttagcactaaaaataaaatggcacttttacaaggctatgcagatggataatcctatctgtaatcacacagagcaatgattattgtgtatcttattttcactttggaaaagcattatcaaatctgaaaaattggattgtaactagaaaagtttgaaaagttttcaaacttcactttctcttcataaaatcgatactgcctgccaacagttgttccttgtgtgtgccaatatctaagtatcacttgacccccctcctctgtttatttaatgcagaaatgggaaattttatgatgcatataaaaataacaggattctggtcagcatgatatatttaagcacttaagctgacattaaacttttgtcttgcttcaaaaataattttgaaaattatagcaaatgcaaaacaaactgcaatctaagcatcatgcttaatttcagaattctcaaattacttgcccttaagtagaaatttaaaaaaaaaaaaaaaaaaaaaaattttataatcctttatgaatgctttaaccacctggataagaaatatgacttaattactacacaaacacttaaaaattcattagaaaaaccttagcaaaataaaatgaaagctgacagactcagaataacaattcctctcataaaagtttaccaactgtacaagttaagaaaattatacacgcttttgtattaagaaaggacagctcagtca

SEQ ID NO: 3875 - DNA, 1023 bp, Homo sapiens
tagacattctgactggtatgagatggtatcacattgtggttttgatttgtatttctctgatgattggtgatgagccttttttcctatatttgtttgctgcatgtatgttttcttttgagaaatatctgttcatgtccttttcccattttctaatggggttgtgtttgttgaattaggttgcttatcaattctggatattagacctttgtccaatgcatagtttgtgaatattttctcccattctgttggtagtattcttcagtattggcaaaagcatttatcttctggagaaatcgattgggaagaggctaatgtcactgattccttaatagtgttcttccttatactattattagggttggtgcgttttcattgtttgtcttttgtttatttgtttttgtattttaaggacagatatttggatgagttttatatatatttaagaagctcagttaaacctatataacagtatattactatttttatttttagaatatattaataacttatattggaatggtctttggtggagattatattttcacgtggacaaacttcattggtttaaatatcaggtaagtaaaaatatttaattaaattgcaaaatcggaattggatattcaaatagtgtcacaataaggttaggctattaaattaatggaacatttattcattattaaacatatgtggagtgccttctatgtgctacatatttaatgtctctacataatgctttttaagaagcagggagaggttgggcataatggcttatacctataatcccaacactttgggaggctgaggtggacagattgcttgagcccaggagtttgagactagtctgggcaatgttgtgaaaccccgtctctacaaaaaaaatgacaaaattacctgggcgtggtggtggacattaggactgttgttccctggccacagggttgctatattgaaagcatttttagtgtatatttttggaatgggtatctcattgtcgggggctaatgaatatgtccatgactgtag

SEQ ID NO: 3876 - DNA, 1051 bp, Homo sapiens
ttgaatcccacatccccagaaagaaaaatgctatgaaaccaggttatgcaatgcttgtatagtgtactttgatacagacatttttaaaagtatttaaactacatcttttaaatctaaactcacaaagaaacaagtagtctcttgtagtaataatcgtttactataaacagctgttaccagtcacctctaaaactgtagctcttaccgtggtgatgactcaccactcatctctcacacacacacaagtcacatttctcctacagtacaagtaagaggtagatggcacctttttttgtgtttcttaagggatctgaatcattagaagtgccctctagattcttttatgttgtaccaaagacagcaaagaggaggaaggaggagtaggaagaaataagagtaaatgggagaaaaatatatattttttgagacagggtctcactctgttgcccaggctttagtggcacaatcatggctcactgcagccttgacctcccgggctcaatttatccccccatcttagcctcctgagtaactgggactacagacacttgtgaccatgactggccaacttttattttattttattttttatagaaacagggttttgccatgttgcccaggctagtcttgaactcctgggctcaagtgatttgctcacctctgcttcccaaagtgctgggattacaggtgtgagcctctgtgcctggcccaatttctaagaaaggaagtaaaatttaagagtctaattttaaaaacataattttgagagagttttagtctactgaaaaaaaatttaagaacaggatatatatatatctccaggatatatgttcttaaattatatatgcatgtataatttgaatatcagtttttaattaagctgacttttaaccacagagctctttttaaaaaatcttttaaaatctattgtcagattttagctggggggacaaacagatgatatttttgccttttgaattttttttattgaagataccttcacaagtgaaaccagtaagacttaaccaaagttatgacttaactaaggatg

SEQ ID NO: 3877 - DNA, 1046 bp, Homo sapiens
tatttgcaaattagcacacctctaaataattcatagacaaagaaaaatcacaaagaaaatcagaaaatattttgaacaatgaaaatcaaagcacaacatagtggctgggtgtggtggctcactcctgcaatcccagcattttgagaggctgagataggtggatcacttgaggtcaggagtttgagaccaacctggtcaacatggcaaaacctcgtgtctactaaaaatacaaaaattagccaggcatggtggctcacacctgtaatcctagctacgtgggatactgaagcacgagaatcacttgaatccaggaggcagagattgcagtgagccaagatagcacctctgcactccagcctcggcaacagaccctggttgtttttgtgtctgtctcaaaaaacaaaaaaactacaacataggaaaatttctggaatgcagccaaaacagtatatagagggaaacccataaaattaattatataaattaaatccctaaatgcttattttagaaaagaagaaagatctaaaatgagtgatctaagcctctgtcttaagaaagtagctgggatgaggtggctcatgcctgtaattccaatgctttgggagcctgaggtaggaagattacttgaggtcaggagttcacggccagcctgggcaatatagtgagacctgtcttttaagaaggaagaataaaaaaaggaaactagaaaattaaatccaaaataaacataagaaatgtaagattgtaagataagaatagaaatcaatgcaatgaaaaccaatgaaactaaaagctaagattttttttaaaaaagattaataaaattgctaattcatagccaattaatcaggccaaaaagtgagtttacataaattatcaatatcagaaattaaagaaggacctcattacagagcaggtatattttaaaagaatagtaagagaatattatgaacaatattatgccaataaacttgacaactgagacaaaatagattcttggaaaagacaaactatgtaccaaagctcactcaagaagaaataggtaa

SEQ ID NO: 3878 - DNA, 1086 bp, Homo sapiens
gttcttacatagagatggaagaacagaccacttgctgtagatctcacaaggctagttctgtggtacgctgtataatgtctccattatatcactggctaaattacatggtttaggggagttataggaaaggttgctgcacaaattgtctgcctggaagtgtctcatactaagcattgctgactaaataatgaagaaattttaggctgttaagttagcctgtttagagttattcatcttttctggattgctctgtggaccacacagattgattttcagactctgaattattctcaccacatagagacagattccttctgttttctgggccttggtgttcccatatgtaaaacaggtgggttggatcaattattctttagttatgaatgaatagaactttctctttgccagtatattatttgactgacactgttatgtttctaaccattcttacctctgagatatctctttttaaataagagcaagtgacctacttggcaagctggaatgtgtagttttgacatgatctgtaggttttattttatataggtggcaccactgacattatcttctttctgccttagcaagtttcctaacagtttactttcagataaggattcaatttttttcttagtaatttttcagggaaagaattttcaggaatagaatatcatttattaatcttttttctttaccatgacatgcaaactcagtggtttatttttagacttcatggtaaacagagatgtgtcaaaacactaagaaaatatctgtcacactttggattttagttcagatttcaaatgaattgatgattcagaaatggggaatggttgcctcaagtggacattgaaacttttccatacttctgactagattagggttggtaaattgtaaattggtgctaagttatcctgtgctcattgtagacattaccaagtagtcacaatattttcttgctatgcttacacatagcctgagactgtttaccaagacaggagtctagacagccagaatcagttgatcagagctggtacaaaagacaaaatctgattgcatccctggatgagagtttagcctttgtattga

SEQ ID NO: 3879 - DNA, 1059 bp, Homo sapiens
cacatcagcctccccagtagctgggatttacaggaacgtgccaccatgctcggctaggtttttttgtttttttttttgagatggagtgtctcactctgtcatccaggctaaagtgcaatggtgcgatcttggctcactgcatctccacctcctgagttcaagcgattctcccgcctcagcctcccaagtagctgggattacaggcacccaccatcatgcccggctaatttttgtatttttgtagagacagtttcactatgttggccaggctggtcttgaactgctgacctcaggtgatctgcctgcctcagcctcccaaagtgctgggattacaggcgtgagccaccgcgcctggctgtttttgtattttttgtagagacagtgtttcaccatgttgcccatgctggtcttgaactcctgggctcaagcaatctgtccgcctcagcctcccaaagtgctaagtttacaggtgtgagccaccgtatccggcctcatccatctttcttaaatgacactgtgctaggcttctgaaaagcccaagacatactcagtcttgattcagttctagaaagagaatggcttcagagagatgttttgatattgctgtgtgtgtgtttgtgtgtgtgtgtatgtgttcaaaataacctcttttctacttgctattttgaggcagccagtagtcatttttatttctctgatcttaagcacttgaggaatttatttcaagtaagtataaaattttgtaagtttgctttatttggtcttgaaagtttagattatttcttaatgtttgcaaaacttctaacttaattcatttgctgtgtatgttgtaggggagggtgtgtgtgtttgtgtatttatgtgtagtttgagtggtattttgtacagtgttgtatctgctagaacaaaacgcagatgaaacacctaattatttactgtcctaggagctgggaaaatatggactgctctattacaatgcactgttcatgattctgcccaccctggccattgcgtatttcacaggagatgcacaaaaggtaggactttctaattacggtt

SEQ ID NO: 3880 - DNA, 1032 bp, Homo sapiens
gccaggcacagtggctcatgcctgtaatcccagcactttgggagtccgaggcaggcagatcacgagatcaggagatcaaaaccatcctggccaacatagtgaaaccccgtctctactaaaaatacaaaaattaaccgggtgtggtggcgtgtgcctgtaatcccagctacttgggaggctgaggcaggagaatcgcttgaaccagggagttggaagttgcagtgagccgagatcatgccactgcactccagcatggtgacagagcaagactccgtcacaaaaaaaaaaaacgagtaattaaagtttgtattttgccttcacttattttttccttgatgttcttcctttttctatatagttccaagtttctgacctatctcattttccttctctctgaaaaacttcatttcacattttttgctaggcaggtctgctggcaacaaatttcttcaatctttatgtgggaagtccttatttctccttcacttttaaagtataatttcacagcgtatagactgctaggttgatgggctttttttctctcaatactttaaatattttactctactctttccttgcttgcatggtttctttttttttctttttcttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctctttttcttttttgagacagagtctaactttgttacccaggctggagtacagtggcgtgattttggctcactgcaacctctgcctcccaggtttgagcagttctcctgcagcagcc

SEQ ID NO: 3881 - DNA, 1804 bp, Homo sapiens
agtgggttttgaggttcattttgccaactttgaggttgaggttgaaaaagaaacacaaattacaataggatctgtgacctgtgctgaggacctcaatatttaaaaaggaaagagaggggaaactgggaaggaaaaaaatgggtggggggtggggaagataggcaatgaggcaaagtggtcttgtgaggctttgattagcattcagtgaatctacattttacatgtgaaaggaggggtaaagggtcaattatgcatttttctggaactcagtaaatctatgtttgacataaaataaagtaagcatgtgaagttacagctatctgtttggtaacaaaagaaaggcagtttttgcatgactcagctcccaagcttatcttttcttttggcatagtgagtttggggtcttgagagtttattttcctttcacacctgctagctcattgagatgacttcatctatgctggtgatcacagggaaaactagaactcagcgtcatatactcaacatatactggctcacaaactccagggcaagtcagagatgtcttgcatgctgaatttatttcaacagtcataaatatgagtgcctacactggacaaggcactgacaatacaaaagcaaagaatctgcctcaaagagtccactatctaatggggaaaagagaccccttccattatcccatccctgcttactatgggtaatcagcaagatgaagtcctataatattacctctactccacccaaaggggttgaggcccatgcagataatttattcaccatgactatcacagaatttctatagtttacatcctgttgagaaaagtccttgtggaaaattctcaagtctactctagcctggtgagattgcttgcatagacttaagctatatgattgagctcaaaaagccctttctctattcctaacacaggggattaaaaaattaattttagagagaccttctgttcctcctgctgcagcagaacatcagcaagtgtcagggaatcaactgtccaactctgtgagggcatccttaactctgggagtgaaatgagatattggaacagaagggaagggatttgtgtgggttgctgggccaataaagtttatccaaacacacatacacacacacacacgcacacatattaggagaacaaaaatagaagctctatgggaagaggcagtgaggaagatgatggtgtcagcagtttggttggcaaaataggctgaatagaagaaagaagtcaagaagtcaagcaggaaatactggtcctgctccctctgggctgtgatctctggcagagataaaagaggccattcaatccttggcggtctgaaaacttacactcagggtgattcaatgataaaggcaccagtgtaggaagatgtgatagttgccagtcgttggaaaagctgtagataggaaggtcaagtggtactagacaaaacagctgcactgctactggaaacaagtttttaacgatctacattggatttcacaaagcgtagagtggtattcagctgtttatttttatgaagcacctaccatgtgtctggctgtattctaggtatgaggagacaatggtgagcaaattgccatggcttcttcccttaagatgcttagagactgttggcaaacactactaggcagtagcaaagtataatgtgttctccagtagaaaaatgtgctggccagccaggcgcggtggctcacgtctgtaatcccagcactttgggaggccgagatgggcagatcacgaggtcaggagattgagaccatcctggctaacatggtgaaaccccgtgt

SEQ ID NO: 3882 - DNA, 1098 bp, Homo sapiens
tttagatgaaaaattttgaattgaagattgcagctgtagctgatgaaatgacttactgattatccttgcaaattattttaatctcacaagcaggttaaaagtgggtgtaattctttttaagccatctctacagctactctgccaaagacagattagagtcggtaaagagactctgaagtgtttacaggaaggcaaaggaatccagtcaatttaagtatgagagttggaaaaaaaaaactttggaaacaagtgttgtgaaaagaaggaaatgctctttgttactaattttcatccaattttgtaagtgtttttacagtttttctaactagtgaaaatgccctgagggtgagtgggtgttgtgcccttccttgaagtgtttccttgggtcctattacttataggtggtaaaatgcctgaaattggaaggtatcttgaacctcacctgtcacggtcttgcataggcaatgccaaggtctcttgatggaagaattccttaaagttgtggaattgaaaagaggcctgaattgacctacagggaccctttggcagcgtatgagaggtttgtatcttagtgatgtgattgaagtctcagaggagccaactttagaatagtgttgacacttgtaaataagaaaagaagtgaccactagcaaagtatggagccacttatcacagaatgaaggaaaggcacttatttgtttcaacagctcagcaacaaaattgagttaaatacagccctaattcctttttgtttaagaaatagcctttatttttagaaaaagtcaagtaaattgggtggaattctagatatttcaattaaagagggaagagcatattttctggttcctgtttaaaagaatgtttttattaatgacttaaaatactccatttatcagtttacttcaaatagttcttttcaaggagtggtgcttccgttttcgtggcctacctgtaccttgtattataggatttagattagctgggtagataagttagcaaattcaagagtgccagatttgtcctagtgtcaatttgtttttaaatttatctgtttttttaggttgatttctcaagagccaagaatgaactagaacttca

SEQ ID NO: 3883 - DNA, 1032 bp, Homo sapiens
aataaagatttattttcatgctcacttcttaaaagtcataaaaacaatcaaataggatcatgtttattgtcatgtgtttcctggtttctgacctgtgtgcacacccctgtgtgtttataatttttaaattgaattttatatggggtttttatttgctaaaaaccaggctgttgaatcacatttgggaagggtacttatcttaatgactaatgacttaattgggaaagttgaattcttgtaaaatacaaaatccaaggacttcttggatttaatctgattgtcacttcttagcagatcacttttttgataatgaaagttaagcatactgaatgctacttttgattgacaaactggctataatagtctaggggaaaaatccctaaacagataaagattcctaaagtaatggtggcagctgatgtttcagtgaacttttatcttgatgcgtttaaatggaagtaatgccagacctgagatttttaaggcatttttacagcttgtattgaaatgattggagacatggtttctttattagctattttgagacctgtggagttaagcaagacttttaaaaattggcaccatatacatctagttagttcctttactcttatttttttaaataaaagtagtacacatcatttccagggttgtaaatatatttggggcttgtttttggtatggatttaaaaggaggatattaagtattcattctaattttgttatttttctagttgccagagatggttgcactgaaatagaacagggagttgcatacaaagcctaaatgtgtattggatttcgaaaatactaggttggtgcaattggttttgtaccaacctaacatgtctttaggaaagtaccatcatgtggaaggaaacaacaggtgttaaaaggttcaaaggaatgagaaataggaagttactagaacctaactgatgttgaccttagaggtaagattattcaggtatattagtggacctccagtccaatggtatagcaaattccagggatctcaggtgcatgcaattt

SEQ ID NO: 3884 - DNA, 1607 bp, Homo sapiens
agagtaagactgtctccaaaaaaaaagagaaaaagaaaacaacccatattattactctggaatgaaaataggccttggtagaaatttaggacagggctcattgcaaatacttgtagtttttttgtgatccataattttgtcttgatacattttacctagaattttaacagtaggatttttttttttttttttttgagatggagtctcactctgtttcccaggctggagtgcagtggcacagtctcggctcactgcaacccttgcctcccaggttcaagcgattctcctgcctcagcctcttgagtagtgggatcacaggtgcctgccaccacacccagctaattgtttatatttttagtacagacaggatttcaccatgttggccaggctggtctcaaactcctgacctcaggtgatccacccaccttggcctcccaaagcgctgggattacaggtgtgagccactgtgcctggccaacagtaagatttttttagagttctgtcttaatgtagacactagctaacaatgtaattttgaagaactgagaactgtggttaattttggtttttctttttcagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaa

SEQ ID NO: 3885 - DNA, 1050 bp, Homo sapiens
gttaaattaaaatattgtgagggcaaaccctttcaataaggtattagttatttttattttttttttttgagacagaatctggctctgtcgcccaggctggaatgcagtggcaccatctctgcttaccgcaacctccacctcccggattcaaacagttcttgtgtctcaacctcctcagtagctgggattacggacactcgccaccatgcccggataatgtttgtgtttttagtagagatgaggtttcatcatgttggccaggctggtctcaaactcctggcctcagtgatccccgcctgcctcagcctcccaaagtgctgggattataggcgtgtgccaccatgcccagccaataagcataattttttaaactgcaaaatggctataagacaaacttggaaacattttaaaataaaatggaggttaaaaagattaaaagtttttttaggtttagagatgatttttaacatttacttcatatgagtagtaaatgaggacattgtcttttttaagtcctgtagaaaaaaaactgcattagaacacgtggtttcagccaggcgcagtggctcacacctgtaatcccagcacttttgggagactgaggcgggcggatcacctgaggtcgggagttcaagaccagtctgaccaacatggagaaaccccgtctctactaaagatacaaaattagcctggtgtggtggtgcatgcctgtaatcccagctactcaggaggctgaggcaggagaatcactttaacacaggaggcagaggttgcagtgagctgagatcacaccactgcactccagcctgggcaacagagcaagactgtctcaaaaaaaaaaaaaaaaaaaaaaaacaacactttaactttcacatgtcttcattctcgtgacaaatgtgaggtagttaaggggaaggaagaaactatttacaaatggagaactgtgttaccgtgttattgacagagctcagagtttctgttttctgctcctcattgtctgagtgctctagaaaaaaggtcggacacagtggcttacacctgtaatcccag

SEQ ID NO: 3886 - DNA, 1351 bp, Homo sapiens
tctctaccaggtataaaacttgaaaaccttttcacagggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggtaaaattaagttttgtcgtgtttgaaaatgttcagatgtgacttgaattgtatttataatttttgttttaaaatttcacatgggttatttgtctgttaaagctttacataggatcatttggggcagataatttgctttataaggaaaataaactgtattatcacatattctaagaaatttagtcctttgatcaatttgtaattatgttttatgtggtagagttactttttcctaaaaagctgttagtggagtatcttgtagttattggtgttcagaaatatgatagttcttttcaaagttgtggttgtatttttgaaatcttgccaaactggggatcattaaagggctgtggtattatggtgttaggttgaaatcttgacattttcatatggtttaacctaaaatgtaagtgacttcatttagaattcaacttttgaaactgtctgcctataccatatataatggccaggacactcagtaaatggcaatgtgcattttgtctaaggaatgacgactttaaaaaccaaagtatatgtgggttttacttaagaaacatggaaactagtgaaaatacagttgacttgttgaacaacatgaggatgctaggggcactgaccccgcagatcaatgcacatgtaacctttgactctcccaaaacttaactactaataacctgttgactgaaagtcttagtgataacataaccagttaacacattttgtatgttgcgtattatatactgtgtttttacagtaaagtaagctaaagaaaatgttgagaaaatatatttactgttcattaagtggaactggatcatcacaaaggtctttattttggataggaagaaaagggattgggcttgcttgtctcaagactgacagaggcagaatgttcaaagccacgttgttcaagggtcaactgtattggagaaagtcacattgatggcttttgatttggtagcttccgtttaagctttggggtgtgttcttagaggaatgtttcagtgcggcttcctgtttggctttaaaaactcatacaagccctaactatattatttcttctcctaaattcattttctctatcagcttcctttaaccttttgacatttgtgtttgatttattcatatcataaatt

SEQ ID NO: 3887 - DNA, 1978 bp, Homo sapiens
gacctaaaatcatgtttactttgccagttatttgttacagtattgtggtttaaagtcttggattacaggttatttaggacagtgattcctaaccagaagcatattcaagttagttggggggtgggaggggcagatgttttctaaactttttcttttttcttttttttttttgagatggagttttgctcttgttgcctgtgctggagtgcaatggcgtgatctcggctcactgcaacctctgcctccagggttcaagcaattctcctgcctcagctcctgagtagctgggattacaggcatgtgccaccacgcccggctaattttgtatttttagtagagatgggtttctccatgttggtcaggctgatctcgaactctgacctcaggtgatctgccctccttggcctcccaaagtgctgggattacaggcgtgagctgccgcaccttaaactttttcttttcttcagaaagaatttgctcttatggtgagcactgttaatgatgggaatatcatattccgtggatttgttgggataaggaaaaatgatatactattggagggagtagataaaaatacatggtattgggtgatgttttgaacttggtaataaaaatttatgcaaaactataatggaatcataattttgcatgataaacaatgaagttgtgattggtgccttaacaaatgaaccctatgcaacgttaagtttctcatagtggtcaacacaacttttttttgtttctttgagacacagtctcctgtctcccatgctagagtgcagtggcgcgattttggccattctgaagttcaagcgattctcctgcctcagcctcccgagtactgggactacaggcatgctccaccatgcctggctaatttttgtattttcagtagagacatggttacaccatgttggccaggctggtcttgaactcctggcctcaagtgatcctcccgccttggcctcccaaaatgctgggattacaggtgtgagccaccgtgtccaaccacaactgtttaatagagcccatgttcaatcactcagtgatatgcaaagattataactgtttaccaaaaggtactaatgtattgataggctattggtagcaaatccttagctcagtgcccaggagcgaaactgagggtgtttggtttaaagaaaataattatccatcacattagaactgtctgtaatcttattccagactaggggagaatctgggcatagcatatggaagtataaatttaagaaacacaacattggctgactttgatgaactaacttatatatagcttccagagcttctgtttggtttttatttaatccttgcagtaattcctgaaaggtaggtgtcatgcctccatgatatgataaaaggtatgctaagttctattcctggctgtgtcataacatatgggtaagcaggactttttttatattcttagatttctcatctgtaaaatgactaggtggactcagtacccaagatcccaagatcctgtcaattcaatataaacttgctctaggaagttttttgttttttttttgcagcatagatgtaactggaggaacttttaagatagcatttgtcaaacagtaaagggcagcatccagggagatatttgagctctaaggctaactgaatcacctgctatctttggaaagaagcagggctccccaaatagcaaatgacttgtttggtgacaattgcagattgagattatactaaaataatggatccttaggcctgtgctttgtttctgtaaaaagaggaaaggatcatattctatagttaagacctgagaattatatttggaaataaatggtttagtattaaataatgaaaccagtgtgtgtttgtggatagttctattagtagtgaatccatggcctcctttccatatacaggttggtttgaaaattggagtataaggattttaggatttgtagaaacacggctattgttttgatttgct

SEQ ID NO: 3888 - DNA, 1477 bp, Homo sapiens
ttgttctggtttcctttgtgtttagaaacagactattttgaattttctgaagtgtatgtatttaactattggtttttgagccagtaaacatgttctgtatttttgatcttttggatgaattttcctcatttcttctggaaaccatggaagtataatttatttgtttatattatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcgtaagtcttactggtttttattttactttaatattttaatctatttaataaacaaactttgaatttctagaactaaagagtattatgttaactcagttttgttagttctttttcacattacagtggcctgaagcacgaggacaaacgtggaggtagcggatctcacaactggggaactgtcaaagacgaattaacgttggtattctgattttcttaaaaattctatacctaactagaggttaatccatacctctgtcaaattttacttgtctctgagataagaatgaatgctctcttctgagagttactatattacaagataatgtcttatgggatgggtttgggttatagtatattgaatgaccggttttttaatatttcgatatatttgttactcattttttcccccccatatgtatttgtagcttttcctgaaaccccacaataaggttatttgggtattctgattatcttagtgtccttaatagttcctattctagcttttgactttgttgtcattacaaaatttgataagctagtaaagcttcattttataattaactgccttgttctgttactttttaagtatgaagtatatgaactaactagtttatattgtttacttttcgacgtcttctggggagtatatttagtaagaaaggagttagagaatgtgagagcttatggtatttttgtatgaagaacttttcagctacatgtaaatggacctagatgcctttctttttctttctttccttagagagtcccccaaatacattcagaaacaaatatcttataattacagtgacttggatcaatcaaatgtgactgaggaaacacctgaaggtgaagaacatcatccagtggcagacactgaaaataagtaagtggtattgcgtgtaatagtaatgacccagaattgaaagcactggagttttaccaataagataacccatagatttaatgctgttacttgatggctttttgtttttgacaagggagacttactgtaccctcatccctcaaagagtatttgaaagaatgctttttttttctttttttaatagagacagggtctcactatattgcctaggcaggtctccaattcctgggctcaagcgttcctcctgccttggcctcccaaagtgctgggattacagg

SEQ ID NO: 3889 - DNA, 1031 bp, Homo sapiens
tgttcactcattttgaatgttcaaaacatgaagcatggtttaaatgcctgagttattttgatcatgaagcccatctatgaaataagctcttacctgaaaagtagtattttaagttaacaaatgtggggaatgatttcatgaagttagaaccaagacttaggttcaccgttcaatgagtctttccatgggaaaactattccatgttagcaatcagcattttccttaggtcagtatttcagagcactactgttaagttgcataaaatacaagcatgtaaaatacaggaaaagtgttgaatggacaatacccgttttgagattctactgtcctgattactgggaataaatctgtaaacaaagtcgctgcatgtagtaggaaggttaacctgattgtgttctgtgattttgataacacattgtgacataatacttgacatactttagacagatatttaatgtttatgttttatgaattaattttgtacattctcttgcccatttgaagaacttgagaattgacagcagaatgtcattgagagtgtagaccagggattttctaaaaaagaatgaatgccttgaaactagtgcagttagtgagcttgcaagttatagataagtatatcaaaagaagcttgcatttttaaatgtcagtctttttcattaggtaggtttaatacgtttttaagattctgtaaacttgatattgggtggggacgccaactattgttcacttgggtgtgtttggcttggatattattgcaaggactggttccataactccaccccagtgcactttattactgatgacatttatttaaataccttggtgtaaggtctaatatttgtagtctatcttgagtatttacagggaatgaacttcaaaattctattgaagagattgatagttactgtttggctccagttaacaggcagcagaacaactgggtgtgtcttgatggtgttctactttcttagaaagaaccaaagtgaagcagcttaaaatcttgtaaaaccaattcctcagctgcttta

SEQ ID NO: 3890 - DNA, 1059 bp, Homo sapiens
caaatcattgttagtcttgagtttcctttcactccttggggttgtggcagacgtaaagcccactagaaagcaggaattttcaaccacaaactggatatgtattagagatcctaaattatagactttagctatgtcacccacattgaaatctttttgatttagtcctgctagtttattcgcatcgtttcatttacacctgctactaacaactgccagattcagtcacaggttgactaggtagtagttatttcactactgcttcctatactttttgtgtatttttaaaagaaaaatgcaaaacaggcagaagaataagggttgaaatatacaaacctttctatgtatttcatcttctgttaaaatatgatcttgttctaacacctttgttaagcgtttgttgattattcagctgcttttaattaccaaatctgacccaattacttagcttctaatgtgttccctttataaacaaagcctttataataaaaatcttatctaccatcttttgtctgtaggtaaatatgtttatcatcttcattgttctagatcttcatccctcaagtgcaatatacaatcatagtgtttatattagtaataattttaatgttttttttctttctctgctcttagaaacactgaactgtacttcagtatttgatggcatggcattgttaagagatcgttactcgtgcatcagcttaatcgcctactgggggctgtttcccttagaaggatgtgaaaagaaaagagtgtgcatacattttatagattattataagttattttttcagtgcttgacaggggcatctaatgactattgataatattcttatatattttgtctactttaatttttatgtattcttatatattttgtctaatttttcatctcatgcaaggaaataattttttgacaatataatctgttgctttttgacccaagtgtttggaaactaattgcctgaaataccaaacaggctttgtttggagaaagacggatatatttttcccaggtctagttcctggacgattcctctgtgttcttgctacttgactcac

SEQ ID NO: 3891 - DNA, 1031 bp, Homo sapiens
tttaaatttttttatggagattgggtcttgttatgttacccaggctgatctcaaactcctgggctcaagtgatcctcccaccttggcctctccaagttttagcattgcaggtgggagtcactacccagccacagctgtttttgttaaataatattaaattaatcttatttatcaaagaattgcataaatatatatcactttgctttaggcctggtttatagcttcatgaccttaatagcacaggcaaatataaaactgaccagtgctggtgctcagaaactgatatgccaaaacatggtatttgacacgctaaactaaagaagcctcaaggtctctctgacttttcctccaaccccaccatccttcccaaagaagctgaagttcctttatctgcctaacaaccagacccaccaaggagagcaattgttggttctcctcctcctgttatctcatctgttaaagaaaagaagaccaaaatgtaaccacacccaagcagacctttatagaagtacaatgactgcctccaaggattatttaaattccaaagaaaactatttacaagttaatatctgttgctcaatccaatcattctctcaccaatcattcattgcccctcaataaattcctcttctcctcccataatctgttttaccagaatccaagccccccattctttctgtaatttcaagactagtgtataaacttctataactcattgagaagttgggtctttattctgaaagctcctgtgtatacacattaaatacatttgtatgtcttttctcttactaatcaatgtggcccatgtcagtgattttccagcaaatctttggggggctgagagccatagcccccacaccagtaaacacaggcaaaaatatatattgacaattagaaagacgtttttaattttattttatcaacaattttaaaaccaattacttttttaaagattaagttacatgaactaaaaaaattaggttaattactatgtttttgtgtgagtgcccatctatttaaaccaatcagat

SEQ ID NO: 3892 - DNA, 1049 bp, Homo sapiens
ctgcagaccagcattatgagaagatcccaggccttataatccaagcttagtcctacctgcagtccagcactgtgctgagccttctacgactgccccagagcaaaccaggtgtcccctcccaggcctaccactgaggtcactccagcctatacctgcccaattagggctgcttcacacctaagtggcacccccagagggggttctctgttcttgctttaccctattccagaaggaataagcccatagtatgataactggcagttttgctaaggcacaaatatgaatcttgcccacttctgggacggggctctgagcaagtctctcagccttcaggggctggctcgagggataaaggggaccagtggtcactccatcatctggccagtttagtctgcaccagtcagatgcctgtcacctaggtctcagaagtcacatttagcatgaaacggattaaaacgaggagccagctctgtgcctcaatttcttcatctgcagaaatgaggattataccacttagcattgctgttgggaacatatgaattaggacagtgcttggcatatagtaagttttaaaaaggtatctatcattgtctttgccatcatcatcatcattatagattcttgacacctgtggaatatatatagcccatgaaatgacaaataaggaatgcttatattggctcctaaatttctccaaatgacatatttcagctatagaatccagtgttttctgtatatatcctccttatgccacaagttaaccagtagctggcagtctccgagtccctctatctttccagccttctgatcctcaccctatcccaagctgagaccttggcccagagcctcagcctggcagtaggcatgattcagatttgttcctcagcaaaactgccagttatcaccccatgggctcactccatctgcagtcattgaagccaagaaagttgaatccgggaatgccagaaggtccactactggtttctcaaggtgtgtttcacaggatgctggttctgttgagtgattacagtcggtgatttgttgttgag

SEQ ID NO: 3893 - DNA, 1035 bp, Homo sapiens
gcccttccctgagctgaagggtccactgccttaacagagtagaagagctgccatattgccatattctctcttgcagctaggatgcgtgacagcctagcctcccctccttaatcacatacagaagagttctctgtgttatgacagcaggtacctgtatttctggaaactatcttaatgctttcttttcctttccattatatgcaataaaaatcatcataagatgctctaagtaatatagtttttataaagttagtatattctgcacttaaagaagagcgacatttggagacatttctaagaagtcctaagtagcttgaatgctggtacattgtcctaaaattagtaatggttatgaaatccatctttgccagaaaacacttctgggcattttatataaaatgcattattttccaaaataaataagagttcataatagtggtttgtttatgagtcacaaaaagtgaagaattatgtatcaccaaggccaaactaaaactgctaagtctataattggctaatgtggttaactgacactcctggtctttcagaaaaaaatacctatacttagaccttaatttggcctagggccccaagtgggttatggattatacagaagataatgaacacagacccactgtatcataaacaggcaatgaaatccacctgcttgttaaagttcttaacatttcaatctagcctgccatcttacaatttaaaagtgattcctagagaaagtttatacaacgcagcctcattcagctgtcaaaggaatatttacccaatactttcttctatttccattttaagtgtcccgtagtaagcagaagtggtcaaaatcatttcatttgtctcagagctggcacaaattagtcacttagctcagcagctctgttgacagttcttagtgtaatccatatatctttaggcagcccttaagacaattaccaaatcattaacacagacaaaagcagcttcaaaacatctcttgcagaattttgaagcatatgaaagcttcataattattttcatgagtgg

SEQ ID NO: 3894 - DNA, 1100 bp, Homo sapiens
ttctttgttctcatacctagaatctagcatagtgcttgatacacaataggtggtcggcaagtgtccttcgaatgctgactcccccatagaattgcttggtcttcctctcccctctatctcccttctcaatttggttttcctcaggatcagcacgagcggaaccacatcgcagggtattggaagcaagtcggacccattgccgttggctccttctgcctcttcatatttgacatgtgtgagaggtgagcaagtgtttgtgggacactgagccaaactgtgcatcaccacgcccactcctgtcattttaggaggagtgtttgaaaaggagaatggtggtcgggaacctttggtttggaagcactggacgtggtcacatcctcagacaaggtctgggatcaaatcaaaggcacagctctttacagttgaaaaatatttgggccgatgtattctacaagcttcatttctctttaggatttctgtaatgttttttagcctaaatacagccctcacccctgcagctgaaaagctaagaatatgtgaaaaggaaagttcccgttgcctttgtattaattgtgtcttgcctttccatctcattttctttgtagaggggtacaactcacgaatcccttctacagtatctggactacagacattggaacagagctggccgtatccttccttgatgggctcagggttttatttcttcccctggccacccagtccccaagatcattttctaaggctctgctgatgctccccatatgtactcagccagggctttgattctcaggccaatcataacagcacaattaaggctaataataagaagaattactgcttgctttcaagcctgggtgagagcaggcaaaatgagaaggtcacagcctatcctcacagcagagggatccgagttgctaggcttactgcagcctgtctgaattatctgttatacactgtttcctgcagactgaagcatgactagcttttccctggagccatggaggttcatctctgggcccctgtggaagagcctgtttctgaaaccacctatgtgtgagacttcttaagtgaccttggtgtgctggcaaatcacactgctg

SEQ ID NO: 3895 - DNA, 1047 bp, Homo sapiens
tttgctgtatcagagcgactgcgtctccttgcactgcaatctcaacgaacataaccaccacctcatcaatgactttaccataaagcagatgaggcagggagcattccttgtgaacgcaccccgtggtggcctggtggacgagaaagccttagcacaagctctcaaggagggcaggatacgaggggcagccctctatgtgcgtgagtcggagccctttagctttgctcagggtccgttgaaagatgcaccgaatcttatctgcactcctcacactgcctggtacagcaagcaggcgtcactggagatgagggaggcagctgccactgagatccgccgagccatcacaggtcacatcccagaaagcttaagaaactgtgtgaacaaggaattctctgtcacatcagcgccttggtcagtaatagaccagcaagcaattcatcctgagctcaatggtgccacatacagatatccgccaggcatcgtgggcgtggctccaggaggacttcctgcagccgtggaagggatcatccctggaggcatcccagtgactcacaacctcccaacagtggcacatccttcccaggcgccctctcccaaccagcccacaaaacacggggacaatcgagagcactccaacgagcaatagcagagaatgccggaaggtaatcattcagatacatttgggaccaagagatagtgaaaaatgatgaactaagagaaaaagaatatgatggtctttgtaactgattctggacttatgcatcattgatgctgcagtgttaaaactacaagagctagaaaactgaagatgtcgtctgcttacggaagcgctgaaagactaggatgtgatttattaacgaccaacttctgttattgtgtgttaagtttttcatctgtgcatcaaatcacaaagaataaatagagctttttcctttatcagtcccttgggcacagcaggtcctgaacaccctgctctacaatgttgcatcaagagttcaaacaacaaaataaaaaatattaagaggatatccccatcctgtgacttga

SEQ ID NO: 3896 - DNA, 1034 bp, Homo sapiens
ggagagattaagtttttgtgttgtgtgtccctgtgtgcgagcgtcattttaaggtggctcgggagcggcccggaggagcgagggaccgaaaagggagccatgctgcgctgaggggaggctgcacagctgcagccaccgccaccgccaccgccgcagggtggggtgggaggggcgggagccaccgccaccgcggcctccagagtgggcgccttttgccgtggacgctgaccgtccgggacgagggtttcatcaccttaaatggttttgaaccaatgaagctgtattcccttaaaaagacggacagcccatcgtgtgaactatagatttatagtgtacagatttatagtgtgtacagatttatagtgggttcatagtggcgtcatgcacggagactcctgcgagttcccctaagttcttagaggactgctttgccttttgatctgagagttgcaaagttccataaagtatggcccttgtggataagcacaaagtcaagagacagcaattggacagaatttgtgaaggtatccgcccccagatcatgaacggccccctgcactcctgccccctggtggcgctgctggacggccgcgactgcactgtggagatgcccatcctgaaagacctggccactgtggccttctgtgacgcgcagtccacgcaggaaatccacgagaaggttctaacgaagccatgggtaccatgatgtaccacaccatcatcctcaccagggaggacctagaaaagtttaaggccccgagagtgatcgtgcagataggcagtggctacgataacgtggacatcaaggctgccagcgagctcggaattgctgtgtgcaatatcccgtctgcagccgtggaagagacaccggactctaccatctgccacatcctcaatctgtaccagaggaacacatggctgtaccaagcactgcggtaaggcacacgggttcagagcatggagcagaaccgcgagttggcctcgggatcggccagcatccgtggggaaatgctgggcctcatcggctttgatcg

SEQ ID NO: 3897 - DNA, 1055 bp, Homo sapiens
aggggcacgcaggtagattttcacaacgatcaaatcagctattctaaatgctctgtgtactgacagtgtcctggagagaaagcaaagaaacccactgtgtgttttcctcacttgctttcaggtttgttttctttccacattgatgttgattatggtcaaataggaaagtgctgttgccacatttgctttccagtgttttaacacttgctaacttagatggttctgagttctctagctttgttagcgaaagattggttcatcattgggttcagattctttggtaaacaaattccttagaaaatatcctcctggcagtattttccacaaggttaaatcgtcttaagcacactgagaactgtgttagcagtgggcctcagtttccttaggatgtctctttgtctacctggccccccatcccagtccgtcttccgcacagctgccagaatctcctcctttgctttaacatcctctaagcaaaatgctgcagcactcagggcaagcttcttccctttgtcattagacccttcctgttctctagccttccctgttccctccagtccctctcacattccctgccatattgaattagttgctttccctgctattttgtgcttatgtgactttttatacatggggcttcctctgcctgtaatgccttttcctatctcgctgcctagtgaactcctattctgcaattcattggtaaatatcacctcttctcagtagggtgagccagaagattgtgtcttctgtgctacaattcttgaccttctactcagaactcttgatctttttgtgctgactgtatacttcatatatacttctaatgcagtacaaactacatggaattatacttatttatatacctgccttcaccactttactgtaaacaatttgagggcaatgactttgccttatatgcctttttatccctactcttttttttatagaagaagtttaattgtttcactctttatagacatatataaacatacatttttatgtttatatacatgtatatagttccaaatcctatttctatataagatttgtat

SEQ ID NO: 3898 - DNA, 1028 bp, Homo sapiens
gaccctccagcttctcagcattttctgcccttgattttcctaaagcactcctgtatccctccagctgatttctggttaagttagtgggggtgaagtcctgttacttgcaaacaaatgttcgctaattaagacaacgtttatttcatctgatcatcggaacaattatatctggcagagtgaggacactgaggatgacagagtttacatgatttgccagtctcccagctgggaagtcgagaggctatgagtgtacatgatgttaggactccagtgccttgatcccaccatgagtctattgacagggctatggagtgcttcctgttctgagtgggaaattatactagacgacccctaaggtcccatctactctaactctctgaagttgagagtccatgactcacttaagattctctgactttataaaaaatctcattggtatcctttggttttgtaaatagatgacttcagagaccctcaagtgaaaaccattctagaagatagtgctcagtcaagacagatgctcttgttagagggtgagcttagtgttgaaatgagtgaattttcttttcttttgttacatgcgaccttgtgttcatttctactccttaggtaggcagacagggttggtgtactggaagtgtatttttagtctgacattaaaaaatgtatcatagacaccaacacaggaagcagtttttaggtgagtcagtgtataaataacctcaaagagtttcatgatgggatggtagatctttcagtttagcagttcagtatctgaaaaccctttcccaatttcattcattcattcgataggcattattgggacttgtactacatgctagcattttgctcaggatttaagaaataaagataagtccttattcttcataatacaatttcagaaaccatcataaccctcttttgtttagttttctcttttcttttcttttttttttttttgaaatgtagtctcgatctgttgcttaggctggagtgcagtggcgtgatcttggctcaccgcaacctcc

SEQ ID NO: 3899 - DNA, 1016 bp, Homo sapiens
gttttattgaaattttttgccattttttaaaatgaggagactgtagaagaaaagtatttaagtccatggtataaacgcacagccctaccaacaaagaactttgtctttttcagcagtgatttcctttgggaagatatttggagtatataaaatattgctaataggacccctgtatactaattctgaaagaatgctcactctcagaagtttatatctttagaatctgtcattgttgcggcttgaattaaataatatgaaaaccattaaccctctacttgttcatgctgctgcctttttccatctcagggctccagtctgtaaagtgtgcctgtctgctttttggattaattttggcatctcccccattattgtctaagtttcaacagctagaaacacagcttcagccaatttgaatgtagagagggcctgcccttttgctgcagagaaactttgcaaacaaacatctggttttctgaaatgactgcagggaaaaggacatgagggtaatggaggagccagaggcttgccatgaactctcccatgctctgttgtgtgtttgtgaaatctgcgtaatgcactgatacacctgatacctcacatttgtatagtgcttttatccttcttgaaggtactttagtagaaatcatcttatttgatcttcccaacaacactctaagataggccagtccatcagggatatttacattttaaacttatgaaaactgagatggggagtaactgtttgtggtatggtttatttggcaaggcagtagctatgtttgtggaaggaataactcgggatttgaatattaattgctacattatgacaagttgaagaacaagaaaaaagagtagttttaaaaaatatgaactacttgtgatagaaatcactgtgtattggccaaacatttctttttgagctctcttccaggacaagtaaatgacagttgtggtccatcttcttcaccctcctctgtgtagcaagccattcccatgaacagttgttgattctctct

SEQ ID NO: 3900 - DNA, 1026 bp, Homo sapiens
gtatgtttactttggaatttcagcagtcagttcctcttctcttccttcaatactcttctctgatacttaactcaagattgtggttgagccattgaaccatgggaaattcattttcaaaatctgcttaattgctgtgagacttttaatttgttctggatgatggtgctaatgtctgggaactgggactgaagccctccaaagttgttaatttaatcaaccgctgtgtccttgccatgcctaatgaagcagggggcggtgggggaaccagacccctctcacaaaggggctgggttcctcctgaccaccttgtcaaagataaataagaggggccccacagttaagctgaacagttggagcaaattaccagagtgtcagcccacgttatccaaagcccagggttatgcttcccaaaataattactgagtaggttttatgtaggaccccggagttttaaggcatgggttttgtgtgcgtgtgttcacacctgccaatctgcagaattcttcagtcagtttggggttctgttatggctttgtccataatctgtaagatcataaacatcacccccagactattgatgttcccgttaaccactgaagttttccatggcgagactggtgaaagcttgctctgtcctcatgataaattagcttgtttattcctcttctgcttatttctatcctgctgttggttagtgtaatgaagcagaagtccattgtatgtgttcattgggtagcgatcctctggcaccaaagggggtaattgagtagaaaggcggaatgctgttggtgcatgggagaagttaacaccacatgaggtcaccaggcttcaagctttaatcaatgtggacacaatgcaattgagattgtgaaaagggtttgtttatagtgtgagagtaagggtcagtagttaatttgaaatgctgtaggtgtgttttccttgaaccaagaaggtacagagcatgtgtcatagaggactgtaaatatcctcaagggagggacgtaattggggtggggatttaaaaag

SEQ ID NO: 3901 - DNA, 1036 bp, Homo sapiens
taatgggattttgcaaaaaggctctgaaagcaacatcttacatagtagaacttagggtatttataaattcactgatttatataatgcttttttaaaaactttgagccactatgaaaccatacatctgatacatctactattctaaatacatctaaatacattctaaatatttagaaattatttaaaaatgcggtagtacctgaaggaaaagataaatatttttaaaaatataactttatcctccttaaaaataagcctgcagaaaacttaaaaataattctcttttgatttcatgttgggtgaatttagctcctgaaaaggcagctttgggggtggtggtagaagcagggagggaaggagaccatgtaccctgaaaagagagtgcagactaaaaatcatgaacttgaatcccattatgtgcaatttgctcagcttcaaattagtcatgtctcagaaatataatggttgaaaaagcaggtcactgttctcagctcttctaaaactgctaagagtatgaagatcagaactggattaatagaaaattgttgcattgttttcagcatacccataaatgagactattccaaacataaactgtaagtatcaacaaatcaccaattattatttctttagaaaagatcattgtttcttccaaaaggtaacttatgtgagtggcctttttaaatttttaatgttgaggatgtaatgtatactgtataagatataacatacacacatatgtaatcaattttctcaaattgtgcatggattatctacttctttcaaggatgtagcccacacgattgtgctagtattgtttaagtggaggcaactggtctttactgtgacccatttatgtgagcttttgtttctgctgctgttgtttatttggaagttgcagaattttaagaaattaaattacagttatgcagagtatatgtgtttactctccaatttattagattttaagcttgttgcatttcttttaatatatcttaatgatgcaatagttgtaatccttcagtatttgggtgtct

SEQ ID NO: 3902 - DNA, 1026 bp, Homo sapiens
tttgtttattacatacaatgtctcagacttttgtattcatgtgttttcattaggtttctgatttataactcggaaattcctgcattcatctttagatcttagcagtctccatctgtcttctgattgctcagtaatctgatctgtcaggcagcaccttatgcccaagcaaagaatcggaatctctttcttttctccaacttaatggatcttcatgtgtcccatccacacaggcttatagtctaccttttactggatagaaatgctactaagcattactctactcattcattaaagtgaaaattaaatttcaacatcaaccataaactggaaggaattacacaaattataaattactcaaatattggttgaaatttaacttttggaatcagcattggataatttctaaagtaattctttatgcatttttttaagtgactctcaggcagcagtgccatctgcaggcctcctctgatgcagctctttttagtttatggaaatttcttcttaaaatggatttggctctactaaatatagctttataatgtcaaatacaaagtgatgttattcacaaattttaaaaaggtgaatttacaggtacagatctctgatagaaatcttttaaccactaagctaatatcgactgtctatattaataatcaaaatatcaaacataatgcacagcatctggaatatatatggaatgagcacggattttggggatcacacagaactgcgttcttgggactcattacttaccagctgtgtgaaacctttaaaatgttacttaaactttctgagatgcaggctttttatttaaaatatggggataatattttcttcattaaatgtttgagagttctcaaatgacatgtataaagtgcctagtacagaatgtgcatacagtatgccttcaattgataatagtgcccttttccttgaaattaaaacagaaatatctctagaccatttattgcttttgtgcccagaaaatttaaaagttgtgaacatatcattgcccttttagag

SEQ ID NO: 3903 - DNA, 1052 bp, Homo sapiens
acaatgctttaataacaaactctgccagtcaggtttgaatcctactgtgctattaactagctagtaaactcagacaagttacttaacttctctaagccccagttttgttatctataaaatgaatattataatagtacctctttttaggattgcgaggattaagcaggataatgcatgtaaagtgttagcacagtgtctcacatagaataagcactctataaatattttactagaatcacctaggattatagcactagaagagatcttagcaaaaatgtggtcctttctgttgctttggacagacatgaaccaaaacaaaattacggacaattgatgagccttattaactatcttttcattatgagacaaaggttctgattatgcctactggttgaaattttttaatctagtcaagaaggaaaatttgatgaggaaggaaggaatggatatcttcagaagggcttcgcctaagctggaacatggatagattccattctaacataaagatctttaagttcaaatatagatgagttgactggtagatttggtggtagttgctttctcgggatataagaagcaaaatcaactgctacaagtaaagaggggatggggaaggtgttgcacatttaaagagagaaagtgtgaaaaagcctaattgtgggaatgcacaggtttcaccagatcagatgatgtctggttattctgtaaattatagttcttatcccagaaattactgcctccaccatccctaatatcttctaattggtatcatataatgacccactcttcttatgttatccaaacagttatgtggcatttagtaatggaatgtacatggaatttcccactgacttacctttctgtccttgggaagcttaaactctgaatcttctcatctgtaaaatgtgaattaaagtatctacctaactgagttgtgattgtagtgaaagaaaggcaatatatttaaatcttgaatttagcaagcccacgcttgatttttatgtcctttcctcttgccttgtattgagtttaagatctctactgattaaaac

SEQ ID NO: 3904 - DNA, 1053 bp, Homo sapiens
ctgagatattagctaatgaattagttgtttggggttacttctttgtttctaagtataagaatgtgaagaatatttgaaaactcaatgaaataattctcagctgccaaatgttgcactcttttatatattctttttccacttttgatctatttatatatatgtatgtgtttttaaaatatgtgtatattttatcagatttggttttgccttaaatattatccccaattgcttcagtcattcatttgttcagtatatatattttgaattctagttttcataatctattagaagatggggatataaaagaagtataaggcaatcatatattcattcaaaagatatttatttagcaactgctatgtgcctttcgttgttccagatatgcagagacaatgataaataaaacatataatctcttccataaggtatttattttttaatcaagggagatacacctatcagatgtttaaaataacaacactacccactgaaatcagggcatatagaatcattcagctaaagagtgacttctatgatgatggaacaggtctctaagctagtggttttcaaactggtacacattagactcacccgaggaattttaaaacagcctatatgcccagggcctaacttacactaattaaatctgaattttggggatgttgtatagggattagtattttttttaatctaggtgattccaatattcagccaactgtgagaatcaatggcctaaatgctttttataaacatttttataagtgtcaagataatggcacattgactttattttttcattggaagaaaatgcctgccaagtataaatgactctcatcttaaaacaaggttcttcaggtttctgcttgattgacttggtacaaacttgaagcaagttgccttctaatttttactccaagattgtttcatatctattccttaagtgtaaagaaatatataatgcatggtttgtaataaaatcttaatgtttaatgactgttctcatttctcaatgtaatttcatactgtttctctataaaatgatagtattccatt

SEQ ID NO: 3905 - DNA, 1053 bp, Homo sapiens
taacacatccttttactaattactagtttaaatataattatgatgtactcaatgatagaatcattaaaagtaaattattctttaatatttaaagccagaactgaaacctcctaacctacattacattctaaatatgtatatataaaattgtttgtaacccatagaaagaataataaaaatgatagtgagacataattgaaaacaacagttatataatttaagtgtgttttggtttaaattgatttgagggtggtagggacaactgcaaaattaaaaactccattaccatattacattatttctttgggagatactttatagctccacaatggactgatagtaatagaattattgttgctttcaatatttaaaaaatttgagcataacagattaaaccaaaataatccttttttcaggaaaatggcgagaaaataaagcatgaaataatcaatgaagatcaagaaaatgcaattgataatagagaactaagccaggaagatgttgaagaagtttggagatatgttattctgatctagtaagataaaattaagctttaatgaagttcctgatgtgttctgattattaatttgacattttcatcaaaatatgcaaatgaatcagaacagattaattctgaaagcttagaatgcaacctgtatatgtgtttttaaataaatactcttgttatagctctagtagagtagaaattgaatgtttcggtatgattcaccttttctttgaatcaacattatggccatagtttgggatatatattggaatccttttaagattattgagataaatgtatttgaaaggggatactaaatataagtcttagaaatttggttaaaaaaataaaatattctgatggctttgtttactagtcatattcatatgtataatctatttatgaagaaaaaaagttaatattctttcttctatttagcctgcaaaccattttaggtgtgccatccctagaagaagtcataaatccaaaacaagtaattccccaatatataatgtacaacatggccaatacaagtaaacgtggag

SEQ ID NO: 3906 - DNA, 1033 bp, Homo sapiens
caagaactatctgcttttttttttgtagccacccactccatccttaggggttatactctacaggcctggctaacacatttagtagttttcctaaggttcgttcttccaacccccagcctgttgcctcagaaaatgatggttcacttagttcctctcattttaagagtaatacaggataataaaatcaaacgttaaaaaaatctaaaaaatgaaatggagaagtttaaaagatggcaaattcttttcaattcttctactattgaaaagaacttgtaatttctcactccattctgaggtggttactctcttgggaattaccctcaacacatactgctcccataaaaatacattcaacatacatatattactgtacttaccatactattttgtaatttttgtttattttgtccactagatcgagttcatcttctgtcttcgtctcttacttataatagtacctaccagtttatgtgtgatggataatgttatagaatgaaggaacaaataaataaccaaatggactctagttttttactcttatttctaagagacaggatcaacagcttttccaaccccttctaaaccttctggagaggcagagtgatcagtgcctatttgcttcaaagggataagttgaagctctgaagacttcgttctaggtgacactcgttcaactaaatcacccatcatgccctccaaactcaccaaatgaatacatttgaaaatttctttctttctttctttttttttttttttgagagggagccttgctctgtcgcccaggctggagtgcagtggcgcgatcttgcactgcaagctccgcctcccggcttcacaccattctcctgcctcagcctccctagtagctgggactacaggcgtccgccaccggccaaaaatttcttaaaaaggtatctccatggctgggcgtggtggctcacgcctgtaatcccagcactttgggaggccaaggcaggcggatcacgagatcaggagatcgagatcatcctggctaacacggtgaaaccccgtc

SEQ ID NO: 3907 - DNA, 1035 bp, Homo sapiens
tttcaatataatgctggatgcctgaatgtctttttctcctcactaatcaatacccagaactctccctgaaacacacactcagtactacatatatttgaattcttctggttcttgagtatttttttttttttttttacattttaaggagtatggacatctccaatagtactttgtagtctatgaatattaacatttgattttacaatgctatcattgatgttctctctgtagatatacctgtgtttcccacaatcacagccactgtgacttttcaggagtttcgatacgatgaatttgatggctccatctttactatacctgatgactacaaggaagacccaagccgttttcctgatctttaactgacgtggaaaaggatgccgtctaaccaaggaaagaaaatacagagaccctagaagtggatccaaatagaagggacaaatgctttcagtgaagaaaagggaattacacattgaatcgacacatcagtaatacgatacagtgaaatgggcctctaataagaatttcagcgagttttctgatgtgccattttttgtctttttaaaaatatacatattataaatgtaatagtttgacacattaatgaccctaagacctgcgtatgtgaagcagctatgagtgctgtgatttgtttttaaaaatttttacacttcttgttgaaatatatatgcatataaatatatctatatctatatctatatctaaaacactcctggaccattaacgtaaattaaatgtcttaagagatatggagcccttttaaacttgtcatctttatgcaaggtgacatttataaatattccttcgagctttgttttcataaaatgtaaactatgtaacattatgtatagttcagtaatttgaatgtttgttcaatataatgaactagaaggaatgcaattttctgtagatgaatgaaccaaatggtaaccattaaacaattgcatttatatgttgcaatacatttcagaaggagcgttcactctgcagggaataaggtacctcctttagcac

SEQ ID NO: 3908 - DNA, 1054 bp, Homo sapiens
ggttcaagcgattctcccgcctcagccttctgagtagctgggattataggcacccgccaccacacccagctaatttttgtatttttgttagagatggggtttcaccatgttggccaggctggtctcaaactcctgacctcaagtgatccacctgtctcagcctcccaaagtgctgggattacaggcgtgagccaccacgcccagcctaattttcacttcatgaaatactattcttttttttccctaaacatttaaaaatgtaaaatactttcttagcttatgggccctaccaaaataggcctggcaataggacttagtgtacagacccctggattaggatagcatctgcatatagtaggtacaaaggaataattttttcccccagaaataactggaaactctataattgttatgttgattattgtgtttaaatctaattaaggtattttgttttcctttttacataagaacataactttctgcaataaaatactagcttatatcagttagacttaatttactctgtgcccttaccctaggtagacacttgaattagctttcatatactcatttcagagtttttttaaaaatgatttattattattattttaaatagagacagggtctccctatgttgcccatgctggttttgaactcctgggctcaagtgatcctcctgccttgtcctcccaaaatattgggattataggtgtgagccaccacacccaacctcatttcagagttttaagggaatttcagagtttctttattttacatatgaaatccctgaggctcatgagtaaaatgatttataggaatctgaatccaggctttatgatttgtactcatgtcagtaactcatatgaggaataaaactaaacatttaatttaatgtgtatttgttcattttatttattttactctttctgattcttatgtaatcattaacttgctcattttaattgctagattttacttaaacaatttcagctagaaatatatttcatttggaagattaggctgtggtggtatgatatttttccatttctgatga

SEQ ID NO: 3909 - DNA, 1030 bp, Homo sapiens
tctagatgaaaaatgacttttttttttttttttgaaaaatgacttttaaataagtgattttcaaaatgtcactctagttgccctttgcaattcaaaagcactaggaacccagtgtctacttggagaaatcagtgataagatcttaggcagaaatggttagaaaactaatgcaattcagagctgtgtgccatagccataagggatctttgtgttcgcatttctgcagaagtttaaaactccactgccattttctatggtgagggaaatatttcgagttttagactcccttctaggtactgttaagagacccatgacaaaccagaatagagaacaggagttaaacagttgagaatttcaaactatctctgtattcacatctatttttaagttctaaacaaacccaaatcaaaccccacaatacatttatttttatgcaaaggaaatattttcattatatgagaagaaaaaagtctgcagtcctttttttgcaggcatttctctgatgtagaaccacatttttaacaaggaataatattttgcttgtatacttaaagttatggggtatttgtttaactatttctcttttgtttctctgtccttcttttgaaccaaccctgtaaaacttcctcctgtgtatgtttactctttcaccgtttctttttctacatttaggataaaaaacacaactgggataaattataaaaatttggaaattaggggggaggggggagggatagcattgggagatatacctaatgctagatgacgagttagtgggtgcagcgcaccagcatggcacatgtatacatatgtaactaacctgcacattgtgcacatgtaccctaaaacttaaagtataataataattttaaaaaaaaactaaaaaatcaaaaaaaaattttggaaattattgttaacacaattacatgttttcagaatcagccagagctttaagtgctgattatgaatggtcttttctctgattggcttcttctctcattttgctcaaagactaaatttgaccctcttt

SEQ ID NO: 3910 - DNA, 1050 bp, Homo sapiens
acacacagacagatacacacacacttatgtacacatgtacctctgatatggtcttaatttcaagaattttgagcttcacatttctttcatttctttgtacgtggtagtttattatagcctgttatgcagctttatttgtctgtagaataactcctatctccccaaaatagcagataataaataataaaaaactatcagaatatggcttgtggcatgtatatgagctatagatagcaacataggaatgtagaaatctatagataaatagtatgattcccattttacagattttgaaactcaggtacattgagtctaaataaccaaggcacatatttgggattcaaactcaaatttaactgtctcacttcaaagatgtctctttctattatacacattactttactgcaatttttccaaattatatttacaaaattagataaggttcaggtctatctggttacccattcaggagggtttagttaccatagggttattgtttactcatctataatatgcagtctgtacctgagtggcatcatattgactctgctacccttgtttgtgggtgggatgggagtatagtaaactatacagaaattacaagtaaatagtagatatttgaagttgctcaaaattgccttttaaattttatttatttttaaatggaaaaatactatttgaaaggaaattattataatttgataacagaatgtcacattactcttttaatttaaaagtttgtaaatatctcaaaatttaggtagttattttttaccttttgtttttaaaaatacagtgcctttactttcccgaattctgccttccgatgcatgtaaaatatacaaacaaggtatcaatatcaggtaaggtgatttgatttttttctcagtaaaagaaagttgagatttagaggaagatttttttccctgtaatcataacttacatgtgttttatgacgttaaaatgctgtaacagagtcacaatattttatctcattcgagacataatagataaaaaaccaaagacatagaacctttttttattttttta

SEQ ID NO: 3911 - DNA, 1120 bp, Homo sapiens
aaatgaggtaagcttgacttaaagacatagtgtttttagagaaggaagggatagatcagaaagtaattaaaagaaaggtttagccgggcgtggtggctcatgcctgcaatcccagaactttgggaggctgaggcaggtggatcatgatgtcaagagatcgagaccatcctggccaacatggtgaaaccctgtttctactaaaaatacaaaaattagctgggcatggtggcgcacacctgtagtcccagctactctggagactgaggcaggagaatagcttgaacccaagaggcagaggttgcagtgagccaagattgcgccgctgcattccagcctggcgacagagcgagactccgtctcaaaaaaaaaaaaaaaaaaaaaacaaagattgatttaacagaatggattatctcttggatatgggtaatgataaaatgattcagagtaactctaaggtctctattatggattgatggtgatttcattacttaattgatatatagactataggagcaagagcagtatggtctttaatttgtgttagatttgttgggtttgaatcaactgtagtacatcaggtagaattgtccaggtgggaagcaggaaatagattggagcttagaaggaagaggagtgcaaaaggtaacagatttaagtaatacttggagcagtagggcatagttccaaaagctttaggtcaaactgtaaacttcagtcggagaaggaggaaggagaaagtaaaattagttgtggtttatggacttttgcatttgagtctttgtatgaattcttttatcacctaaatcctctaaagctaattttaatcttcattgttaatcagtattaataaaattcttacaatatgggaatacaaatactgatccctaaaaaggatactggtaattggtaattttgtgtaattgctttctgaatgtgcatccataagaagtttgagtttatggtatttttcaatatgaagtcatatagaaaagggaatctcttcgcatatgttattatactgtgctatatacagtggttgccattacctttttaatgatgtttggtcgttatttattgaatgccttcagctttttaaatgatgtttggtcattatttactg

SEQ ID NO: 3912 - DNA, 1032 bp, Homo sapiens
cacaactctcctgagttttcaaaactttgttttttcttataagaaaatgatgacattcatcgtagaaaattaggaattatagggaaaagaaaagaaaataatatcactcaaagataaccactgttgggtcaggtgtggtggggcatgcctataatcccagcactttgggaggccgagacaggtgggtcgcttgagcctgggagttcaagaccagcctaagcagcatggcaaaaacctgtctctacaaaaaaatacaaaaattagccaggcatggtgatgtgcgtatgtggccccagctacttgggagctgagatgggaggatccacttgagcctgggaggctgaggctgtggtgagctgacattgtgccactgcactccagcctggagcctgggacaaagtgagaccctgtctcaagaaaaaaaaaaagacaaccactgttaatattttgttatattttagtttcgtcttctggtcatattattctctacataaaattctttaaaacctcctgttctgaggacaaagaccaaaattgctaactttgtttataaggtccagtatgatactatcacttccttgtctccttcctcatcttgttctttccatctggctttctatgtgtcagctctgctggctttttggtttctcatactcctcatacttatatatccccctctttttgtcacagctccttaagattcttcagatctcagctcaagtacaaggaagttttctctgctcatatattgtctcagaactctgcccattccctttaggcagagtgtatgaggccaggaattgtctatttgtgttctgaatacctactagatgtgtcagaaacatagtcaggatgtgccattaactttgatattgaggaagtcatcctacttaagggagagagaccagtgaatattctgtggcattctgaagtatttacaaagtcctgggggaaacagatgagtggaaaagttattcaggttcttagcaaggtgtttggttattaaagctgtctcaaagggttttagaagtt

SEQ ID NO: 3913 - DNA, 1038 bp, Homo sapiens
gaaattagaagaacaattttaagttgcttagtttcccaatttgagtttattttacccaaataaaatagaagtaataaaagagcaggaatgattaaattagaaaaatagagcaacaaagccaacactttgttctttgaaaagatgaataaaattaatagaccaggcaccgtgactcatgcctataatcccaatattttggaagggcaaggtgggaggattgcttgagtccaggagtttgagaccagcttgggcagcatagtgagacatctctactgaaaatttaaaaaaaattagttgggtgtggtggtgtgtgcctgtaatcccagctacttgggaggctgagatgggaggatcacttgagcctggaaggttgaggctgcagtgagccatgattttgccactatactccagcctgggtgacagagcaagaccctgtttcaaaataataataataataataataataataataataataataataataataataaacgtactgatcaagagaaaaagaaggcacaaataacagatattaggaatcagaagtgttacatcagtataaattcaaatgtcatcgtatatcattagcggatattttgaacaaattttatgccaataaatgaaaagagataaacaatgctagaaaaatttagtttgtcaaaatgcacataaaaaggaattagaaggccgagcgcggtggctcactcctctaatcctagcattttgggaggccaaggtgggtggatcacttgaggccaggaatttgagaccagcctgggcaacatggtgaagccttatctctactaaaaatccaaaaattagccgggtatgttggtgggcacctgtaatcccagctacttgggaggctgaggcacgagaattgcttgaaacccgggaggcggaggttacagtgagccgagatcgtgccactgcactccagcctgggtgacaagagggagactctgtctcaaaaaaaaaaaaaaaaaaatggaatgatagctcaaagtaaatctttggttttggcatagttggtgt

SEQ ID NO: 3914 - DNA, 1049 bp, Homo sapiens
tttgcaagttactgacttaaattgaatagaagaaaggatagagcttttacttttgtggtaaaatattggttgagtaggaattttttttttttttgagtcatcaattattttgtgaagtattgtattctgggtccaaacatatttcttgaggtatgtttaagtacagtaacagctataaaatcatgtatatgttgtattcaaatatgccaaatgattgtgactcatcacttaataacagctgttttttgggtggggaagaaatattaaaagtacacaaaattatggaactctatctttggttatataccacttttttctttagtgtaaaattaaaagattgaatctaagcctttttccatagtcagagtgtaaggatttttctgaatcaatttttgccattgatagtttggcaaaggatcatgatgacaagacattttttataattgataataattttacttattgagaattgagaatatgaaacgtatagaagattttcttggtttgactgtacttctgattggttagacttgtaattttgttttttcctttgagttaaatgtctttaagaagctaagcagcttctcttggatgctagtcagaagcttttaggtgccaacgtgatgaaagtcctgaacatatgaattgctcaagccagcctttcctagatgtgaaaaatttctgatttattctgagaaatttggcagtttctcctgcctttaattacattgcctggcaggtgacaagccatcttctctatatatggttaattttcatttttccttgttaattttcatatttacttgtaatattttcattgtaatatgttcttgaagttatttcacacaatgttagagatttcgaatttaagttaaaattcagttgagaatattcctgctgatgcaggtacctcagggaagtgacagtgaaatgattaatgtgtaaaatctctgcctcatggctggcagatttctttagccagtgattggaaaaaatctcaatttcagaaagattaaaaaggtgcaggctgggcatggtggctcaccacg

SEQ ID NO: 3915 - DNA, 1032 bp, Homo sapiens
ggccaccgctctaatcgccttgtgccgccgcagcgccagctccgtcgccagcggtgagcctcccgattcccccccttgcccctggcggcggcgatgaccggggagaagatccgctcactgcggagggaccacaagcccagcaaagaagaaggggacctgctggagcccggggatgaggaagcggcggctgccctcggcggtacctttaccagaagcaggattggcaagggcggcaaagcttgtcataagatcttcagtaaccatcaccaccggctacagctgaaggcagctccggcctcctccaatccccccggcgccccggctctgccgctgcacaattcctccgtgactgccaactcccagtccccggcccttctggccggcaccaaccccgttgctgtcgtcgcggatggaggcagttgccccgcacactacccggtgcacgagtgcgtcttcaagggggatgtgaggagactctcctctctcatccgcacgcacaatatcgggcagaaagataatcacggtgaggagtgctagcccctctccacctctctccttccccgagcctagggtgtgcctccccaggcttctggaatcctaggccccctccagcagactcttctttttgcccatcatccgggccgttcggtaaatcatgatcgactcagtaatagcgtgccagtggtcaaggggttggttcttgtgggtgcaaaggaatgtatcctccttgcccacttcaaagtttgtcgtgagaagctgttttgtttgagacaggccttcgatttgctgattctggactgtcagaaattttaggttgcctcccacccaacatggttttctccctttgtttatggagctatatatctttatttctctctcttccccctaccttggcattttaaattttgaacgcataaattgccctcctcccttcattgctcacatacagatcccatcttgactgcaactggttgtgattttgcctgccaccaggttgtttcttttttgtctgctttcagtaaacttagaatg

SEQ ID NO: 3916 - DNA, 1033 bp, Homo sapiens
aacatgctgtgtgatcctctgcaaaaatattaacctaagggacttcactatggattggtaaattgagttccctataaatgtatgatcctgaagtaagtgcattggggtgcatcattggcaaaataagcaacaaatcaaaaagtaatttacctaacttggaggagcagatgatagagttcaaaatgctttgttaggttaaaatactacgaacaggcatatcatgtactaggtagaaccgaattttataagtatagttaaaaagctttcaaacaagaaaatataaaatacattattgcttgataactagaccagtagatttttactgataaattgtttggacatttattttggcttatatacataacactaactgtaaatgagctatttctgtgaaaacacctaaaagtcaaaactaaaatggaagtgttcagtttggatgaagcaaatccagttaattatggtctatcctcgtattaactcttagtgacactgttacctctaatctagctgttgactgtgaacctgtcaaaaatgttgctttttcagcaattatttccatgtatcaaaattctgatcagggaaaacaagttatctgtattcttataatttgaataatgtattagagcctaagaattttaatgtggtatcagcaactgtgacacaagattgtgttgccctatatcacactcacaattatgtctcctgttccttattattgattccttagaatcacaaaaagggaaaggttaaggagaatgtagttaattctaccagaagaaactacctcagtattctcaggctgcacccatagtacctgtggcactaaaatcttaggatagaagagtgctaagaaggaagaaagaataataaaaataatgttttgtgttttttcctcatattagtgataatgaaaatgtgtttaaattcaggcctcccataaagtattgcgtatcataaagtctaaggcaggtacctgaccgtgaaaaactacattttgaagcactgatgactgataagagagacacaaaatgtt

SEQ ID NO: 3917 - DNA, 1053 bp, Homo sapiens
tatatatatatgcatgtgtgtgtatatattctcagatgcctatttcccacttactctttctagagcaccagatccatgtatctagctgcctcctgtgtatctccctttattttttttctttttgtcacgatgagtcttgcggtgttgcacaggctggtctcgaattcctggactcaagcagtcttcctgtcttggcctcccaaagtgctaggattataggtgtgagccactacgcctggcctgtatctcccttcacatgtcagacagccaattttactgtatttaaattcttcctaaatcctctattcaccaaacctgtatctcatgttgtatttcatattgataaacatcattatcagtacttgataatcctcttagatttcctttttgtgaacactaccactgctttgatttgtgggctaggatattgtagtttcttcctaaatggtcatttggcatttagtaggatttcagtaatatttgctaaatgaatttttttcaccaagcattgatcacttcatcactgatgctagaatgctcttaactaacgagcatttcatttcatgttatttctttgtttaaaccctttcagtgccttttcatggctttcagaattcaactacaatccttatgcatatagtaaaaagttcaggggttttttccaggactcacactacccccacctcccaattctaacctacttaggtgcacagaacctatacactagctacgttaactatgctgaactactaataggctttcatcttagtacaagtttcttatacctgggataccctacacataccccactaccatttcttttttcatttagctttcatgactcaattcagaacactaggatgccatccctgatgcctcttccctttcaatgggaattgggtgaaactcctaaaagtttctccttccccagtatccctctcccttagcatagtgtttgtcattatagcaagcactcaaatgtttgatgagggtcaatatctgttacctttctcaaagaggttttgatcagttgtattttttcctcattactga

SEQ ID NO: 3918 - DNA, 1636 bp, Homo sapiens
agtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctgatctaatgttcatttttaaactaattacagttttctgttacctttgatttgttaattttttacactctttatattcacctaccttttatatatgagtgcttggtattttaaattccaaagccattatcactgcaacctcagaatttttaatttaacctttttttcgttttaaatagagagctcctaaattagttgcacacttcttgccagaacattacatccctcattccatgtggtaaaataccatatcgtagtgtgcttcctgaattactcttaaactgtcaccttatataaagcac

SEQ ID NO: 3919 - DNA, 5308 bp, Homo sapiens
acagggtattattataagggacaaattatagttgtaaattagattaatgaattttgtgagttttaaaatttgtacgaaccatgtctcccttgtgtcatattttccaataatataattacctaacaatgacagaattatacattttccctttaattctctaagcattgagtaaacagaaaaatatagggatgaaatacacacatgccaacattcaaaactttgtactaactagaaacaaaaatagaaggggatttataaaggaaaatgatggagacattttagagaaattaagtataaatcgcaacattctgttttcttggatgtattctgggtagcttctagttacttgtaaacaaagtattcattgtttttgtaataaagtgataatgttttgttttatagttgagtggctttagggtaatttaatcacctggaaagtgatatttttttaattaccttttgttactaaatcttatctaatttaaaatactatgttttgaaagtatatatcttgtatagttatctttttatatgaaaatgaactctaatacatatctttctttcagtgttcatatcacaaagctcaattaaatggtcctggaaaaaaaaaatcgttccatgttgttccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtctcaaaaaaaaaaaaaattaatagtagttcaaataaaattacatatgtaaataaaaagaaaaattttcttcattattaaaaggaagaaaaataaccctgcctcaaaacaggtcctgttttgcacggcagttgtttcaatattttcagaaacaaatttgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaataagaaatagataacaaggccaggctcagtggctcacgcctgtaatcccaataccttgggaggccaaggtgggcgggctgcttgagcccaggagttcaagaccagcctgggcaatatagtgagacctcgtctactaaaaataaaaattaaaacaaccagccaggcatggtggtgtgttcttataggctgaggtggaaggatcactggagccctggagattaagggtgcagtgagccatgcttatgctactgcaccacagcctggggaacagagcaagatcctgtctcaaaaaaaaaaaaaaaaatagaagtagagagcaaattattttttattgttaccattatttagtaacaatatttaagcgctttataggtaaaaatccttaagttctggtattccctttgggaaccattataattaaggtttacagaacacccatcatattcttcccaaacattttttcattgcttgtaactttccaaagaattctccttttgggctttctggttttattttaagcccaaaggtgaattttttgggaagtttgagctaaattccttcaaccaaaatatacaagtgaagaaaaaaaatttgtatttaaacatttgcacatttacttctacctgaagcatgtgaatgtcaacacttcatatttcataagtagtgggttttcataaaaatagtattgtaaatataaatcatcttaaagttagtttttatttcttcttgaatatttagcagttaagtacagttactagtcttttgttgctgtgccatatacctggtttttccataacagtttaatgagttgaataattccacatggaattatgtttattttcctcaggaagtggtatataagatacatattttaatcctcaaatggaaggatgtagttcctaaacgtaaagtcctgttaatgcagttatctgctgattttataatactataatatttgtgtatactttgaaaagccttaaaaaaagtttaaattctattttgatatagtaagcagggttttaattacacatgatagaattttaaagagacaaaattaaaatgtttaagtagaatgttttcatggttgatccagaagtcttctgttgaataagcagtaagtattcttccttataaaattttcatagttgttataaatcctgtttatttttggagctatctgataactaaataatcttccttatttcttcttttaatgaaatgtttgatttgtttctcaatcaatgaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaaggtttgggtttctgtagaaataagaatgggtgttcttaagtgtgtttaatagataaagtaaactttcctagtcaagggttagatttttattatctcttgtgttccgactttctacttttcaactttgaacttcaaaaaaacattactttgcttatcctttgtactttgatcaggttgtttagaattgtagatcaaaccattctttgatcattttattgtttaaatttttagttccatttataatttttatagccaactctcggttatttctgtcttttgagattgcaattcagaagctgtatgtcgaagtaatttatgagttgacttttatacttaggcttctttaaatactaatagtcaagaattctagagcatctaataaaaaattaactttcagatcattgggaatctgtcctcatttaaatatgtgtaaatgcatttccacagcaaattgcttcatgccctttgtctataaggaaattattccttgtagctaatacatttttcattttgcagtccaaatcttttttgagaaaggcctatattaggttactttatctgtactgacacttttaatattggaagaatgcaactgtcatctgtcagccttttctgcaacaggctaattactcagtttcattaattttctctttgttcccaattatatagtcattttaatggctttatttgtagtctttgcaaatttttcatattttattagcttgtgaaaataaagattatgtaaagtctattaattgctgggttcagtggtaggattatctcatgattcctacttgtacagaatgattagttttgcttcttcacattttggagtttagatgttaagatttcacacagtcttgtttctctgcatttgtttctttgtaaaaaaaattactctgtttttgagtggaattcattctgttgctttcttaccacttctgcaaatttttatcttagccacatataatccccctagtttgttgtcatctaaacttaatgaacatgttctctattccataagccaggtgattggtgaaaacactaaacaaccctgagcccagggccaacccctacggaacaccactactttacccaggttgatattgacttattcatactagctgcatgaatataaccctatagcaaattgtacaatcatcttgtgtgacctagatttccaaaacttatttatgagtatattttctcatacacagaagccttgctgtatcttttttacataatagacttcttacactttctacaccgtgtcacagggattggtttagtcacacttccattaccaagtttatatgcttttgttgtacattttctgtaattttacacatttttgcaaggcttttctttgatatcttaaataattgagaggtggctatattttgaaatgagattcttttgaaattgtagagaattttttattgtatttatatgataactgggctcatatccaaagtctaaacatcagataattttatgtgtgtaagttcctatctcaatttttaatttttttgctagcatcatggtactgaattttgtatactttcacagtcttaagaatgaatgctgagatttagctctagcttactagaatgcctactctctccattatgtcttacagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttgga

SEQ ID NO: 3920 - DNA, 1057 bp, Homo sapiens
atgtttacatttctacattttttgttgttatttaccactggaaattcaatactcaaccagaacttgtcacatggtaacttcaataaatacttgattggctagtaatgaacaaatttcttattttctgagtctcctcatctggaacacatggataacctccaaggtcctcagggactcctggaagcctggccttcttcctgcttttcccaagttctctccctgtttgtcaagagaatctctcataggtaaaagaacagaaacagggctcatggtctgtaaatttaccagaaatgattcttcactagagttcatcatactttgtggtttaagatagggctctctgatatggaatgcgtatcccccatcaaggaggttttaaaaggcctctaatacaccgatttcatagaggggttaataaaatgaccttactaaaacagctaaggaagtcaataatccaactgacaataaacaagtcttttctcttgatacacagagtaattgaatagatgggagtaatgctatcattttgtgaatctttgaacttatacattgcatctgttgattgtcttagtttgggctgctataagaagtaccatatactgggtggtttattaacaacagaaatttacttcttatagttttggagactgaaagtctgagattaagatgtcaggttcgggtgagggccctcttccaggttgctaacttctggttgcatcctcacatgtgagaaaaaggctgcgaaaattccctggggtctatcttataaaaaaaaaaacaaaatctcattgatgacagctccaccctcatggcctaattggctccccaaaaccccagttcctaataccctcacgttaggctttagaatttcaacatacaaatttgaggcggaggggggacacaaacatttagtgtatattgcactgatatactttattgtgagctgaacaatacagaaatcaattataagatgaaatctagaatgaataacacagaaaaatgaattctacatatttctattatatataaatcaggcaatagcagagcaaaggcacag

SEQ ID NO: 3921 - DNA, 1038 bp, Homo sapiens
cgtattaagcaattgagaaatctggcacctttgcaaataattctggcacagacttgaaaatgtggatttctggattctttggaccagttaaaaaaaaaatgtagtttatttctaaccaaggacgacaatagttattgccaaattaatgaataaataataaaacatctagataacagaaagaagctcattttatttagaatataatcatacatcaatttttccctaaacaaataaacaaacaaaaccttaacttatggcaattgctatacgtcacacactatgctgagtattttggatttagtgataaatgaacaattcctgccccaaggagctcactctctaatatagtgtaagagattgtaaaaacaactttcaacataatacagatatgcttatgatattttgaatgcatagagcaagaggcaattaattatgtttggctggagctgtgcagggatcatggaaggagatgacatttgaattgttattaaaaagataagtcatttggcagagagaaaaaaagaatgtttagcagtgggattttggacaagtcactaaaactgtttaggttaatgttactatgaaagagtactagaatatacagttttgctgctgtgctgctatagttattaatttacttccaaatctagctacagattttgaaaacatttcttttctgtattatgaaagaaagcactagttaagtattgcaaatagtttgttgtaacaaactttttcctcattatctattatcaaaggagggcagtcaccagggaggatcaaaccatcaaaactggcatatgtaaagttcatggctagcgtccccagcctgctctttgtaagtttgttttcctacttgttggcatctgctgccttctcctgccagaccccaatgtttccttgccttttatgtttgccattattaaaatatgctttcctgaatgatttttttgtttctaaattagtttcttcatgttggatatttctaatgagaaaaaaactaaatgtttctttctaaatatagtaaccaaactttgg

SEQ ID NO: 3922 - DNA, 1038 bp, Homo sapiens
acacacacacgcacacacacacattagttgccatatatatatatatatatatatatatatatatatgctatatatatatatatgctatatatatatatttgcaatatattatatatatttgcaaatatatatttgcaatatatatatatttgcaatatatatatatttgcaatatatatatttgcaatatattatatatatttgctcttttttcttttatatatatgtaaaatatatgtatacatatacttgctctgttttcttttaaatggatctcaattattgcaagataggttttgaacgtccaaacatttatttaaacacaattattgcaagatatgttttgaacgtccaaacgtgtatttaaacattaaatgaaaaaaaaacaaagcagtttttttgtttatttgtttcttttgtttctttgttttttgagacggagtctcgctctgtcgcccaggctggagtgcagtggcacgatctcggctcactgcaagctctggctcccgggttcacgccattctcctgcctcagcctcctgagtagctgggactacaggcatccgccactacgcccggctaatttttcttatttttagtagagacggggtttcaatgtgttagccaggatagtctcgatctcctgacctcgtgatctgcccgcctcagcctcccaaagtgctgggattacaggcgtgaaccaccgcgcccggccagcaaagcagtttttaatgtctgtaagcattttatgggatgagcgtttcttagatatggatgataaaaatgtattaataagaaaaaaataaaaagacagctttccctttctgagaaagaatgtattagcttcctcaatgacggaaattttaaatacctaccagactgacttcagtaatgtcattgaatacttttagccaatttcagaagaaagataaactgtttacagactcgcagtaattcctagataatgagtattctttcattattagccacagcacaatagtaactgtgatactggagaacttaaaaatttgttccttca

SEQ ID NO: 3923 - DNA, 1049 bp, Homo sapiens
ccctttgtcttcggtgtaactcctggctctttaacaaaacgtaagactcttcacagccttgcaaacgcccactctccatctccaccttcaaagcttccatgtacttcatcacttaatgctctgtcatcacttaggatttgatagatccctgcacactttaggctattttattcgtttgcctttgtgcctttgtgtagtgttcttctaggcagctactccgactcattgtttaagattatgcttagacatcacctgttctagaagccttctttaaccactgaatcagaagctgaacttagtgtcattcaccgatgtttccttttcacactattacttctgttacttgaagtgaacatgctgcattctaataatctgtttgagtgcctttttgttcccaaaaatgtcagctttttgagggcaaatattgtggctcattaattcctggcatccctttggtatcttgcttgatctatggcgattacttgtgactgacctcactaaatgttggaaatatttccattaggtggtttaaccttaaaaatctttgaaccctccaagtttcccttgtaatatctaagagtgtttgatctgtacatcagtatttctatgtgaatgctattatataacattgagagattgtcctttcaaatcctaaccttccctttccccaagatattagctcacccactgattttctgaattattctaataccaactgcatcttattcaggcacttgctggtaatgaacttcttagacatgctgagcccactaatatcctttgaattcttatgttctccctaagccctctttctgggtagagtctcagaatgttcatcagcccccacagtgctcaaattgatcttcattgacatgaccaaaatcatgcagagggtactatattagataattgagaaaaaaacaagaacttgaaaggaatatttagtttttaatatgtactaaatttttctcttgttactttattccttaatctgagtcagttattcttatggcatcacctttcaatttcccattgttaattgcactaaa

SEQ ID NO: 3924 - DNA, 1025 bp, Homo sapiens
ttggaaactttgttcattagatctctttataaatcaacttaccaaaaaaagaaaacagaatagaaagatatattgattaccataagcatgacactcaaggacttaacaattattttaagtatattttccagattataatctggaaaattatatattatatatattgccaagacttgaatgctgtttttgcaataaaaatttaaaacataatgtataaatatttaaattagattaactttagaaaattttgaattttattatataattattatttaaaaatttaaatgatagaatgtgctattgatacctaaaatatcatttaaaatcaaaatattatattttattacattctatcttaaatattatattatattttaatataatataatttgtacttatctgtgtgtaattacattactgtaaaccaaaaatgtcaattagaggtaatatatggattccaggatcaacctaatcattgtagtagaatgtgatgttactatttgtgtcaagactccatagacttgtttacaaatggagttgggaaactaattttagtaatggtttctaatactgtaaaattgatgatttagtaacctacatataacggaatgccagctccaacattttttcatccaatttggaatttaattttactgaatgcctgcattgtgacttgtgagagagagaggcatggaacaggatggattaaagctaaataatactcagacccttctttgacatttttaaaaattctggtagtagagatggttattagtaacatagtgatagcagtattcctaggaaaatgaatttttgtcatgattctcttgctctattttccattgctctaattctgacctccctccttaagaagctaaattgtaagaagcaaaactttgtattaaaatgccacagaattagactatttaactttcattttcctcaaagaagtacagctgaatgaaaacatgagcacattaccattcaaaagtccctggtcatcttttggtctatagatgtatcca

SEQ ID NO: 3925 - DNA, 1034 bp, Homo sapiens
tcttaaagcaggtcattgctatttcataattattctgctttcttaaataattctgaatctcatttcccaaagtcattctcttcatagacttcatataggaaatttaggtaggtataattatggattgtaaaagcctgaagaaaccctagagtttatggactcatttaaaagatgacaaaacagacccagagagatagtgacttgattgtaatataaaaaataatcaggtatattaatagtactataactgaggtctttccatttctgatgcagtagtctgtctcatgttctgcctttcctttgcttcatgaattagcataccattcttgatcttgagctttattactttggtctagtctttattttcctgtcaaatctactcttcactctgtgctggccttgttctctgcgtacaggctgtcctctacctggccctctggcttctggctgggctcaccccatggcaagcaccagcgatagttgggactctggaaagaatgagagatctgtgtttgtgttcttatggcttcttgcagctaggctatggttggtccatggctatacttttttctcatctgtgagggatactcctgtcccagcttgttgggttccggtaaccatctcttacccatatcccttacaggcctagggttagtgatgtcttcctgcattgctaattagatttttatagcctccatgtcaaattttgttcttcgtaacaagttatgtaacaaccttctgggtttgcttaggcctgtccacacctttgtaaatagtcttttcattaaatttttaaattgtcacctttgagtatatatctgtttcctgtccaaatcctgactgatacaaggtatattgctctgatttcagcaaaggggctacagtaaaaattatttgtctgtcaatagaagggctttgtagaaagaaatgggttctttttgtcgttacttggttatctctaaatgtaagctgttgaaggttgggttctccgaatgcagacatgaagacaaagtttgaggctcaagatatttatt

SEQ ID NO: 3926 - DNA, 1052 bp, Homo sapiens
ataaatagagtcaaaggtgctttttttctttatgtagtaaaacttttgattttggtcttctgaaggtgatgttttgtcattagtttagcatttcttggttaataaactcaacagagcaccccttcaaaaatatgttagattttccacctgtattgggtgtagactaagataaactggccttgtttttgccttcaagtagcatatgttataaaaatatttatttagaattttaaacagttctttaaggttgatattaattccatattcccttagataaggaaactaaggctcattaaagcttacctatgttgccccagacagcacggtaaagccacactgtgaattcttagtccttctatctcccttctgctgcttgcctgctgcactttgatgacatccatggagtgcacgtatacagccctgtccttaacaccacaacccatggctgaaaatgctaatgtgggggaatgggggaggaggactcagaacttaaaataagcccttcaatgaaatcacccaatgcagggctgtcagaaacctcttcgagaaactagctgccaatctgcctctcaggagcttagagggaaaagttagagctctgcagttagaatttaacaagaaatccacatgaactctgtcactggatgctttggaaattttggagataagattttgcattttaaaaataaaaggcctggggctagatgcttactttgaggaggctgttaaccatttcagagcactgtgtattctggagagtggattgaaagaagtaacctattaaatggcacatagtcccctgaataatgagtggtatcctgaaaatgtgaatttacctttaaaagtgcccaggtaatttcagtcctttttgtctctctgtttctttaggtagatgaatcacgaggtttcacacctagcttcctacacttcaaatagatcaattctaaaggatttcacagatcaaacaatttatgaaaaaacactaggattgtctttatggggcttgagacaatatgacagatataccttgtccaaaactcccactgtttaac

SEQ ID NO: 3927 - DNA, 1074 bp, Homo sapiens
tgtgttgcccaggctgcagtgcagtggctggagtgtagtggcatctctcagctcactggaagctccacctgccgggttgacgccattctcctgcctcagcctcctgagtagctgggactacaggcgcctgccaccatgcccggctaattttttttttttttttttttttttgtattttttagtagagatggggtttcactgttagccaggatggtctcggagatctgatggctttataaagtggagttcctctgcacatgctctcttgtctgccaccatgcaagttgtgcctttgttctcctttgccataattgtgaggtctccccagccacgtgaaactgtgatcccttaaacctctttcctttataaattgtacccagtctcaggtgtttcttcatagccatatgaaaatgaactaatacggtaaataggtaccattagagtggggtactgctgtaaagatacctgcaaatgtggaagcgactttgaaactgggtaacaattggaacagtttggagggctcagaagacaggaagatttgggaaagtttggaacttcctagagacttgttgaatggctttgaccaaaatgctgatagtgatatggacaataaagtccaggctgaggtggtctcagatggaaatgaggaacctgttgggaactgagcaaaggtgacttttgttgtgttttagcaaagagactggtggcattttgcccctgccctagacatctgtggagcattgaacctaagatgatttagggtatctggctgaagaaatttctaagcagtaaagcattcaagaggtgacttgcgcattattaaaatcatttagttttatgtattcacaaagatatggtttggaattggaacttatgtttaaaaggaaagcagagcataaaatttcagaaaatttgcagcctgaagatgcaatagaaaagaaaaacccattttctgaggagaaattcaagccagccgcagaaacttgcctaagtaaggaggagccaaatgttaatcatcaagataatggaatggggaaaatgtctccagggcatgtcagaggcctttgcggcagt

SEQ ID NO: 3928 - DNA, 1023 bp, Homo sapiens
ctaacaccatttaattacaggacttgggttctagctttgcttctgtgtgaccctgaccaagtctcttaacctcttgtgatgttttctcatccataaaatggatggcgattttatttttacttctgcataaaataatagtttaaataacttctctacctgttctgaaaacagttaagtcaatggaggtggaagacttatgctttttagaagaaatccggtattacaggattttaagtattatcctatttgccatcagtatgccacgttattttattctttgtgtaatctcctttgacaggcttcatcgttatgaagcatatgatgatcccgtggataggtgagttcaaaggcaatgagtgcaggttggagcctgatgaatcagaatgctaaaggctcagtgggagataagatcaacagaagcaaagtaggagatagtgtggtcaggccatgccccatcactttcaagcctgataggataatgtagtcagatagtactgggcaaagcagatgagtcttccaaatccagtaggatgagtcatcttcctttattcctttctcccaacttagccaatgccaaaatgtggggggggaaagatacagatcctatttcagagtaattttacttttattattacaacagtttttttatggtaatcatgagatgtgagtgaaagaaatatgtaggaagtaggtagatatcgaaaatggaaaaagcaagcatctcataggctatgtgtgtaggtgtgagagagagagagagagcacccagcttacagaagctaggggcagggtggggcattttcttcttgctctttgtgttctctgagtttaacacaccacttcatgtacagttaaggttcagaaaaatacgcattgcataacaaccaatatttagtattaatgttttgtttaagtcatcttctagaccgaattctttgagaataagagcttgttttgataaccagagttctgtaaatatcgttatattaaagatgattatagaactatagagtatattttttt

SEQ ID NO: 3929 - DNA, 1108 bp, Homo sapiens
aaattgttacataactcatgccttttgtctttaacccaaatttcttattcccactatatagaaaatcaatatgaatttgtttcagaagagtgattatatcttttcatgagtatacctgtatttctagattaaagagattgtgtggctttgttctacagaaggtttgattttgtctcacctttcagtgaggaaagagaaaagaaagacacttcagattttaccctaaggaaatatactgttggcgctccatcatctaatacctttatgaggggcatactgtgggttaggaactctctctctgcagggcttaggaggaaagttgttgccacctgccaccgctggccgcctgaggtttctgatagtcatgtgtaagttttgaatggcagaacaaagcatgaatcagacacacatcttgcctagccatcccctgtgtgcaaatgtgtatgatgtggttaaccatgtaaaaatgcaccccaaaaggagcattgaatcaatttgtattttcttggcttttaccttaaacttgtatataaggattatttatatattgacagaaaggaacatgttgatctgaatatcactcatatatccaagaaaagagtcagaaatgtattgttgtgttatagattgatctaaatacgtattaattatcttcaagtgtagacacctagatttaaactgactctgtggcagattaattaatagcaataagccaatgaatagggaagatttttaatatataatgactaccagcttgttcttggcttacattcttgagattattgtattcaaaagtgtcagttggcttcacattttggcaaagagccttctgcattcttattctccttgaagcataatgcagataatgacaacttatctttctagattagtcttttattattcaacaagacaaaggccacaacaaaggactagtagaatagtgacctctacctgagaatttgttataactatagatgtttgtgctctgcccaagagattctgatatactgtgatttgatgtgagccacgatgtgaattattataaagttctctagttgattctgatacacataaaagttgaaaaattggccatgtgtggtgtctcacg

SEQ ID NO: 3930 - DNA, 1807 bp, Homo sapiens
caaggctgcagtgagctatgatagtgccactgtattccagcctgagtaacagagcaagatcctggctctgagaaaaaaaaaaagatttttttaatattagtacctcacttgaaaagtcctggagaacctagtacctagcagaagcttaatctggctttcaccttccatgccatttctttggcaaaccaacagaaagtagagtcagtaagtaaaagagcagaacttgttagctgcacaactacacatcctgagagattatttctctagcacattgcccttaagagaaacagagaacatttactctctgacaggccattactgaacaatccacttgtataaaatttacagtttgcattttagaataacccacagcaccaacttcacactgggatcaagagagacgataactatagggagatatattcaaagaaaacctcctggaaaaaagtctggccttgttttttgtttgtttgtttctgagcctgttaaaatcaattctcaataaccggacaaagaattcaagagaactttatgtactagttagctcttcctctggttgtaaatggaaatgaaatgtttaatgttttcctagtgcttcagtggtctaaggaaagccatctatctacaaaatatcacatgaacaaacagttcaggtatgggatggaagaaggagcacgagtaaggtcaagcactaaaacatggtggacgcagggctctagaatgctcaaagatctctcctctcatctccaacattaaccatgggagcaataactggaaatcactatgtgaccttccccattcttgtagctgaaaatacttatgaaaatttgtctcaggaaatgtctagaacctactagcttccagtctttggaagttttggctaatatgtggattttaagtttggcagttgattttgaattttgacagtaagaaatgttttccaccatctttattaattgccaactccttgaaagccaggtacatcagcttgattcagtgtattgcatgttgacatgaatcatttcctttcagagacacttgtctgtgataacaaagaacaaggaaacttaaattgtgtttctcttcctcccctagctgttactatgggcaacatcacactttgtaaaatattcttcttaaatgatgccctgagccaaattctgaatgtgtagatttatttatttatttattcctattgtcttggctgccagaaaactggtgatttttacaatgcaaaccatttgtaaacacttcatttttagaaacatggaatctttttattattacaaggtactgagattcatcatctcagagtgggaaaaaaataatagttgtagatgcttattaatgtgatccaggccagacttcttaccagtaccttaagagtaataacaagatagatatgttatatacagcagtaatctctccttatccatgggggttacattccaagacccctggacatgccagaattctctaatagtaccaaacccaattgctgtcaattggaacatgtttccgtttatgtcttccatccacaaatgtaatgccttttccatcctaactaagcacttatcatacactgtggccataacttttgcagtttgagatacaacaaaactagcttaaaattcttttttcttcttcacaatttcacgtataaaaaatttgttttgccgggcatggtggctcacgcctgtaatcccaacactttgggaggccgaggccggcagatcacttgagatcaggagttcgagaccagcctgaccaacatagcaaaaccctgtctctacaaataatacaaaaa

SEQ ID NO: 3931 - DNA, 1082 bp, Homo sapiens
aatttcaagagctgtgaggcaaaagcatcaggtaacctataaaggaaaacctatcatattaacaggagattcctcagcagaaaccctgcaagctagaaaggattggagtcctatctttaggctccttaaacaaaaccagcaaaaccaagtttcataaatgaaaaaaaaagatacaagctttttcagacaaataagtgctgagagaatttctcactaccaagccagcatgacaagaactgctcaaaggagctctaaatcttgaaacgaatcctcaaaatacaccaaaatagcacctccttaaagcataaatctcaacggacctataaaacaataacacaatgaaaaaaatcaaggtatttaggcaacaactatcatgatgaatagaatagtacctcacttttcaatactaacattgaatgtaaatgatgtaaatgctccacttaaaagatttggattggcggaatggacaagaattcacgaacgaactatctgctatcttcaagagactcacctgacagataaggactcacatgaacttaaggtaaaggggtggaaaaagatattccatgaaaatgaacaccaaaatcaagcaagagtagctattcttatatcaaataaaacagacattaaagtgaccacagtttaaaaagacaaagagggatattatataatgataaaagaactagtccaacaggaaaatatcacaattctaaatatgtatgcacctaactctagagctccctaatttataaaactattactactagacctgagaaatgaattagatggcaacataataatagtgggggatttcaaccctccactgacagcacgaaacaggtcatcaagacaaaaagtcaaaaagcaacaatggacttaaactatatcctagaacaaatggactcaacagatatttacagaaaattctacccaacaactgcagaatatatgttctattccacagcacatggaacattctccaagatagaccatacgataggccacaaaacaagtctcaataaatttaagaaaatcaaaattatatctagtactccctcaaaccacagtagaataaaatcaga

SEQ ID NO: 3932 - DNA, 1052 bp, Homo sapiens
cctatatgcctctttctagaaaggatcttaagtgaaatgacttaaaacatctggatgcattagaattattaaaatgaaaatagaaattcaaagtccctaaagaaatttttgactcaagactaatacagtagctgatattgaaattaaatttatcagtgggcttcctacatgtcaatataaaaagaaaaacatagtggattatacagttctttttactggaagaaaatataccaattattcagtatataaggatttttcttagttttaaattacaagaggcatttttcatagagcatcttttatgtgcattcatgggcatctattacatgccccatgtcttctaggcactagagatactgtgatgagcaatatagataaggtggctgtcttcttggaagagggaagaaatagggcagaaaacatctgagaaatgaacataagtaagaggaagagagtaaaacagagtgatgtaacagggcctttgtaggggaggggaagtgttaatttagatttggtgatgaaggaagatctctttatggaggtgacaattgaaatgagacttgaatgataagaggagtaagtcaggcagagtctgaggatataacatgttagatagaggaggcaaaatgaagagtccctaaggcaggaatacacttagtgcagggagcagagaggcccgtgtgagtgcagcaaggtggatgggagcgggacttaggtagtgggtgggtaggagatgctctgcaagctaagcatgtttacagtgagtgcagtggaaaagtcatgtgagggttttagtaacagagtgagctaatctgtttttaaaactcatcctgactgctctgtggagaatttaagtgtccaaaatcagaagcaaggagattcacaggaagcttttgcagttgtataagtgaaggagtcagtcacttcgaagagggtagtgatagtggaaatagagagacttgtatagactcaagatatgctttggtggtagagggagcagcacttactgatgggattggatgtgaaaagcaagagaaaaaatgagtcaagag

SEQ ID NO: 3933 - DNA, 1046 bp, Homo sapiens
aactatttggtattgtggaaagacaaaaaaactaagactcttacttctggcactaactagctttgtgcctgacaccagttattatatttattgctcctgggcctcaattttgttatatttaacatggggtattgcgtagacaatctctcagattcttgacaactctactttgccatactcttatgagtataagccaaagtaaaatcagacactggaatgacagaattacacaggtggtatgtgtatcctgtatgtgtattttttcctaaacaaatctttctaaattggtgcttgtactggggatgcctgtcaggtttagtttattatgctaaatagtgccctcttggtgaagctaatttagcttccaaagtcatggattagcaacttccacaatgagaacatctgatcggatcacatttgcactctaaagcttcatttgagttagcagacatttcatgagttccaactggtatatcaagcactgtgctaaattctgagattcaaaaattaataggacgtactccctgtccttgagttgctaacaaggataattgatggacaaatacagaggcagtaagcaggatgattgcctataatggaaaaataattttattctttactggtattatcccactctaggtatttctgaggatgctagtcacttgaataggaaatattatttaattgaaatatccagataattgccatgctttctgcattagtcaggatacactacattatgctttagtaacaacactcccccaaaatgtcagttgcttaaaacaacagaggtttatttcttgctcatgtaacatacccatctcagggcagcaaaggaactctgctaattttattcactccagccctccagtctccaccatatcaaacattcctccttgccgtactcgagggaagtgagcactctggagaatctcacactgcctgttaaatacactaatgtatgtgactggttcattggccagacctagaaacatggctccatccaaccacaaggaagataagaagcaccatgtgctatagggaaa

SEQ ID NO: 3934 - DNA, 1089 bp, Homo sapiens
aatggagggaaatgtgtgcttttgtgaaatgtctaggaggcaaatagatttacctcagtgatggattagatttaggatgtgtgtagcagaaaccattaaataccccagtatctattattcctttcttccatttagagatagtgccacctacgtcactctgagtttgagctgcacaggtgaccacctagctaacgtcttcttttgtcaagttgtctttcagttacatatgatcgtgaactaaatttgggccaacattcgggccccctcctaaaatacaaagttgcttgccctggactctaagtgccttcccatgggctgggacatggacaccttgctgatgatcatgtttccatctatgcagacttgaacattaggacaagatagacaaagcccagattcttgaatagtcttgtggagcagagcctccccactgcctttgttctactcattttgcattttttatttgtgatagagcattttttggattcctttgttacagcaacttagccaaattgtttcagatggtggagaggactgaactggataaatggtgatgccattcactgagatggaaaacattcataatctttttcagcttttggtcttttatatatttaattgaatattattttatatttaatttgagtagttaataaaaatgttttaaaactttttcattccttgggttgtcacagactcattcttttttacaaaattaagctttgggaattataattttatctaactgtgctatcatttgcttatatttactaaaccattaaggtataatgaaaaacaaaactgacttactgaaacctagatatatttgtttctataactatgaactagcctatcaatctaattcaacaaacaaggtgcaaataaggcaaaaaattaataaagaggaggagagaaaaaagaaaagaaaaaattagggtatttttgtgtgagtttagtttttagttcacctatgagagcctctagaaatcatcactttcaattttaagaagggtttacatgctctacacttaatacagttgattttatttgaaatagaatccagactcagtattcagaataaaccctctt

SEQ ID NO: 3935 - DNA, 1035 bp, Homo sapiens
cattgttgatgggtatctgggttgatttcatgtctttgttgttattaatatgctgcagtgaacagggaagtacatgtgtctttttggtagaatggtttattttcttttggataagtactcaggtaatgagattgctggatcaaaggatagttctgttttaagttattggagaaatctccaaactgctttccacagtggctggactaatttacattcctaccaagagtgtttaaacattccctttctctgtagtctcaccaacatccactgtttttttgactttgtaatagtagccattctgactggtatgagatagtatctcattacggttttgatttggatttctctgatgcttagtgatgttgacaatcttttcatatatttgttggcctcttgtatgtcttattttgagaagtgtttgttcatgtcttttgcctacttttcaatggggttatttgttttttgcttgttaagttagttattgattctgaatattagaattttgttggatgtgtagtttgcaaatattttctctgattctgtaggctgtcctgtttaccttgttgatagtatcttttggtgtgaagaagtgctttagtttaattagttctcacttgttaatttttgcttttgttgcaattgctattgaggatttagtcataaattttatctcaaggccaatgtccagaattgttttgtctgaattttcttctaggattcttatagtttgaggtattatatttaaatatttaatccattttgagttaaattttgtctatggtgatatgtaggagtccagtttcactcttctgcacatggctagccagctatcccagcaccatatattgaatagagagtcctttccgcattgtttatttttgttgacttgctgaagatcatatggctttaggtatgtggctttatttctgagttctctattctgttctattgatccatgtgtctgtttttgtaccatgctgttttggttactacaaccttataatatagtttgaagtttggtaatgtgatgcttct

SEQ ID NO: 3936 - DNA, 1024 bp, Homo sapiens
atgttcgatgtgtatatagccattaattttaatatagtcgcccttactctcaggaacacctgctacctgaacaatccagttttaaaaccaactctccaagaattatttcctacttcttcttcctggttttcagggcattgcttaagcactgctttgtataagattcacgtgcctcctgtagttccaactgcagcaggaggatttcttgagcccaggagtttaaggccagcctgggcaacatagtgagaccctatctaaataatgataataaaagtaatatgtttttaagttacaattaccattatattggttgaacatttgaaagattctagatgctttacagactatgactattggcctgcattacatgccatgaattctaataattgtgtgctgataagatgacattctgggtttcaaaggaaagatattccatttagaattagaaccccagggctcaggtgctaactatgttacttgggcaagtcacataactctgaaagctactgtatttccttctcgggaaagggagggtgataataattaccatacctttcttgcacctcaccaaatgaacaaacatctgcgagtggttgtcaggtgctgggaatagaaggggatcctctacaaaggatcatataaaaagttttggaggatgaaagtgctttatatgttgatgatgttggtggctacatagctatgtacatttgtcaaggctcagaactgaatgtccaaaaaatggataaatttttactgtatgtaaattatacttaaaaacggaactttgtaaatactaaatactaaataaataaaggctattattttttctttccatgggatgtcaatttcgtaagacaggcaatagctttatagtgactattagaggagagatggttcttccttgtgcttggattagagcagacgtccttgtgactcttgaatcttcatctggataaattatctttctctatccttgggccaaaaagaatgaaacttttattaaagtgatttctccggggcacta

SEQ ID NO: 3937 - DNA, 1053 bp, Homo sapiens
cgcccagctaactttttgtatttttagtagagacagggtttcactatgttggccaggctggtctcaaactcctgacctcgtgatccgcccacctcggcctgccaaagtgctgggattacaggcatgagccaccacacccggccagtgtgttctttctatttctagttgtttgaggatttttatcatgaaggatgttgaaatttatcaaatgctttttcagcatcaattgaaatgatcatatgggttttgtccttcattctgttaatatgatatatcacatggattggcttacgtatgttgaaccatccttgcatctcagggataaatcccatttggtcatgacaaatggccttttaaatgtattgttgaatttggtttgctagtattttgttgaagatatttgtgtcaatattcatcagagatattggcatgtagtttcctttttttgatgtctctttttctgatttggatataagagtaatactggcctcgtagaatgagtttggaagtatgctctcatcctctaattttggaatagtttgaggaaaatcgatattagcttttctttgaatgtttgtagaattcagcagtgaagccattgggtgctggtcttttctttactggaagactttataacagcttcaatcttgttacttgttattggtctattcaggttttggattttttcctggttcaatcttggtagtttgcatgtgtctaggagtttgtccatttcttctagattttttaatttattggcatatagttgctcatagtagccactaaggatcttttgaatttcttcagtatcagttgtaatatctcctttttcatttctgattttatttatttgggtcttctctctttttttcttagtctggataaaggtttgtctattttgtttatgttttttaaaaccaactttttgttttattgatcttttgtattgttttcttcatctcaatttcctttatttctgctctgatttttattatttcttttcgtctactaattttggttttggtttgctcttgcctttctagttctttaaga

SEQ ID NO: 3938 - DNA, 1061 bp, Homo sapiens
gcctaggggagctgtaagaagagggccaccatcctccagaccctagaatggtagatacaccaacggcttgcactgtgcacctggaaaagccacaggcactcaatgccagctagtgaaagcagccacagggactgtacactgcagagtcacagaagtggagctgtctgaggctgtaggaacccacctcttgcatcagtgtgtgctggatatgaggcatggagtcaaagaagatcattttagagctttaagatttaatgactgccccactgggtttcagattggcatggggcctgtggcctctttgttttggccaatttctcccatttggaatggaaacatttacccaatgcctgtacccccattgcatcttggaagtaactaacttgtttttgattttacaggcttataggtggaagggacttgccttgtctcagaacttggacttttgagttaatgctggaatgagttaagactttgggggactgttgggaaggcatgattgatattgaaatgtgaaaaggacatgagattttggaggggccagggacagaatgatatggcttggctctgtgtcccctcccaaatctcattttgaattgtaattcccacatgttggaggaggggcctggtgggagataattggatcatgggggtggatttctcccttgctgttctcatgatagtgagtgagttctcatgagagctgatggttttgaagtgtggcacttcccacctcactctccctttatctctcctgccaccatgtaagatgtgccttgcttccccttcgccttctgccatgattgtaattttcctgatgcctccccagccatatggaactgtgattcaattaaacctcttttccttataaattacccagtattaggtagctctttatagcagtatgaaaatggactaacacagaaaatttcttagagatcatctagtccaataccctcgtttaaaatttattttttaaagtaacataattaacattttttgaaatgtagttgaaattaacaaattgtaaacaaatatttaaataaagaataatttcttat

SEQ ID NO: 3939 - DNA, 1058 bp, Homo sapiens
tattaagtatttgatgactgaatgaatgatcctggtgtcaagaccagaacctaatcctaggtctccagaatccctattattgtacattagtcactgcacatttacaataaaatatcaattaaagtatttcctatcttctacccatgtagaaaataatccttcacatgacctaaattcaaccactgtctaatttccatgatatatttgggaagcataacagagctaagtaattaaggcctctctatgaatgttattgaaataatacaatatcaagaacagtaggattcagaacagaaagaaaatgaaagcttttttctattgtaggaacccacctcttgcatcggtgtgtgctggatgtgaggcatggagtcaaagaagatcattttagagctttaagatttaatgactgccccactgggtttcagactggcatggggcctgtggcctctttgttttggccaatttctcccatttggaagggaaacatttatcccaaaataaagtttttttaacagttaaaaagtttctgcttttcaaaaaggctgatcgactctaaaccaatcaaaacttttgactttaagtcaatagttaccttctttaaagataaatcatttcttttgtttgtgcttcttttctctgaattttggaaaattaatagaataagagtaaaacatttgatatctgttcaattcagcttaagatctatttattttcatttaaaaacagaacaaaacaaaaattaattattcaatatcactccctctacacacacagacatatgcccatcctgcatttttttcaaacagaagttatcttggagacttacttcattaacttaggtgtgaaataattttcttgtctatatcaaggacagaatgacaaatattctcagattctcttagcaacaggcatttgatttgctgtcttgaatagagccttgtaaagtttcctttgtaggagaaataccatatttgaaaatgttgtcatattgttgttttagtattttcatattattattttattactaaataagtttatgtaactttagaaatagaaac

SEQ ID NO: 3940 - DNA, 1048 bp, Homo sapiens
gttttattaactttatttttttttaattttacaatttaacatcttcatgtggagctgaaattctaattagtgtgaattttagtgtccttattggagatcaaatacctaagcgtattgaacatataataatatcacctcttgttttttgttaactctttatatgggttagtgtgtaatgaagctgagtaaaggattaatattcctaatttagtaggtacaaattatttattttgcttactattaaaagtgagtacatctactgttaaaatagttggagacctaagttgttattggttgtaaatatccttccttgaatattaaaatctacttattttttgtcagtatctttggcaaatttttttaagttgtcttttgtgttcttgacttgccaatgtactccatttgttatttcattcatgccatcacctaagatatgatggagactcactgtgctaacaaaggcaggccattccatctaaagcttctacctgctaaaacatagataactgtttagtgctgcttctgattttttaaggacttacgcctgaaaatttcctgtcttaaaaacaaccaaccaaacaaacaaacaaatgaaaaacctagttattgaccttgcatcctgtattccatggttacagggtgagcgtaaagacagaatatctgagagctggctctatgtttttctttttcatctaactattttggttctagacacacttttgttagtgaagcaagagttaaggagcaaaaattctgaatatttttattttcagttcattaaagctttctgactcctcctctcctcacacacatgaatttatgttttttttaaaataattactctctaaattcatgtataaattctgggcttatttttagtaaggaaagggtacttttattttggattggagaacagctatcatagtattaaaattgacttcaggcctgtaatcccaacactttgggaggctgaggcaggcagatcacctgaggttgggagtttgagacgagcctgaccaacatggagaaaccctatctccactaaaaa

SEQ ID NO: 3941 - DNA, 1050 bp, Homo sapiens
caagaccaacatcatagagcttgttccctatgttttctcttagaagttttacagtttcaagtctcaggtttaagtctttaatccattttgagttgatttttgtgtatattgtaagataagggtccaattccatttttcttttctttgcatatggatatccagtttttccaacaccatttattgaagagactgtcttttccccattgtctgttcttggtacccttgtcaattattatttgacaatttatttgtgggtttctttctgggctctcttattctgttccactggtctgtgtgtctgattttatactagtatcatcttgttttgattaggatagctttgtagtataatttgaaatcagaaagtgtgatgttgtcaactttgttcttctttctcaagattgtttgggctatttggggttgtttgtggttctgtacaaattttaggatttcatttctgtgaaaattgcttttaaaaatttgatagggattaccaaaaaaaaggatgaatgagatctagtatttgatcacacaacagggtgactatagttaataatgaataattgtatatttaaaaataactaaaagagtgtaatttgattgtttgtagcacaaaagataaatgcttgaggggatggaaaccccattctccatgatgtgattatttcatactgcatacctgtatcaaaacatcttatgtaccccttaagtatatacacatcctatatacccacaaaaactaaaaattttaaaaattaaattttttgtggagattgcatttttacagagattgcctctgatggtgttttacaattaccttaagctgtcttcactctttttcatttttttctttttgcttttttgactgaaggatttccgatacttgtctttgagtttgctgaacctttcttctccttatctagtctgctgttgagcccttgtattgaaatttttcagttattgtattattcagctctatgatacctggtacttttctgttttctgtttctttgctggaattctcactttgttcatacattattctcctta

SEQ ID NO: 3942 - DNA, 1605 bp, Homo sapiens
aaatctgaccccatgatccagtcacctcccaccgtaacatatggttggggacacagagccaaaccagagttagtgcattttttgaagagaatgtgattcaagtactgagatagtgactccacaactataaattattaatatgtattaacactatccaggagaagtgttaattggcctgacttgagagaagatttgagaaagagttgaggtaaagtgaaactatacaggaatatctgtgtatttttgtaaagattcctgtggctgtattacttcgaataaaacataatgacaatagtaccttttgttcatgtaacactctaattgtcagagtatgtttatcttatttaattctcagaataactctgtgacgtaagcaaggaaaatgtgagtcagataaggaaattaaggctcatgagcggttgagtggtttgaggcatggcagagcaaattgctagctcagcaaggcggagcccccactcttaagttcccagtgcgaggcctattacattacaatactgggacttattcaaaaaatatgctaaaatcctatttgagccatttttgtaatattaatttttctaagtccatttataggtgaaaagaatataaatttttattttaagaaagtgggtactgttgtggagtagggggaggggggagggatagcattaggagatatacctaatgctaaatgaccagttaatgggtgcagcacaccaacatggcacatgtatacatatgtaacaaacctgcacgttgtgcacatgtaccctagaacttaaagtataataataaaaaaataaacaaataaaaaagaaagtagagatcttgaaatatatctttattttcttcatgcatgattattaattgagggtccatactgtagttggcactgtaaatgactaatttcttgtgagttcagacttcccatgaggccatgttaaggtaaaacgctgctggctaaaaacatgctgccagatatacaggcaaaaatgtttttctgtcctttgatcagtgtttagtcttattcagctaaatctgtgccctcctctgcaggaaaacaaggtctatcaggcacagaactgtcactgactttgaaacaagtagctctgtactcagagaagcttcatgtgtgtgtatgtgcatgttgtgcgtgcctgtgagtgtgcatgtgtgtgtagtacagaatttgaccatttacttggtgcatcaaaattgcggcctttcttctgttgcttttgttaacaaaactattgttggcacgtcactgggtaccatgtgctgatttttacacttgcttttagggcttgaatctatcttatgcattgtttcatcacaaagaacttcagtaattttattctcattgtatttgaattatcagctttgtatgtgtgacttgaacttgttagattcatttttagcacatgtgtgcctagacagaaagcaggtttttaaaaagaactatggaagttaattattttgctgtataacgctgttttattaagcatttggctttggcattattcattggcatctgtcatttctctatgcctgaagcttttgattcagataacaattcatcagataagcataattactcagcaa

SEQ ID NO: 3943 - DNA, 1051 bp, Homo sapiens
gttcttggcaatcatttgggaactaccatggtagttcttatgttttatcatttgtaaatggggtatggttgtgtagaatcaatgaatagaaacatgcaacttaggtcctggcacatagtaggtgctaaatatgcattcatttctagctgcacttgtactagggttatcttagccctctgctaatgagtctttgcagaactctaaggggaatcaaatgaagtgagacagagtatctttccttctttctaccttcaagagctgccctctctgctttcccttatgttgagaactcacacttagaagaaaagaacaggatgtgaacagactccaaggcatcccaaaatgaagcaagtacaatttaagtcacagaaagaaatgttggtccctctcatttccttctgtttcaaaagctgttcgttcataataagaaagtccttcaagctccagaagtagagcgctgcatatctagtttagttcaaggttgtttggggacaggttctaagccattatgcatatgactaaagagtcgggagaggaccagactgggaagagcaactttcacacattcttgtgctggagttaatccaccagcactgccagttgatgcctgagagatgagggggtgggaaaaagaatctggcagggcagactcttgaaaggaaaagcagagagataagatgtctgaatcacttttccccttgaaaacattacaccaggaaagaaaaaagtgacctggatcccaaatacagggatttctcaattattcttaacttattctttttttttttttaaaaaaaagtcctgattgttttcatgaatatattatgatacatatttacaaaatttatacagtttacgtcatgccataacacactggtgcattatacacatagaacactccagcagtttgctcaaaacattaagaaaccaggttctgttacatgtcgtttgtactaaagtcacaagcatcctcctcctctttggtcattttatccaaattaaaagaccttgaaaactattcacctgctgtagactcctcaggcagttgctt

SEQ ID NO: 3944 - DNA, 1053 bp, Homo sapiens
ctaaatattttaaaatgcattgacgatctttgcctgaaataattatttcattgggaggtataaaaagtgtgatttttctaatttatatcattttttctatatttagtagctgacattgttctgtgaagaataactttgcctcatcaactgggactgaattacatttcttcttaaagaagcaggatatatttataatttaaaaaaattataggcaattttgaatatagagaaaaaccaaaatcatcagctgtaatttcaacagccagtgaactaatgttaaaaatgctatgtactatatctttccattcttttttcaatacagataaggatatatattataaaatttgattcataaatatatctagccttataaagggctggatatataaaatacattattaacactttacaatgttgttaaatatcctttaaaatatttttgctgactacatatcattccataacaacaatgtgacatactttattttcgcattctcttataaccagggaaccatataaccttgtttgcccagagaaatcctgatatatgaccattatcctgaaaaattaataaaataccctcctttactcctcatatcatacaagtttgggaaacaaattgtatggttacctttcctgtaatcacttaatctacaattgacaagtagctgttttgaattttccaatctatttgctcttatgaaaatttttgggtgcattcatgagggtgaattcaccctcatgttgtattagttcattctcacactgctataaagaactacctgcgactgggtaatttataaagaaaagaggtttaattgtcttatagttccataggctgtacaggagacacgtctggggaggcctcagggaacttacaatcatggtgtaagggtgaaggggaagcaagcacatcttcacatggcagcagaagagagagagctaagggggaagtgccacacacttttaaacaaccagatcttgtgagaactcactcactatcatgagaacagcaaagaagagatctgttcccaggatccaatcacctcccac

SEQ ID NO: 3945 - DNA, 1050 bp, Homo sapiens
ctgtaccctccactggttgaatttcctgcccttgcaggagaaattttgaaaaggagggaatgaagtttttaaaatcaagcagaatattttgaattaagtagttttttatttcagagacttctagaggggattagtacagctttgagccacttttctctatctctaaatctaaagttcccaggatactatttctaagatgaggactctgagatcttataagctgcttagtcattccaaagagatgcaatttttcttattgtactagatttactaagacagaaaagtagactgattcattacacaatagaaagaggctgactgcctttggaaggagtacttttccttctaaaatgcttaatccatcctattgtcaggctaaaaattgtgggagatggcatttactgggccaccctgattcttctgtagagtagaacctggaaggttttggtggctaaatgagtacctctaaacaggtgaagatggactgtgtgggtgctaagagaaccccaactgctgaattttgaacatgatgggcatcttttatcactacaagcccttatggttagtaggaaagagataatagaggcatcaactgtcccatatcccaaaggtatcctgctaatgagccatttttaatgcacatgctaagggttgccagttcttattttggagagattttcaacaagaattgcaaccagaggttaaaattagaccttgggttactaaatatttgtacgacatccatccaacaaagcatttatcagtcttcatcaggtgctaggtacagtgccgggtgctgggatattggcaaaaatgataaatatttgtcattaccatcctattgcttgctgaataaagtgggttgcaggtaagtaaacaagataatgtaacagtgagttatgtgttatgataggagaaatacaatgaactataataatacacagaagcgagttgcttaatttttacttgagtcaggtaagaagaggcatttacatgaaagatgaataagcaatagacagaccaagaggagttggggcaggaaagagcatt

SEQ ID NO: 3946 - DNA, 1017 bp, Homo sapiens
aagaggaacaataaattttattggaaaccgatgtgaattttgtttccaaattagtgtgctagtaacaaagccaacagacatttaaacagtaagctgacagtttacccacactttctactttagctgaaattggagtgcctcaattcgttccttcttcatttctgtaatcgaaaagaagcctttatagtatgtctaaaagcacactaaggttgtatttgtattaacatcttaattttgctaagtgccaataaatgctatgccttatcttcacttttctgttaggaaattacctaaaagacaatgctttattgtaaaatttaaaaaatatattgtaagtagtatttccagagacaagaagctatctaaatctattttacaatctgcatctatatctacatttatatcatatctatatctgtgttttccagtggtcataccctcaagcatactgatatagaatacagaggttgagacatttagatgctattactaaggttaaaaattatatcataaacatacacacacataaaaaagactgtaacaaatgaagataaagacaataaacacttttttctcctaccctaagataagcataactcatcaagatccatctgtttattcttggatgttctattctacttctgtggttggtctcactcctgtagtggtctcattcctgttggtatcaacactggaatattacagagaagattagcatagcctcttgcaaagatgcctcacaaatttgtaaacctgctatatttttgcatagttaattacttctttctttgggttccaatagcacattgtatgtatattagctgtcatcttactgtattataattatttgtttacttctctgtccccctcagaaaacagaatcgctaaagaaagaaattattctttatattcctagtggccagcacagtgcctagatcctaaaacgcatccagaaaatgtttaataaatgaaaaaaaagaatgaaagaagttttatatttatgtgtaagaaacaagc

SEQ ID NO: 3947 - DNA, 1050 bp, Homo sapiens
gtgtactgtctttatttgttttcattctgtctttctatttttttctctctttcttttttctgccttcttatgagctggttgaatttgtatgtgtgtgttccattttattttctctattagcttcttagatataccttttattattgtgttttggtgtttactctagagctaataatatgtatccttaacataactgaatctatttaaaggcagtatcttatttttttgtatttcctacttccataataatatttattagtataattctatttacaccctaccctaaatttatatttttgtttaaaaccactcaaatgactgtccatttttttctggtactaaatttaaactcctaacatggcttatcaaatccattatgttttgggctctgtttacatctttaaccacatctactgtttcttcaactccaggaatacaggtactaattttctttcatttcttcaaatgtatcttgttgtttcaaacatctgtgtcatatgtattgttccttctgtctggactactaatccccttttggcatctgacacttcaattacattttttttttttttttttgacagagtcacactctgttgctcaggctggagtgcaatgagtgatgtgatcttggctcaccgcaacctctgtttcctgggttcaagcaattctcatggttcagactcctgagtagctgggactacaggcacacatcaccatgcctggctaatttttgtagagatgaagttttaccatgttagccagactggtctcaaactcctgacctcaaatgattcgcctgccttggcctctcaaagcactgggattacaggcatgagccactgcacccagcctgatacttcaattacttttaataatttttctgaggaattgtttgtgaagtttctgatccctttatctgcagacagaattaatcactctctattcagttctacttttgtgccttacatacacttttatcaaatgcttcttacacacggcttcaaatttcgttggcctcaactcttatcccagctgtggctgtggtgacca

SEQ ID NO: 3948 - DNA, 1030 bp, Homo sapiens
ctgtgtcaaatccatgtttctctggatgaaattttttctttttgcttggcatattaagatggctttggggagaatttatggagaactttattcgtataacattatggttaatagcacaggcctggggaataaggctagaccaaattctcactccatctcttagtagcaatggcagaaattactaatttgctgctctggcttctatctacaatcaccttcttcctagccatcttccagttaggggtgaccatgtaacacagttctggccaatgacaaataggcaaaagcctgctgggtaaaacccctgaggaagctaggggattcagccagtatgacccttatgtcttctttctcttcactttttcatatatattgtgtagtggtgaagtcttggctattagtgtactcatcacccgtctttctttatttattttacctggagtcctgtgattccagaagatatagcagcgatcatataactatgaggaaggtagtacactgtgcgtgggggtggggacagcaaaagaaacagcctacccgtccttgtccaaattacttagtaggtaaaacagacctgaattgcctatctccaatccccttttttactttttgaagaataacagccattgtttgtttatgccctgaagttggtttttctgttactcacaggtgaacacacttctaactctatgtcctcagtttcctcttttattatttgaaaatgttaatagtacctacttcatagggttgttgcagggatgaaatgaaaagatgcaagtgagtgacttaacaaagtgcctgtctcagagtaaacactcagtgggggcttgccaatatcattattccaacttgaatattttctttattatatttaatgttagaaatttagattttaatgtagatcatatgctactcagtgcagctataacataatatatctctttcatcttccaagattgttttcagtgtttttaagatagttttgttgaggtataattggctacagtaaactgcacatatttagattagt

SEQ ID NO: 3949 - DNA, 2837 bp, Homo sapiens
aaggaaatgggtcctgagctgttaatctctgtaactgcttaatttagttttacatttcccactaaaacaaaactattcttgagattttctgtgaaactcaatttacatcccaaattcttttattttcctaccaaaggagggattcttttatatccatacttttataaagagttcttgtataaaactacattatgatgatattaagatatatgtaatctatatttaaaatccacagaatgtaatgattgcgtatcaaagagaaaaggtaagaaacatttcagtagctgaaagaaacacaaactaacctcaagcagaccaaaacttttgaagtgtaatatacaagtgtttttgtaaaaatgtcagtgtttttccttgaactgtttcttgagttgtttcacatattgaggattactatggtatcatgacagctagaacagagtataggagcaaaaaataatagaccactaagaaagataagtgatcacccatttgaaagagagactgtgagaggatacagatcctgaattggcataaggtaaggattaaggaaaaattactcaagacttaagagacgaaaattatatatatttttttgtgacagagtcgtctcactctgttacctgggctgaagtgcggtggagccatcatgtctcactgcagactccatctccgggcttaagcaatcctccccccgagtagctaggagtacaggtgcaggtcaccatactcggctaatttttgtaactcttatagagataggggttctccatgttgcccaggctggccttgaactcctgggctcaaacgatctgcctacctcagcctcccaaagtggtatgattacaggtgtaaaccactgcacctggcctaaaaattatattatcttagcaatttctttaaaattctcacttacaaaaataataagaaaattgtagaaaacctggtgatatagtttttgggtttatttctaaaaacaaaatgaaagaagtctaagaattaaaaacattttccatagaggagtgctgatggatctggggtagaaaaaaattcaaataataaaaaatctgggaaatactagtatttcttatatgactacctccaagaaggagttcatcaaaattttatcaaaatatcctaaaattgtgtttcttttaattttttaaatttattttttaacttttatttcaggtttggagatacatgtgaaagtttgttacataagtatacatgtgtcacaggattttttttgtacatattattttatcaccaaagtattaagcccagaacccaatagttatcttttcttctcctttacctcctccctccctcccaaaattgtgttcttataacaaaaaatattacattaatgatggcttgataaaaagtacaactgcatcttcaaataaaattttctcattttgcttattccaatgcaaatcagattataactgtcactctatggtaaattacaataataatacacaatgaatttaaaataaccatagtttaacagtgaatgataacctcaaacatgtttgctgaccaagttgaaaatgccaactcttattctgcaaacagtagagatagggttatcaggatgttggagagattttgtgagataaaatagttaaaatgtaaaagcattttattttccttttaattttattcagccagcaattgtaggactcttccaatgcttcctaaatgttaaatgcattcagtgtttattgaatacctatgatattgaaatattgaggacctacagtattgaatgttataggtgttagtgacataggagtgaaaaataccaaagttcctttcctcatagtacttgtactcctctgggaagagacagacaataataaaagtaaaatgacaaatgcatgtaaagtatgccagtgggtattaaatactatgaaaaaaagtcagggtaagagtaatttgaaaaaacaactaccttatcctcgtttctttgtaatgaaatatttctattcttgtccttcttttgtcatgaaatttactaataataagctctgaaagtatactgggagactccatgtataattacacataattgatttctccactttttgacatattacaaaggacagattatgattctagtaaatttgtatcatgcagagaaaagatttcagataaaagtgatccatgaaaatagagactgacatcttgtttcctttaagaagccacaactaaatagctggcaaagtgttgaattaccctgtggacacatgaatgggagtcttggcgagaagtagttttaatcagaggtagtttttaaccttattattaggacttttacatcagatgtagctaaataggatgaggtacataatttgttatcaacatagttaatgtatttattggtatttattggtatatactgaaaacatacctttaaaaggtaactaaattagaaatctgagtaaaatgtcaactgatttgcagatatagtaggtgattcgtaataggtgattaataaacatctttttcagggacaagcctgtttcagtgagtagaaactgagcttcttccatctctggaggcactggctgagtcttggggcacagggaggcaaaggaccaaatctgccacagacaaaactttactgggacaattagaaaccaggcaatttttaaagtgtacttttgtaaaaactgctttatataattcccatgctataccagtcaactatttacagtgtccaatttcatttttcttttatgatattcacagagttgtgcaactatcaccagaatataattttagaagattttgtctcccctaaaagaaacccaaaactcattagcagtcac

SEQ ID NO: 3950 - DNA, 1849 bp, Homo sapiens
tgaataagtgagaacatgtgacactcgtctttctgtgcctgcttatttcgcttaacataataatcccgagttccatctgcattgttgcaaatgacaggatctcatccttttttatggctgaatagtactccattgtgtatatgtcccacattttctttatctattcatgtgttgatggatacttaggttgcttccaaatcttagctattgtaaacaatgctgcaacaaacataagagtgcatatatctctttgatatactgatttcctttcttttgggtatatatctagcagtgggattgctggatcatatagtagctcaacttttagttttttgaggaacctccaaactgttcttctttgtggttgtactaatttacattcccaccaaaagtgtacaagggttcccttttctccacatccatgccaacatttgttattgcctgtcttttggatgtaagtcattttaactggggtgagatgatatctcattttagttttgatttgtatttctctgataagcaatggttttgagtaacttttcatatgcctgtttgccatttttgtgtcttttgagaaatgtcaattcaaatcttttgaccatgttttgattggattaatagacattttcctttagtgttgagttccttgtgtattctggttattaatcccttgtcagaggggtagcttgcaaatattttctcccattctgtgggatgtctctttactttgttgattgtatcctttgctgtgcagaaacttttaaacttaatatgatcccatttgttcatgtttactttggttgcttgtgcttgtgggatattgctcaagaaatttttgcctagaccaatgtcctggagagttttcctaatgttttcttatagtagtttcatagtttgaggtcttagatttctttaatccattttgatttgatttgtgtgtatggtgagagacaggggtctaatttcattcttctgtatatagatatccatttttcccagcaccatttgttgaggagaatctctttcccccagtatatattctttgcacctttgttgaaaatgagttcactgtgggtgtgtagatttctttctgggttctctattctgttccgttactctatgtgtctgcttttatgccagtatcatgctgttttacttactgtagctctgtaatataatttgaaatcaggtaatgtgattcctctagttttgttatttttgcttgggatagctttggctattctgggccttctgtggtttcatataaattttaggattgttttttctatttatgtgaagaatgtcattgttactttgatagggattgcattgaatctgtagattgctttgcatagtatggacattttaacaatattcatatttttcaattttttggtgtcctctttaatttccttcatcagtattttatagttttaattttagagatcttacatttctttggttaaatcctaagtatttaattttatgtgtggctattataatgggattactttttaaatttttttttgcattgttcactgttagcatatagaaatgttactgattttttatgttaattttgtatcctgcaactttactgaatttatcagctctaatagttttctaatagagtctttaggtttatccaaatataagatcatatcatctgcaaacaaggataatttgacttcttcctttccaatttggatgccctttatatttttctcttgtctgattgttctagctaggacttccagtactatgttgaataacagtgttgacagtgggcatccttgtcatgtcccatatcttagaggaaaggcttttggtttttccctattcagtagac

SEQ ID NO: 3951 - DNA, 1070 bp, Homo sapiens
ctttcctccaatttattttttactctactgcaattaagaaactcctgcacttatgacactcctgaaagacaaatctggtcatttcacatccctaaaatccaataatggcttttcattggctacacaagacaaaatcaaaattctgtagcaaaccatccaagtctagaatctgacctatgattacccttccaggttcatttcccaccacttcccacattcaccctaattcttaatgatccgaccacactaaatactgggggccatacacattcttttatgcttctctgccttcatgatgttattgttttggatggtttgtatgtgtgtgtgtgcacatgtataattctgaaaatttctatttttttccaagattaagcacaaatgtcaacttctctgtaaaatttcccatcttctctgactaccaccttcaaattaagcacttctttctcattgctcccataacatctttcatatacctctgttagtgctcttatatcaatttaaatgtagactctacacatccatctcctttctcaatcttcatgtgggtcttcagccctacttctgcactgaagcaaaaggaaccaaaaacctgaccgcaaatcagtcagtggcttaacatcccaggttagagtgtcgctctggtccacttctgtctccaattgttctgttgatgcgctatcagttagttttaggccagccagcctgtacattgatgcttgaaaaaacagtgctctatttccaagctagttgtctagaaactgtcatctctttcttagcgttgctcccaatctttttgtcccttcctagatacccattactaggctgtgagcaatgcgagcattttgattgtgcgcaatttatcctttaatccaaaatgtcaagtgtaattttggacatatcacagatactaaatgaacatttattgaatgaatcaaacatttctctatatttttatatattttcataattttattttaaatggtttggtaatattcaattgcattaatttagcataactggcataattaactgagttttctgtggaaatgtaatagtctaaacaacat

SEQ ID NO: 3952 - DNA, 1028 bp, Homo sapiens
gcaatctacagattcaatgctatttctatgaagctaccaatggcatttttcacagaatcagaaaaaactattctaaaattcatatggaagtaataaagtaataaagagcccaaataggcaaagtaatcccaagaaaaaagaacaaagccagaagcatcacattacctggcttcaaactatattgtaaggctacagtaagcaaaacagcatggtactggtacaaaaacagacacatagaccaatggaacagaagaaagaacccagaaataaagctgcattcctatagccagctgaccttcaacaaagtaaaccaaaatcagcaatggggaaaggactctctactcaataaatggtgctgggataactggctatccatatgcagaagaatgaaactggacccctaccttgtttgatatggaaaaattaactcaagatggatcagagaattaaatgtaagacttcaaactataagaatcttagaagaaaacataggaaacaccattctggacattgactttgggaaaaatttatgactaagtcctcaaaagcaatgacaacaaaagcaaaaattgcaagtgagacctaattaaactgagtagcttttgcacaacaaaagaaactatcaacagagtaaacagacaacctacagagtgggagaaaatattcacaaactgtgcatctgacagaggtctaatatctagaatctataaggaacttaaacaattgaacaagtaaaacaccaataaccccattaaaaataggcaaaagaaagacatgaatggacagttctcaaaagaagacatacaattaaaaaaaagaagacatacaagcagcaaaaaaaaaaaaaaaaacatgaaaaaatgctccacatcactaattaccagagaaaggcaaatcaaaaatcacgagataccatctcatataagtcagaataactattattaaaatttaaaaatatttgggtgaggctgcagagaaatgggaatgcttataagcatatatacactgttgggaatgtaaattagttc

SEQ ID NO: 3953 - DNA, 1045 bp, Homo sapiens
agcaaagaaatgatatggctggggatgggagttgtggagttgaaaaaagatttgcttttttaagatggaagaataatagtgggttttattccttgttgtttgttactatctgtgtattgaggtgggttttaacctctcttttactattttaaattttgggtgctttttatgacagtttcctatggaggtaagatgaattaatgtagaatggtcttatgttgcctagttctaaggatgtttctcttttatcttcttttacgtctttaaatgtattatctttaagaaatattaaatggagtattaagagaggtatagaaatggattttctgacaaaataataaaatatgccatagtaggaaaaagtttccagaagacaagagtttgccagtcatcttgttgctgactgtggcagtccattccctcacttgaaaggatcttaaagaactaaagaaaaattaaaaaaaaaaattgtgcgggaactagcctaatgcttctcaaccaggggcaattttacagtgtctggagatattttgattgtcatgactggagtggcgctggtggcatccagtgggtagagaccagggatgctactaacattctataatgtacctcctcacaacaaaagattacctagtgcaaattgtcaatgttgccaaggctgagaagctatgggctagccctatcatctttcctttcttccagagagaagctaggaagctgcttctgaaaaagggatccggaagcaggagctttccctatcccattgttctgtgtttagatgagacacagcttttaaataaatgattagggttcaaaataaagacatttcttttttgcctttgctttctctttacccccttctgtggattcccatagtataatcgaattttataacttttggtagtttcccattagggcccatgacagaggaacattaaagtcatggtgaaaaattcctcattcagttgagaaaccacaatttcacattgctgatttctattctgcatctgtctgacaacttagtgaaggaaaggatgaagaatag

SEQ ID NO: 3954 - DNA, 1050 bp, Homo sapiens
actgctctcagatgtctgcttctaagctacaaccaactaaactgggactgcctggtaggaaaaatttctaggctttattggcaggggcaggctactggggtgaactttgctggataaaacactgtagatttagcaatattccatgctgtgttggttattctcttacaagagctgcttctctgcttagctacaccgcatgcagggagagatcattcgtcggatcttgtgacaggcaagttgctcattggcttctgaagtcctagcaagagagactatccataagcctagaaattggccaaagagaaatgcagtttcttaacattgatagaagaataagatctgttggcaggatttctcaagggacattagcattcatttgtgacatctcatcaaaaggacagtctttcagaaaggccaatggaatcttttacaatccaatattgataatgtttttaacgaaaaaatgctatagttcataatcaatacaagtcttataaatgcaagctggttacattggttataatcacgtcaccacccccacccctgccttttccaatattagtacaacaaagacttcttgctcaattacttaagtgtaaaacttatgtttaggttaatttattcatttattcatttagcacatatttattgagcactgaatatgtaccagattctgtgcaaaacactagggatacggtaatgaacatgatagacaatgaagtaagaggaggcctggaagaagcaggtgacaaataatatgaaccagaaaatttcacatagtgattaataccaggagaaataaaacaaagtgatgtgcgagcaaatgattttgaggttactttagattgtctggaaaggtggcatttgtgtcgggaaacaagtgatgaagagtaatttgcatgccaagaactggaacataacacttcaggccttaaggtagaaatgaggtggtagcttggcacattcacatacaaaaggaagaggtgtaatgtgtaaggaagagacagttagggagaagccaggcctttttggtcataaaaaggaatatag

SEQ ID NO: 3955 - DNA, 1100 bp, Homo sapiens
tgatctcaattatcaaagggatattgagttgctgctacacactggggagaaggaggattatgtggaatccaggggattatctggggtgcccattagcacttcttataacaaccaaaaaaaataaaaaggcagatgactaaggactttacccttctgaaggaaggtttaggtccctctgctggataaagaattgacccgctgaacttctggccaagggcaaaagaaatataagccagaggtatcaactatggccttgtgcccagctactgaaatgaggactgtagtggctttgtgtattttctctttggctattatatgtttatgtgtgtaggctgtttctcctttttccatttttgtttttacacaaactagtggtgcttaaccatacataatagtctttaggcaagaaaataatcaatgaaactatgatagaatttgaggagtaatgactatagctgccaatggatacagtgatggttaggactatgcatctctttattttgtgaagggtgagaatttcttcacttgtgagaatagcaatatcttgttaggtggaaacacagagttgcttcattgtacagaactcacatgagtgaagggtaaatatggaaaatgagtagctaaaggaatgtactgttcccagttatcaactcattgtctcaacccccaatccacttattaccattctatgataatggagctgacccctttaagaatttcttctttacagtgaacatgttgctaagctttgtcaatagacagtgctggaggatcacagaaaaaaggagcttttcttcttgtttcaggtgatcttctcctgcagggggagggagagagagagagagagagtacgtgtgtgtgcacacattctgtgttttctgcagtgcccagtggccggcagcacagagcaccttcctgtggacaactttatagtgggagggctaccagcaaagcatcttcacttgaatggctgcctcaggcaactggttccagccattttaagcaaggtacagatggtgggcacattctcatgaacatcttcccccagcatacctccttgcagagagctgctaacagggcaccttcctctggacaacttt

SEQ ID NO: 3956 - DNA, 1029 bp, Homo sapiens
aaaattacgaaagacattcatttgcagtttatgaaaggaaaatgtagtttggatacaaagctgattaaattggatcaagaaatattagaattaaatgcaaaaaataatccatgcatttatggttttgatttttatatattcccagctagttgaaaatgatgattcccacaagaagcataactcagcttgtttctgcttactgagtattttctactatggtatatattgataacatttcttccattatgtatgttgtataccagagttacagttactgtgggaatcataatttgaaattttgactcctgtgtttctggaatctttacaacaaatgttgcattaacatataacttttttcagttgactttaccaaaattaagcccatctttagtagatactgttttaacatgtgaaagaaatacgttataaacataccacaagatatggctataaaacaatgagatcagtatccatttttgctttaaagaattggccttattgcttcagtgtcacatctcatactcaagggcatttactacaaagaaagagttctccaatattgctgttctgttgctgcctgccctatttacacatgtacctgctacttaaataggaaagcctttcaattcatggacaatacaccttggtggtaaccaggcttttatttttatttttttttcttagtgtaaaaactgtactgttttggaaatgtgctgtgaaatattaggtttaactgtgtagatcctagaataaggggatttatatagatgaagttgtaaccaagaaactggttattaaaaatttatttactccaaacatggaaaggtggcagtgtcattcttgtgtcacctgcacagtttgcagtctcagagacttcagaggactctgagatttgcctgctgaggtatacccagtcatagggtctgccaggtgggaatcacatgatacgacccacgttcagttttctctcttttgactatggtagtgccagctttgactgtgctagagtttcagggacggacatgagcg

SEQ ID NO: 3957 - DNA, 1026 bp, Homo sapiens
atagcttctctgcatttgcagtaaacacacagaaatgaaaatgggaaaatttttctgtcacagcagtgaagagaactataaaataattacaattagatttaacaagtaaaccatagacctgtataataagaatcatggaaagtactatgtttcagaaacagaaagacataccaaataaacaacatgatgaaagtataagtgtaaattctcccaatttagcaattctaattagagtagaaacaagtttttcttttttaatgttaggaaaaaatgaccacatgatttatgtagaagaccaaatgtccaagaataaccaaagaaagtatgtaagagaggcactggttttaccggatatcagaatattagcctaacgcagctgtaatcagataaatattatatggacaaaggaatagacaagaggatcagtggaacacatggaggagtgaatttcaaactttatggattccaattcatgataagaaatatttatatgcgtaataacttttgatgtgtagggtggttctgtctctcacagtccactgactcaaatgttaatctcctttagcaacacccccacagacacacccaggaacaatactttgcatccttcagtccaatcaagtggacactcagtactaaccatcacaaacctagataccctaatacgtatatggtttatataaatgataaaggtgacatcacagatcaatgggaaattaaaagatcattcaataaattatgctgagagagttgattaactactggagggggatactatgttcttgcatcataatacatggaaaagtacattccaataggattaaagcttaatgcaaaaaatgcgaaatggcaaaacaattagaaaagtatgttggcaaaatttttggatgagaactttctaagcatgaaaattgtggcaaaaactacaaaggaaaattgatatatttgactttgtaaaaatgttaaatttctatacatcgaaatgaaaaggcaaaccagcctgggcaacagagtgaaaccccatct

SEQ ID NO: 3958 - DNA, 1071 bp, Homo sapiens
gaataatgctactgtgaacataggtatacaaatatcctgctttcagttcttttgggaagtagaattgctagattgtatggtaattttatgctaaattttttgaggaaccaccatactgttttccataggagctgtaccatttacattctcaccaacagtgcataaggattccaatttatttacatccttaccaacactggttatttatttatttattttttcagtagtagccacctactgggtgtgaggtgatttaacttttcttaatcttagccttgctgatcacatttaataatatccttagcatttaaatgcaaatctaaaaatttaaaagtgtttacactctttgcatttgcaaaatatctgaattaagtaaatttcattaagacgtgtcttactatattatctaattattcgggtcacttatttattagtgtatagcattacttaatgttgtctttctcagtggtgacatagtatggtaataacaatcatcaaacatctttagttgacaagaatttgaaatggatagtggggccaggcgcagtggctcatgctgtaatcccagcaataagtgaggcctagatgagcaaatcactggagcccagaagttcgagaccagcctgagcaacatgacgaaaccccgtctctacaaaaaaaaaaaaaaaaaaaaaattagccaggcttggtggtgtgcgcctgtcatctcagctactgaggaggctgaggtgggagaatcacttgagcttgggaggtcaagtctgcagagagccccaccattgcactccagcctgggtgacagagtgaaaccctctctcaaaaaaataataataataataaaataataaaaataaaaataaaataacaggaaaaagtgggagataagatagatgaagtgtgaaattgtgaagaatcttttattcagccaaagactttggacttgatgctgtagatagtcaggaaaccattgggaaattttaagtaatggtaaggggcaaaggagggggtggatactagaggaccgatttgaaagcgattgtagaaagtattaagaaatgacaggatttgtta

SEQ ID NO: 3959 - DNA, 1033 bp, Homo sapiens
tctttaaatgattaatacttaagaattgaacatttgtctttatctttcatgcagaggaaaaaaacagcagatttgttgatggaaaagtaaacctttaaaataggaaggagggtataatagagcaaatggaaatcatgagactaaaatcacattggaattatgtgacagtgtcatgtgtctctgggcgagaaaacatacctcagatttccctatttcaacagagtacaaccaagtgcctgaattgagtgattcctcctagtattaagattttatcattttaattatattttttttatctagcagtttcttaacgactttgattgttggaagatcaaaatgctcttttattttggtacttgttcaggttcaagaattaaaaacttaagatgggggaagaaggctttgctttctctaactcttattttctgtaggtacttcgtaactcaggaagacctcatttattcccagtaatatgttttactaaactctttcaggtaactcttaaaagactgtgtgacttaatagtagatcatggcttgaactcagtttttatttattgttgttactagaaaatttttgtgaaatatttttctttgtctctgtagttatcagagactattacagacgattgctgtactcgaggctcagcgttctcaagcagtccaagaccttgaaagtttaggcaggcaccagagagaagcactgaaaaatcccattggatttgtggaaaaactccagaagaaggtatacattgaactgtttttaagatttactaagatctatttgggaatagcttaagagaatttggttaattcttttttatgggtatatactttttaaaatgtttaatttttttcgtctataattagccgtactacttaaggcaagataccaacttcttccacctccaccaggcacacaataaaatatatccaaatgaaaatagctagaagcttttattggatatttgtatgggaacttgtcctattccttagccattttttttctagcttttcctgttatcttccccttc

SEQ ID NO: 3960 - DNA, 1029 bp, Homo sapiens
ccctctttttgttttttgagacggagtcttgctctgtcacccaggctggagtaagcaatggcatgatctcagctcacaacaacctctacctcccgggttcaagcagttctcctgcctcagcctcccaggtagctgagattacaggcatgcaccaccatgtccagctaatttttgtatttttagtagagacaggggcttcaccatgttggccaggctggtctcgaacccttgacctctggtgatccgcctgccttggcctcccaaagtgctgggattacaggcgtgagccactgcacctggccctcttttttgtttttaatgacactatttaatgagttttgaagaatcaggctgatattttggcagagtgtccttgatatggatttttaaaaatgtttctccattagtttttttagattacaaatgcccatggaatcttaagggttattaccacagtagaaatggaaatctagtttttttaaaaagattctgatgcagttgaatataaaatctttccttctgtttctgtctgcctgtctgtgcctccctcctgcacgccttccttccatccctccctgattattgtgtatgtaatattactgcctagaaattggacagtaaaattaacttataggccgagcacagtggttcatgcctataatcctagcactttcggaggctgtggcgggaggagtgtttgaagccaggagtttgagacgagcctgggcaacaaagcgagaccctgtccctacaaaaaaaaccaaaccaaaccaaaccccagagaacaaaattcgctgggaatggtggcatacctgtggccctagctactcgggaggctgaggcgagaggatcactttagcccaggagtttgaggccgcagtgagctatgattgcaccactgcccttcaacctgggtgagcgtgagactccatcaaataaataaataaataaataaataaataaataaataaataaataaaatcaacctccagattgctaattccttgatgttctcttcagatgtcagga

SEQ ID NO: 3961 - DNA, 1669 bp, Homo sapiens
ccactgtcatgtaaatgcttaagttggtctaatatgattctataaaaggactaccattactaaattgaaggaactgttgcccttgaatttgtcgtctctccagcctcctcatcagaatgtattaagaatatatagtagctgtgccagatataatggggccggtttaactactgtgctaaagcactaaaattgaaacagtagaagtgtacttacttaatagctaaagttatataactacagtaggtctaaagattagatttgttggagaaaggttttacaacatgggaaatgctttagcaactgtcactcttaagtaaaatagagataatatctaaaaaggtatttcgaataaatctctccattgagtctagatagcagctgagaattatttacaaattgttgagttccggaactggtggcatgattgcactatgtcttaatgtttaaccagaaataaatggcaataaatttgctaacataaaaaggtaaattttaaattaatcagacgggatctcttaaattgtgatatttcaactggtgcaatcttaaatatgtaccttaactaaatactttctcatttgctgttccaagataaagcaatagtggctacaaggaaggttgataaatttatatttacagtacatgggttcaaactgcgcaggtccacttatgtgcaaattttgtcctgcatctgacacccctggaacagcaagaccaacccctcctcttccttctcctcagcctattcaatgtgaggataatgaagatgaagacctttaggatggttcacttctacttaatgagtagtaaatatattttctcttccttatgattttctgaataacatattctgttctctagcttactttattttaagaatatagtatgtattataggtatcatacaaaatatctgttaatcgactgtttatgttatatggtaaggcttctgggtcaacagtagtcttagtagttaagttttcgggagtcaaaagtattttagactgcagtgggagcatctgtgctcctaacccctgttgttgctcaagggtcgactgtatttatttatttttaaaaatagacttttaaaaaagcatggttttagatttacagaaatatctagaacatattacagggttactgtatactctatacccaatttcctgtattattactatcttacagtagtatggtatggttcatttgttacaattaatgaatcaacattgttattaactcaactttatacattattgagttccttagtttttacctaatgtcctttttgtgttccagaatcccatgtaggataccacattacatttagttttcatgtctcctgagtcttcgcttggctggagcagtttttcagacttgccttgttgttgatctgaacagttctgaggggtactagtcaggtattacagatgcctctctatttgaatttgtctgatatttttctcatgattagactggggttatgggtttttgaaaggaaaacaatagaagtaaaatgccatttctatcacatgctaccagggtgcatactagcaataagatttattgctattgatgtgactttaatcacccagctgagggtagtgttggtcaggtttctccactgtaattattcttttttcctccccttttcatactgtattctttggaag

SEQ ID NO: 3962 - DNA, 1066 bp, Homo sapiens
cttttttggataattcattgttagtgtatagaaatgctactgattattgtatgttgatttttgtatcctgcaacttaactaatactaaatttgtttattctaaaagtgttttgggtagagtctttagggttttctatgtataagatcatgtcatctgcaaatggtgatgatttaattttttcctttccaatttagatgctatttatttctttctcttgactaattgctgtgtctaggacttctattactgggttgaatggaagtggtttggggatccttgtcttttttcagatcttagaggaaaaacattcaacttttcacccttgagtatgatgtcagctgtgggcttgttgtatatggcctttattgtgttgagggtgttgaggtacattccttctgtatttaatttgttgagagtttttttttttaatcatgaagggatgtcaaactttgccagtgctttttctgcaccaattgaaatgatcatagtttttgtccttcattctgttgatatgatgtatcgcattgatttgcatatgttgaaccatcctttcatcccagggataagtcctaattggccatgatgaatttttttttttaatgtattgttgaattttgtttgcttgtattttgttgagggtttttgtttcaacagtcatcagagatattggcctgtagttttctttttttaacgtgtctttgtctggtttgagtatcagggtaatacttcatataatgaatttagaagtattccctcctcctctattttttggtatagtttgagtaggattggtattagttcgtctttaaatgtttggtagaattcagcaatgaagccattgggtcccagggttttctttactgggagactttttattatggctttgatcttgttacttgttattggtctgttcaggttttggattttttcatggcttagtcttggcagattatatctagcaatttatctattccagattttccaattagagcaattagttgctctaatgatcctttgactttctgtggtgttgattgtaaagtctgcttttttttttttatctct

SEQ ID NO: 3963 - DNA, 1028 bp, Homo sapiens
gtcagtgaggaagggccacttaattctgcagtagttgaagaaatcacaggctatttggctgtcaatggtgttgatgacagtgattcagctgttataaactgtgatgactgtcagcctgatgggaacactaaacaaaatagcattggttcctatgtgttacaggaaaaatcagtagctgaaaatggggatacggatacccaaacttcaatgttccttgatagtaggaaggaggacagttatatagaccataaggtgccttgcacagattcacaagtgcaggtcaagttggaggaccacaaaatagtaactgcctgcttgcctgtggaacatgttaatcagctgactactgagccagctacagggcccttttctgaaactcagtcatctttaagggattctgaggaggaagtagatgtggtgggagatagcagtgcctcaaaagagcagtgtaaagaaaacaccaataacgaactggacacaagtcttgagagtatgccagcctccggagaacctgaaccatctcctgttctagactgtgtttcagctcaaatgatgtctttatcagaacctcaagaacatcgttatactctgagaacctcaccacgaagggcagcccctaccagaggtagtcccactaaaaacagttctccttacagagaaaatggacaatttgaggagaataatcttagtcctaatgaaacaaatgcaactgttagtgataatgtaagtcaatctcctacaaatcctggtgaaatttctcaaaatgaaaaagggatatgttgtgactctcaaaataatggaagtgaaggagtaagtaaaccaccctcagaggcaagactcaatattggacatttgccatctgccaaagagagtgccagtcagcacattacagaagaggaagatgatgatcctgatgtttattactttgaatcagatcatgtggcactgaaacacaacaaagagtatgtgtaaatatggtaaccatgaattctgctttgtttattattccccaagtttttcagtatcta

SEQ ID NO: 3964 - DNA, 1027 bp, Homo sapiens
gtaggagtcagaatggcatttggaggtttacatgagaagggagactgttgatgaccaaaggcaggaggaagggactgtgaaactttgcactattgccaccactggcctctttctctaactaatcatcctgcatctcattcaaagttaggaaataaaatgacagggtaccttgtgaaaactaaacagaagaggagtcggggaatagagacttcaaatattaacagctcctttattctgcttgatgggagagcctctggaaaatatcaccaaatcactagtttacccaaatggatcaatcaaggcatttttctatatcccttacatttctgtcatataaacctcaagcatccacaccagaatacctgctcatctcccaaaccacacattaaaactggcactggcatatgctatacacaggagttcaaagaaggaaagggtgggattacaggagtagtcttgatttcttaaatgtaagtatttgcttcagaggcttcttccccattttcttttctggtctttggaacactccctttcacttgctaatttatggctttatttctagagactaggaaggcttgggtttgctttgttttgttcttagccaatgcaagctagcattgtgatttttgtctatttagttatgaaaaattatactgcaataaaaaatttttggatgccagattattattaagggatttgatctgaaactcattttagcaaaagtaaattaaaaagaggagagcctgcctttctgtataccgggaacattttgaaagaacacgagaaatgattggaatagttttttgaaagatagctgctatataagttcaagattattattttatttattttatttatttatttatttatttttttgagacagtctcactctgtcgcccaagctggagtgcagtggcatgatctcggctcactgcaaactctgcctcccgggttcaagtaattttcctgcctcagcctcctgagtatctgggattacaggcgtgtgccaccacacctggctaatttt

SEQ ID NO: 3965 - DNA, 1049 bp, Homo sapiens
ataaaactaaatattatgataataaatatcagctaaaccattggtgtgatggaagattgccagctgctcaattcccaaaataaactgtaccactttggtgattatagtaggaacaaaagcttataggcaaggtctttgaaatatctttttgaaatttctttctcttaagtaaatagctggagaagtgtgtcattaggtgggccttttttgtttaataattattatctgttttagttcttatgcgtacagttctacaggtatgatcataggagctggaaatttatgacctgaaatgtagctgataatgcttcaaagagtgtttttcagaatcctatagttatatttgggtaacagtagattcaaatttatgagagggcaattcagcagcaaatatgtgggtaggatatgtgaaattataggtaggattgagggcttaatatgaatggacaagttgaaattcggttgactagtccttctcagatatggcctccaagaggatgagaatttatgaaggtggggaagagagggagggagtctggttaattctagttactgaccacactcttttttctctgaattctagaaagtgcaaccattcattatttggtagataacatataggaaaaactccagtgtagttgttagttagattgcgttttgcccatatgaatatgttaattaatggcttcccttatttctaaaactagattgattgcatttctaatttcagatggatgctggctaaggtttttaccatatacctcttattttgttagccaacagggttatttcctgagataatttgtaaataagttcatttttattccttaacaatatttggcagaaatataattttgtactctaagcttctttattgtattcttaagaaacattttgcaatgcagctaaaatgaggaaaacaactgctttagtctataatattttgctaagcttggcaaaacaatgttgagacttggttgagataatacagactttttattttttattttctaacagaaagggtctcactattgtccaggcagttctca

SEQ ID NO: 3966 - DNA, 1027 bp, Homo sapiens
tctgttgcccaggctgaagtgcagtggtgtgatctcggctcactgcaaccaccacctcccaggttcaagcaattcttctgcctcagcctcccgagtagctgggaattacaggcacacaccaccacacctggctaattttgtatttttagtagagacagggtttcatcacgtttgccaggctggtcttgaactcctgacgtcaggtaatttgcccacctcagcctcccaaagtgctgcattacaggcgtgagccactgcgcctcgcctgaatctgaatttttaagaatgaggtttagaaatttgtattttatttcattttcttctcattttgtttttaagagacagggtctgttttactcaaattggagtgcagtggctgttcataggtgcagtcccactactgatcagcatggaagtttagacctgctctgtttctgaccttggcccattctgccgtccttaggcgacctggtcataccctgctccctggagatcaccatattgatgccgaacttaatgcagacacctgattgacatagtgcactacaacttagaactcctggactcaagcgatcctcctccctcagcctcccaagtagctgggactataggcatgtgtgactgtgcccagctagaaatttgtattttaaacatgtacctagatttaatgcttatgaacactgaagttttatttcttttaattaattgattaattagttaattttttagagacagggcttcacttggttgcccaggctggagtgcattggtgtgatcataacttactgtagcttgtagccttgaactccaggcctcttgcttcctgagtagctaggactacaacaggtgcacaccaccatgccccactaatttattgtgtgcattttttttttctgtagagacagggtcttgccaagttacccaagctggtctcgaactcctggcctcaaagtgatccttctgcctcggtctcttaaagagctgagatgaccagcgtgagccattgtgcccagcccgaacactaaag

SEQ ID NO: 3967 - DNA, 1059 bp, Homo sapiens
actgcagcctcaaactcccaggctcaagcagtcctcttgcctcaatcttctgagtagctggaactacaggcatgtgcaactatacctggctaattttttaattttttgtagaaacaaggtcttaccatgttgcccaagatggtctcgaactcctgcagttcaagtgatcctcctgtctgtctaggcccctcaaagtgctgggattacaggtgtgaaccactgcacctggcctattcagggtattttatataaatgggaattttacaatatgtaaccatttgtgactgacctctttcagttagcataatgtttttaaggttcatccatgttacagcatttgtcaatacctcactgttttttatggcttaagtgtatttcattgtgttgatatgatattccttgttttgtttattcactcagcagttgatggacctttaagttgcttccactttataactattatgaataatgctgctatgaacatttttgtacatgtttttgtgtggacatatgttttcctttatttttgggtgtatacctaagaatggaatttctgggtcatatggtaattgtatgtctaacttgttgaggaactgccaaactattttccaaagcagctgcaccattttgcattcctaccagcaatgtatgagggtgcaaataactctacatctttgccaacacatgtttttgttgtcttttttattatagcaatactagtgggtgtgaagtatctcactgtggttttgatttgcatatccctgagggctaatgatattgagcattttttcatgtgcttattggctatttgtatattttatttgcagaaatatctgtttaagtcttttacccatttttagattaggtttatctttttattaagttgtaagggtttttatagatagagagataattacaaatattttctcccattctatgggttatctttttattctcttgagttcttggaagcacaaaaggttttaattttgatgatccccatttatctgtatttttctttggttgcttgtgctttttgaatttttatgttttaattgt

SEQ ID NO: 3968 - DNA, 1028 bp, Homo sapiens
agacaatttagcccttaattatgtggcttaagtggggaataaatgccaggatgccaaattaagtgtgtgttgtgtgaattctgatttttaaaattcacattgaaataagaatggaagagaatacactagtatgttgtgttttttttttttttttttttttttgagacaaagtctcgctctgtcgcccaggctggaatgcagtggcgtaatctcagctcgccgcaacctctgcctcctgcattcaagcgattctcctgcctcagcctccctagtagctgggattacaggtgtgtgccactgagcctggctaatttttgtatttttagtagagacagagttttgccatgttggccagactggtctcaaactcctgacctcaggtgatccactcaccttggcctcctaaagtgctgggattacaggcatgagccaccgcacccagacctacactagtatgttaagtggttgttgaaatggggtaagctatatttgtactttatattgtggatgtgtctaaattattgtattttgtataattgtccattcatttaacatttattggatactatatgcttgttaaataatttaacaattatttattggatacctatacttggggtcctagaaccaatcccccccacgtatactgagggatgactatagtctgttctcattattcttggattccacgtttgtgaactcatttactggctaaaatttatttgtaacccccaaatcaatatgtctggcactttcgcagtcatttgcggacatgttcagagtggtgaaatttgagttgcttgatgtacacatttccaaatgaggttaaacaaaatgactctctgctgccttgttctagctctcttgtctatttacttagtgctacatctttcccacttttttttttagaggtggtttcactgtttaaaattgcccctaagtgtagtgctaaagtgctgtctatagtgttcctaagtgcaagaaggctgtgatgaaaagttatagtgctgttgactgtgagttccgtg

SEQ ID NO: 3969 - DNA, 1026 bp, Homo sapiens
gttgaaattaggtattttggtcatgattaagagtgacgtgtatacttagcagtcctgtacttcagtcatcttttatttgctgagcttttgtggaaattaaatgattgtaaagttttagcctactttctaaaaaaaaatcacttgttttttaatctggagagtttaaatgtctgactttggggaaacatcatgcaataggggaacattatctcctgaagaatgggggagagatgaactaacttttgtaatggttatagagttacttctaaatttgaataaatgctgttctacctagtgaactagtcagagcattttccactttgacctaagccaagcacatgggtagctacttctctttctgtagttaagagaatttcaccaaggatattttgatttatttgtagctatatggcagtggttctcagtatttatcattcatcataatcgcctgaaagttgtttgttttaaataatagatttctgggctctgcccttagagtttcagatttagtacgtcaggagaccacactttgagtagcactacttgggtatagtcaggacttctgcattaaaaaacaaaatgaacagacaaaaaccctacaagtgattctgttacatatcctagatgagagaacctttgatcaatagttctcaatacagtatatggttctgggcatagcagcagagcatcacttgggaattttacaaatgcagattttctccaactctggagatggaacccagaaatatgtgttttaaactaaaccactagaggattctggtgtgtgctaaagtttgacaaccatccttgtaactttatagttccctggcacctatcagggaatttactagaaattcaaatttcacactgcactcggagctctcatataacagattctgaatatcagaatctcattttacagtagtctctactgcactcttcagtttcgctttccttcggctgaacatactaaatgggaaattcaagaaataaacaattcatgttttaaattgtgtgcccttttga

SEQ ID NO: 3970 - DNA, 1052 bp, Homo sapiens
acaggtgtgagccactgcacccggccaatgtgtcttttcctaaggagaaatctcctctttttccttctttttaaataaagataaatacaattaaagtataatacacacagaaagttctcataaatgtacacctcagtgaattttcacagtgtgagcacactggtgtaatcgtcactaagaagaacactgtcagaactccagaaacttgtgtgtttattccggtcattaatggtccctaggtgccacccctcaccaagagaaatcactcttttgatgtctagtaccacagaattattttatttgcttttgagcctaggatttatacagtatgtattgtttttgtgtttggccttttttgctcaatgttatgtttgtgagattcagctgttttattgtgtcttcatcctgttctgatacgagtaacctgagaaatcctataactcaacctgatttgtaccttgagatctcaacacttagacatttttctcatggcattcatggttttcaagaactcctaggaggggacatcaaataaaagccttctttgttttaaactctgtggtagacctttttttgtgttttaatgaccttttttgtgttttattgctatttgggtaaatagtagattttaaaatttatgtcactgatggcttatgcagtacctcagctgcttttttttttttttcctacttaaaaattttgttttaaaaactatggtacaggattcctggccagctaatggctttttggacttttatgacttggtagcttgcttttcattctttgaattcctcaagcagtgattcccattctaatttttatgataccatgtagtatcttcagttatttcaaagcatgttgtgagcctccccaccaagaaaaagattccaatttaagtttaagccactttactttcaaaatacttaacatttatgaacagtacaacttttatatttatgaacagtacaacattgtggtgtgtagattataaaatcaaataggctggtaaaaaattgggaatcagctaagagacttacctgcttattaacccc

SEQ ID NO: 3971 - DNA, 1044 bp, Homo sapiens
aaactattaacagtgataatataataatactgatttattctcacttgagttttttccttaaggtctgacaccatgccaatttccacagacctgtaactttaagttaccttaagctgggcctggtggctcacgcctgtaatacaagcactttgggaggccgaggtgggaggattgcttgagaccagcaacaacatagtcagaccacgtttctaccaaaaaagaaaaaaaattagcctggtagtgcacgcctgtagtaccagctacttgggaggctgagaagggaggattgcttgaacccagaaggttgagactgcagtgagctgtgattgcaccattgcactccagcctgggcaacagagtgagtgagaccctgtgtcaaaaataaaataaaaacacctaaatttcatatgaaaattcagtttggagtcacctacaagaaatagttgctagaagagtttcatttttatagtagtatttactagagatttggtatatactctggtgcaaatttctgtagttaatgctctgataaccactataattgtactctgaaaaccactctcagtaaatatttcccaaagtccaaagtcttgattattttgtttgaccctttcgttctcacctttctgtttttcttttcagctgatttttctcatttatgtaggtaatttttgtcttattagagaggagtgagttgactaacttgccttgaggagaatatcactttgtgattaatcaaactattcagatattattattactgttgttttggaacttcagtatatttgtaagttagaggcagtaattcagctgacatttattgctaatgacctcagccatttgaaacataacagcaatcctggacataaaaaaatctctaagccttcaaaatgactgcaaccaagtataataagccattagcctttattaggaaactactaattggaattagtccacagataaaaatcttcagtgttggccattggagttagggacattggcagctgaaatgtcatctacaggggaaaaggaagaactattaaa

SEQ ID NO: 3972 - DNA, 1031 bp, Homo sapiens
ccaccacctgcaaaagcatatgcacccctcagccaggtccttctccccacgcagtgatagttccaccctgtcccactcactggaagtccgggagccgtgctcgcgcagacctgatgattccattggataccgttcctcttactttaagatgttcttgtcagtttttcccttcttgccattttctaaagtattccagaccggttaactattgtgtcgcgttttctgctgcagtacctgactccagtctcctgaaacagaactcctcccatctattttctctgggtgtcatttactcatcaccctgacttcgtattttcagtaacttttggcagtatttggagggcccattatgtctctgacaacacctgtggtcagaataaaatcctgcttttcatcattttgtacgtgcctattaactcagttatcggtagggttttaattactactgtgttactgaggttgccatctttgaagtttagggatggttgttttaggttatatatttaaggtaacagactgtttcatgtgatttttttttttttttttttgagacggagtctcgctcttgtcgcctaggctggagtgtagtggggcgatctcggctcattgcaacctccgcctcccgggttcaagcgattctcctgcctcagcctctcgagtatcgagtagctgggattacagtcgcgcttcaccacgcccggctaatttttgtgtttttagtagagacggggtttcaccatgttggccaggctggtctcaaactcctgacctcaagtgatccacctgccttggcctctcaaagtgctgggatttcagcactgtacaggcgtgagccaccgcgcccggcctcaggtcaactttttagtaaagagcaaactcataaattttggcatcagagtttgagctttatttttcttaaatgagtttgaaatcaatttaatatttctctccaattccctaatgtctcagaagtgaatttacagtatacctttgttttttcgtattcttaagtagtatttggattttattta

SEQ ID NO: 3973 - DNA, 1030 bp, Homo sapiens
caagttttagatattagatgactgttttttttcccccttgtagcttaacagagcgttccaaaaagaggactctccagctactttttattgcatcagtatgcagtggtttagagaatgggaaagttttgtgaagggtaaagatggaggtaagtggttgactgaaaaatttttttttggtaaattatttgtttttttgtttgacaagtatttcttgaatatctgtgtgcacttgggattacactattgaacagaagagaaaaagatcctgtcctcagggatcttacgttctagtttatattctgttggttgtaaattttgttaaacttattttatgaattatagcaggaataagaggactgaacaaagtaaatctgtgatcttaatgttgaaaaaattttagaaatctttataaggaataagaggttgcttaaagtatggtttattcaatacagtggacttttaaagtaaaattgtatgacaatatttaataatatgaaaataagatattctgatatgtgccaggcacggtggctcacgcccataatcccaaaagtttgggaggctgacgtgggtggatcacctgacgtcaggagttcaagaccagcctgaaacatagtgaaaccctgtctctactaaaaatacaaaaattagctgggtgtggtggcagtcacctgtaatcccagctactcaggaggctgaggcaggagaattgcttgaatccacgaggcggaggctgcagtgaactgagatcatgccactgtactccagcctgggtgacagagcaagactttgtctttaaaaaaaaaaaaaaaaaaaagattctgatatgtgaaaaaggctgcaacaatatgcctagttaaagctttttgtatttatgtatttactttttaaaattttaaattaatagagacaaggtcttaaccctgttgcccaggtttaagtacagcagcatgattatggctcactgcagccctgaactctcagcccatgcgatcctcctacctccatctcctgagtagttgggactaca

SEQ ID NO: 3974 - DNA, 1005 bp, Homo sapiens
ttttatattactttgagaattttattaagaggatttatttttactgggtatttggccactgacttaaatgttagaaacaaacttcctagaacattaattcttaaatttttcatgctttaggtatggtggaggaccagctgtcaaccatctgtacatttgtcatacttgccaaattgaggcggagaaaattgaaaaaagaagaaaaactgaattggaaatttttattcgggtaaaaaagtgatgcttttcaaattgatctaggataaagatgaagacctgacaattatcagagttatatgatattaataaaatgattagatgaaagagttgtaatagatttcaagtgttctaggtgcataatggtgaatgacctcaggcagttcactacagttctgttgagttatgttctccctttgtgtgtgtgtgtgtgtgtgtgtgtgtgtgtgtatgagacaaaatcttgctctgtcgcccaggctggagtgcagtggtgcaatctcggctcacagcaacctctgcctcctaggttcaagcaattctcctgcctcagcttcccaagtagctggaactacaggcatgccccaccacgctaggctaatttttgtatttttagtagagacagggttttgccatgttggccatgctggtctcgaactcctgacctcatgtgatttgctgtcttggccccacaaagtactgggattataggcatgagccactgctcctggcccctttgtgggtttttgcttttatggattgacaatactttttttttttttaatgtattggcactggcagaaatcttattgaaatggaaaattacaggtttccttaagttagtgttgtctgtagtctatccagactgcatgtactactttgattcttttgtgagatataatattcttttgtttttttgagggactcctgggcttataaatatactcacttttcacaaactgagcatattatgaggtgtcccttaattgtaagcaacagaaagtgtgg

SEQ ID NO: 3975 - DNA, 1019 bp, Homo sapiens
atggtttcagaaattcacccttcctttttaattgtaggtaatctctagcttctttattgaacatatatttactgagtacatgctttctaaactttttgctagtgcctaaggacactaaaaatcctttttcttctgtgaaagctctaatttcatagtagagtaagatacataaacagctgtttacattacagtgagctcctctattatacatcatttttcctacctgaggcattcctgtgctggtgattttatctatcgactatattggtggttcttaaccccattgtctaaatgaatagctggcttttttcccaagtatggaaatgtatctgggatttaagaaaaaaaagcctcataattaaatataactttggcccttgtgagattggctgtgttaatgtttatttctacaataaataggacctttgtgtgatgccaattaaacttcaaggttgaagatgggatattcatggtaattatgtttgtagtgaaaccagaagggatagggatacctgtattggacatagaaattttaaggtgtatgttcatcttgaggaaacacaatcaccaaaaatgctttataattaccgttcttgggagagagagtgtaagaataatgattgagctgggtgcagtggctcacacctgtaatctcattgtctcaggaggctgaggcaggaggactccttgagccctagagtttgaggttgcagtgagccatggtcatgctgctgcactccagcctgggtgacagagtgagaccttgactcaaaaaaatggccagacacaatggctcatgcctctaagctcagcactttgggaggccaaagcaggaggatcacttgaggtcatgagtttgagaccagcctgggcaacataatgagagcctgtttctacaaaaaaaaaaaaaaaaaaaagaaaagttagctgggtgtgttgaagcatgcctgtagtcccagctactcaggacgctggggtgggaggatgccttgagcccaggaattttgaggctgctgtga

SEQ ID NO: 3976 - DNA, 1018 bp, Homo sapiens
cagaaaggtttatcctagtaataatagagattagctgttttgtgaaacaaatgtgaggtaaaaatttgacaaatttaataggcttattaagatgtgagagagtatattttgagggatgaaatctgtatgtgattttgcataaaacgttttcctaaataaggcaatattttcttctgaattaccattttaacaggctagattcaggaagtgaaaggtacaaagtttcatatccacataaaattcctaaaggttataccgacttcgatgttatctgctgttaacaatggcatacgagaaagacagctaaagtctgattttgtttacatctactaccagctgcctttttctgtcttgtaatcaatttagacttttaatgcttcttagtggtaagtcagaaaaaagtgttggaagacttggtgaaaagcaactatttgtgaggcaaagtgaactggaaatttcttctcaatctctgtaataggaatgcaacggcttgctaataagatctgggataatacagacttctagttcttggcagtaacctaaaggaaacattgatctgcaactgatcatgacatgacagaaaggaatggtatactatttggttgataaagatgaaaaagctgacttctacttttggagaaagtatcactttgttcttgaagccctagctgactgctgaaaaggaagttggcttggaaggggattgttccttgtaaagcaaagcatactaagaaaaagataacagtgaagatggaaaagaaccttgcatctacctccatattcaaagtagagatctgtcaaatgtatattaattttgattatataataataaccatcctttatctttttttccacatgtaagaataaaggtttttttttttttttttttttttttttttcatttgagacatagtctcattctgtcgccaaggctgaagattcagtagcatgattacagctctttgcaggctcagcttcctgggcacaagcgatcctcctgcctcagcctctcaagtag

SEQ ID NO: 3977 - DNA, 1031 bp, Homo sapiens
gagaaaaaaacagcacaagaaatacagaagtgttatttcagacatatttgatggaacaatcattagttcagtgcagtgtctgacttgtgacagggtgagtatgagggtattagaatacacagaaaattcgtgtcaaatgatttttaaaaatgtgacaagatgatgtgaaaagtttaattccttctctttgctattgatgagcatacatgcatttattgtgtttacatcaacacaaatttgattctaggtgtagaattttttttggaagtagcagcatcctgtttaaaggatggtgacccatcattggacaggcacatattatccttcgtcatctattttggttacatataaaggtgagaagttgctcagcaacaagaattggtaacacctgcatattctcccaggctgatgaaatttgtatactgggaatctgttgatattcacaggtacaaagctgtgaatgtatctcttacatttggtcatatatggtttgtaaatatttttccatgtttaggatgggactcagatactaaaggtagtatcaaattcatagacaataacaaagcatacattaaaatcatcatgaattttttaataacacttcttcaaagtttctttgagcttttcttaagtacagttttactttagtgcaatgatgaatatgaaataacatctcaaaaacaaaaagaagatttcaattattgtgttagaatctcaagtcaaatctaagaactttcaatcgggtcgttttaatgtaggttattttggtactaaatatttaagtggaattatcaggcatgtttttagctatttaaaattagatgccagattttgtctcacccttttaaaaaaatattttaaaactaccatcaaaggtcaattttcaaaaataaatacaatagtgcttaagagtttggacctcaagatgcagtggctggatttggggtgtttaatgctgcagtgtctgtgattgtaatggggatgctaatactactgcacaggacttacgtgaagatacctggtacagagca

SEQ ID NO: 3978 - DNA, 1067 bp, Homo sapiens
ttctagtaaaagagaaataaaaagattagcactacatttctttttctgtgttgtggttttgaatgaaaattaagaatgattaggtaagtattataggactttgtgggatcttcaaatcctcacagaggtttgaatgattttattctcagaatatttgtttaaagggaaagaaacagttatttaaaatgcttgtcagctgatttcttttgtgaaaagtctccctgagcacttactatggattgagaataaaataaacttttctgcttgttgttgcactcttcattgataacttccttccattcatcagtttttttggcttgcttttattgggtagcaattttcttccatgataaatatggaaagataagccataagcttattccttcattgtatttttgctaaagtgtaatatttcatatggtactgctggactagtactcgtggaaccatagtctagattgaaactgttgaaagacaaatcaatttttttataatcatagaatcttaattcaattctgagtttttagtgcaaagtgcttgctgtcctttgaagcacctctgacagttacccaacctctgtgtaacaattatggggaacatgctccttccatgaaagttcatctgtatttgaaccgaagtcttcaccgttgattgaatatgctgttctgactttctcaagttgcacagaaaagaaaggatccctttggtcatcatgttcaattggaacatgtgtatcaagtcctggcatcttttgccttctgctgtttaaacatccatgctttcagttcgtaatggttgacatttactgagtacttactatatcaccctcttctaagtattttatatatactaatatataatatgtaattatatattaacgtattatgtgtaattatataattagtttaaaatattatatattaatcttctccaaaactctagaaagtagatatttgtaattagatcagtgttttagatgagggagctaaggcaaagagaagaaacttaccactggtcccaaatctaggagatagtggagccttgctccagaaactttactcttagta

SEQ ID NO: 3979 - DNA, 2528 bp, Homo sapiens
ttgatcacttttcattttaaagtgctattcacttgatcttaaatgttccatgaactgttaaatttcttaagttacatagttactacaccacatttatgtgtatgttatgttttaatagtcaatgataggtatgtacaattgataatataaaggggctcattgaaacttgagagcctgttgagttttggttagttgtagattgcatttttataaaaaaaaatacagatagattgatgataatagatattggggcattgtttctgtctcatgagaattcttttattcattaccataagccttcactgatactataagcattattttaaatgacgctgatcttaagtctgaaataaatggaaagcagaaaaggtgagccagttgatttgaatgcattggatattagtgttagaaacaatgtatagtttagattgaaactgaactgacttatttagcacttaaacaaaaatttgacaatgtttttagttttttttaagacagcttagtgtggtgatacttagaattctatggtttgatgtttcttttagaaatgagaagtatagttttattttttaatataaaaaatggttttaatactaaaactagtaatttgatactagttgtttataaacattgtaaaatatatcttttaaacaaattatcttggtagttaattcataagggtgggtttgggtaggaatagcagagtactttcagagggaaaggggagtcattcagaagtgatagcattttatttgtttgaatactctgccagtaaaatcagctgtacttagaaagttatctgttgtgtagaataatgatgtagagtttactaatcagtgaggatgtcttgtttttattttctgcaaactctgcctcactttaaaatgcattataacaatacctaattaaagataattttggctctgaaagttaccttattttttgttgagttagtgacttcatttttcttgccacaatataagcttttgagggatttttttaaattggtgcttttaataagcaaataaatcccagggttttattttcttcagtgatacccctatagaaactcttaaatgtatttgcgcatatatatatatatattttcttatgcatgctcgatgcattttcgtcctgagaaaaatgttctctacagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattataaaggagtgctttgtgttttttatacatatattacatggtaaaattttctacttgactgggtttttttttatgtttactgtgagaaaaaatgattttaaaaagttttaatgataaaagggtaacatctggttgcacaagtcttaaaatacagaaagacttttaaatacagaagttactttatttgggttcacgttgtaaaataaaattgtcttccagaaaattaaaatataaaacaacttaatagaacgtaatagctaattatttacaaactcattttaaagactagaattttaaatcgaaggttgtgccactttttccctaagtctgatacacttagatcttgaagccttcgactatgttgaaagtgttttctcttgcgtgaactattaatagaaagttttttcattaaaatataatttgttcaggcaagatcacaacataaatttgctttataaatttaatatatattacatacgtttgaaaaataacatgtttaatatcctcaacactcaacactgtatagccattctttaagtcctttaatttttgtttttctccatgctcctccccttttcctctgaaaggagtgacagttttccccaccccgctccaatcccaatatatctgcttcagaaagactttgaaactacaacaaccaaaatggtgtactactaaagaaaaagtccactcaaattgataggttccaaattaattatctcagctatttcagcctaattttaggtgtaaaaagctcagaaatgacattccttcatgcaaaataatgtattctacttaggtttgtgtgttttttttttgtttttgttttttaaacatagttgctgtaaacgtctatgggaaatacagtctttataataggttctgatagaataattgagtaattcccccccataagtacattttattgactgttactgcataataggcgataaatctgatgcttatttggaaaagaagtaggcattctttagatgagctgtgctttgaagactgttatgaaaaggaataagaagtcagcatagtggcactcctggtttccttttttggccccgccacagaaaagatggatgtagtaagaaagttggagtgaaagagaaagttccagggagaggggaggggagctagtagtcatcagct

SEQ ID NO: 3980 - DNA, 1026 bp, Homo sapiens
tcagtgtaaaatatgcatatcttctatatttaatatgaaagtcttgaaatgtatcagacagaaggggatttcagtttgcaaataatgagcaatgtagcaattttaacacatttcataaatatatattttgtcattggtggagagcaccatttgttgttttgaatatactttaaaggaagaggtacaaggacataaatgttgagattacctacaggatggaaatagcagtacagttcattgtagatattttgaaatgtttttgattgttttatataacctagagtgacttcccttacccttatttagatctgcatatatagttctagtatgaagtttaatagttaaggagttagctatttgttatctttaagagtagggtattgacgtgaacaattgcagtattttgcatgatactgttttatagatgaccttttaggaaagtggtgcatttattaattgaactgaagaagtagttcagttgaattcagtatcataattcacaaattggaggctgttgattttgattcatttaaggtttaaaatctttattaattgcaaacagtgcaattatttatacttcacagtgccttcccagaccttccaccttaggttctgctgcaaaaagcaccaggtaagcacaacctaaggacatatataaataaatatttcaatacattaatgttgtccctgtgaggtttttgtggttgtgtattcaaaggcaatctgctactgcttccccaaaatgtattttgttattttatgctaccatcttagtggaaagtctgtaagttgttaaagcaactgtttacatttctgggtaatgttttttattttacttttttttttttattaagacaagaaaatgatgagtagattgctgcagtaattgaactacatccaaatctttttgtattttttccccaaatatagaagtgttaatattaagaaaggacaattacacagttttcaagatttaggaaatcacttgtttagaaacttcaacagccttcacaatctgttttatat

SEQ ID NO: 3981 - DNA, 1140 bp, Homo sapiens
agcagcctattatgcccagacaagtccccagggaatgccacagcatcctccagcacctcaggtataatgtaattgctaatttgttgatttctactccagtctgttttctgcatgtttactgtttgtctgtttgggagtgtttgccttttaaatttttatctggcaaagtataataactatttaaatgaagtactacggtgtattgtttgggtttttttgttttttataatgctttccagcatctgagtggtgaatatttctgcaatgcctttgattttaaaaataaattttcttcccccagggatttgcaaatcatgcaagaagccaccaccatttatattaaccactttttctttcttaaaggattcactcctgaattagctccatttcaaggattttctttaactttttgtgtatttcttatgtatctcttctgcacagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttca

SEQ ID NO: 3982 - DNA, 2042 bp, Homo sapiens
ggttatatggcaaggaaatttttttttctaattgcatttgtcaaccagttattaattgaaactagaaatgtccttactggtacatacaatattaacattactatacttttgacaatgacagttatatatattatcagtctaaatgacataaggttaaattttaatgtgtcaggcgaaaattgtgtgtgataccattatttttgctgcaagataagcaggtaagaagtaatctgcagtgacggaaagtaaccaagtgatggaaccagaatctggcttccaagagggtctgagtcccaagcttgtctcccaaatttgtctctttaggaaccatttggaacctgatactatacttctggacaaatcactatatttcagctgcttttgctcttagtcatttaaaattattacataccacagctagatgtcacaaatgaaagctaaattggtaagcttggttatccttcactagcagaaaaagaacctataggtggtagagttttgtcataagagaacggtctacttgggattttcaatgttttctttgccaaagaatgtttctcattctccacagaaagaaaaatttccagaaaggtgatgattttaatcttctagatgtaaaattacatatacctgatgataaagttgttttgcacaactggtttctttttaaagaaaaattgtttttcctcttagaatggcttcctaggagagtcatgttccgtctctttctgaggctttaacagattatgtttttgtgacctagcttaggcagatctacagtagctacaattcggcaaaaagaaacttttaacttaaaaacagcatactctgattaaggttggttacataatttattttctgaactgggatcctttttagaatgaatagggatgctattaataatcatgccctgacagcattgtggtcaggacctgtaatcaacttaactttaattaaatagcatcaccattttaaaagacttgagcatgagccacgtgcggtggcacacacttgtagtcccagctgcttgggaggctaaggtggaaggattccttgaacacaggagattgaggccagccttggcatcatagtgagacctggtcacgtgtttgggttaaaaatcactaacttcaacttctattttctcaatgggtaatgtcccctagatagggtccctagttattattaagtaggtaaaaataaaggcttgttaatggatttaggtaattatggaggaatgagtttggcttctgtgctttattttaccatattgattatttgtaatatggccattaatacatttactgtttagtcttttttgttttactttttatgttttactcaaaatgagtgggtgggtggaattctaatttttattgttaagggaagacattttaccttgtctttaattttttatttttttttaccatttccctgccagttagagatactatactatactgtcttgaatcctctgtaggaaaacatggcatagaaataattaaataataattagatgttaaataataatgctgtatgactaaagaacctccttaccccaccttttctgttgttgttctgtagtaccacaataatcacttgttaattttatttatttatttatttgagagggagtctcactctcgcccaggctggagtgcggtggcgcaatctcagctcactgcaacctccgcctcccaggttcaagcgattctccggcctcatactcccaagtagctgggattacaggcgcctgctaccacatccggctgattttttgtatatttagtagatacgggctttcatcatgttggccaagctggtctcaaactcctgacctcaggtgatccacctgcctcagccttccaaagtgttgggattatgggtgtgagccactgcacccagcctcacctgttaattttatgagcaaaacagattagttgggcaagtccttcacatgcatatctcgttgttgttgttttttttaagacggagtcttggtcttactccccaagcaatggtgcgatttcgtctcagtgcaa

SEQ ID NO: 3983 - DNA, 1092 bp, Homo sapiens
gaatttaattttattgtgccaactgggaaaactggattaataataggaaaaggcaatgtattttaaactcttaatgttttaacacattattcatttttctggacactttctgttgctgtcgtaaacaagtggcaatgctttttctctgaccgtattttagtagaaaagaattcttatgttaatatgtaacaagtaaaacataaatgagggatctcatgtatatttagagaaagagcaggattttaatcttactagcttctagagaaagcgaactaagagataattattagcataagaaatgtcttttgacccaaaaagtggtttgagtgtttttgtttgtgcattttggtttttcccgactcatattttaaaaatttgaatgtttataagtgtattagtttatatttacactgcttttaaaagcagttaattcaaatattttattataatcacattaagtttatgtttaaacatactaagtaaatgtaaatgtattttaagagaagcatgaaatgcttcctaaaatttgattttcagtgtagaatattaaatgaaaaatcttaatacaatattgtcaattaggatactgaccaaaccatatttttaatggcccatttaattgtgaccattttcttctaaatagctcctagtacacccttgaaacctttagagaaattactgtcttttgattttaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtgtgagtatactttaaacttttaatttttagtgtagacccttagactgtagttaaattaagacgtttattcaaatacatcaaaggaaaatgtatcattactagtcagcatttatagatttcatgatatgtataatagatacaacgtgaagattttccagcaatgaaaataacctaattaaatgtgtagttacaggttttgagaacaaccttacatttgggtgtggctagataagagg

SEQ ID NO: 3984 - DNA, 1050 bp, Homo sapiens
accagattgttgaaaaaggaagaccagctcctggcttccatcatggcgatggaccgggaaatgcagttcaagaaatcatgattccagctagcaaggcaggattagtcattggaaaagggggagaaactattaaacagcttcaggtattgttatttttgtgaaatggctacttttgatctgttttgatgcccatttttgtccacttcttttgttaatatatattatttctatgattgtaacaggaacgggctggagttaaaatggttatgattcaagacgggccgcagaacactggtgctgacaaacctcttaggattacaggagacccatataaagttcaagtaaacttaactttatactttataaagaaagagtgggttgaatggggttgggcaaaatatgcatgaataattaaaatgttttgagacatgctttctaaattagctaactttttctgctttagcaagccaaggaaatggtgttagagttaattcgtgatcaaggcggtttcagagaagttcggaatgagtatgggtcaagaataggaggaaatgaagggatagatgtaagtaaaaatacccattcagaaatggttgtatgctaattcataaatataatagtgttttctgttttgtgttaagtagctctaacattgttatccttttatttcacctttatactttagaatacagaattctatatatcttgttaccctatttactataaatatagaattatatgtacttttatgatttgaggcagattttcaggaaatggcgcttttttaaaatacttttttttactttaaaccctgagaagctagctttcttaatacttagtcttttttacataaggtccccattccaagatttgctgttggcattgtaataggaagaaatggagagatgatcaaaaaaatacaaaatgatgctggtgttcgcattcagtttaagccaggtgagtacatataataatcttgtaagtgttggcagcagtgagttttgacatacatttattgtttaattaattttgtttctttgttttgaagat

SEQ ID NO: 3985 - DNA, 1520 bp, Homo sapiens
aatttaaattttgaatttttgttttatttttatttaattttttgatagcttttggaacacagttaccaccgatgcatcagcagcaaaggtatagtcacaagattttcaaaaagtactctgcaagttttggttgagctgtatgtaaaaacacaaccacattggtgtatattgaatatgtgtctgtgtattttttggtgtacctagttcatatcactccccttgggaaggtaccataaagtgatgatttttcttttgagtgagaaaaatttgtgatttggagagataggtggaattaaccacattttagaagaacaggggtgaattagagtaactgttaagatgacattctctaaactccacttcaacttctttacagttaatgccttcagactgttccattcatcatcccttcttcacttgatgtgtcatcttaaatttcttaatttaactactcaagtaataagatcatattttttgacatgagtctgagcctagaaccttagtttaagccattgggagacattagacttccatttttattaatagattatcttttatttgtaaacaaagtatctttcattgaaggaaaatggtgctttctgttatttcttagcagatctgtaatgacagaagaatacaaagttccagatggaatggttggattcagtaagtaacttgatttttaaagttttgaaaacatgatcaaaacatactttagaatctttcaaccaaaaaaaaaatttttttttttctaactagtaattggcagaggaggtgaacagatctcacgcatacaacaggaatctggatgcaaaatacagatagctcctggtaatgttacattctcatggtattttcagtgtgactagaaaactagcttttttttttttttaagccttctagtaacaataatgctacttttaatcttttgacctgaagttatctgtttgttttaaattgtagacagtggtggccttccagaaaggtcctgtatgttaactggaacacctgaatctgtccagtaagtttgaaaaatcttaaaaatctacttaagtaacaacagcagaactctttgaattttgtctcttctctttgttactgctttattttacactgtggtttcgctgccaccttccctcaaagtcctccaactcctttgaagtttatgcctcatgcctttctcaggtggggttcatcatctgaatcattaaacacagaaaatggttaaaacaactccatatctactccagtctctacttgtaaagccacgtgtagcctggagaagaatgcacagtcaggtcgactggtgacacttaaaactcagacattaagctcaagtggactgttgtgttgcctgcatttccctagttccattcacttttccactcctctcccaggctctttaatactgtatttccccacctccaaatcttcagcatctaaccccacgctctcccacttaagcttatttactgagaaaatggaagcaaatgataagaagcttttctttttccctacca

SEQ ID NO: 3986 - DNA, 1034 bp, Homo sapiens
tgttttttattttttttgttttgttttgtttgtaacagtcttgctctgtcatccaagaggggcatgatattggtgcactgcaacctccacctcctgggttcaagtgattctcgtgcctcagcctcccgagtagctgggactatgggcgtgcaccaccacacctggctaatttttgtatttagtagagatggagtttcatcatgttgcccaggctgctctcgaactcctgagctcaagcaatctacccacctccacctcccaaagtgctaagattacaggcatgagccaccatgacagcaaagctgggtatttcttaaattggttcagtcaggtgcaataaattatttgccctactctaaaatttaaaaatcttctaagaattatggttttgcagctgaggtttttttaagactcgagctccctggactcctacatatatccttagaacaacattgtccaatagaagtacaatgtgagccacatgttttgtttaacccagcatatccaaaatattaccccctttgcatgtgcttaatataaaaatttaagatgatttatattccaggttttcaatattcagtgagtaattttacacttagagcaagtatcatttcagactagtcacattttgagtactcaataaccacatatggctagtggctaccttactagatagcatagcctttgagtcccacaaagtgttcacattctatgtgtttacacacatcttttgaagtgtcatgacagagccagataggatccagattttctttaaatctggtctctcttccggattcctagttgattacttctttgttgcttcttatagggatgtatcagaagtttaataatcttatgattattatgttaactgcctgaagtattaatggtagcaataaattgaactataattttaatttttcaagtaaattttcttatgtgatactaaatatttcacatatacatgtatcaggaagtaaatgggggtaatttagtaatgaatagtatataatagtttatgatggtatttttct

SEQ ID NO: 3987 - DNA, 1085 bp, Homo sapiens
ggctcacgcctgtagtcccagcactttgggaggctgaggcaggcagatcacttgaagtcggagtttaagaccagcctggccaacatggtgaaaccccatctttacaaaaaatacaaaaagtagccgggcttggtggcctgtgcctgtagtcctagctacttgggaggctgaggcacaagaaccgcttcaacctgggaagtggaggttgcagtgagtggagatcacgctgctgcactccagcctggtcatagagcgagaccctgtctcaaaaaaaaaaaaattggattttattattaggctaagccataatttctttatacttcttaaaatatagaaattgttggcaaattgtgaaatttattgttgtataatgctaatagatcagttgtcctgatgtctttgctgtaatgatttctttataaaaatgatcttaaatctgagctccctaactttagtttttgcctggaattacccattacatttgatgatatctctaaatgtcagttgtagctgttactctgatgatataagtggaatatacagaagcgtacttagacaaaagttaggttaatatctgaactacttcctccttgtgtatttaagagaatattgacttaagtttctagaatcctcaactaatcctaagtttattttctttgtctagaatactatgctgtttttgtttttggaaggaagagatataggcatagtttcctgctctcaaggagcttcaaaggctgtaccagtggggatgccattggtatttttagctggatagttgttattcagaaaagcaggacaagtaattatgattcctggtccgtacctggtaatgccagtaatgttaactctagctggttgttgacatctggtcatttagttgccaatcttctttttttttttctggcttttatgtgaaatttttagatttttataatatcctgagctaaattcaacacagggacaccagattgctgctttagttcagggtttccagcctgtgcacttaagaaatttatttttgtgtatatcaagctgtaactccagagattgggattgtttgattgggtctttagcagtggtac

SEQ ID NO: 3988 - DNA, 1354 bp, Homo sapiens
catcaccgcgcggcgtctcggacgcacttctcctggcgccctccgggcggcagcgctctcgagacactgttgcttcgccgtcacgcccgtcgttgtcacgcccttccccgcggacaccgagaatgacccatagcggaaaattctaccgcactacctccctgaggcagcgaccggtaagaaacaaccttttcttcaggcttcccaccacccaaacacagtcgcagtcaactggccactatcacccaccaccctgcaggaacaattacccagcctcaccccaagaacgcgcggagaggaggtgccaaaagaaattctgttctcgcgaagtcttaaacttaatcctcgcgacgtctctgttcctgtcgttctttctcagccctaacccacaccagcgcgttgcctcggaaacatcgcgagattttgttccttcagtctccgcccctttacggcacgatggtcgcgcaagaatgtaatagagcttcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcaggtaagtgtggaccgcgcggcggaatcccgaaagctcacggtaattggccgctgactgagtaggccgctacccttaagcgcatgaggaagaggaaagaggtgttcttccgggctgaaatgtgaagagacacgtttccccatgttggtaataacgattagagaccagaacccagttttgtgttcttggtgcctaatccacttagaaccccgacgcgtgctacgcaaagaaggcctgaagtctttctcccgcttctgcggcactcgcgtgtctccagtgagctagtttagataaagatcctcttccaggggataaagcgcagttagtttcacacaatttaatggaaggttctggtaatgagtttgggaaagaactagggtctgtcctggagccatagcaagggaagggatttatcattaaagtagcctttacagctcatttccgttctctctcgcaattaaaaccgctttcagtaccattcaccgtcacacctctacaaggaagggacttgaaagcagcctttttctgggcgggatttacgtgtcagtctgttccaccagtccgccccccttatttctcaaaatggcctcaggcccattataccagaggtttcaatttgaatctgcctctcagttcagagtcgtaaactgaccagacctctttgtattacgt

SEQ ID NO: 3989 - DNA, 1147 bp, Homo sapiens
tagtcccagctactgaggaggctgaggcaggagaatggcgtgaacccaagaggcagagcttacagtgagccaagattgcaccactgcactccagcctgggccacaggagagactctgtctcaaaaaaaaaataaataaataaattaaataaataaataaataaatataaaaataaaaaaagtaaataaaataaaatattggtgatattgttgcttatattacttggcttcaagtccttggagttctatgaagccacatttggaaacctctgtcacagtggcaaaatgttgtatttattcttacatcaacttgtaaggtagctaatggctacaggtgttattaattacaaaagaattcggacttgctcagttacttcgataggagcatggtcgcaaaatcagatctaatcaattccagagacaatgctttgaaggtttagcacttcttgttttgatcattgagatatttaatcctatattcttattttcttagaatgctaaagaagcatatagatagatttaagtggtaaacaattttaatgctgttgatatctccctagaaattttttatctttaattacaatagaagggggataagaaggcaccaacatttacttagctccagttatgtgccaggtactctgcataacttaattgacatttattcattccttaaccaatatttttcaacagctggcacattacaaaaaagtgcactcttgtgataagcaaaaatagacatgctccctacattcatgaaaggtacatattccagtgttagacactaaccaaattcataattgtaaacaatgctaggaagaaataatacataattttatcctcaacaatcctttaaagaagtacactgtcccctattcataaattaggaggttaaagagcttgtccaaatctacaaggctagtaaaggtcagcatggctgccaggtatggctcagcaagtgttgcctgaaacccttctgagggcagggggcattattcacatccactataatgtagctgaggcttctagagttttgaagtgtatcacccgcacaatcataagtgtggccttaagtgagagcggaatcagccctcagtttctccatttgtccctaattattgtagtttctcagggtaattaaatttgaa

SEQ ID NO: 3990 - DNA, 1086 bp, Homo sapiens
acttttttttcatatgtttgttggctgcataaatgtcttcttttgagaaatgtctgttcatatccctcacccattttttgatggggttgttggttttttcttgtaaatttgtttaagttccttgtagattctgaatattagccctttgtcagatgggtagattgcaaaaatgttctcccattctgtaggttgcctgttcactctgatgatagtttcttttgccttgcagaagctctttagtttaattagatcccatttgtctattttggcttttgttgccattgcatttggtgttttagtcatgaagcatttgcctatgcctatgtcctgaatggtattgcctaggttttcttctagggtttttatggttttaggtcttacaattaagtctttaatccatcttgagttaatttatataaggtgtaaggaaggggtccagtttcagttttctgcatatggctagccagttttcccaaagccatttattaaatagggaatcctttccccgtttcttgtctttgtcaggtttgtcaaagatcagataattgtaggtgtttggtattatttctgaggcttctgttctgttccactggtctatatatctgttttggtaccagtaccatgctgttttggttactgtggccttgtagtatagtttgaagtcaggtagtgtgatgcctccagctttgttctttttgcttaggattgttttggctatacgggctcttttttggttccatatgaaatttaaagtagttttttccaattctgtgaagaaagtcaatggtagcttgatggggatagcattgaatctctaaattactttggggagtatggccattttcacgatattgattcttcctatccatgagcatggaatgtttttccatttatttgtgtcctctattatttccttgagcaggggtttgtagttctccttgaagaggtccttcacatccttataggttgtattcctaggtattttattctctttgtagcaattgtgaatgggagttcactcatgacttggctctctgtcttttcttggtgcataggaatgcttgtacgttttgcacattgattttg

SEQ ID NO: 3991 - DNA, 1024 bp, Homo sapiens
gtgatcttgtgtctccctgaccgaagacctctgatggtctgggcccaagaattattgctgtctctgcttaagggtagatatggatagattttattttatttctattccctacccctagatgcagtgagtcctcacttgtggttgatgccctttatttaaacagggtaaggcttgtgttctgtaggtaagataagggagtaggatcttgacagggttttgtatcttttctactagagcagttttgttttcccttcagcctgaaaccgaatagaggatttttcagctatctttccctgccccaaatatttctcatggatacttcgctgtggtccattgataagagcttgctagtaagtaaaaattaccctctgtatagacctgaagggtttggtacttttatactaattcatttttatgctagcctttagaaattcattgaaactttaattgaattacttttacggccttgcatagcatctggcatccatctcaaggaaacaagtccttgcatctgtgtctctttgaaggttcaaacttattgagatttttatttgtggttcagtataccatcaataaatttctacaagtagaaataaaacagacaacattatttcaccacaatacaaaagaacaaacagaaattattaagaaaacatgaaaataaaccaaaaaagctactcagcctataaaagtaaaaagtatctctgtgatggttaatgtcaagtgtcaatttgtctggattaagggatacccatatagctggtaaagctttattttgagacatgtccaaggtttttccagaagagatttgcatctgaatcagtgaactaagtaagaaagaccagctctcactcagtgtgggtgggcactatccaattggctgaggactcagacacaacagaaaaacagaaaaaaggcaaatgtatttggagctgggacatccatcttctcccatgcttgcacatcagaattccaggtcctccagccttgggactccaggatttataccagtcacctcccctca

SEQ ID NO: 3992 - DNA, 1049 bp, Homo sapiens
aatgctttctagaactatgcaatatttgaataatttctagaaatgtctaagaaacaaccttttttattttaaatcatcacttacaaacgtagtctgagactgcaaactagttttcacttgactaatccatcattatagattagttaccatttgctctatataatctattgaagaaactattgttattcatattttgattaattttactagcaacaaatttttattttagtagcattgcatttaccttaaatatgtaaaaatgaagttgtaacaggatcaaatatggaaatggcaatggtaactctgcctagaacatagttgaatgtccttggttgtcggtaagatgcaaagatctatacaaattttatcataggtcaaaattatttctaaatatacaaacagtttcaactatttctttctccctaaaactaaaaccaaaccaaacccaaatgaagaaacctaaacttcttttcatctaatagttatacccaactagataatagtagcttctagacatcaataaaaagatttcattttaactgtctttttaatttgtaaaatatatgagtatggaattttgtatctaacttgaaatttcagatgttttaataatccaaatacgttcttctttagcatgtcaaagtactaatagttaaaaaatttctttagatttaagcatatacattacttgactttttcaaaagtatcaaaaaattgatagctgcagaaatgccattatttgattttctaaaaaacattgattcattcttaaatgtgtattctttaaaaaatagtaaatacctcaagagtgacagaaaactttccttttctgttctgtaatgctaatttaaactttgagtcttagtttacatggtcataggggttaaataaaatgtataactgtacaattaattgtgttcttgtgacctgatgattttttgaaaatttgcttttctctttaagaaatttaagttttcaagggccgtattagttatctaaatattttgggctaatgttgacttataaataaataaaaatttagaaatata

SEQ ID NO: 3993 - DNA, 1057 bp, Homo sapiens
atttgtaaacatatgcttttagtctcaaggaaattcagaagaatataaattgttcaggatattccatcacaactgctgtgaaaacagaatctcacatggagggcatcagaattgatcctttttttttacttggatgacagaatgcaatttgagtacagattcaaataattttttaaaacattaggcttggggtcctcagagacaagaaaatataaaaagggttatatgtagaacaagtaaaagttcttttttctctaataaaaggaaaatccaatcattctgtgatggttttactgggttaataagaagaatctttttcctccataagtattctattacaatcattaaaatagaacctagaaaagacattcacaatcccatgaatccttgggtctgaaatacttgttaattagattaaattaaattaagttaaattgcctgtctgtcccttatttacaactaactcatgggctacaggcttgcagcatgagcatttaatgctaccctaccattgaacatttagcctcactggccttctctgacactagtctctgagtttacttaactttgagcattccttagtcttctcttatgatttctcttacactctgctccctacccatcattttctcactgtgttcttgcctcagccctcttttcttctgtgtcagtcttactcccttttgtggcatcatttttgagtctgacatgtatgtagcaatatggattggagtgcctctcgctagctttgacccactctggagctctagtccagcatttgcagctctctgctgaccatgtaccctggatgccctggtccgatagatactcaataaacatgtagtgagtgagtgagcaagtaaataaataaatgaatgaatggatggatagtgttctgttaacacttaaattcaatattgcccaagttgaattattttctccttcgatcatgttcctcctgggtttattatttttttctctgctaacaatatcaaatacctccaacccacaaaggttaaacctaatcactcatatgtatttactggatttttttttt

SEQ ID NO: 3994 - DNA, 1046 bp, Homo sapiens
gtaatcaaaaactgttccctatgtgtgataatttgtaaagaagcaacataaatagtatttgcctgaataattccctactccctactcccatccctgaggcagagttattgactcctacatgttaccttgccttatatgcctttagtgtacctatcacactgtttaatattaatagcctatgtatatattccttgggagcagagatgatactaatttatcttactatctccagtacctagcacagagtgtgtactctaaaaaaaatgtttttgatgtactaatatgtaaattagtacatattagggcaaggttgtttttttttttcactgatgaatccatagtccagaatagtgtctaacacttaataggtgctcagtagacatttgttgaatgaatgaaatcaatgaataagtaaatgaaggaatggagaaaatttaaatctttgtggcaaatatcagtagcccagagaaagaaaatatatgctagtttgaatagaaattatttttcctattatgtccaatttacagaatgatcaagtctcggcctctggattatacctttgttcctcgaacttggatctttcctgctgaatatactcaattccaaaattatgtgaaagaattgaagaaaaaacggaagcagaaaacttttatagtgaaaccagctaatggtgcaatgggtcatgggtaggtttgcttttatttggaatatataaaaataaaaaaaaatttgggagtggggagaataaatgtgcataattactcatgcgtgagtaccaatatgaaaaaataacgaaataggtttctaactattgtagttttggaaccaaatatttaatgatctctattcttttaaactctcccacaggcttcagtaattcaattaaaaatttaatcagcaggttgtgaggctttgaaaggagataacaaaatataaggggaaaaagctattctctgtttttttctaaaacataaaactcacatttataataatttcaataggcttggagagtaaaatcagttgctacagtagagctaaaactgact

SEQ ID NO: 3995 - DNA, 1044 bp, Homo sapiens
cgggaggcggaggttgcagtgagccaagattgtgccattgcactccagcctgggcagtaagagcaaaacttcgtgtcaaaaaaaaaaaaaaaaagtgggctaggtgcagtagctcatgcctgtaatctcagcactttggaaggctgaggcgaaaggataacttgaggctaggagtttgagaccagcctggtcaacatagtgagaccccatctctaaaataataaataaataaatacataaataaataaataaaaataataataaaagcctgttgtggtggtgtacacctgtagtcccagctacttgggaggttgaagcaggaggattgtggagcccaagagttcaagattacggtgagctatgattgtctctaaaaaacaatataaatgaataaaacaaaatacataaataaaatttttttaaagtgaaaagtaatatattgtaaattacatgtatttgcttctcagagcttgatgactatttctcttttctctcagctctcatgaattgattggttgtttgttttttaagacacgctctgctgccaggctgtagtgcagtggcatgaacacagctcactgcagccttgacctccctagctcaagctatcattccttcttagccacccaggtatctgggactacaggcaggcaccaccatgcctggctaatttttaaatttttgtggagatgttgctcaggctggtctcaaactcctggtctcaagtgatcctcctgcctaggcctcccaaagtattgggattatttataggcatgagccatggtgcctggctaattaaccgatttattaactcagtgtcttagcccgtgtgtgctgctataacaaaacgccacaaattggataacttataaacaatagaaatttatttctcaaatttctgaaggctgggaagtccacatcaaggtggtggcaggtttattgacggtgagggctgctgtttctgcttttaagatggtactttgttgctgcaccttctgaaggagatggatgctgtgttctcatggtggaagggatggaaaggtt

SEQ ID NO: 3996 - DNA, 1027 bp, Homo sapiens
tcaaaaatttgtatctgcataatgataaacattgtggtcatccagagccttgctactcaaagtgtggtctgtgaaccagcatacctaggagcttgtcagaaatgcagactctcaggctctacctcagacctaatgagtcagaatctgaacttgaacagtagtcccaggtgtgcacattacaatttaagaaacactaatgtagaactgacattaaatccaatctgaataatattcaaaacaaataagcattttaaattttgatgtttaaaagtggcatgtttcatttacttttattctctttcatatgagaaaaagcatgatttcatataagagaaagcatatatcaaatttggtttgggaaccaagtgctgaaatttaatgaaattaataatacaaaaatggacaaaatttcattcatgacctgatatttggaaatactactttttgcatatacaactgccttatttttataatttttaggaagtaatagatttctgactgttaattgtaatgacctctctgcaaataatgttaatgtgtgtggagagtgtttttgcctcaaagtaaaagcttacttggatatattttttgttacatttgttatttttctcttttttttggaagtgatagtagaaatgtctttcatccgataattacaatttagggatctggagaagattatcttgagacatatttgcaaaattgttactttaaaattttcttataacttgtttttcaatatcattgttcattatatctcttttctttaaacgattatcaatgaggataataatctatcttttagggttttgaaggtcagagttttatatgtataaacctcaaaaagtgcctggcacataggatgttttacataagtgatgatatcaaccccatccttctcttcctctttgttgtcttcttgctcttcctcattatcattgttacaatccatagcaagctcaggatagagtttaattatctactctgtgaagccaggggcagactggactcaatgtcttagtctgct

SEQ ID NO: 3997 - DNA, 1031 bp, Homo sapiens
aactgtggagataggaaaaagatcagtggttgccaggggttgggagggaatggggaaggatgaacagacagagtacagataatgtttaaggcactgaagataatcttttggatattgtaatgatggatacattggtccaaacccatagaatgtacaacactgagtgaaccccaatgtaaaccctatgtaaactatgtcagtaattatgatatatcaatgtaggtttgtcagttgttaaaaatgtatcactctggtggtggatgttgataatgggggagggtatgtgtgtatgtggcagggaggggtacagaggaaatctctgtaccttcctcttaatttttctgtgaatttataactgctcttaaaaattaagtatttaaataaatcaatatgaaaaatctttggccctaggctctgaaaacagttaggaactggagatagatgatctaaatcccttcttcccaatattcttctttgtcttacattctattattaagatggctaggactgtttttacaggacagggagactgaagtggggagtttattactagcaataacagaggcatcaaaacgttagaagcaaggagaaccaagaattatgtgccaagaactagaaggtaagtctgaatgacctgcaaaactactgggttcaaaagtgatcaatgatggagtacagaaccaagaggctagcaaactccagcaagtgcagtagagttaaccgtgagtgaaagattccagcagtaggaaactgagtggcatcctggggatgtgaaccatgtatggatcattctccaacaactctatcaaaatcactccaaaaaaactgagtaaatatggaatacctactatgcaagtacaacagatgaacaatataatcaactatagtgtacttgctgtgccttatcaaagcatttaattacatccaccaaacagattttaattcctaaatcctccacatagaaactagatcttaggccttgctaagaatcagtgctaatacttaatatgtgtttatataatagttggacc

SEQ ID NO: 3998 - DNA, 1050 bp, Homo sapiens
atcagtcagaatggcaactaacgaaaagtcaaaaaccaacagatgccagcaaggctgcagagaaaagagaacgcttatacactactggtgagaatgtaaattagttcagtcactgtggaaagcagttcagagatttctcaaataacttaaaacagaactactattcgacccagcaatcccattactggatatatatccaaaagaaaataagttgttctaccaaaaagatacatgtacttgtataatatgttcattgcagcactattcacaatagcaaagacatgaaatcaaccgaggtgccatcagcggtggattggataaataaaatgtggtacatatacaccatagaatgctacgcagccataaaaagaatgagatatcttttgcagcaacatggatgcagctggaggccattatcttaagcaaattaacgcaggaacaggtaaccaaatactgcatgttctcacttataagtggcagctaaacattgggtactcatggacgtaaagatgacaacaatagactctggggattactatatggaggtaggagggtgaagaatgtgggctgaaaaactaccaattgggtactatgctcactacctgtgtgatggaatcaattataccccaaacctcagcatcatgcaatatactcaggtgacaaacctgtacatgtaccccctgaatctaaaataaaagttgaaattatagaataaataaacaaatagggttatttgattttttcttgttgagttgtagttctttatatattctaggtatcaactccttgtcagataatatgttttgcaaacattttctcattttgtacattgccttttcactctgttgattgtgtcccttggtgcacaaaaagtttaaagttgatttagacccatttgtttatttttgcttttgttgcttgtgtagcatttgttgttattagcagttttaaaaaaaatcgttagaattgtttcaaattgctgtttactaattcctttcctccttatttaaagtccacagtagtattcttgagactatgtaatgatgatac

SEQ ID NO: 3999 - DNA, 1300 bp, Homo sapiens
gctataacctatatcctgaaccttggcaaggcatcttgtaatccaatctgtttaatcctaagggggacagcagaactggcatgaatgaataagcaaaaatacaataccactgctgttaaaaaaaaaaaaaggaaagtgcatgtcctggtgatggatggtcagcagcaacattttaaaacagagacagcacattttacttagatgacatcactgagagtatgaatataataccaacttggctttagaactgctctctctcctctgtccaatgactacagtctgcaaaccatctaaattccccacttcaaggaacttaaagtctagcaggggaaattttacttacacgtgagtaattaacaaataacttagaattggcttaataccagaaaagggtggtgcagacctactgctatagcggtaccttaagagaaaagagaaatagtagagccttggatgatcagaggatcaggaaagtcttcatgggttgaagtgaattaaatcagtctcagagactggaaggattctgataggcaaagagaaagccacataaaggttcagctaagaagtgctcatctactgtttggatacatggtgaaagatcatgaagaaacttgaatgtcagacagtgagatctgtttctgatctgttaatcatttctctttcttacattctccatatctgttgccccgagtccccttccaggaaatggtctgtttcctgggtactaaaaggattgtcaactaaactgagaaaaagttttctgtgcaagtacaatttttcctcttccaaaggaatttgccttttagctccggcccccattagataattatgaacaatttggaaagtttaagaatataaaaaggaaaaaaacaccctcataatttgaccaactaaagacaatcactattcatttttgacatgtttctttccacttttttcatgcgtagttttaattatggtatctatattacttttatattatttttaaatttaaaattctataactttagttttcatttaattacaactggcttaatactaggtttaaaatgcctaatagcaggcttaaaaatgactacataattttccatttggtagatgtattatcattgcctaattgttcctcattgtcactattgatgacatcataataaacaattattgatgataataatagcactgtgatgaacatctttgtgcgtatgcttttttttgtattttgaatattagttcctttgcatagagtctcagaaataaaatttctgggttaaagggtatgaggtcttgaagttgcactatt

SEQ ID NO: 4000 - DNA, 1050 bp, Homo sapiens
gaaaatagtaaagctgaggcttgaggaaactttaggcagtttgcccagctgtataaagagtgagatgatgagtttgggcactccttgcgcatctatgtgcccagccctcaaaataatggaacaacaacaaaaaccgtgcctggattagtttacgttttacttgagggaaacctaaaatgagcatacaaataaattatggtgagctacagagtaagacatggtatggaaaaaaaatagaacaggataaaagaagatgaagagacattcatctttttgagacggagccttgctttaatgcccaggctggagtgcagtggcacgatctccgatcactgcaaactcctcctcctgagtagctgggactacaaacacgtgccaccatgcccggctaatttttgtatttttgcagagatggagtttcaccatgttggccaggctggtcttgtactcttgatttcaggtgatctgtccgccctggactcccaaagtacgttgcaattttaaataggattctcagagtaggcttcattgaaaacgttacattgagccaaggtttgaaggaggtaatgggctaaactagttatctgagggaagagctgttaatctgagaaaagctggttatcaaggagaaaagctgtcctggcaaagcaaacagccagctccaatgctcctagtcagtagcaagccaggaaaggcaagaagtgttgagattggacaggtggtgtagagttttgtaaggactttggcttttattttatgtgagatgaagatctcttatagaattttgaggaaaagaatggtatgatcttaacatcttaaaagtatcaggctggtgcagtggcccatgcctgtaattttagcactttgggaggccaaggcaggaggattgcttgagcctgggagttcaagaccagctttggcaacactgtgagaccccatgtctacaaaaagtaaaaaaatatatatatctgtttgggcatggtgtacatctgtggtcccagctactcaggaggctgaggcagtaggatccattgagcctggaaggctagg

SEQ ID NO: 4001 - DNA, 1049 bp, Homo sapiens
aaattattgtcagtctttattttcttctttacatttattagtaaaagtatactttatacttattttcttcctaatacttactgatgtttctagaacttttaaaaatgaacacacactggcctctcatttaaagcatataaataaagctgactacagtctaagaatcaataggaaaaaaattagtttaacttttaacttttttaccatattacattaaaaaataaactgtgaaggaaaagcagatatactaaacatttacaaatgaaatgcatcccccagatgttgactaaagacaacatctattaaagctgtagaatatagtagttcttaatcagttacatttcttgtattctaaatttattctaaacccaacaatgttccaaagttagtacctgctttcatcttaggtgcatttaatatttactgtttattacttgacacccgttagatgctcagtgagtttaatttttatttaaacattttaaattacctatctttttttcctattgattcttagactgtagttagctttatttatgtatttatgagtttaatttttatttaaacattttaaattacctatctttttttttttttttttttttgagacaaagtctcgctctgtcacccagactggagggtgatggtgccatctcagctcactgcaacctccccgtccctggctcaagcaatcctcctgcttcagtctcctgagtagctgggactacaggcatgtgccaccagacctggctaacttttgtgttttttcgtagagacagggtcttgccatgttgcccaagctggtctcaaactcctgggctcaaatgatccacccaccttggcctcctaaaatgcttattacagatataagccaccactcctggcccctatcacttttgaagaattgagttattagtaattattagtaaattgataggtgtaatcagataaaaaatttaaaattctctgaaatacgtatgttccccaacattaaagtttttttgttgttgttgtctgtcttggtttgatactgttttcctgatccctct

SEQ ID NO: 4002 - DNA, 1070 bp, Homo sapiens
cttctttcaaaattggagtcaaccccatcaaactctgctgctgctttattaataagtttatagaatattctaaatcctttgctgttatttgaacaatgttcacagcattttaccaggaatagattccattctcaagaaactactttctttgcgtattcataagaagtagctcctcatctattcaaattttatcacgagattgtagcaattgagtcacatatttaggattcacctccaattctaattctcttgctgtttccactacctctgcagttacttccttcactgaagtcttgaacccctcaatgtcatccatgagggttgtaacccacttcttccaaactcctgttaatgttgatattttgacctcctcccatgcatgaatcatgaatgttcttaatggcatctagaatggtgaatcctttccaaaaagctttcagtttactttggccagatccatgaaaggagttactgtctttggctgctacagccttacaaaatctatttcttaattaataagagttaaaagttgaaattactccttgttccatgggctgcagaatggatgttgtgttagcaggcatgaaaataacattcatcttgtgttctccatcagagctcttgggtgaccaagtgcattgtcaatgagcagtaatattttgaaagaaatctcttttttttcttagtacatctcagcagtgggcttaagatattcagtaaacagatgtgctgtgagccaggctttgttattccatttatagatcacaggcagagtcaatttagcataattcttaagtgccataggatttttggaatggtaaatgaacactggcttcaacttaaagttaccaccctcattagtccctaacaagagaatcagcctgtactttgagctttaaagccaggtattgacttctcctgtctagctagcaaagtcttaaatggcatcatcttcttccaatataagatttatttgaagaaaggggtctctgccttttaaaatgtgtttgatcataattttacccgacatgggaggtttcagaatgaaaacccaaagatacaggaaaaac

SEQ ID NO: 4003 - DNA, 1031 bp, Homo sapiens
tatcgaagacactaccatatgctaaaggaagaaatctagctgggatataggatttttgttgtttttgtttttgtttgttttgctatttagcaataacatggtcaaaaaggcaatcagaaattttaaatacagttaatggatacatttggcaacaattttcccccgagggttttccatggtgtactttgcaagaaataagcactctaatttttaaagtaaatctcttattttagcaaatattatatttcatgacaatggagttctagaaagcagcatctgttttttgttgcgtgtttccattttaaagtgagttgagttctcaaattggaaagaaagattccttgagacgtacttttaaaatctaaagtgtgaaagaaacagcagagtaaaagccagactcattgcaccttcaatgtctgcatagatccagaagttgtacattttacctaacaacatcacttttgttgaacattccaactccagaatgatccccaatcaccctaatctcagaatgctggaatgatgtctgttggaaaacccaggactccacacacaaaactcctgggattttgtttcccatctctttctaggtgtttgcaatgtacaaataatacagctgtgctaatctcacatttagccatgatagatgatggttctagagtgtacttccatttgtaagtcctcctgataagtgctttcttgtttatcactatgtaaatctgaaatattttgtacttcatttgtttttatccattctgaattttcaaagcataaaaatgtcaaagaaaaattgagataaacattttgttcaccattaaatgtttgcatctgcagtctatgatgagaaacaatgaaattatgactaaaatttaacaaatagtattttcttatagaagcaatgtattaaatgattagatacacaggacagttcacagcaaattgtttacttacatggcataattgaaatactgttatttgtaaagagttctatactgcctaccttagctaaccagaattgttcatagacttgt

SEQ ID NO: 4004 - DNA, 1776 bp, Homo sapiens
tggaattttatataaaggctgtgccttagattccaggcaaggagacttgtgcgtaagttacctaaaaaacttagtttgatcatttgtacagggattctgatgaccgaattactataagtattggtaaataaatttatagtaatttggtcatcagaatcccttgtacaaatgattaaactaggcatgcactactactcccagctaattttttgtagagacagggtttcaccatgttactcaggctagtcctgaattcctgggctcaagcagttcggctgcctcagcctcccaaagtgctaggattacaagtgtgagctactgctcccagccgttttttttttccaagtaaaattttaaattatatttttggcctagatttttagaattaaaaggaacttattttttttgaagagtgccacattatgaggttaaagtacaaaagaaggagaggatagtcactaagatctgcctttcttttcccaacagttcaatcaatgtactgaatataactgctgaagaaattaaaccaaatcaggttggaggagaatgtacaaatcaaaaatggagtgtggcatcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataacttaagatggtctgagttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgattattgtaaatgtttaattttgtctcaaatatagttggcattggaagtttagcctttacttgaatgtatactgtagatttttaacaaagcgagttctatatttattatgtttagtgtggtttgaaattacctctttcatatgttttaaataaagtgaaatttatgtatgttttgtacatagatacacatgattatgttaagaggctttaagatttaaaagtttcacacaaccataagtatagtatttcatgccagtaaaatttttttagtggtattctgtttacagatgtattaggaccattgatgcattacatttaagaattctctttaatacatctgggcaataaatattgaaaggtattccatgaagctgagttctttagataatcaacactactaacattacatttttgagatttttatgacattagatttttattttgtatatgtagaatattataatttttaaaaggactattgatgatagaagaataggggcaagacgacaaaagtacctttgaataaaacaatttaagaaattggtttaagatattggatgatagaagatatttaagatatctagatggtgatattttccttacaagatgggtaccagtatagtaatatctgtatactaactagggctttgtattgtcaataattttttaataattttttaatgaggtatttaccactgaagaaatatgataatataaaaccatcaaattttataattgagatgatactctggaaaaacatgtcatttcattttcagaaaactcttaagctctcttcagt

SEQ ID NO: 4005 - DNA, 1032 bp, Homo sapiens
gaacccaggaggtggagcttgcagtgaggcaagatcgcatcactgcactccagcctgggtgacagagcaagactccatctcaaaaaaaaaaaagatccttttaaacatgggtggactatgcaacaaagataagcaagattaatgataattaatttgaatttgttccatctctttcctcactcagaaccgcagatgaatcatcctgatgatttaccttcactatatttaatgcctcaccatatgtactgcctttttctcttacttgttttacaacaggttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacataggtatttgtctataggtgatcttttcacgtgtttctaaaaattgctaaagttgcactgctaagggaaaggtggcatgtctgtagtattagcaacaatagagattttggagaggaatttagtagatgatttattcattctacaaatattgagtgtccagtatatatagacactgtgctagatgctggaaatacactagtgaacaggtagatctgttgtcttcttggaggtaaatcatatgatgtgtgtctttttatttcacatttaagatacaatttagaatgtagtcttaattataggagttaatattttaagcactttaattgtattaaatggaaggatattgttttgacagtttttgtagagtacatatcttaacacttttttccggcatgcccattttattgttgttgaagggcaaagaactgagaaaagcctgttcctgttgagtgaaaaagatttgtgcccaaggatgacagtgtaaaaaaacatggctctccaccctgggaaacccatatgttgctcttaattgctacattttggtgttttcctgtatctcaagttattatatcattttctaagataagatcaat

SEQ ID NO: 4006 - DNA, 1073 bp, Homo sapiens
ctctttggtagatacttttgttattcccagtgtccaagaagaaacaggctaagcagttaaataatgtgccgagatctcattgcttacaagtggtggaactagaaactcgaaaattaggctgtttaagcccaaatcctaacctatataccaggttcactttcaccacttacgtgtatagaatgcattagagttttagatgcttaagcatgtatggtaagaattaattttatgtgttcatgtttgtagctatggacattttgaattatgtcgggagagctgatggaaaaagaggctcctggaggactggtaaaactgaagccaggtaaagtccagtttaaattgataaatgtaatcagacttccttctatcctgcattttcatactgacagtttctttctcaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgtaagtggctctttcctctctaatacagtcttcagattgctaataagaataattaaaatatgtggtaggcattctcaatggggacactattggtattttgaataggacactcaactgctatgctactttcaattactgtgacaactgaaaagactgttcctatgtgttttcagacatttcctgaaaaatgctggagatgattttccggggaattaatacatgtcaagcactgttaagaagtgctttataagcattgtctcattttataatattcctcataacatatgagattatttcatatattataatttgatgatttagatactataaatatccccattttatagataaggaaactaaggcataatatttagtagcccagtatcacacatgacagtgctaggatttgaatccaagtttctcactccagagctcacaatcataaccactatgtcaaatatcctttcagttgttttagtattatgtactctact

SEQ ID NO: 4007 - DNA, 1066 bp, Homo sapiens
atggcctcccctgtgcctaggaaaacgtagtagcacatagtaggagctcaattagtatttattggatgaatataaatttcttttttctttttgagatggggtctctgtcgcccaggctggagtgcagtggcacgatctcagctcagtgtaaccttgcctcccgggttcaagggattcttctgcctcagcctcttgagtagctgggattacaggcgcatgccaccacgccggctaagttttgtattttcagtagagacgggggtttcgccatgttggccagactggtctcaaactcctgacctcaagtgatccacccacctcagccacccaaagtgctgtgattacaggcatgagccactgcagccagactaaattttcatttaacactatattttgaatattttaccacagtcttaaatattcagaactgtggttgtgaactcttgatccacagtccagatctggcctaaagacacattttatttggcttattacatagtgctgttgtttgaggtataacttacagtcaagtgcacagatcttaagtgtacaacttgatgaactgatcttgtgtgtaccagtataaccacatctcagatcaagatgtaaaaagttttggcaccccagactcactcatttccttctctagccactcccctttcccacaggataacttaatacatagagttttttttttttttaattagctactagcattttaaaattgggagacttcacataaaaattcagagttccagtatctcataaaaacatcaaagatcaacacaaccgctttccccttgaccacaatttattgtagccgagaagcagctgtccacagtattgacatgtgttccccaggctgcctgcagtcttcacccttcctcctcttccccctgaccttgaaatcaattgccagttgccacttacaatttcatttgaattgtttttcttatgatggagaaatatttatctcttccattgtctctataaaaaagtgaaaacataaatgaaaacagaaaaggtgtcttatacttagtccataccattcatttgtagttttggc

SEQ ID NO: 4008 - DNA, 1049 bp, Homo sapiens
ttattagatggctatatacgtgttacctaccgctaatgaacaaaactatgtctcttatttatggattactttatacttttgctttgatgtatttcaggtttgttccctgacaatcttaaatgaatgaaatgccttttacaagatattttaattatttaatgttcaaggtttgctcataaaattcactcatgaatttgatccatcttggaatttgggtagctgtatcttggaatttagaaagcttattttgccaaggttaaagacacatctgtgacacagcctcaggaggacctgacgacatgtgtccaaggtggttggggcacagcttggttttatacattttagggagacatgagacatcagtcagtatgtgtaagatgtacattaattggttcagtctggaaaggcgggacaacttgaagtggaagggaaaggggggcaggggcttccaggacccaggtagatgagttgaaaggttgcattcttttgggtctttgatcagcctttcactgaatacgcaatttacatgtgagagggaagtagaggaatagccacttagaccttagtctggttcattgaatctgcatttttacgtaaataatagggcataggaagcaatcagatgtgcatttgtctcaggtaagcagagggataactttgagttctgtcctttgtcccacacgttggaaaataagctatcagcttacactgcaagagtgaaatccaacagaactgttttagggtaaaaaccttgaggcccacaaggaattttggacaaatgtagctttttaatctttgtagctattttatttaggaataaaatgggaggctggtttgcctgatgcagttcccagcttgacttttccctttggcttagtgatttcagggtcccaagacttacttgcctttcacatactctaaccaatcatattaatagatagaattttaggttacacattacttgaactaaaacatgaatcactgcttacttttttctcctaaggtaactatggtaacagtgctagaaaactaagtttgttctcatccag

SEQ ID NO: 4009 - DNA, 1031 bp, Homo sapiens
ggtgtcagacataaaaatgtcagactctagcaatgtaggattctgagatgagagaagaaatagtctttcaaattagcaaaaataagtttttaaatagaaatgaaactacaagcagttaaacattcagaacaatcttaactccagttgttctcatcttttaactcttgcttcacacatatccttttctcatattctcttgagtcacattttcggtttgatctaccacactactagctatgtgatcttgtgccctggttgtcgcatttatgaaggataataacaatacctgcttcgtaggggtgtgattagaaaaataggttagtatccagaacaatgcctggaaaaatagctcatacttactgagcacttaatatttctacttgatataaaaatgctgtaattgagtaagaacagactttaaagacaggattttttttttgtcatgctagatctatccatgagcgtctaataaagcctctacattcagagaaactaacattcttttaaactgagattcttgaacaagtgattttccttttcttatttggtgatcatctttctgaagtctgattttcatttttacccctcagctttgtcattaagtcactaatcaccgaattcaacactttttaaaattcaaaacctgcccattctatggcatttgctgctgtgtatcaccctttctctttaaaagtcttctcccttggctttcctgaagtccgttcccctgtctctttgtatctcttgtgtctgggtctgcttcactcgcttatgttgatgttctttggggtttgttctcctgccccttttttctttatgaattcatctatctaaatgtgctcggatgtcttgtgagttctaggcctagagtttatccccatgtgaatgtctcataagggcatctccaaacccagtaagctacacaaagctcattatctccacacatttgcccaaacccagttttactaactttactcctctgttccctttatctaaatgacactattatctgtcaagtgccaaagacaggt

SEQ ID NO: 4010 - DNA, 1031 bp, Homo sapiens
aggcaagagcaacacttaatcaagccttgccactttccccaaggtctttgagctttgccctgtctcattccccagctgacctcccaatctttgctttcttcatctggcatgaactcccttaatttcccttccttcatatctgagtccacctgcacaggtcacatccttaccatcctagcttttcactagggctcattccttccagccaggagctgggggatccacgagcctactcttgtccttattcttgctttcctatgagcttgatcgttcaaaaatgtaagccctgaccttaactccccttctaactactgctctgtctctccctcccttcactaccagacttttgttcttggtttttttttttttttcttttcttttcttatttagagatggggtctccctatgttgcccaggctggtctcaaactcctgagctcaagcgatccttctgcctcagtctcccaaagtactgggattataggcacgagccagtgtgccccgctgatttttttactcttgtttattttcttttcttaatacttcaaaccgtagtaagctagcttcttcctatactactctaatactactgtgtttgattaagccaccattgtcttcctagttgccagatttagtgatctaccttgaccttcctgttatgtgcctgcttgcttcatgctccctttgatagtgtcttcctccttctgttccttctctgctgcttgtccagtctctcccatttctgaccatctctgaaatgccctttgttccttctcctttgggtccccaagttctttccaggtgattttactcctgcagcttgaaccaacccctccatgtgaacgtctctcaaagcagcctctccatcctcagcctttcaggagatcccaatctctgtttccagctgctgtcacgtgcacacctggatgtcctggaggcaccacaagcttcagctgccctgcagacctgctctacctgttaaataggatctctgcaatgggtttcatctgccttgccttccaagctggaagt

SEQ ID NO: 4011 - DNA, 1028 bp, Homo sapiens
acttccttgggtgctggtaccttattcacagcagatggtcatgcttagaaaaccctgcttcagggtcagtgactgaaaaaccaggggtgccatgccagtgcctttgtcagggctgttttctgcttaaccactttctcagaataatgcagaagaaacccagtccgctaccttttgagtgtgtgggaagataagtaagtgttcaggtgggaatggtagttgcctctcgcatcagggtttgcatggagaaggaagaggtgcacactcctgccacagagattcatgtctttgatgtggcaatgtctctgcgtggtgggggccaagcctcagtgttgaagtaggttatctcattaagcatgaggggagggagtctttgtgtctgcttggaaaaaaatctctcttctgttccactaagcgaccaacttccataaaagtagaggaaataatgattactttccaagcagagtctacattgccaatgtgtgtgtggagtgggaggtctcatctagtcttgctgttagcattaaaagtttagactttttttttttttaaaaaaagagagagggtcttgctctgtttcccaggctggaggacagtggtataatcctacctcattatagcctccaactccagggctcagtcgatcctcctgcctcagcctccagagtagctgggactacaggtgcacaccaccatggccagaaaatttttgtattttttgtagagatggggtctcaccatcttgcccaggccagtctcaaactcctgggctcaagcgatcctcccttcttggcctcccaaagtgctgggattacaggcatgagccatcatacccagactagacatttgacttttgattatttccttcattaccttttttttttttaaaaaaaacctctccctggctcttctctgctttctttctgaagtttttctttggattgttctctgttcccacagtggccctgccttggtgttctgggactgacagattgattcatcattgtaaatatcagttcttggatctgagc

SEQ ID NO: 4012 - DNA, 1048 bp, Homo sapiens
gatgcggcaccgggtagtgccactgcagttgagactcatttattctttgggttctaatagctactttttcatttcacccattctgttctttttttcaggtgctgattttaacaatgcaggcctcactgccaaaagttcttcggttttgtgcttgtgctggtatgatttatctgggttacacattctgtggctggattgtcttaggaccataccatgacaaggtgtgtagctcacattcttccttctgcagatggggcacgtgggacccttgaacgtgggtttctagcacttacttgcttcctggtcttctctagcatgtacccttgacatcagtaatcacatatctttgtatcagttttctttttctttttttccttttcaggatatagaagtgactacaggatattgaaacaagaactgtacaatactagaaagcatgtattatagttgtctgggactggcttaaggggtcacatggttacccggtgatcatcaaatgggaaatgtttggacgtgagatcactatattaaaaatgaaaattaagtgaggaaaattattataaaaaatttccaatttaaagtattatgtttttcatccaagttaattgagaagaatgaagatgggcagagactgcctaaaacgaccatagtaggtttacgatagaaatggtgacacgtcttgtctctgcagacggttttgattacagcatcatctttctgccttattaaagatcagtatctgaattctaaactattaccaaacttcagttagcattataatctcagggacatcaaagttgtgctaagatgttcttgttataaaatgatacatttgattggtagatgcatcaggaaatgaaactaggtaagccttggttttaacccaaaaaagtaaaaggagttattttatcttatggcttttcctccatttgggcctgtggcagttggaacaacagaaacaacaaaaatagcagcagctaacacttactgcttgtgtgttagacactctgctgggcatttcggtgttctttcttatttactccccaca

SEQ ID NO: 4013 - DNA, 1050 bp, Homo sapiens
tcactcaacaaacctctggtgtgtagtcatcatgttttcatatcatactgtaataatcccagttattcaagccccgtacttgaagttgccaatttccccattttcactgccaccactgtcatccaagccactacttgtggtctccctgcttctggtcttgcctctacgagcccctgccctgccctgcagaaaccgcagtggtaaatcaggtcatatctcttccaggcttaaaaatcattagtggcttcccatcccatttagaataaaatccacaagtccttatagaaactagccccctgcctgcctctccagacccctgtcctcatttctctgttgtaacatcctttctgtttgctgagcaagccaggctctttcttgcttggaggtcttagtgcttgatttttttcctgtttggatctatgcatagctggttctttttcctttcaggaaaaaggtttcagttcaaacatgtttcgcaccgtgaaagccattccctaactatctttcctaaggtggactccccctctgtattagtctgttctcatgctgctaataaagacatacgcaataatttataaaggaaagaggtttaattgacttacagttctgcagggctgtggaggcctcaggaaacttacaatcatggtggaaggggaagcaaacacatccttctttacatggtggcaggaaggagaagtgcagagcaaagtgagaaaagcctcctataaaaccatcagatctcatgagaactcacccattatcacaagaacagcagcatgggggtaactgcccccatgatttaattacctcctactgggtccctctcacaacatgtggggattatggaaactacaattcaagatgagatttggttggggacacagacaaaccatatcaccctcttagttattcttgttcactttatcttcatagtacttctcacactgtgaaattaccttgtatatatttttacttactgttatctcccccactagaatgtgagctccatgaagatggtaaccatgtctgtcttgttcattgctttacctt

SEQ ID NO: 4014 - DNA, 1025 bp, Homo sapiens
cctgggccacggacctgttaggaaccaggctgcacagcaggaggtgagtggtaggcaagggagcaaagctttatctgtttttttagctgctccccatggcttgcagtactgcctgagctccgcctcctgtcagatcagtggtggcattagattctcataggaacgcaaacccaattgttaactgcacatgcgaaggatctaggtgcggctccttatgagaatctaatgcctgatgatctgtcactgtctcccaccacccctagatgggaccttctagttgcaggaaaacaagctcagggcccccactaattctacattatggtgagttgtataattgtttcattatatattataatgtggtaataatagaaataaaatgcacaactagtgtaatgcacttgaatcatcctgaaaccattacccacccccccccactcctgccccactccagtccctggaaaaattgtcttctacaaaaccagtccctggtgccaacaaggttggggatcattgctgtagttaaccatatttgaaacacacgcccttttaaactgattggggatatttggctctattggcaaataatcattctgttatcagtgtagaggtgtgtaaagatgttatttctggaacataaaaataaatacttaaaaatacctttagttttagaaatgggagacggtccctgccataactagagttgcttctttattctgtgttcataaagaggttttcagtatatgacatgccatgtgtaccagctcaagtttagggaaagcaagttacttcaaaagaaacaacaaggttgagatgcagagacattgttaaatgtgtatgcttattgttagcttatttcattctttgttttgaagttttggtcttggcaaccaataaaatagatacattgatacattgttagtattacttggaaggagaagaaataatgtccccttttttcagttggttaattttaattgtttcccaaaatcttttcttgctaaaccaacttccttcaattatttgat

SEQ ID NO: 4015 - DNA, 1087 bp, Homo sapiens
ttgcaccactgtttcgagaaaacaacttcttcgtccttcagttcagtgtttctcacccagaggctgtgtgtgtgtgtgttggggggtggggggagttggggggtagtttctatggctttattctcaagggcctgagaattcagtgtacaccatttcatatactctttttattaaatgaaaaagcatattttgagtcatcaggagggatgctttagcaacactgatccactacagtgatagcaattaacactaaattcagtattgctgaaacatgcccacaggggcttcttacaggcatgttctcaggagatctgaaagttcatgtttgaggatgttgctctcaggcacagttaagatgcacctttttcttggaaatgcctccctcaatgcgcccagtcacatgcccccgtagcacttaccacatcgtctattatgactcttatgggctttcccaccagctctctcacccctctctccagagtcagaactctgcttccgtaatatttacttattttacagcattcacggaactctttaataattatgcattgacaagtctttctcttctactggacactaagcatgtgcagttcagggttattcagccttgtgtacccagcacagtgcttgctccgcggactaagtgctcattaagttggtcaagttgagtcaagaggtgagtgtgtcaggctcaggacaaacacatgtttaaggccttcacattcttttgaatgagactcattgtggtgattgctttttcatttcttttttttttttttttttgaggcagagtcttactctgtcatccagactggagtgcagtggtgccatattggcttactgcaacctctgcctcccaggttcaaacaattctcttgcctcagcctccgaagtagctgggattacaggcatgtgccaccacacctggctaatttttgtatttttaatagaaatggggtttcactgtgttggtcaggctggtctcaaactcctgacctcaggtgatccacccgcctctgcctcccaaagtgctgggattataggcgtgagccaccgtgcccagccacctctggaacttctgactgtc

SEQ ID NO: 4016 - DNA, 1086 bp, Homo sapiens
ccaccttgaacaagatctagaagaattctttggattaccaggcagagactcttgttctctaccctttttgtctccctaacaaatggagtctctctctcagtcctgagccatctaaagctagggatggagtgacacaagcacccctgtggctactacctctgtgactacactgggtcagacctgaagtcagcacagcactgggtgttgcccaaggccggctgtaactactccctggctacttcctgtgtctgcttatggctctggggctctatagttagcaggcggcaaagccaaccaggcctgtgttcttccctccaggatgctgagctcccccaggaccctcctgggtccagaggtgctgtccaggagtcagggactacaataaaaaaccttagaagtctacctagtgttctattgtatcgtgcctgagctggcactcaaattacaagatgcagttcttcccactcttccctcccctcctccaaaagcagaggagaccttccccatggtcatcaccaccagaagcccatgggcagtactgccagactaccactatgttctcttaaggcccaaggtctcttaagtcagcttgtcatgaaggttgtctggcctgagactcatccttcagggcagtgggctcccttctggcccacggaaggtccagaaatgccatccaagagtcagctcttagaactggggactccaggagcccacttgttgctccaccccccaatagccgagatgaacctgaagccagcaagtctcagaggctcacccaaggccctagatgtagtacctgggtatcgctgctgattattcagtgcccaagggctcttcagttagcaggtgatgaatgctgccaggaatgggttcttcccttcaaggcagtaggttcccttctggcccagggtgtgcctagaagtgttgcccaggagctagggcctggaacagaggcattatgactctgaccctatcatgctgtggctgagccggtatccaagatgcaagacaaagtcctccccactcttctttctcctctcctcaagcagaaggaagggatcttttttggagccactagttgtgcag

SEQ ID NO: 4017 - DNA, 1048 bp, Homo sapiens
ttctgggttctttgtggttccatatcaattttagggtttttttctatttctatgaagaatgtcgtggatattttgatagggattgcattgagtctgtagattcctttggagtgtggacgttttaacactattgattcttccaatttatgaacatgaaatttctccatttttggtgtcctcttcaatttctttcatcagtgttttacagttttcattatagagatctttcacttctttggatgagttaatttctaggtattttatttgtggctattgtaaatgggagtactttttaattttctttttcagattgcttactcttgcacatagaaatgctactgatttttgtatgttgatattgtgtcctgcaactttactaaaattgtttatcagttctaactgttttttagtggagtctttagtttttttccaaatataagatcatctcatctacaaacaaggataatatgacttcttcctttccaatttggataccctttatatctttctcttatctgattgctctagctagaacttccagtactatgttgaataacagtggtgacagtaggcatctttgttgtgttccagatctgagaggaaaggctttcagtttttccccattcagtatgatactagctgtgggtatgctgtatatggttcttattatgttgaggtatattccttctatatccagtttattaagggtttttatcatgaagcaatgttgaattttatcaaatgctttttcagcatcaattgaaatgatcatattgtttttatttttcattctgttaatatgatgcatcacattgattgatttgcatatgttgaaccatccttgcatcccagggataaatcccacttggtcatgatgaatgatctttctaatgtgttgttgaatttggtttgctagtattttagttgaggagttttgcattaatattcattagagatattggcctgtaattttttttatgtgtctttgtctggttttgatatcagggtaatactggcctcataggatgagtttggaagcattgtttcc

SEQ ID NO: 4018 - DNA, 1466 bp, Homo sapiens
ggtgagaggatcacttgagaccaggagttcaagaccaaccatggcaacaaagtgaaaccctgtctctacaaaaaaattaaaaattagcccggtatggtggcatacctatagttccagctacgagggaggctgaggaaaaaaaaaaagaatatgcagggaggtaattgtattaagaacaaaagactacaggcttataattaaagatcttggaatgatagttgtggtgatttttcttttttttttttttgagatggagtctcgctctgtcacccagcctggagtacagtggcatgatcttggctcactgcaaactccaccttccaggtccacgccattctgctgcctcagcctcccaagtagctgggactacaggcgctcaccaccatgcccggctaatttttttgtatttttagtagagacagggtttcaccgcattggccaggatggtcttgatctcctgaccttgtgatccgcctgcctcggcctcccaaagtgctgggattacaggcatgagccaccacacccagcctcagttgtggtgattttttaaaagaaagacttttgcccttcttcaaatactaattggaagaccgtttatcagggcttctttgttgtcttaccagaaagaatgcttgaattatttaaatgattctaaaaagaagatgtcaccatattaatgtcccactacataagcactatgtaatcctctttgctttcagttcagaagaacactcattacatgatgatctttgatgcctttgtcattctgacttgcttggtttcattaatcctctgcattagatctgtgattagaggacttcagcttcagcaggtagggaacgttgctttctaggaatgctactgacattttgattgacagagacattcactgtgcctcccctcttttccctaaaggagtttgtcaattttttcctcctccattataagaaggaagtttctgtttctgatcaaatggaatttgtcaatggatggtacattatgattattattagtgacatattgacaatcattggatcaattctaaaaatggaaatccaagctaaggtaatttttttcctaatcatgctattgttagtgtcagatttgcactaatggtaatgtatttttccagaatgtaagaattttcagaatgaattgtttcttccaaactgtatatcaagtagacttgaaattggtaatggtaattttcttaaatctagtcaggaggtctcttaggcagagtttttcaaagtgtgatccacaaaccattgcatcagaatcattgggtgcctggtaaagtgtaccatgttagacctactgaattcagactcttcggcggggcctgtgaattcttacacacaccaaaattcatacacaaccaaggtaactaaggtaagagttttttttttttttttaatcttacaagaaatgctcgaatctttaacaaaaatgagtggggctatagg

SEQ ID NO: 4019 - DNA, 1050 bp, Homo sapiens
ggggagggactcaaagtttatctaggcttaaaaacgaagacagcatttatataacattaatgaaatagagttcagatctttgtctagcctccatccactccagaaatgtagccacttaggtcttaaaaacacatgagtcacggtaaccatgtggtatcaatgtttatttagcttttaaaattttaattcagaaaaataatagaatctgaaaaataatagaatctgaataactggtcttaaatgtatcagcctttcaaaatgcagtcttatttaagtactgtatcatgtttttgttcctttctatggcagagtgtttctttgtggagccagatgaaccttttcacattgggacaccagcagaaaataaactgaacttaacactggacttccacaggtgaggggagcagacaggagtgtaacttacgtttgcacgtatatattgccacagaactaaaatcacctctgttttctagactcctaacagtggagcttcagtttaaactgaaagccattaatctgcagacagttcgtcatcaagaactccctgactgttatgactttactctgactgtaagtgtgggccaggctgaatttggttccagtctggagaaaaattgttttatctggtaatgtttcatatccttggattacggtgtgataaaaaaatataggatgttttcacttgaatgtgcataagggaagcattgatacatctagctctattttgctataataacaagtttacttgttagttatgtcttctacacctctgtataagttctagaaaagcagggaccttgttttgttcactactatttccagtaccacgaacagtgcctggtatagattttcaaacccaaaaggaataggtgtttttaggttctgtgtggttggctctcagcaatctatggctggctgtcagctaaaggttactgccaagggttcttgttacttagtgtcttcaccatggatgtttccatgtttggggtttgtagtatacatctttaacttattacagtctaccttcaagttataccactgcacacagtg

SEQ ID NO: 4020 - DNA, 1048 bp, Homo sapiens
tgcccctgtctggaaagctctttatccagatgttacttaagcagttcctttttgtcattcgcttctctgctcaaatgtcacttcaaagagcctgcttctgaacagcctgctctgagaataaggggaagaagcagatggagatttctgggtttttttgtaataaatgctattaataaatacttatggtactatctgactaaactgcagatatttatcactttggtaaatgtttacatttaaaccaaatttaagaagaaaaatgtttaaaaaactacacccacatccattgtcactttttgtctatcacctgggcttcaaggctttatcattatctgaaattatctcatttatttatttgtttattcatttattgtctatgtccactcctgtagaatgtaatctccatggcagcagggactttgtataacaatctagttcattgccatatgcctagggactataacatagaagctgttcaattaattgttaatcaatgaataactgtaataagatacttgagaatggttgtctttttgttaggaaaagactaagtactataatcgcaatgtctacataattttaaaaatattcactcctgagtaataaattatttgtggttaagagagtaatgttatctcttttttaaaaatggcttgtcttttttatagttaaagtggtcttgggaaaattaatgactacaagtcggtgggtaaatttggggtgattttttgtagcatttctttgctgcagaacacagtcgaaacaattatttatgtgatatgtgtatgaaaatgcacatctcaccatgacaaagaaacatctttaagaaatattttgttaaaatgcatcatttctttatagaaatcataaagagcaaaatatatcctcttaattttgacctaatttacttcatatgcactttctctagaactggaaaaaactatttttcattttgttaaaacattttcataaacttgaatgaaccctataagtagaactcttccttattagaaaaaatagcagagaaaccactttgagggacaggcac

SEQ ID NO: 4021 - DNA, 1049 bp, Homo sapiens
aatttagaaggcttttgtattaaatcaaaatgtatttttttaacttttatatctacagaatatgtaattttaaaattataaatagactttaagttaccaacttttaagacatggcagccattgaaaaactggcttcctgatgtttttctaaatattaaagtacttaaaatatttctatgcaataaatattgataaacagacattatttaatttgaaaacccattgttaaaaaagataaatatttttatatgaaattttcattttttaaaactttgtgttaacaattcagaagaataccaagagaacatatatattgagtaaacagtcaaaggaaagtactcttgaatgttttataggaaagctgtctcagtttccttccttttgttgctatatcatgtatgaattgaataaattgctctagaaatgtaaaaattttattaaaatattataatcttcgtgttatgctattataatggttttaaggatcacttattttaatattctttttaagcaaaggtgttaaaattttggaccatcatgtattatccatcaatatatgtaaataacatttatttgtccagaattttccagaatctgaaatacttttaagggccatgcttgtattactatattactatattattttggatgagaatagttttaaagttgatctctgccctcttagagaattctatcatttttttgttgtctcatcaccgagttatagctataaactgcttttattgactctgctgtaccagaagtgttggataagtttagatgtctttactttaaatggcattttacttcaaatattttttgcgagtttttatacctgctttttataatttcctaggatctttctgtagtgtcaactgttgctcctttctgaggctgccagctttaatttttctttttcttttcttttttttttttaatagagacaagatctcagtatattgcccaggctggtctcaaattcctgggctcaagcgatccacccgcctcagcctcccaaagtgcaaggattacaggcgtgagccactatg

SEQ ID NO: 4022 - DNA, 1879 bp, Homo sapiens
cctttgacgccgaagtgcctgcggtgctgcctccaagacagtgtctgctgcagcctcctgaaggggtcagccttggcgtagtatctctgagactggattcttctttggtaactaaaagttattagctttattcatatagggaaccctttggcttttcacttaacagtattgtgattttgatggaaaaatgtgtctttcaaccttaaagaaaaaaaaagtcagcctgaacgataagcgaacggcagggagttgcatgtgcccacgtccatcgtaggaacctcggttcgtcacagtgcttcttaatgtgcttgcttaacagcctccaaaggaattcaaaatatggaagtcaaattatgtaccacctcctgagacctacaccactgagaagaagcctccgcctccagagcttgacatggcaataaaatggtctaacatatatgaggacaatggtgatgatgctccacagaatgctaagaaagctaggcttctaccagaaggggaggagacgttggaatcaggtaaggaaagtcagaatccgatggtggtctattttgatccccgtgatgggcttaaaaagaatgagatatttaatgaatgaaaattaaatctagcgaattgacaaactaatttgatggtctttggatacttactgctctgcttttgagaaagatcatacatatttggctttaacatgaagtctctgatagctcagctagtagtagttgctgtattttagtgaaagatcataaattattcaggctttaaagtaaaatatctgatatctcatccagtggtcagatttatgatgcattattagaacaacacaaatcaattcatggtttcttgtgactgtagctacaaagtactgaaggcttaattttcttttttttcttctttttctttttttttttctttttttttgagacagcatttcgctcttgttgcccaggctggagtgcaatggcgccatctcagctcactgcgaacctccacctcccaggttcaagcgattatcctgcctcagcctccaagtagctgggattacaggcgcctgccaccacgccgggctagttttgttttttttgttttttttgtttttgtagaggtggggtttcaccatgttggtcaggctggtcttgaactcctgacctcaggtgatccacctgcctcggcctcccaaagtgttgggatttacaggcgtgagccaccgctcccggccgaaggcttcattttctattaaagcagttgtgcttcagagctaaaattagtatgacaaaatgaatttaactgagcattactacatagtaataggaagataatgactgagttgttttactttagttcataatagcataatttcgtctcttacttggactgtcacagtaatctttgcctacacattcttatccaatctgtaccatccttcactgcagctagtgttgagtttctaaaagtcgtatctgattatataacttgcctgcttaaaacccttcaacgggataaagtcaaggccttgtattaataggccctttctccctgtccacagtcatttttaatggcccctttctagcacttgaagatcttgaaatccagaactgaattgtatggttccctgcctttcagtatacgttgcaccttattctttagtgttctttcttatctctggctagtaaactaattcatccttcaaaatccaaatcaaaagaagaaatctcaggtatcacctctaataattatttgctcctttgtaccttgtttatgctaatgctgttgattgccctcatcacttgtatgtgatttttttaaaagtctgtctgctttatgatgagttcctcaaacagcaggatttgaagtgtttgtatcgagtacattgtaagta

SEQ ID NO: 4023 - DNA, 1051 bp, Homo sapiens
ggggtttggtttgcatgcccattgaaccctaagaacacagaacaaggagtcaagaaggcctacgctgcattcttatctctgggtgtgcccaagcagactcaggcattctttgaatctgcctagtaagttccccttagaatattctttgtgtctcccgttgatggcactttcattctttttgacagtacagaacaacagtctgtttatctaacaaaataggcttttgtgaaaagttagatgtgtaaatcacacttccttacaatataactcttttttatcagaacatagccatgcaatgaataacttattgtaagcaggtactgttaacatttgaaatatggcttaaccaagctatgttcacaaccatttattttagcagctgagccagaaagaccccctaaaatctcctcagtgtgaaagtgcaacttacactaggagtctcttcttttggtcaaaggtctttccctagcatctcaagcccagtagttttgacctatcttcaaagtaggtactaagcatttaggcttgcctttgatactacctgtagactttttttatttgttatattcaatacttaagttaatgtgttaatagttactttgttcaaaactgagatgatgttgggatatctttacctccttggcactccattcacacctaatgtgtgttcctgccttctattttctacttgtcacttttcttcatctcttttattttattgcggttaaacacacataacatttgcaattttaaccattattaagtgtacaattcaagtgacattaattacattcataatgttatacaactattaccactcaatttttggattaggaagagttagataagaaataaggtctgtaacattttctatgtgctctatgtcctcttttctctgtaattcaaagcctcattaataatttatcaggaaatggacagaaggaaagctgctttccaaatccagttcctgctgggaaatctgtcagtcaggcaagcagctactggcaaaaattgtttcaataccatttctcttaaatagacagcaacttac

SEQ ID NO: 4024 - DNA, 1027 bp, Homo sapiens
ttggagagtactgtagctcctcacagtcactcgatttcattgtagatacctaaatttgttggttagtaacaatattgtgtaggaaagaataacacaaacttaagagcaaagctaagttgaaatctcagctctctgcttacttgctatgagactttgatcaaatttacttactctgccccagttttctcatctgtaaaacaaatcattcttgtacttgcttcatcaggttgtaaaagttaaataaggttaatatgagttcatagtagagtgcctggcacataggaagactatataaatgtttgctgttaccattgctaactaaattccttctgagagctttgtcctaaaattagaatatagaagaggatcccaatatgtttttatttagaaatttttaagaccggatcattgagtacacaaaatgtctgttcgatccctttttgttggtagttttggctagttttagtagtcaacacatacagccaggcatggtggctcatgcctgtaatcccagcactttgggaggctgagacaggcggaacacctaaggtcaggagttcgagaccagcctggccaacagggtgaaaccccgtctctactaaaaatacaaaattagccgggtgtggtggcacaagcctgtaatccaagctattcgggaggctgaggcagaattgcttgaacctgggaggcgaaggttgcagtgagccaaaatcatgccattgcactccagcctgggcaaaaagagtgaaactctgtctcaaaaaaaaaaaagaaagtaatcagcacatatggacaaatttaggaatgaaccactgaacaaacctaaggcatctccaaatcaaagggtagtaatgaatatgcaggtttttcttggtgaaacaggttggtgtggtttatatattctgttcatattacttagtgttcttaatcactctataacttaacatcctaaggccctaatatacagaaatttcatttatctctgatatgaagagatcatggaatacaaagtcaccttggcacagga

SEQ ID NO: 4025 - DNA, 1022 bp, Homo sapiens
atgtttccagactgtgtgccgcttgtacgttattgcagttgtcgttgttttgcattaaggacaggaatctctacagatggcaaccacatacttgatgcattttccagaaatcactgaagagaggtagatttcatgtgcgaaggtggagaagaaagccctgtctcctcgcccctgccaagctcaaacccctgctgctcctctgctgccctcttcctaggtctgccagcctgagtcccttgccaggtcctgggtgttttacctcctaattacaactctgcttggcacctcagcctttctttccatgaaaaatcactagtggcacatagaggaccttaaaaacaaaaacaacaaaaaaagattaaattatatatgtatgtatgtatgtatatgtatgcatgtacgtatgcatatatatgtatagtctggccaaaaaccagttttgttacatggattggtatcacacagtgtaaatatcatggtcatagagtagattcccccatctgtagttatcttctctgaactaatatatttaagccaaaactaaaatggagaattataaggtctagggtattgttttgtttattttgttttgtgggagttagtccaggtcttgatcagttcatgcccctaatttgctttcaccatgctatgccttcaagatgctgaaataccagaattaaaagtagaaagttcctgttgatttttagatgccttaaatattaaacatttaaattaactaatggaaggtgaagtagataaaccaaatcatcaagtaaactgagattcatttctgtttcgttctgcagtaagtcatgtgatattttcctgggaaaattcatattcttaattatctttggtttgcaataatattaaaataactgcatttcctgagtacaattcaattgtgccattaagggatgtggtgttctttcatcattccaggcacgatggaatctactgaaaaaagctgaccattccaggaaaggtggaatctactggaaattggtcagaaacaatacaca

SEQ ID NO: 4026 - DNA, 1102 bp, Homo sapiens
attttctttatccagttcaccattgatgggcatttgggttgattccgtgtctttgctattgtgagaagttccaaattgccgtctgttagatttgttgtgagaaataaggagttaatgagaacaaattacatgaaacaaatagaagtcctaacattaatggttaatctgtatttagtggtaaactatgcttatgtgtttattaaaattttataactttacattgaacatttaagagattaaatacattggcacaaaaaaactgcatataacttttgactcccccaaaacttaactacaaatagcctactgttgcctggaagccttaccaataacataaagtgcattaacacatattttgtattgtatgtcttatctattttaatcttataataaagtaagttagagaaagaaaatgttattaagcaaatcataaggaaaatatatttactgttcattaagtggaagtggattatcataaagatcttatccatgtcttcagattgggtaggctgaggaggagaaggaagaggaggggtcgatcttgctgtctcaggggtggcagaagcagaagaagatctgcatataaatggacccccctcagttcaaacccatgttgttcaagggtcaactataattatttaaatatccggcagttgatactgggaagactcggataactaactagaggctggcacagtgaggctccacaggcctctctcttcatcactgtgtggacatgccatgtggtctctccagtatggcagaatcagagttgccaggcttcctccatgttcatgttggctcaggttgcccagtgtgtgtggaggggctggtggcaggcagcgagagagggagaaccaggtggaagctgcattgtctttttcaagctagcctcgaagtcactcagcatcacttccatcacaggtttttttttggttagaagtgagccactaaaactggcccatattcaagggaaaggaaattagtcttcccattcctgggaagaatgtcttaagaatttgtgaacttgttttaaaaccatggaggcacctgtgaaccttgcttgagtagtgtctcccatgacacctgtttcaacttaaag

SEQ ID NO: 4027 - DNA, 1100 bp, Homo sapiens
tattcttctatcttcaattttctctgtgtgtatttattgttgaccatagaaatgtggataaacatgtggctcaccattaaccatcatctccaacttgctaaagctattgtggagtaatgataccaccaaactttgtccagctagaaatgagacccagccatagagaagacttcctgagtttctcaagtatgtatctgttctatcacatagcttttttctatcccatgtgttatgggctgaactgtagtctccctagcaaattcatatgttgaaattctaacccccagtacctcagaatgtgactgtttgggtatagggcatttaaggaggtcgttaaggtagaatgaggccatacaggtggtccctaattcactatgactgttgcgcttagaaaaaaagtggattaggacacaaacaacacagaaacaaaagggtgaccatatgaggacacagcactaaggtagacatccacaagtcaagaagaaagatctcagaagaaaaccatcctgtcgacatcaacttgatcttagccgtctgttctctagaactgtgagaaaacacatttctgttgtttaaactacccagcctgtggtattttgtaatggcagccctagcaaactcatccactatgttttaaatccaggttttttttttaagtttctctttttttttcagaagtttctaaccttaattttaaatttgtttttctttcctcctttgcttgagctagatttctacaccctaagaagtcatactcaggtttctaaattcatccacatactggagtacaaagattccacaaattttaacagtattcgaagagtgctcagtctttgagatgagtcttgactggtactttggatataacttacattttatacctctgtaaattccttttcttattgctcacctgtgtcagttctcaaatagattatttaattttataacaaaccaacaaataaaacaaagcactgaactatgtaaaactgacttctcatcccctacccctgccctatgaatttttctctttttcttactccttaccttgggtaaaatggcagcagcaacaccatgaacccaagttcaggttctcaaactgg

SEQ ID NO: 4028 - DNA, 1962 bp, Homo sapiens
gtttctggtgttctaatgatagctagtgaatgtgtgaattatattcttggccttacttgaaatgatgcgaggtttctgttgtatagtgttaaaggtgagcctgattatttgaagcccttccctaggcagtgggcacagtggataagaagggagagcatattgggtaaaatgacagtgctccaggattccattacatttagtggcattttgggatattgttttatttgattccactgtcgttcatgatatgccatctgtctttatttcctttcctttgtttgctttgggtttaattttctcttatttgtctagtttcttaatatggaagctgaggtcactggttgaaaacattttctctctattataagcacttaatgctataaatttccctctactcctgcttcagctgcatcccacatattttgacatgtttttatttttaatctgtttaaaagactttctaatttcctttttgattttttttgactcaggttatttagaagtgtgttatttaggatatttggatattttccaggtatgattctgttatttatttctagcttcattttattgtggtcagaaaataaactgtgtttaacttgaattcttttatacttcttgagactggttttatgacccagaatatagtccatcttgaaaagaatgtctagtctgctattgtgggtggagtgatccatacatgtcagttaggcaaaattgtttgatagtgttgatttttttgtctacctattctttggataattgagagaggaatattgaaatctccaactacaattatgaatatgtctatttttctttttacttctgttaggttttgctcgatgtattttgaacttctgttgttagatggataaacatttagaattgctatatcctctggataaattgactcatctgtgattctgaaatgactctttcatttcataattagtctgttttcacgctgctgataaagacatacctgagactgggcaatttaaaaaagaaagaagtttattggacttacagtcccacatggctaaagaggcctcacaatcacagtggaaggcaaaaaggagcaagtcacatcttacatggatggcaccaagcaaaaagagagcttgtgcagagaaactccccatttttaaaaccattggatcttgtgagacctatcactatcatgagaatagcacgggaaatacccgcccccatgattcaatcatctctcaccaggtccctcccacaacacctgggaattatggaagctacaagatgagatttgggtggggacacagagccaaaccatatcattgatggttaattttatgtgttaaatttgacagggctacagggtcccagatgtttggttgaacattctgagtgtgtctgtgtgggtgtttttggatgaggttaacatttgaatcagtagactgagtaaagcagatggtgctctctgatgtgagtgggcctcatccaatcagctgaaggcctgaatagaacaataagactgactcttctgtatgaggtaattcttcctgcctgattacctttgagctgagatgggaggtttcttctgccttcagtctcaatctgacacattgattcttcataggtttcaagcctgctggccttcaggctggaactacaccatcagctcccctaggtctccagcatgccaactacagatcctggggcttgtcagcctccatactcacataagccaattccttataataaatctctctctacttctacacatacacacacgtacacacatgtacacacacacacacatatatacatacatacatttttctggttctgtttcttttggagaaccataactaatctaatacaatttctttatccctagtaatattctttgttctgaaatctaatccctattctagttttcttttgattagtatttatatgctatttgaaaaatccttttgcttttaa

SEQ ID NO: 4029 - DNA, 1047 bp, Homo sapiens
gcaatatgataggaaacacttttttagggcatccatatcccgtgggaactcttatctgtttattttctccacttggcatctatccacaggaagccagcattcctaactcccttaccttacagaacttcttgttttgtgataacacagaaacattttattggaaaggactggaaggcacctctcccaccacaccctgcaatccatcttctagagatgattgagcaatatgaaatataataattgtaagtcattatcaaatggcttggctccagattgagagaatcagcaattaacctctgcctttcgtgttttatttctggagatacctgtctcttaaccaaccactaacatcacacgtagcacatccagaatttagaaaggatttgctctgggcacagtagatgagcacacagattctacagagagattgaagtgatttatttgtgacaaatttttgcaagtcttggggattgagtgtaagggagtattcaagcagttggacttactatgtgaaagaagacataagacatatttactgctcagcctgatgcctggcacatagtaagtgcttaattacaattattcctactgccaagcaccatcattatctttactttcactgcaattaacatagaatgagctagtcttattctctagagaatactttctattctttagaactctagttataaaatcaataaaattctttggtatatggtatatagatgatatgattaaaaggatccatccagccaggtattctggctgcactgagacaccagtgactatctaaaaaaccactcaaatgggcttacctctcatggcactgggactttgcctacaggcagtggtgagccatgtgatgttttgctttggtttcctcatctatgagatgataggattgcaccagctcaggagtggtacactcaagtgccccaggaatcagagaggtaaaaaatgccatgcctgagcgttagtgccggctgacacttggccttagcacttgggagacataggaatagttggaagcatctatggggcctgggc

SEQ ID NO: 4030 - DNA, 1034 bp, Homo sapiens
ggtccagagatgccatccaggatccagggactcgagtcaacaaccttagaagtctatctggtgctttacactacagtgcctaagctagcactcaaaccatgagacacagtccttcccactcttccatccccttttcagaggaagaggagcctcaccctgtagccaccaccaccacggacccaagaggagtattgccaagctaccactgatattcttctcaggcctaagggctcttcagtcagctagtggtgaatggtgccaggcctgggattcacctttcaggccagtgggctcttctctggcccagggcaggtccagaagtgccattcaagacccaaggcctggaattggggccccaagacccctcttggtattatactccactgtggctgagctggtacctgtgatgcaatacaaggtcccctttgctttttcatctgtttttctcaagcagaaggagtctctcatcatagtcacaatagctggaaatgtgctgagtcttacctgaagtcatcacatctcaaagtctcacccaaggcccacagcattctatctgggtatcactgctggttattcagggcccgggggctctttagtcagcaggtaacagttcttgccagctccgagtccttatcttgaaggtagcaggttcccttctggcccaacatgtgtctagaaatgtggttggcaagctagaacttggaataggggcctcacaactgtgacctgtgccctatcccactgtggctgagctggtatccaagatgcaagacaaagtcctccttattcttccctctcttctcctcaagtgggaggtaggggtctcttttggagccgcaagctgtgctgcctgggtttgggggaagggtgatgcaagctctcccttagctgccccaactggtatctcagtaagtcacatgcccttaaaatccacctgctctgagcccagctcagtgccaggacttgcagtccttacagccgagactgccttttaagtttatttacgtccccaaggcacttcagcccatggtggt

SEQ ID NO: 4031 - DNA, 1051 bp, Homo sapiens
tgcccttttgatgctattttctagatcttgtaggcatgctccattcttttttattcttttttctttgtcttctctgactgtgtattttcaaatagcatattgtattagcctgttttaatgctgctgataaagacatacctgagactgggcaatttgcaaaagaaagaggtttaatggacttacagttccacatggctggggaggcctcaatcatggtggaaggtgaaagtcatgtctcagatggtggcagacaagagaagagagtttgtgcagggaaactcccatttttaaaaccattagatctcatgaaacttactatcacaagaacagcatgggaaagacccaccccctgattcagttaactcccaccaagtccctcccacaacacatgggaattatgggaactacaagatgagatttgggtggggacacagacccaaaccatatcacatatcttcaaactcactaattctttcttctgcttgatcaattctgctattaagagactctgacacattctttagtataccaattgcatttttcaactccagaacttctgcttgattctttttaattatttcaatctctttgctaaatttacttaatagaattctgaatttcttttttgtgttattttgaatttcctcaaaacagctattttgaattttctgtctgaaaggtcacatatctctgtttctccagcattggtccctggtgacttatttagtttgtttggtgaggtcatattttcctggatggtcttgatgcttgtggatgttcagctttgtctgagcattgaagagttgggtatttgttgtactcttcacagtctgtgcttgtttgcacctatccttcttgggaaggctttccaggtattcaaaaggacttgggtgttgtgatctaagccatatctgtattagggggcaccccaaccccaagaatgctgtggttcttgcaggctcatagaggtaccaccttgttggtcttggataagatccagataattctctgggttactaggcagagacttttgttatcttcccttactttc

SEQ ID NO: 4032 - DNA, 1050 bp, Homo sapiens
agtgaccaatgcaaagtgcgttattaggtacaagtgtaaagtaacattcttagttttttgggttttgtgttttgtttttgagacagactctcacttcgtcacccaggctggagtatagtggcgtgatcttggctcactgcaacctccacctcccaggttcaagcgattcttgtgcctcagcctcccaggtagcgggaactactactattgctactaattttttgtatttttagtagagacagggtttcgccatgttggccaggctggtctcgaactcctggactcaagtaatccacccacagcctcctaaggtaggaattacagtcgtgaacaaccatgcctggccacattcttggttttcttgaggaatgaaaggagagaaattgcagtgggtctgaatatatatattcagctgagaaaacaacaacaacaacaactatcctactgtaatctaatggacttgagaactgaatcctgactaatatcaggtgtcagacaattttccaatacattccaaagacagtagtttccttcattcacatgaactcccttgagccacttggtcccctgtggactgttgttcttctctccagaggggcacttgtcctttctcaaagccataagcccagggaagaatgctactttgttcaagttatttttgattcttttggaacttcctaaaactcctgtcatgtggttccaagtttaaccatagtcattttggacatgattttgtttccacaatgatgtatgtcagcaaccacagagtgagcttcttgtatttttacatcaatctgataccctttgtttatttgttcctcaggtttcactttcacttatgtaatgggttatggcattttttggtcattacctcatctgggatctcctttttctttgtacctcctgatgcgtcatcttcttgactctactcccttggatctcttggatacaatgccctcagctggtgggtgggaatgggtgggagccagattgcatgaggactcctccacccttccccacagaagagctgcctgggtttgtcaccaagtc

SEQ ID NO: 4033 - DNA, 1021 bp, Homo sapiens
tacagtatgaagcctttgtaaatcttgcaagagactggtttactttgaaactgaagcctgtaaaatccaaaaaagaatgaaatcaagtttgctatgagaagcactttcctcctgtatcctacaatccaagttgactgagagcagtgatctgaatctttgactggatggaaaagccatattccttcctaaagttaagttaatttgagtaaaagagggagaagggagaagtgcagtaaggcaagatgggcgcctgggataagtgtgatttcccccaggtctcttctgtaatcctcttgttatacccttctaccctgtcaaatgggacatccatgccccttgaaaagatgcagctggcctgtagccttccagcaaagggaaagcagctgttcctcccctctccagctttttgttttgtattgacctgaaacagaggccactatggagccattaattaatagccatctgaaacctgtattgtagataataattttaaaataaaatcaagtagatctctaacttttattaccaacccgtcaaattgaccagtgttggttggggttctccagaaaaacagaaccaataagatttatatatatggagagaaagagattgattataaggaattggctcatacaattatggaggctaccacgtcccaagatgagggtttattggcaagctggagacccttgagagctgatgtttctgttcaaagactgtcaggaaggaagaatcctctcacttgagagatggtctgcatttttgttctatatggatcttgaactgtttgaatgaggcccacctatgttagggaaggcagtctgcttcactcagtcttccaatttaaatcctaatatcttccaaaagtactctcacagaaaccgcagaataatgcttgaccaaatatttgggcaccttgtggcctagtcaagttgatacataaaattaaccatcacaaccagaaacatatagatgggagccaactaaaatcatgagggatttctgtcacggagaaaccccc

SEQ ID NO: 4034 - DNA, 1029 bp, Homo sapiens
tctctcattcactctccttttcaaactgcttcagtcacataaaacatcaaggaccaatttcattctgcatgtgggtatacagttttcccagcatcatttattgaagagattattttttcctcattatgtcttggtagccttgtcaaagatagttgcatgggtttatttctgggatctaatctgttcctttggtctatgtgtctttttatggagaacaatgctgttttgattactatagctttgtaatatattttgaagttgggtggtgtgatgccttcagcttgttctttttgctttggccactcaagctccttggtggttccatcagattttagaatcatctttttctatttctgtgaaaaaaaaaaaaggcattggaatttttattaggattacattggatctgtagattactttgggtagtatggaaattttaacaaaatcctttcaattcatgaacatggtacatctttccatttatctgtatcttcagcttcttgcatcgatggcttgtaggtttcagtaaacagatttttcacttccttgattaaatttatttctaagtattctattgtttttgatatttctttttcaaacagtttattgttagcatgtagaaacacaactgattttttttgccaggcgcagaggcttacacctgtaatcccagcacgttgggaggccgaggcaggtggatcacaagttcaggagatcgagaccatcctggctaacatggtgaaaccccgtctctactaaaaatacaaaaaatttgccaggcgtggtagcaggtgcctgtagtcccaggtactcgggaggttgaggcaggagaatggcatgaacctgggaggcggagcttgcagtgagccgagatcatgccactgcactccagcctgggtgacagagtgagactccgtctcaaaaaaaaaaaaaaaagaaacaactgatttttgtatattgattttgtatcttacaactgtattgaatgtattagttctaacagtttttggtggagtcttttgggttttccat

SEQ ID NO: 4035 - DNA, 1021 bp, Homo sapiens
tgggattacaggtgtgagccaccgtgcccggccaacataaatattatataagagtctttaactatttcttggtatgaaaattgataacttgtaggctggtcatggtggctcacgcctgtaatcccagcactttgggaggccaaggcaggcagattacgaggtcaggagatcgagaccatcctagctaacactgtgaaaccccgtctctactaaaaatacaaaaaaaattagccaggcatggtggcacgcacctatagtcccagctacttgggaggctgaggcaggagaatcgcttgagcctgggagatggaggttgcagtgagccgagattgtgccactgcactccagcctgggcaacaaagcgagactccatatcaaaaaaagaaaaagaaaattagtaacttgttttagagctttcctaatgtcagaatatttgatttttttttatttagttttagaacctctataataatagctcttgtacctgcctttcttagaaggtattaaacttactatgctataaggaagtaactactgaattgtcatcacctttaaaaaatttttaatgtaaaatactctcatatatttatctattagtaattttgaatattaagagtgtttcctggttttttgtttttttttattaataagatattatgaactagatccttataaaagtctcctagacaatttgaggaacaaagtgatcattgagtatccaacattacatgtggtattgaaaggatccaataatgacatgaaagttcttcaccaaggtaagtgtaaatttgtttctgtaatgcttagaatagctttagagaaaccaaagcaaaatatgtccacccttatttctttatatgtgttttcccactatatttacacacttacaggatctactgtatagctagttaatgtgaagaaccaggtaaatgcaatgctgctactcttctgtttctaagagcgtataatcttataaaaccaattttaagtgaataaatcaaattgaatggctataaaagga

SEQ ID NO: 4036 - DNA, 1035 bp, Homo sapiens
aagtgcaagggcatggtatgtcataaacaaggcaagtaagtgatttgaggaggttggagtgtatagatgtatgcagagcagtattttttaaacttttttttaaaagttaaggttgaagagttagttcaagacccaatactaacgctgtctggatctggtctccttggcagtagaaaactgtaaaaatctagcaaaaaaaaagcagtaagacttggtgatcaagttggctatagggagcaataaataggaatcaaaggtgactacagtttctggcatgattgctgtttacagagagataaaagtaaggtctggagaggctaagagcatgttgagtttcatgtaggggtggcatcattttcaggaacactacttttgaaaagaatgaccttactctactaattattaggatatcttcagagtgaaactgtatactagtaaaaaatagtaatattatccttccagaatacataatctgtgtagtataccttactttactttatgaggctctagactagactttttagaccaaaagtttcaccattacaaatagtacatttattataataaataaaagtttattgtaactgcttcctaagcctaaaccaaatcatgagaacttccagaataacctttttgctcttatgcaaaaatgtacatcagagatttgctgtaaagtcaaaattgtgtttttaatttgatacataccttggaaagttactaagcctgttttcccatctaaaagtgggaatcagaacagaaatgatactgcatcgttgtaaagattaatttgagttaatatttgtcagctactgaatacagtgcctggcacccagaaaatcactcctgtgtattattcaagtattttgagtttcaactagaacatcatgctgaaatgattcaatgaacgtaagaggtgtttaagttccacatgtctggtagtagttaactgtatcgtgtattactttttttgtttatttgtttaacagcttcttttgaccaaattcattttgaaaaaaaaaaattttttttttaaga

SEQ ID NO: 4037 - DNA, 1045 bp, Homo sapiens
ttattataggttataaatgttaagctctaatttaagataagcattctaaatagaaccattttattaatttcctgaaaagtgcttagaaatcagaaacatgtagtttctttgtggctgtttaattctacatttacagcattacagtaacttcagagtaaagtctttttaccaaatacttgatgttgccagtttccattggttttactttccattcttggaaggtatatagcaattgtctcatgatatagatatacctggtcagctagagcatgcttaagttttttccaggttttagctttgccatacatgacttattttttaaattgcgatcctagaatgtatgtctaatctaaggaattcgctactgatctgtttgggagttttctttccagaatacatagggtctgaatttatctcttagaaaagctattatagctttttaaataaattcacttattcattcagcaaacagtgagtatgccaaagtctagatgctgttctagacattgaggctatggcagtaaagaagagtgttcctgcccctgtggagaagatcattcatgtaagatgcttgtgttagtaaagccattcttgccctttgccgccttatttcttaccaactttctattctcagaaagtaaatgagtggttttggactagaaaagcctatgttgctaaatgtcaggcactatcagagggcagctgttgtattactgcccacttaagttactactgactgaagaatttataaaacaaccaactttgtctattcaagtacagttttccaaatctattaaattttaagcctggattttacttttatggaattatttaccagaaagaaatttagatacattttgttttttatgtttactttgctgctttgatacttgtaaatcttcgtggttttttttttttttgtgatttaagcagttataggatgatcctttccaaatttattcaaaaaaaaccattaagtacatttaatcttctaggcatataaataaaaattggagtttatacaagaatgaataaaatacagttc

SEQ ID NO: 4038 - DNA, 1033 bp, Homo sapiens
ccatgcccccagtattctaagagactagttttcaatacttttttctattaacttttcaaaagttggttatagctttgactctgataaatgtaaattttcatgttgtctctactatttgattatacattaggtgaccttgggcaaaatctgacttaccaggttattgagaggattaaatgaaattttaataccaactaaagtagtacctggcacatactaaataatatacagtgacaatgaaaatttacattcccttcactgaaatccttaggaatatgccacatttactgtatattccattcacccctcataggtctgggatagcactgtgtaatcaaacagtactatttgtgcagtgaaacctataaatgtttaccttataatgggtaaataatgactatagatttattcagttaggttttgctgctgaaggagttaaaaatctttcagttttggagattttggaattgttgatatgagaagttggtcttgtcctaagattattaatactccctaggtattaaattgattgcttgtttaagcaacttgagttgcaatatagtcaaaatctcaagttgatgtcgcttaaaatttacatgttttcacttttgaggaatctgaatgaagaatcttttgtactgtttttgtaacttttctataaagtctacatttattttttttaaaaaaagttttaaatgtaaaagcccgtatatgaagtgtgatgaatgtgccattgtacctgaattactctgtagacctatcagaaggtgattgtagcagctgactgggataggttcattctaatccagacaccctttatggcaggcattttcactgactctcctaaaattatatgtgaaattatgtgatgtgtgaatttttctaagaataagtactgcaattttcactgaatagtcaaagtgaggtgaagtctgtgaagtcaaaaatagatgcaatgaggatgaattttagaggactattttagaggaatttgcaggagtaccacagtggatagctgtaatcaataaagttc

SEQ ID NO: 4039 - DNA, 1062 bp, Homo sapiens
acattactggcttcccagaagttccatgccacccttttatgcccttccctgatcttttctcatttctttatatttttttctatcttaggactgtaccacaatttgtttacgcatttttttaatggattttggattttctgtaagaataaaaaacagtttagaaacaatgccactacttttgtctatgaattatagtatgtgtgtgaacatgtgtttctagggtttatacctgggaatagaattgctttgttgtgtggtatgcatatcttcaatttgcctagatgttaccaaaacattttccaaagtgattgtactagtttacactctcaccaatagtgtatgaatgtacctattgtcatattctcgccaatacttagtttggtaagactttaaaaatttttgtcaatctgttggctttgtaattttattgtggttttaaatgtgcagttctttaattcctgatgagattgaaccacctttcaaatactttattggccatttggatttcctcttttatgcagtgcctgttcaagtcttttgctcatcttttcattggtcagctttatttttcttactggtttgtgagaattcttggtatttcttggatgctagtgcaagttggttgtatgttataaataccttcttctagtctttgtcttgtcttttcattttatagtgtcttgtggtgaatggatgttcttagttttaatgtagtcaaatttatcatttgtttcctttatagttagtaggtttatatgtttataaagaaatccatctctaccttgaagttaggaagttattcttttatagttattgcctaaaagctttatactgttgtgttttacacttatgtctttaactggaattgatttttggtatcatatacagaggagttcccatttaatttttcatatagataatccacttttcccagcaccatttattggaaagttcatcctttccctattgctctgtaggaccacctttgtcatatatcagcatccctatatgcttgggtcattttgtggccttgtcttttccattctgttggcctactggtat

SEQ ID NO: 4040 - DNA, 1101 bp, Homo sapiens
tttgcaatgacactgggagatttatattaataataccatggtccctagtttatagctttaagaaactaaagcttggaaaggcctaataacatcaggtgtgtcctccattttcatgcaagattggatttaatggttaacacagattagggtgggttttcccacttccagagtgtaagggtttcgcttctctccctctgccggtctcctacactctttacacccagcagggcgtggagggtggcccagggagtggcccaggaggcttctctaagggaagagggtggtggaaaccaggaaggagacgagaaccccagcgggcaagtcacgcagttacgcttgttcgcccagagaatccggcagggcctccgcagagccgtaaagagctctacaagtcgtgaaggggcgaggcgcaaaagcgtagctttacggcgattcgagcagtcgcgtcaagcaggctattccgggtttgtggctgcttggctccacacgtgggccgccgtaggtattccgaccggtaattcctcctattggtgtgcagcagccacattgaaggatagagtggcagcagaggccaaggatcgtgagttgatggagtttgctgctgaaaatgaagggaagtctgggggaggtctccacagcgtagctgagggggtgcggctaagtccagagcctggcagggagggagtaagggacttagcaggggcggaggagttcggcggcggagaggaggggacagggctgacagggataaaggagataggggatggagaggaaggaagtggacaaaggccagaggaaataccgatggacctaacggtagtgaagcaggaaattatagactggccaggtacagaaggcaggttggctggccagtgggtagaacaggaggtggaggataggcctgaggtgaaggatgagaacgcaggcgtattggaggtgaagcaggagacggatagtagtttagtggtaaaagaagcgaaggtgggtgaaccagaggtaaaggaagagaaggtaaaggaagaggtaatggactggtcagaagtgaaggaagagaaggataacttggagataaaacaggaggagaagtttgttggtcaatgc

SEQ ID NO: 4041 - DNA, 1034 bp, Homo sapiens
gttaatattgagatgtgaggtaccattttattcatcgtgttagttgttgcctgaatatcttgtgggttttgtgtgtgtgtgttgttgttttataggcctgtgagatttatgctttaaggaggttctattttggtgtattttaaggcttgtttcaagctttagaactcattttagcagttcttgtagtgctgacttggtagtggtgaatgctcttcacacgtttgtctgaaaacgactttacctctcctttgtttatgaagcttaattttgctggatacagaattcttgattggtaattattttgtttgaggaagctaaaaataggaccccaatcccttctggcttgtagggtttctgctgaggaatctgctgtaaatctgatatgttttcctttataggctacctgatgcttttgcctcacagctcgtatgattctttccttcatcttgactttggagaacctgatgactgtgtgcctaggtggtgatctttttgtgatgaatttcccagctgttctttgatcttcttatatttggatgtctctatctctagcaaggccacggaggttttcttcgattatttcctaaaataagttttccaaagttttagatttctcttctgcctcaggaacaccaattattcttaggtttggccatttaacaccatcctaaaatttgtggaggctttcttctttttttgttgttcttgttcttttttctttgtctttgtctgattgagttaattaggaagctttgtctttgagctctgaagttctttcttctacctgtcctagtctattattgacactttccagtgcattttgtatttctctgagtttgtctttcatatccagaagttgtgattatatttttatgatatctgtttctctggagaatttttcatctatagcctgtattgtttgtttttttaaatttctttaagttggttttcacctttcactggtatctccttgagtagcttaataatcaatattctgaattctttatctggcaattcagagatttcttggtttg

SEQ ID NO: 4042 - DNA, 1027 bp, Homo sapiens
gaatagtggttgaatggatgattaattgaatgaccatttaaaaagtgttttggaaataaaaacaaaacaacttggtaactgattaacagaaggtgatggaagaaagagaagtcaaagataaagcagcctttgacttgggttgctgatgtcattgaacttaaataggcaactcaggaagaggagcagttttggaggatggggatgataagaaatttgattctggttatatttagtttgaggtaccgtttgacatctagaggtagaaataattaatagttcgcggtaaaccaggttgaaaagcagaaatagaagtatgaaggaagttgagagagacaaatagtgtagagaatggagttgcggatttttcctgccaactttagcccttcacctggtgcatacataggaacttgaactttatacattatataaatacatttatttatccattcattcaataacttatttattcaacctttgttgagcttcttctgtgttagaccaagtaataaatgtgggattataaagatttctaaactctcatccctcctccagataaggttacaatttagtgggagagataaaaaataatcataattaagaaatataagaagttctatataaaagagttggtgaagtgctctgagagcctagataattgagcaatagattctctcctgggtaattgagaaatatgtacttcaggtggaagtaataatagaacttaatgtttttaagtgtgcatatcatactaggtgaagaaccagagaactttcaaagttctcttcagtttgggaattttgtttctcttgaagtttaagtgtcagagaactgaagaaagccaactgacctatttaattttcttttatgacagtgatctttagaactttcttctcactaattcttttagtcttgaaattagaatgtcaaaactggggcaaaagacttgaaagctagacattttaatgaacaacaatgttagtacttactacccactggaaattcaaccattatctaagtttatttaata

SEQ ID NO: 4043 - DNA, 1051 bp, Homo sapiens
aagagagaccccccactttgggtaacaagatcttcagccctgtagagttcagggtgtggtgaaggaagcacagaatacagtgtgtcattgggagtgatggtaaataggaccatacctgcttccaccccttggtctttagacccaaatgttcatcctatttgggacaaaactccatatgggtcagtgatttaacaaatccactgtgttctaaagggtagtacaccattttttcacattattttcttttaactggcacatcaattataactttagaaggaaattccaatgttatgtgaggctggatgcttctagattgggcaggattaaaactaatggattacatcatgggcctactccttgcccctccttcaatgtaaagagggtctccatttttggatgctgtgttctgtgaggtttcatgtctgtggatcaggcattctgtaagcctctagatagtagtgctagtagaactttagagacaagaaaggcaaactcttacccaaataaatatctgtctctgtgatgatgaactgctgatacttccaggttggaaggtgcccaatgtaagaaatttgccaccgagtagctggttgccttcttcgtggaatggtgacataatgtggactttgttggtctttttttgctgacaaatggaactttcagaggcagcagaagctggaacatccttggtaagtgatagtacatgctgttgggctcatacataacttctgtctctactaccatgtcttctccattcatttgatactcatgccaatctgggagtgaccaaagatgaaggctggctaatgtcaactggccaagtcattttgtctacttggttttttataacctccttcatggtatatgcttcctggtgggcattaatgtgtgagggcgaactctttatactctttgcctaatcccatgtgtctagtcatgtgactctgtctcagatctctcttcctctatttttttttcctcccaggcccctgaccagatagccatgccattgattactgccgaggaatctatatatcctcacttcaggtca

SEQ ID NO: 4044 - DNA, 1032 bp, Homo sapiens
atattttcatgaatcatgataaattagcttttcattggcagttatttgttggtattttttggtattagcagaaatattttgtcaaatgtaaatgtttaaaacacatcataatttttaaacccttctttggcatttccttatgtaataatgtgctagctgcccccaaaagtaaaagtatatagaacctctcccgaccttctggtggtcctgctggtgacacaaaattgcttctaactggatctacaaccttcaaaccaaaaagcaaaaacatgtgttattatttttaatgttctttgtttcattacacggtaaactctagtttcatggtggtattttgagaatgacctcaactctgtggtttctttggtactgctgacatcttatttctgttagaatcagtgtaatgatgatcaagaaacctctatgaaacacctaagcaattacttataacattattctatttaaaatatctaattgtaaaatgttccctttacactctgtacaggctatgttggagttctgacttcagttcttgagttatcaattgattatttagttcactgataagtatataccagttagagtgtcttttctttttatttataaccaaaactcctgttgtatatattaaaacaaatgttagctgactttacacttgaagtcatcaacagatgattctgaaaatgtacacagcttgtcatcataatcctaaatgctctagtatcagaaatacttttgtatgattcactttaaaagaaacatttcccattctccaactgcttggctttcaagtaagaaaatcatagatgtttcactttattaaagttatgtataaaggaacaaattctctctctccctcttttcttttaatttttgcttgttcatacaatctgtggaacataaggcaatttcaggcacctttgacaaggaaaaacacctaaaaaagttttcaagatggatggtggcaacttttttaatggcaatacttaactaaattctaaggaaataaaaccttccaaaagttttattcca

SEQ ID NO: 4045 - DNA, 1056 bp, Homo sapiens
ttctgcttattttatatgtaatttgttcttcattttccagcttaaggtggaaagctaaactactgattataaacctttcttctcttctaatatttaaagttataaagtttcctttaaaaacagatttaactgcatctcacaaaatttgatatgttacattttcattatcactcggaaatatataatttcttttttgacctgcttatttagaagtatgttgttttctttattatttttctaatttagttccattttgatcagagagcacatactggtggaatttaaccttttaaaatttaccaaggcattttatggcccaatatgtgacctatttttgtcaacattctacatatacttcaaaagattgtgtattttgcagttatttggtgtggtgttatataaatgccaattagattatggtggttaatgatagtgttaacctcaggtcagattttcccctcccccattttttttgtatgtctagaagattttgtatatactggatattgtggatgatacgttgaagagatgttagattctgttacgtcctttgaattgaagactgttcatttttattctgtagatagttaaataactggttcatcaccttaaacttaaaggtttggtaactttttaccaaaagagtcaccttaaacttatgggcttggtaactttttaaaggacagatttgtttcagttttgctcttggtgtgagtctcagtccaaggatgtcatatttacttctaaagcatggcccttcctgaatgtcaatggaaaggtgtttaccaaagtatttaccatgttcttctaaaaggatgtggctaaacccccaaactgtttcccctgtggtgaccagcagctgatatttatgttcaattctttcagccttccacctgcttctgttgagctctttggagtctacctcatataagcacatgttagtgtcagccaaggatgaaaaatctatatccagcatttgggggaagctcctttcttttcttcctctcctttcctttcctctcctctgctcccctcccctttcctttcctttctttc

SEQ ID NO: 4046 - DNA, 1087 bp, Homo sapiens
aaacttcagccaaagagaagtgattggggaagctactacaaaagtctggctctatttgtcaaaagaaaatgtgggaaaaagaaaaatataaatgccatacaaactaacaatgtaggaatggtacaattacagaaaaatggtaggagaagagaggaagaataggaagagtagattaactttgctgattgccttatctgaagaagctgggaattaaatattttacagttggtaaattagatgaaagaaatataaggatatttaagaatgaaaagataaacactatgaaagatactcctatagactaatattagaaggtatgggaaagggttaaagggaggaaaataaaacattgtgtaaaggaaagaattaatagatatgtgtaatgaaaggactgggggcattatatacatttaaaattttaaaggaaacccttagaataaaaatacaaacccttctaaatctcaaaaggcatacacaaagcaaagcaaaggaaacaaactacatagtgaaagacttcaaaaaattaaagtggtaaaacataaaataatacaacagattaaacaaaccataatattagcaaatgtagatagatttagtttatacattcaaagaaaacaattcagactggatcaaaaaacaaatacaatccctttgtctttacctaaaacatagtgtttcacagtagatgaaaacaaaaacaaaggcaaaggtatatcagacaaatgtaaacaaaaagaaagtcagatgagggaagcttagtcttactaccagttaaggtaatgccaaaaatataaaacccaataaactagacatagaaggtctttttgtaattctgaaaggtgcagtactcaataaatatgtgaactgcatgattatctatgcataaaaaccatgacatcaatattcataaagcaaagaccacaagagagaaaaggccaaatagacacactactggtaagatactttatctctcagttgatggcagattaattgtacaaaaataaacaagaatatagaggatataaataacataaacaatgaggtacaactaactggtatgtattaaattttgtaccttcaaacacct

SEQ ID NO: 4047 - DNA, 1024 bp, Homo sapiens
ccaactatgacttattttagaatttgtaactctaatgagaagtaaagacaattttattttcattctcataaaaggctaacattattctgtcattcatttattcatcattcattaacgtatttattcaacacatgtttactgagctccaactatgggcccagtgtggttctaggcagcagagatacaatgattgagtatgacagatccacagttgctgctctccagtctaataaaggaaatagcaaatgaaacaaccaagtataacgaaatgagaggaggatatatacatgaggggcacctagcagtcttgggtgggtgggtaggggaggaaaggataatactggaaggaaaaggtaaccaaaggaaatgaaatctagactgagaccttactgaaaagaacatgaaatttaccagacagaaggaacaataaaaagctcagaagtgagacagcacagtgcatttgagggcctgaaagaaatgaagttggttggagtacacattctagggaagcagtgactggagctggagctggagagataaacagagaccagatttggaaaggcctttaaaccatgtttaacaagcagaggttggggagacttgacttttcttgattttgggatgagtgtataggtagaagatgctagataagttatgtatttgttgaaactcaagaccacctgatactttcattgactgaagattatctgattcattagttcacttgaaaatctttatctaacactagtatgtgccaggaactttactaagctaggcaatagtttaacattctctgtggtattactaggacagactagtttagatgtatttttcttccctcctactgactggactctagacactttgattaaatgaagttcttaagcatttatctcccttgcactgcatgaattgcttgaatgcttagaatttaaccaaaagctctacaggttgagtactgctcatctaaaatgcctgagaccagaagtgtttgggattttgaatttttttggattttggaata

SEQ ID NO: 4048 - DNA, 1027 bp, Homo sapiens
gtatcaggtgtcattgaacacctgatatgaaggatgtaaaagttctctcttttctatctaggtgtctatattttaattggaggctagatgatatttgcaacctgtctttatctaaagcattgtcagtgaactcacctacttaggaattcatatgcaccttagttaaaaaaaatgtattgtggttttaaattttttcctcaaccagtgtaatatgaagaattctttttattttttaagagattctaagaaaatgttcacattatcaaaactagaattctatcaacttttaagacatttaattattttggaataaaatgtgaatttttagacagaaaatggcaaaaactagtatgaaaatatatcatgttacatgtgaaattatgacagttgttaacctattaagttaatcatgttaaatatgtaataatttggggctaaatgaatgtatattataaattatatcagtgaagatcaaccatgtgtgtgctttaattattaattttaaagagtgagctctaagaatgaacacatcagatgtgagtattattttaaaaaatcaaaaagaattatctagttattgtatatatgtttttaatattatgactctggtcctttggaatgaatgctattattgcttatctgtatttttttccttttttctttagaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctctaagtagtagatttttattatgagtctaaaatgtgattgggtaaaaaaataaatatactaccagttacattttatgatttatgagtggtagtattagaggtttttatgtaaagatttttgaaacataatttatctaactgaaactttaaaataggatagttgttactattcctgtttgctggataattcttatttatctttggtttaatttct

SEQ ID NO: 4049 - DNA, 1024 bp, Homo sapiens
atagaccaatggaacagaacagaggcctcagaaataactccacacatctacaaccatctgctgtttgacatacctgagaaaaacaagaaatggggaaaggattccctatttaataaatggtgttgggaaaactggctagccatatgcagaaaactgaaactggatcccttccttacaccttatacaaaaattaactcaagatggattaaagacttaagtgtaagacctaaaaccataaaaaccctagaggaaaacctaggcaataccattcaggacataggcatggacgaatacttcatgactaaaacaccaaaagtaatggcaataaaagccaagattgacaaatgggatctaattaaactaaagagcttctgcacagcaaaagaaactatcatcagagtgaacaggaaccgacagaatgggagaaaatttttgcaatctatccatctgacaaagggccaatatccagaatctacaaagaacttaaacaaatttacaagaaaaaaaaccccatcaaaaagtgtgcaaagaatatgaacagacacttctcaagagaagacatttagtcagccaaaaaacatatgaaaaaaagctcatcactggtcattcagagaaatgcaaatcaaaactacagtgagataccatgtcacaccaattagaatggtgatcattaaaaagacaggaaacaacagatgctggagaggatgtggagaaataggatgcttttacactgttggtgggagtgtaaattagttcaaccactgcggaagacagtgtggcgattcctcaaggatctagaaccagaaataccatttgacccagcaatcccattactgggtatatacccaaaggactataaatcatgctgctatagagacacatgcacacgtatatttattgtggcactattcacaatagcaaagacttggagccaacccaaatgcccatcaatgatagactgaataaagaaaatgtggcacatacaccatggaatactatgcagccataaaaaaggatgagttca

SEQ ID NO: 4050 - DNA, 1084 bp, Homo sapiens
agcctgggcaacagagcaagactccatctcaaaaaaaaaaaaaaaaaaaaagaatgaactaaggatgaaagcttaagggggccaaagtgtgggcaagtaggaaggggctgcatctcgatggattagatgggaaaattaagttgagacatccagttagaatatttcagtcatccaggtctgaggtaggaatggaggttgtggtggactgtgggacttgttattcatcagggtcttccagctggttatttgggtttaatccctcagcaggaatactgtggttgagtgaccatattctgggtgcagggcctagaatttttttttttttttttagcagattttgatttggtgggaaaaataatttaaatggaagctagtttggaccagagactgattctttgaagtgacattgatctgcaaatgaaaatctttgtagtcttcaaagctcaagtggagagtttagaagtattgatgagagaagacaggtaaatcagacaaagattgtgggttagagtagagcactgagtgattccatatttaaagaagtaataacattagatgaaccagtcaaggatattgataggaaaataatgacttgtttaaaatgaaattttaaattttagatttttatctcatgttatgattctaaaaataatatgtttctctaatactttattttcaggtacaaaagttgcaagaagcagctgaaatagtaaaaagcagatgtgaaaatttgctacataaaaataaccaaataacaaaaaccaaaaataaaaatgtagagaaggtacgtttggaatttcaaataaataatattttatatattttttactttatgaatagtacacaaattcattcattttggtcattttctctagttcatacttaggaaagggctagtcttagcctctgtaagagtttgttttccaaggaaataatgtttcttccaggctggaaatgttgtttgtttatgtgaatgttttttcacttttttgttaatatttggaaaatagcataaatgtttaatttttctgatgcaagagcagactttaaatagctcaaaaaatggttatcaatcataagtata

SEQ ID NO: 4051 - DNA, 2097 bp, Homo sapiens
attacctctcttcttcttccactctcatctccttccactcttccccttttttctctatttctacctcactggctttcttgttgttttcccctaacttgctaggccgcctcccgctgttgtctttttcccttaaacagacacacttcctatcagttttactcaaaagtctctttctcaggaggccttcgcccacatgtcattcctagctgcttttgtgtttgatgtattttactgcttgttcttattttttgtctgtctgcccctccagtatgtaagcttcatggaggaagggaatgtcgtctgttttgttcactaatagaaccttcagtgcctgcagcattttaaaaagtaactagtgaacatattggctcatgtattcatcaatcattcacatttctgcctttttgaattacctactcattattttttatatttgtcttttgtcctaattaatatataataactatattaaggatattaatcttatatttgttttatttttctaatgacaaatgttatttgacaagacatcaaatttgtcatttgctaatactttttcatattttgtttgccatttaaactgtattggaaagctgtgaaattttggagagagatacacgcacacacatttttttaaatggcttctcttgagagtgctctcacagctctgcacatcttgtaatcaaagatattgtccatgtagactgtcttttgaaggatgtttgtatagtagatatccttggaatatggtaaccgtgtctcccttaggagtatgggtaggcatgctcactgcctgctataagaaatttgggttccctaaactcaggtttgttcttctgtaatgcatttgactgcatatacagttgccatctggcctctgggttgctctgtgggaactggggctcagcaaactgatacaaatgctgacagtcttgctactcttattgctgtgagtaataagtcccctgtctctgacctaggaatcttgtaccttctgttagcatccatgaaattgcagtagactaactagtaagcttgcaaggaagataaaatctcagacttttacatttctacatatcttcttttaattttatgctctttaggacttttgctatcctgaaatgaaatacagttttatctgaattgtctgaaaatttttaaagtttttatttaattcatttgatgcttctttagtgttgggctgaggcaggtagttaacctgtttttttcctaatagttaaacagttgtcttattgtcatttatttagttgtccatgtttcctccattgatttaaaaatctaacctttatcatgtattaagtataatttttgtgtatttttcttttccagtaacctctgtattctattgatttttcatatctaggcacatttccaagtttttttgtcagtaaatttagaaagttttaaaaataatatgtcctgtgtaaatcttaataaggatgttcataattattagtcactagctttgtgaaattcctaaattttagatggtattgcatgaaataaaaaataattattttatcaactttgttaatacatgagttatgtttttataataattctgtagcactggagtataaatgtattctaatgacttataaaatctatatcttttttgctagactacacttgctgctttgaaggatgaagttgtatctgttgaaaatgaactctcagaattgcaagaagtagaaaaaaaacagaaaacccttattgaaatgtataaaactcaggtgactactgcatttattttagtgtttactaaaattggtagacaatttaaaacactatttctttgtaatctaaataaatagaactgaagagaggtggggctatcattgtgggttataatatggtgtgtctcaaatatttcttaaggtcccacacatctttataaatagatgattctgctgattcctgattcaaacactgcatatggatatactggatattcctaaaagtagatttaaaatgaattacatcggtataatgtgacccttaatgtattcttgttaatcttggttatatttgtttgtcatcatgtgtatttaatggtattgatttagattaatgact

SEQ ID NO: 4052 - DNA, 1052 bp, Homo sapiens
acctcctctattaaacacaacagaaagtttatttggaaggttaaaaagttgtatttgtttctaatagaaagttagaaaaacagaaaagcacaaaaggaaaaaaatttaaatcacctgtaatctcataactgaaagataactggagttaatattttagcatatatataattttttattttatatgtaatatatacactacttccaatagctacttccagttttttactattgtaaataaaaacataatttctttgagtcttttttgcttatctgttttcttaggatatatttaactgtatggtcaaaagagagactcatttttaatattgttctatatttccaaattaaatgtgtctactataagtaaaatagtccctatacattttccaatactaggtaattaaaagtgctaattttaaaacaaatctctccaaattttataaataatctcatttattcttgtggctttacataccatctatgtgctcgaggctttcaaatttatacctctaatctagacctagtctctgaattccagacatatattctgctgcctgattgacatctccatgtcaatatttaataggtgtctaaaagttgtcatgtccaaaatggagctcttgatgtttcccaaaatagtaaatcctacagttttcctcatcccagttaatggaaaatcatcatttctctcatacgctgcttccagtctgtcatcaaatccacctcaagtatattcaaaatttgaccacttctcaccagcaccactgtcattatcctgattcaagcctccatcatctctcatcgttactgtgacctcctgatcattctccttgcttcagccctggcccctgcaggcagcattcagtattagcagtagagttgtttctataaaaatgtagtcagctgggtgtggtgtctcacgctgtaatcccagcactttgggaggccaaggtgggaggatcacttgagctcagtttgaagaccagcctggtcaacatggtgaaaccctgtctctactaaaaatacaaaaattaactgggcatggtggcggg

SEQ ID NO: 4053 - DNA, 1046 bp, Homo sapiens
agaatccccatctgtctagggagagacctggtgggaggtgattggatcatgggggtggtttcccccatcctgttctcatgatagtgagtgagatctgatggttttataaggggcttccccccttggctcttcactcttttctctcctgctgccatgtgaagaaggtccctgcttccctgtcaccttctgccacgattgaagtttcctgaggcctccctagccatgtggaactgtgagtcaattaaaacttgtccctttgtaaatcacccagtctcaggtatttctttatagcagcgtgagaatggactaatacagttaattggtactgcagagagtggggtattgctataaagatacccaaaaatgtggaaatgactttggaactaagtaatgggcagaggttagaacagtttggacagctcagaagaagacaggaagatgtgggagagcttggaacttcctagaggcttgttgaatggtgttgagcaaaatgctgatagtgatatggacaatgaagtcctggctgaggtggtctcagatagagatgaggaacttcttgggaactggaataaaggtgactcttgctatgctttagcaaagagactgacggtattttgccactgccctagagatctgtgaactttgaacttgagagagatgatttagggtatctggtagaagaaatttctaatcagaaaaacattcaagatatgacctggttgattctgaaagctttcagttttatgcattcacagagagaaggtttgaaattggaacatacatttaaaagggaaacagagcataaaagtttggaaaatttgcagcctgcccatgcaatagaaaagaaacacccattttctggggagaaattcaagtggtctgcataaattggcataaataatgagaagccgaatattaatggggaaaatgtttctggggtatgtcagaggtcttcatggcagtccctcccatcactggcccagaggcctaggaggaaaaagtggttttgtgggctgggcccagagccttgctgctttgtacagtct

SEQ ID NO: 4054 - DNA, 1864 bp, Homo sapiens
aatattttctcatgtattgaatattttttgaatagaaaggaatcttaacttgagctctttgaacacttatggatccaaggatgacctttatgaaatccatgtaccctctgaaattccgtgtacaattttgcattatatgtacatatatatgtggttttgggtgaaaagaattgatagctttttcacattctaaagcagaagtatgactctcaaaaatgagtaaatagtcttctatgatctcatttaaaatggctatatagaattctgttactgatttgctgtaattctttaagagatttcttattgctagaatttagattgttgataatttttgcctatttgtaaacagcactgtgttgcattctatactctatacaaactctatacaaacttcttttgtatagaggatttttgtgagtttagtgtcattggcctatactttctgaagcattcttttgagattaatttagtaaattaactaatttcataaattgcagaccaaaaataatttggaatactagggcaaaaatcttttcagttgttaactcttttaaaaatctgaattaaaagtcatattaatttattgagtagtgcttatttcacttcctacttttttatatagagaaatataatttgcgatcactgatttataacattcttttctcagacaggagacaatttatccagcatgttgctagaaaatctaactgataatgaaagtgaaaatactgtaagtctttccacacttactttgtgtccattcttcctgtcattgttatttgcatgctgcttggttttataaagttagccaatattatccaagttgtgaaattcctaattcttattttatatttgctcaagaatcttaagaagaaggtatttgaaaaggaggcccatatccaagaactttcttgtttgtttcagagtgaaaaggtaagcaaaatttgagcttttgagcttaattcattatattaatattgactcccttttttttcccatcctggccccaactcctcagaaataaacacagaaaagtgttttgaaattctagattatttggatattttacaggttttacctatcaaatataacatcttaattttattaagtttttttagggtttttatggtgtttgtcaggatacttggcataaatcacttcatataggaactgttttaaatttgtattgtgtttcagttggggaacaaattaaggaattttagtgtttgtaggagcattttaggtatacccatacctttatttagaaagatagatgggaattttaaaaaagaaagccattaaataaaaaatgttgggggataaaacttagccctggttgggcatgaaatacatttgtaataggggcggcagtttatgtaaagtagtgctttgctttttatcagctgtttagattgtgcctaaatcagggtaaaattaaagatattgggctggggatacagcaaataatatggatttttttggttttctctttctctttgttacaggcaaatactttgaaagcaaaccgtttttcccaatcagtaaaagtagtacatgaacgactacagatccaaattcataaaagggaagccgagaacgataagttgaaagaatatgtaaaggttatatataaatatatatccatttttatagcttaagtgataaaattaatgaaaggccataaagccttccttagttctagaatttggtggttttaaaatacacagttgttgacatgggaaatacatatttaaggtaaatcttaatatttgtggcctaactaaaggtttgggtacaaatttcaacataaaaatgctgtctctgtttaataccaatctaggaaggatttatggaattgaattac

SEQ ID NO: 4055 - DNA, 1008 bp, Homo sapiens
ccataattctataaatatttattgatgcttactgtatgacaatcactattccagtaatgaagatgttaaatggtaagtattgttattgtatcttatatttgctccttggttaataataagtttcaattatgaaccatcaaacatttatatactcatatattggccatctttaaaaaacattcaagtcaatatgtattataactgcagcctttctcatatgcaatattctgaatattgacctctagccatttttcaaagtaccctaatagggcttctctttctactgttttacctcctgactactaaatcttacttggccctagcctttgaaactgtcttcacttgtgtgacttcattatctcctagctttctgctacttctaacatttctttctcttctgttctggcatctcttctactgcctgcacttcaaacgttgttgttagtcagggtctattatcttgagattttcttctcttctgactctaccgaatggtgtcccactccctcagtttcaattacagtacttatctgatgactaccaatctatatctttacataaagttttgttagaaattgtatttcttatatttttttacttccatgggacatttccatttagatgatttcataggtaccttaaaccaatatacatataagaatcacctggagatcttcttaaaatacagagtacaattctataaatttgggatgggtcctgagagtctatatttcttacagtcctacagactgtggtccacatttttaatacaaaggctttaaacacagcatgtccaaaaactgtattaatcctcttctctgttaaaagtataccatcttccctgtttctataaatggcattatgatcaggcaaaggcataagcatgaaacacaagaatcatgattgatctttcacacgttatatccagttagtcaccatgttgtgtctcttctccctcagtaataaccttcatagtccctttctcttttctgtattttcaatcaggac

SEQ ID NO: 4056 - DNA, 1028 bp, Homo sapiens
attaagttaacctattctttctttctttcttttttttttttttttttttttttgagacagagtcttgctctgctgccaggctggagtgcagtggcgtgatctcggctcactgcaaccttcggctcactgcaacctccgcctcctgggttcaagcaattcttctgcctcagccccacgagtagctgggattacaggcatgcgccaccacgcccagctaatttttgtatttttagtagtgacggggtttcaccatgttggccaggatggtctctatctcttgacctcgtgatccgcccacctcagcctccctaagagcggcaattacaggcatgagccaccatgcctggccaaattaacctattcttaaagttttattgctgcagtgacccttagagatcatcagaattcttaatctgaaatccatcattggtttcagagtccatgaacagcctgcattaaagcgaaattctatcagattctcagaagggtcagtgactccccaaaaacgtaagaattgatccagcccaaagtcatcaaactgttaagaatcattgtctttttaggtcacattaaggtagttttttaatcactactttatgcctttctgtattttccaaactattttaaataaacatgcatagggcatgtgttgttgttgttgttgttgtttttaattaagtaaatgctgttttagaacctgaaaaaataaagtccatctttcttgaacctccataaaaaacaaatctaaaaaccaagaagaaatgaaatggatatgatacgttcttaaaattgccagccttctcttatggtcacagcatttccaagtatattcctgccctataaaaagaatagtcaggctctgcaactacaaaaaaagtggtgtttaccattgaatccatttcagctgaattcattgcaataaaatatttgcatttgagttttttataatgagcttttactataaagagaatgtgcaggttctatagctagaaaagagatacttaccattgaatccatttcagctaaat

SEQ ID NO: 4057 - DNA, 1050 bp, Homo sapiens
ttgctttaatactaacctttcgattttaaataaaatagtttccaaaatgagaatctatagctacaagcagtacctcataaggaaagggaaaaaaaaaaaagtactgtaacatttgtcttgcttcagtcgatgtttatggtttaccttttcagattaatgcagttaatctgttgaacaaagagcctactgttttaccattttgcaatttttgccctattaatataacatagtataaggcagtattcctcatccctgcctgcccattacaatcatttgagtagtaattaaaaatactgatgcatggatctcacccctagatatcctaatttagtttatctggggtaggttttagggatcagtaatgttcaaaatatttccaggtgattctagtgtactgtcagggttgagaactccgctctaaggtagtttgaatttgaaagcttgagaaaatttggagtggccattttcattacagacgaacaatgagtaatatccctgaatagtccctgaactgaaaattctattaagtagacatgataatggcctcacgtacacaacttgaacttaaccaatactgtggaagtattaatcttataataaaagatgttatatattgagcatctaaaaaatccaggcttttcactttttttggtgacttcttatagcaattctggaagtaaataacccttttgttgagacagtaaactgaagctcagtgaatgacttacccaagggggcatactgcttgtaagtggcagagccagaactggaccacatacaactttgatttgacagcttggactcttttcactataccatgccgtatgaaaatttgatatttagtttgactcaacttaaataattagtttatcaaggttttcttaaggtcatgtttctttagagccgtggttattgttaccaacaaaaatactttaagtgcttcgtattggaaagtagagtatttctgacttggacaggtttataaatgtgtaatggtgctggtggtggtggtagtggtatgatgatggcacaagagttaacaaatactgc

SEQ ID NO: 4058 - DNA, 1024 bp, Homo sapiens
atttaaattataaagtagactggaaagatcatttgagttgtccagttaaaactaaattggtaagatacctgtgtttgtagtgagaaaaaaatgttagcatatttctgttgtttccttccagtactgtctttgacttgtacatgctgaattctgtttgaagtattatggtttgtaaagctttcaggcataatgatgtgttattattattggtagtaaaggtttgtttttaacagtaagtgcattttcggagttctaaaagaaaaacaagcaggcaagctttgaaatgttagtattcagccaaaatttaacccttgatttctctgtatctgaacctgaaattccaagtatctcaaaaatggcttgcaaagccttacatgtttttcactttactggttcacatataccagtaaaacattttaatgtttagaagatttctttacatataagttattctttttcttgcatgtaaataaaatctaaacaagtttttaaaacttgattttaaatagatttaagacatacaacttaactagtttagtagaccttttgctgcccctctgttctttttgctgaggtattcacatgggacaaattgctgaataaatctgtatgagccatcctctccttatctttaagctgttctatgggctgtactactactcaaccaacatcctttttcactgaaacaccaaactcagaaggactgaagaacaaggggcattttataataaacagtgtttaccacacacacccccttgtgattagggtaaattgagaggtctgctatttgacaacagatatgccaaaactgtaaaccaaatgcatgtaaaagctatttttacttactgccttttcttagtagttcttcataataccccagttttttggtataattttagtagaaccaaacttgcaccacaaacctctaaaattaattatattcctattcaattttcattattaatggagctatatgttgtatcttgacacatttcagcagttgcagctcagcaataaaagtaga

SEQ ID NO: 4059 - DNA, 1027 bp, Homo sapiens
ccgcccctccccccgttcgggtccgcttattggacggaagagcccctgcgcttcgctcttggttcggtttacggttggtttcctctgccacagagctcaatcaagacgacattcaattgggtaaacttggagaagaaggcggggctaaaactggcgaaggcgtggcttcttggctgcttgacgaagtgtcgtgaataaaagaaaggagaccgcagaagtaaagaagtggggagtttaggcaagtgcctgatttgggtaatcgaaagcacccagtgattgtatttgatgacttttaagctttcatatgccgttatttaatacctgtcacttccaaatgagagatgtaagggcaacggccgttagcgttctgttttggatcaggctctggagtggacgcccctagcttaggggtccttctaggcagccagaaacctgcggaaaatggtagcgatggcggctgggccgagtgggtgtctggtgccggcgtttgggctacggttgttgttggcgactgtgcttcaagcggtgagtgtagatcaccttcgcagctgccacagggagagtaggagtgattgcagctgagaaagacgcaacattcggtcctggttgaaaagggtggggaggactgcgcttccttaatgactgctgcggccagaatgcaacgtggcttaatttctcggttgatccttctccttccccgccttgggtttctagcagcagttttctcttgatttcagattgtcttgggtacgtagcttctcttatacggctcttgctaaaaacaatctgtaaaccacaccaggtgggaggggggaataataaagcttggcaagaagtggaggttgtttttaaatggacagaaatgcaagagactcatgacgagacttccaactcttagaggcaagtcttcaagtcgttggtccaggcgaacagtttgtgtttacctctctcgcgcgcgtgctctctcattttcactacttctgttagtctcttaacttccgttctcctctgctattcatatacggct

SEQ ID NO: 4060 - DNA, 1047 bp, Homo sapiens
ttcaggttaggtagaaatatatgacttttttttctgcttggagattaaatatggtttaggaaaatgtgtataactgtcaagttttcaagggatagacagtacgatttttgttgtattaacttgacacattaaactgtgatgttgctgtgaagatattttgagaagtgattaaagtccataatcagttgcctttaaggaagggagattatttgaggtaatctaggtgggcctgattcaatcattaagaggacttaagagcatagctgtttcctgaagaggaaacttcacctatggacagcttcagtctacctttcctgaggacccacgtgatggatttcagacatacaatcatgtaagccaagtccccacagtcaatatcttaatatgtatctcatactggttattcttcagtggttaaactctgactgacacagaatatgtgtgtatttatttattatttgtaaattgtttttctatattttcctgttgggaggattatattgtcttattgatttgtaaaggctctttgtatattaaagatatacatcaaatatgttaaaaaaaattttctcatcctcctattgttttctctttattatgcttttaaatgtggagaactttttaatttttataaatttatatttattaatgctttcttttatgacatttgtgtttatatttagaaatccttatattttatagaaatgtaatctgcttaacccatttctgtaaatgtgagcaatagatgtcatggataatcctggcaattgctaagcaacattccattactcaatactgagactgagcccttttataaaaccctgtgacatactccctcaattattgaattgttctctccagtgtttaaattccaggcttctctaagatgctttaatttggcctggcttctgcctccaagcatactatgttacttccaatagacatttcctgttctagctgcagcccaatgtgactagactcatggctctcagctattagagtagttcttggaacaataaggagcatgaaaacaatattttttcccct

SEQ ID NO: 4061 - DNA, 1049 bp, Homo sapiens
gtggctcatgcctgtaatctcagcactttgggaggccgaggtaggaggatcacctgaggtcaggagttctagacaggcctggccaacatggtgaaaccccatctctactaaaaatacaaaagttagccaggtgtggtggtgcacgcctgtagtcccagctactcgggaggctgaggcaggagaatcacttgagcctaggaggtggaggttgcagtgagctgagatcatgccactacccttagtctgggcgacagagtgagacttcatctcaaaaaaaaaggtgtgatgaacattaaagttaactgagaaatttgcagttaactctgtgggaagtatcactgagatgattagggtttcatctttaaggtatgattgaatgttttacaattagaatgtatattatgtttataattagaaatggtagattttaagatgaactatatggcttaagtgaattgatttatttaattttttttcttttagaaatatgtgccgtatcacgaatttctaagaaagaaattggtcggtgttttaaacttattttgaaagcgctagaaaccagtgtggatttgattacaactggggacttcatgtccaggttctgttccaacctttgtcttcctaaacaagtacagatggcagctacacatatagcccgtaaagctgtggaactggacttggttcctgggaggagccccatctctgtggcagcggcagctatttacatggcctcacaggcatcagctgaaaagaggacccaaaaaggtagggttcgtcatcaggaagtgtggcagtaaactgaaatttgcagcatgtgattgtttttccattttaagtctgaaccgggtaaatagcaagaaacccacatttgaccaggcgcgggggctcacacctataatctcagcactttggaaggccgaggcgggaggatcacctaaggtcaggagttcgagaccagcctgatcaacatggtgaaaccccatctctactaaaaatacaaaaattagctgggtgtggtggtggggcttgtaatcccagctattcaggag

SEQ ID NO: 4062 - DNA, 1031 bp, Homo sapiens
ttctccagttcctttgcaactagtcaaaagtgctcaaggagggcttccctttatggaaaaaggcaaagtcttcttgagactttttaatcctttttgtccttttcaccctctaccttcttcctgcctagaatgtagaagcgaggcctggaggtgaagcagccatcttccattcatgccacagctagcatgagggtgaatgtctatataataaggatggcagagcagaaagatgaaaagagactggaactctggaagcagtttgaagccactgtacctacccctaccttgtaatggatgagacaaataaacccctatttgtttaagccactgtagtacagttctctgttatttacagatgaatgcattactgatataggttacatggtacaaagatcaaatttctcttctagaagataagttgacctgaggaaaagtcctgcaatgcacagagagaagccagtcagaaggctccaggaccccaggaaaaagacagtgaggccttgaaggatttagtatgagaaaaaggtaaattatcacaaatttttgtcatttgtaaattttttccataattcttatgatgaaaataattatataaccacacacttaccaaatattaaattaaaaattatttccagataaaacaagtctacttggtctcagttggataaactcaagagtaaaacaacaaaacaaaaacctcaaccatgttactgacacatgagaatttcattttattgctgctctgggaatacatctaattactcaataatgccaattaaataggaagttcacctgctgacaaacagctatcttgggatatatcagaataaaccatagaaataattggattttctaatcaatattaacttcatcatattatacacttgctagtttccttcatatttagcaacaacatttgtttcttatgtttagcctttcatttgtgacaacaatctcatggttaaggaaataaaggctgggagcagtggctcatgcctataatcccaacactttgggaggccgaagcagat

SEQ ID NO: 4063 - DNA, 1172 bp, Homo sapiens
ttatgtttaataaagtaactgccaaactgtttgttttccaaaggggctatacccttttatattcccaccagggttgtatagagttccaactgccaacactcagttttcagccattctgatgggaatctagtggtatctcattgtggttttattttcatttccccgggtgactaatgctggtaagcatcttttaaggtactttttggccagttgtatattttctgtgaagtggctgtcaaatcttttgcccacttttaattggattgtttgtcttattgagttgtaaaagttctttatatatactgtattaaagtcctttgtaagacacatgttcgtaaatacttttctttcattatatggctcagaatctggcaactttttaagagatacttgagcccactgaatgatatatagatcttatagtttttttaagtcaagccttaataataattaacattttttgagtgttcatctctcagtccctctatggccatgaaggtgggagatgtgactctgtttagtctcaagtaaagaaatgcaaactgagataatgggtacaaatggagatgaagcaaagccctgtgatgttcaagttcctggtttctgttaccattcagtctggctggacctctgcctttcccatggtaacatgacctttctaatgaattctcccttttcatctaaactgtttcagattgagtttctctcacataactaagagatctgattactatagcttcggagcttctaaggcatcttatgcacttgtctcttccccactgttcaatctgaagcatgtactctgccctttagcaaaaatcacaactccaccaggtgtggtggctcatgcctgcaatcccagcactttgagaggccaaggcaagaggattgtgtgaagccaggagttcgagtccagcatgggcaaagcaagaccctctctacaaatgaatgtttgaaaaaaaaaaaaattaaggccgggcatggaggctcacaccaataatcccagcactttgagaggccaagacaggaggatcacttgaacccaggagtttgagaccagcctgggcaacatagcaatattctatctctaccaaaaaaaaaaaaaattaagaacaaaattagccaggtgtggtgccacatacctgtagtcccagctactcaggaggctgggg

SEQ ID NO: 4064 - DNA, 1044 bp, Homo sapiens
agtggtgatacccccaaattatttcttattgtgttatttgagtcttttctcttttcttatttattagtctggttagtggtctatttcattatttttttcaaaaagccaactcctgcatttgttgattttttgaagagtgtgtgtgtgtctctatgtccttcagttcatttctgattttggttatttcttgtcttctgctagcattggtgtttgtttgctcttagttctctattcttttagttgtgatgttagattgttaacttgagacctttctagctttttgatgtgggcaaagctttttgatgtctctgcatttagtgctataaatttccctcttaacgttgctctatctgtgtcccagggattctggtgtgctgtctctttgttctcattggtttcaaaatcttactgatttctgccttaatttcatcatttaccaaagagtcattccagagtaggttgtttaatatccatgtagttgtgctattttgagggaatttcttaatattagtttctaatttgattgtgctgtgtctgaaggactgtttatgatttcaattcttttgcatttgctcaggagtattttacttctgattatgtgatcaatgttagtgtacgtgccaagtagggatgagaagaatgtgtattctgttgtttttgggtaaagagttctgtaggcatctatcaggtccacttcatccagagctgaattgaggtcttgaaaatctttgttaattttctgtctcaatgatctgtttaatattgtcagtggggtgttaaagtctcctattattattgtgtgggagtgtaagtctctataaaagcctctaagaacttgctttatgaatctgggtgctcctgtgttgggtgcatatatagttaagattgttagattttcttgttgaattgaaccctttaacattatgtagtgtccttctttgtcttctttgatctttgtttgtttaatatctgttcagaaactaggattgcaacccatgcttttttctgtttgccatttgcttggtagattttcctccatccgtt

SEQ ID NO: 4065 - DNA, 1082 bp, Homo sapiens
gaaatcacacgtcttctgcatcgctcatgctgggagctgtagaccggagctgttcctattcggccatcttggctcggccttgcttacttttgattttagaggctcataggcagaagggacttgccttgtctgagatgagactttggactgcagacttttgagttaatactgaaatgagttaagagtttgggggactgttaggaaggcatgattgttttgaaatgtgaggacttgagatttgggagcggccaggagtagaatgatatgatttggttgtgtccccaccaaaatctcatcttgaatcgtaactcgtacaattcccacgtgttgtgggagaaacccagtgggaggtagttgaattatgggggcaggtcttttccacattgttctcttaatagtgaataagtctcacaagatttgatggttttaaaaatgggagtttccctgcacaagctttctcttgcctgccaccatccatgtaagatgtgacttgctcctccttgccttccaccatgattgtgaggcctctgcagcctgtggaactataagttcattaaacctctttttcttctcagtttaggtatgtcttaatcagcagcatgagaatggactgacacaggtaagatcagggagaattccctggattaccaggcagagactcttgttctcttcccttgcttttccccaaacaaatgaagtctctctttctatgtttagctgcctggaactgggagaggattgatgcaagagcccctgtggccaccaccactgggactgcaccaggtcagaccaaaactcagcacagcattgggtcttgatgaaggcccgaggcaaccactgcctggttcctgccaatgttcactcaaggcccaagggctcttcagttagcagttggtgaatccagccaggcttgtgtcctatccttcagtgcagtgatctcccccataacccagggtgggtcccagaatactgtctgggagcgagggcttggagatgggaaccagagcctggaatcaggaatgttatgaatctacttggtgttctattctactgcggctcagctggcaccaatgccacaaaac

SEQ ID NO: 4066 - DNA, 1050 bp, Homo sapiens
agaggccgactccgggcgctgggcccggggcgggcgggcggcctccgggcccgcagaacaaagcccacacggccatcttgagacggtaaacagaccccctgcgtaggccaccccgcctcctgccagctgcgccgaccagccagaggcagcgcttaccgtcctcgaagtccatggcagaggctgagggccgtcggccttggcggcgctaggctgagctatggccggcggcgagcgtccgcgacccgcgattccacacgatcactccgcgcgaccgagagcggcgcgctaccagcccgggagccgcaggccacagcgaggctggggaggcggggccgaccggcgctaccagccccatcggcgcggcctgctattggctgacgcgggctggtgggcgggccctcgcgtggggggcgggaagcaggtccgctgtcacgctcggaggtgctgaccctctggagccgctgacggggaaggaaggtaaaaaaggagcgctaaagattggcgggggttgtgggaaagcaagccgagtgtacgggaagggccggctgcggcccgccatgtttgaacctggcaagagcgaaagaagccggttggaatgccttcttcctgcccaaactaataaaaccgcatgcctaccttttgcttagtattggctagggatgactaatcataacatttgtaagtacttacggggtttcctccatggagacacagaagtctgggacgtttctagaagcctgtggcaaatttgaaaagcaagatacaaaatagcgtatggagtctgattatcgctatgtcaataaattttcttaaaggacaaagcactgaaataaaatggaaataataattcttttaaaaaatttttaaattatttttatagagatgggggttttgccatgttgcccaagcaggtctccaactcctggactcaagcgatccccccacccccagccccgtctccgcctcccaaagtgttaggatcacaggcgtgagccaatgcgacccgcctggaaagaattctaaaacatggcctgcttggccaccgcccag

SEQ ID NO: 4067 - DNA, 1027 bp, Homo sapiens
acagtgacagcaaaggaataatcttcagtttgtgtataatgaggtctgaaatttccgtcgccacatattgatcatgaatcttatttcactagataaactgacagcagagtctcagttacttaaacaaaattttgaagaaaatcaacattatcacccacatctatggcttttttttttcctactgtcactttcatggttcagttattttgtctatatgcagtgatttccagttttttctggattcctcaatagtcaaatctttcctcaatcctacatatatgctcctacatccttaaaaatatgatttaatagaaagacaactggtttggcaggcagaaaaactgagttctaatcttaactctgctgttaactagcaaaattatctaggctaagtctcttaacctcagctttcttatctgaaaaatttattcctccaataggtatttattgagcaggcattatgtgccagacactattcgaagtgttcaggatatatcaatgaaaacaacgaggcctctgccctcagggagcttacattctagaggaatcagaccatgaaaaacatatgcaaaagacaggataattatattatataattgcaggtgcaaagtgttatgaaaaaattaaaaataaactgggagtggggacaggttgcaggtcaggagagacctctgaggaggtgactagaaggaggtgaaagggttaccatgagggtgtctggaggaagaatattccagaaaaaattcctaacagtgtttcctcagtttttttttcccctttagattccatttatgcttgtttacctcagtgaagatttacaatatgtacgaccattaggccagtcttgtatattattccatacatttctttgaatagtcaacaaatgaccaactattccctctagagctagccccatgggtcctaggtacaagagcctgttgccttgtatttactttcagggacttctgtgtggtattttccactggaaaggtcaggtttatattatatcaaacatcacatgaggatt

SEQ ID NO: 4068 - DNA, 1044 bp, Homo sapiens
ttgcccaggttggagtgcaatggcacgatctcagctcactgaaacctctgcctctcgggttcaagcgattctcctgccttagcctcccgagtagctgggattacaggcatgcaccaccacgcttggcttattttgtatttttagcagagacggggtttcaccatgttgaccaggctggtctcgaactcctaacctcaggtgatccacctgcctcggcctcccaaagtgctgggattacaggcgtgagccaccacgcccagcctagaaacagaatcttataggctgggttgcacataggcaggtatggacatataagtctagatttacaagtaggtcacactgacctgaaaccacatttcctgtagtatgcaattagactgaaagaaagtcacatctgtgttttccacattgtgatgtgatgcactgcaggtcttcagtgaattcgcttgccacaaggaaattctggcatgtgttgtatgtgaaatgtgatatgtacttaatttaaaaaattgagtttcgtgatttctgtgtctttaaatttgatacacgttttgtattgaatttctatgttaattgttttcataaagtgaaaagaagtaaaaacctcaccaactggttttatgtagaagaggtaaatctgtgacgtttgctccttctcttgtccaggaggatgaggctgtcactactacagttgggactgtttcatactccgtgctcttgtgctatgccagggggtactgtctaacccacaagtctctgccaggaatgttgctgtccacactggagtgtaagacacctgcggagctcgtctatggggctcatgttggctgaggctctgaactacagaactgcaaacaaccaagggagcgccccaggccccaggtattcctaaaccttagatcagagccatttgcagcacagagttgtgtgctgtttcaaaaccacagaccctgtatatacgcccctccattgcagaggtggatgtcttggcaaatgtaggacgaggattgaaaattaaaaaacaaacacaccgtgttcagggtg

SEQ ID NO: 4069 - DNA, 1023 bp, Homo sapiens
ctgcagtggcatgatctcagctcactgcaacctccgcctcccagactcaagtcatcctcctaccttggctccccaggtagctgggacctcagctgtgtgccaccacgcctggctaattttttgtatttttggtagagacagggttttgccatgttgcccaggctgatcttgaactcctgagctcaagtgatactcccgtctcagcctcccaaagtgctgggatcacaggcatgaaccaccgcacccagccatgactgctcagcttctatagatttaagagttcgtgcaaatattttaaaatttgagtctaaatattaaattttgtgtatagtgtttgtagcttcaggagtggggagagggtagttctcagtatggtccaggtagttgtaatagaagcctggtgagtataatttgaagtccatctcttttaaagagagaggttcctgtctttagattccaaaattcacatgtggatccagagtacagaaaaggtagaggactgccatgagaattgagaagtggtagaaagagtcctggactgggagtgggaactaggtttatcatgtcccaattatgtttcttgaggcaaattttagttttcctcataggcaaaatgtatataattgtaatatctactagtctactttgcagggtagtttgtgccttatctgagatgaagtaaatgaaacacttgctgtgcatgcgcaggattttgtgtgctacaatgcaggttttataggtgaaggtaatgcttatagccctggagttgtccaaatatatgaaccaaaatataaagaaagctagaaacccacctgtgggaacttgggagaatagaatagttttagcgtggataccagagacaaatggatagtatagtcattactcctttttcagattcataggaagtaccctgttgccattgcaagagattttgtttttacacttcctgaagacctgttgtgtataaagtaaccttaagatagccccctttatactatcaagctcaattctgcagcagtggca

SEQ ID NO: 4070 - DNA, 1336 bp, Homo sapiens
actgatcgcccatttttttctattggggtgtctgtctttttccatattgactcttagcaattccattaatccttaggttgtatgtgttgcagatatcctctactttgtgactgtacttttcacttgctttatggtgacttccaataaatccttttaaattttttagtcattttatggcacatgttcttggcttttgtatgtctggtgatgcctttatttggttaattttttttttcactgtttagggtttatttgatgttttagttagtatggatattcacttaattctagaatgatatttttactgggtatggaattctatattgatagttattttttcctcacagattgaggctattccatcattttctgccttgttcttggaagttcagttgttgctcatcttaaaataatctgttctctattttctggctgatttttagacatttatattaatctcgagtttttaaagttttcctctaatatgtctgtgggaatttttttgttgttgtcaagtttgagatctctgctgggattctggaaatttcctggctgttatttatctctcaactgttttttctgccccattttctctctctggttcttttgggactctaaatataagttaaatccttctcactgtgctttctagattttttgtcttctctgttttctttctctttgtctctctgtgctgcattctagtttcttcccctgattttctcagcgactgttacttcagttatactattattcagatctagaatttccattggctctttttcagatatactttttattgtttttagtaccctaggttggcttttatttctttgaatatggtgcaaatagttatttttacattctgtgtttgatagttctgggactccaaaatgtgggtcagattctgttagtagttgattttttctgcttgttcatggcgtcttgttttcttatatgcccatatgtttgactatgtggtggacattgtatttgaaatgtattatagaactattttcaggcctaggacagtatcttctcccataggattttcatttacttctgccaggtgtctaggggtgctactagttcagaacaccctaatccaagttcatgtcttgcatttacctggcctactaagatgacccaaagtcaggctataagagctatctcatgggaaggctggttttacaactggttcaccttttgccctgtgggtatagttttgttcttctagccccatgaggccattgaaagtgcaatttagttttatagctatttattcagatcggacatttccccctgggcaaaactaaaatgtatccctgctggatgg

SEQ ID NO: 4071 - DNA, 1029 bp, Homo sapiens
catctgtgatatttcaaatgacagactagaatcacttttcatccccactgcagaagatagctatcatatttatttcaacaatgggaacttgttttcttattttgagggccagccacattcaattatagatctttcatcagtagccatacctttactacaaccttggtttttcttatcacaaattattgaataatacctgtaatagtttaggcaaacgacaactgtaataataaataaaatttacagaattgattcttcatactgcatggttcttagattagaccagaagtcaaggtgaacaaagagtgcatataatctaataaattattgatttatttcttgttaaaattttagataagaaaaagaaaaaaatacttataattccctacattaaaaattcatcatatgccccctagtcttttttttctgtttgtagaatttttcctttaaaaaaaaaaaaaaaagaatttgctatgtagaaattgaccctttattctattagcagtagatccatgagcattttcatgccactaaatattcatcttaaatatacttaaattttttacaattttccattatcctatacattatttactcctccattattactcatgttatattgtctccaggattgggcatcataaagaatacttttgtcggcccagcacagtggctcatgcctgtaatcccagcactttgggaggctgaggtgggcagatcacctgaggtcaggagttcaagaccagcctgatcaacatggtgaaactccttctctactaaaaatacaaaaattaactgggcatggtggcaggcgcctgtaatcccagctacttgggaggctgaggcaggagaatcacttgaacccagaaggtggagattgcagtgagctgagattgtgccattgcactctagtctgggcaacggagtgagactcagtctcaaaaaaaaatgtttttgatgattattcttgcagtaaattgtacacatccaaaattatttccttagaataaatttctagtagtagagtta

SEQ ID NO: 4072 - DNA, 1047 bp, Homo sapiens
taaagaacttaatttgctcaaacttacacagttaataagtagcaaggttgtaattcaaatcagggctatcttacctaatctttgtttttaatcactattctctaccttacacaggcggtctatttttgaatttcttatttttaaaataagaaattgaaataaaaataagcaatggaaaattctaaaatgaaggtgggtttgttcatttatttatttatttattttgagacggagtctcgctctgtcacccagattggagtgcagtggcgcgatctcggctcactgcaacctccacctccctggttcaagcaattcccctgcctcagcctcccgagtagctgggattacagactcatgccatcatgcctggcaaatttttttgtatttttagtagagatggggttttaccatgttggacaggctggtctcgaactcctgacctcaggcagtctgcccgccttagcctcccaaagtgctgggattacagccgagagccaccgcacccagcctgaaggtgggtttaaaatggggactattctggtgaagactgaataaataagagtctaattaaaaagagcagagatccaagaagtgcttaggcctaaattagactttagaggagttaatgttccattctgattattcaagcagattatgcaaatatccaataaggcaagatatctccagtccagattttattagtccattaaaaaaatgcttttacttcatctgaaaattctgcaaaacacaggattaattacttataaataactggtagtaaatctccatttaccaagaatgcacttatgaagattatctaaaaaatcttcattatcagagagaaaagtaatgtaggatgactgggaatatgtttaggtcctgaagaataaaagagggtgttattttaaaaatatgattaagtactaccaaaatattagaagtactaggaaatagaaagcgtgtgtttggcagtcctaggcaaagaaaaggaaaatgagaaactgaagaaagcctagggtcttattttccacacccagtagccacttt

SEQ ID NO: 4073 - DNA, 1070 bp, Homo sapiens
gagcaaagacttgaaccaagatgaaatagtttgccatgagactatctgggagaaagagcattccatctgaggaatagtcaatgctaaggccttacgctagtagagaacatattcaagaatagtaaaaacaaaacaacaacaaaaaagccaatgtgtctacagcagagtgagtgagttggggagaggagtaggaaacgaagtcaaagggttactaggtagtagtatctctctgtaggtcctttcaggtcattgtaagggcttttccttttttatctgagaaaaacagggagtcattttagagttttgagggacattatctgtatggatcactccgattgctgtgttgagaatagatggtaagtgtgtaaggatctgtccttgtactaataccagattagtcagctgatgaagtcctagtggatctgggtatagcagtgatgagaagtgattggattctggatgtattttgaagataatagcagtaggaattcctgatggtttagatatgaggtgtgagtaaacaagaacagtgaaggttgctccaaggttattggcctgaacaactgatatagatgaggaaggctgctagatatgtgtttgggaacctttcttttgtacagtgagagaagggtgatctttaaaagggagatgggtaagaagaactagagtattgcaaatataacatccagatcaattttagggaaagagtacttacggaagttgaggaactagaaattaatacttgacctgcatactctttgagaagtctgtctgtactttcaggggcatacatagcccagtttgaagaccactgttcagatcaaccttagtaattatgttattaaaatcttctatattcttctttactttttaagtctgcttgatttgttaacctttgggagaatcgtttaaagcctccctctgtggctgttgatttgtcagtttttctttgtacttgtaaaagttttttatttttatattttatagccattttgttgtgtgccaagagattcatgaatatctctatactttattaatgtataagattcatcattaccaggcctagtact

SEQ ID NO: 4074 - DNA, 1045 bp, Homo sapiens
ctctacctgtgctctataaatgaatcagcaaagcctggatgacagttcacctgttacagcatggtttatgaactattttaagcctactgttgagacctgctagaaaagactccttttcgaaatatgctcattgacaatgcacctggtcatccaagatctctgatggagatgtacaagatgaatgttgttttcatacctgccaacacagcatccattgtgtagctcatggaacaaggaataattttgaccttgaagtcactaagtacatttcataaggctacagctgctgtagctagagtgattcctctgatggatctgagcaaagtaaattgaaaactttctggaaaggattagctattctagatgcaacttaaacatttgtgattcatgggaggaggtcaaaatatcaacattaatatgagtttggaagaagtcgatttcaaccctcatgtatgactttgagggatgcaagactacagtggagcaagtaactgtagatgtggtagaaataggaagaaaactagaattagaagtagaacctgaagactgggtgccatggctcacgcctgtaatcctagcactttgggaggccaaggcaggtggatcacttgaggtcaggagttcaagaccaacctggccaacatggtgaaaccctgtctgtactaaaaatacaaaaattagccgggcgtggttgtgcaagcctgtaatcccagatactcaggaggctgagccaggagaattgcttgaacctgggaggtggaggttgcagtgagctgagatggcaatactgcactccatcctgggcaacagagtgagactctgtctcaaaaaaaaaaaaagtggaacctgaagatgtaactgaattgctgcaatctcacgataaaacctgatcagatgagaagttgcttctctagcgaagaaagtggtttcttgagagggagtctactcgtagtgaaaatagtgtgaacattgttgaaatgacaacataggatttagaatattacgtcagtaaagcagtagcagggtttgagaagattgactccaa

SEQ ID NO: 4075 - DNA, 1219 bp, Homo sapiens
cttttattactcatttgctgagtgttttgcttttttcatgaaacagtgttgaattttgtcaaatgctttttctgcatccattgagatgatcatgtagtgttttttctttgttctattaatgtgatatgttacattgattgcatttcttatgttgaactaccctggcattcctggggtaaatcccacttggttatgttatatgatacttttaatatgctgttggtttcagtttgctagtaagttgttgaggattttggtgtctgttttcataatggatatttgtagttttctttgagtatctttggctttggtattagggtaatgctggctgcttagaatgtgttaggaagtgttgtctcatcttccatttctgaaagaatttgagaataattagtgttaattttgtttcatagaatttaccagtgaaaccgcatagtcctggatttttccatttggggaggtttttgattattagttcattctctttacttgtactaggtctgttcagattttctatttcttcttgacttcattttggtaatttctgtgtttctaggaatttttctgtttcatctagattatccaattttttggcatccagttattcatagtattctgttataattcttttaatttttaaggttggtaccagtgttcccccacttctattcctgatttttcacttgtgttcttctctcttttgttgttgttgtcaattcctttgtcaatcttgttgatctttttaaggaaccaacttaatttttttaattagaggacggcttaggtaggggtttcttgtttttgtttttgagacagagtctgttgtccaggctggatttgaactcctgggctcaggtgagcctcctgcctcagcctcctgagtatttgtgactaaaagaaccaatattctcttatctttattctaaagattgattattttcttctttctactggctttgggtttagtttgctcttctttttcctaaggtaataattccctaaggcataaagtgagatggctaatttgacatcttcttttttaatgtaggtatttacagctgtaaattttcctctacatgctgcttttgctgcatcctataagtattagtatgttgtgttttcattttcatttgtgtcaagattggccatcatactaaatctcatctgtggggaatgcagactgaagctgagataaacttacactggcataccctgtttt

SEQ ID NO: 4076 - DNA, 1025 bp, Homo sapiens
cccatgccttctgagagctttacaaatttagcttttatattcagattgttggtccattttgatttagtttctgtacctggtgtgagacaggcttccaacttcattcttttgcacgtggttatccagttgtcccagtaccatttgttgagaagactgttcttttccccattgaatggtcttggcactttgttggaaatgaattggccatagacgattgggcttatttctggactcttaaatctattccattgatctgtatgtctaccctgcttctactgccacattgattactatagttttgtaatcagtgttctgaaatcagggagtgtgagtactccttctttttctttctcggtactgtttttgttgttcagggactcgttcagttccatatgagtttgaggataagcttttacaatcctgcaaaaaggcctttagaattttgatagggatagagttgaatctgggatcactttgggggaattttgccatcttaacaatactaagtcttgaaatccatgaacatagatgtgtttccatttaattaagcctttaagtttttctagcaatgttttgtagtttttagcgcacaagtcttttactttcttggttacatttattctttttttttttttttttttttttttaggagttttgcttttgtcgcccaggttggggtgcagtggtgcgatttcagcttactgcaacctcagcctcctgagtagctgggattacaggtgcccactaccacgcccagctagtttttatttttagtagagacagggtttctcgctgttggccaggctggtcatgaggttacacttattcttctggttattttttaatttttgatgctattgcaaatggatttattttcttaattttctttttggatcattcgttgctggtatatagaagcacaactgatttttgcatgttgctgttgtgcttgcaaatttgctttatttgtttattagctctagtagtttttttgtggatgctaaggaattttctatgaatagaat

SEQ ID NO: 4077 - DNA, 1034 bp, Homo sapiens
agacataatttttgctgcctagcacttgacatctaataccataattgttaaggtatttgtgtaatgtattgttttctagggtcacatatatagctataaaagatggtgctctgtgtctttttaaaaatttaaatacaatacttacaggaaaatgcatgaagtgtagggtacagctcagtgaatcaccacaaagtaaacactccatgaccaccacagatcgagaaatagaatactgccagcaacccagaaaccccctatgtctcttttctcagtcactatccctgttttttctttcccaggttaaccacttgcctgacttaaaagaaaataacttttttttacttgtttctgaaatttttcagaaatatacagaagtattattttgtctagcttattttgttcaacattatgtttgagagttagaaattttgtcagatgtcgctatggttcacttgtataattttatcacaatttgtcatgttactgtaggaggtttgggctgaataatgctgctgtgaacattcttgtacatgtttcttggtgcatatgtgcaacatttatactaggtgtataccaagactagaatctgggtcattggtttgaccagtgtatgtatgttcaaatttagaagatgacacatgaattgttttcaaaatggttgtatcaatcacatcaagtatatgaggattcctgttgctctgtatcctcactaacactcggtattaatatcccctttaattttagtcttctgaaagatgcatttccctgatccaaatggaattgaataccctttcataaatgtactggttgtttgggtatccatttttgcaacgtctcttctcctatcctcaccaccttaacaaaattactattgagctttctaacttactggtttataggaactatatggtttatacatacagccctatttttcctattggagtttctgtacttttccttttgtttttaggagtttttatatgctctaaatacagactctttgttagttacatttaaaaaatatatacattcca

SEQ ID NO: 4078 - DNA, 1047 bp, Homo sapiens
atctcatttgcttacggtgtataatacttttaatgtgctgtttaattttgtttgctagtattttgtttgaggttctcaatctcttttctacctggataaatgaaggcatacagataattttcataataaagccatactacagtgtatatttatagttcagtggaatgtaagtgatagtgttttttttttttttttttttgaaatggagtctcgctccattgctaggctggagtgcagtggtgtgatctcggctcactgtaatctccgcctcccgggttcaagtgattctcctgcctcagccttctgagtagctggaactacaggcatgtgccaccacgcccagctaatttttgtatttttagtagagacagggtttcaccatgttggccaggatggtctctatctcttgaccttgtgatctgccctcctcagccatatatttttttaatagataatcacttatataccctggtatttggttgtatatgcttcacactaattacaacacttgataatcatatgatatctgaactctagaccattgttttcaattatggctgcactttacaatgtcaaaggagatattcgcacacacaccattgccagagtcatttagattggaatttttcagaaggggactgaacattagtagttttaaaaaagtcttcaagtacagcaatatttaaaaattctctagattgttttggctacaaatacaagttgtatggggtgctttaaaaagtctataggccttggtaaagtggaatcaaattccaggggaggagttgcacaatctgtcatttttaaaagtttcccaagtttatctgaagcacagctaggttcttagtactggtctagaattttctcagcgacaagaaaggatagttagcaatttattttgattaagatcatttgcaagggccctgaatacaggttttctattgtatgggctgaaaggagatccatatgttttaaatgtcaattatacaggagctaagttgtttacttaaggaaattgacataggtgcttatccagatattaatcta

SEQ ID NO: 4079 - DNA, 1051 bp, Homo sapiens
cctttaagccatgcctggccgtagtttgtcttctttattagagtatgagtttgaaggtagataccatccatgtctcgtttatcttagcacagtgctgggaatactgtgtgcattcagtaaatgttttgttaaacattgaccaatgaaaagagttctcccaggcaaatagagattcagaatgctagctggaatgggatgggggcattggcacttgagttgctgttgggccataggaaggagccactgaggataatccacagacagcattatagacattttagaaagagaaataaaatatttcccaagtcttcattcaatccagttgaaatacagtggctagtaaaatattcttaattcagacctaaagtaagactgtcattgttgattttgattagtatttccaagtggaggtattaatccatgttgcagaaatttgaagtgtttgctatgaagagtattttctttgtgggtttgtactagttatttctttaaagattttggaatgttagactaatacaagtagaagattgggaacactagtcacacgtgtaagaagtgaagaaaacttttccttatttctctgaaggtaaaaaactgttaggatggaggaagaaattgtagaatcatagcctggaactgtgataacatttttgattcccacagcttaggaagcttgctatttgtttaaaggtacttaaatttttttaaattgtagatatgtaatgtagcatatataaactatatactttttttgttttgtttttgagatggagtttcgctcttgttgcccaggtgggaatgcaatggcacagtctcagctcactgcaacctctgcctcccaggttcaagcaattctcctgcctcagcctcccaagtagctgggattacaggcatgcgacaccacacccagctaaatttgtattttttaagtagagatggggtttcactatgttcgtcaggctagtctcgaactcctgacctcaggtgacccaccctccttagccttccgaagtgctgggattacaggtgtgagccactgcacctggcctaa

SEQ ID NO: 4080 - DNA, 1170 bp, Homo sapiens
tttttttttttttgccatatgaggtaacattgtcagatttcagggatcagggtgtggaagtcttttgtggggcaatagttcagcttatcccactcagtcgtttataatagacttttaatgttcttacttttattttatagtttagtttttaacaggcccccatgtccacttctgggttggtgggagatgatggcattgggtggcagagaaaatatctcatcttttctagatacgatgcagaaaattctaggtctgtggttctaggaaggacaaatcagagatgatagtttggaaataaaacagttaaagtaacctagcttgagaacagaggtaggtgtggtggtgctattttttaaagaatagagaatttagaagagtcacaagctagtttcaggtatggggaggaggagatatgtagagtgtgggacatactgagttttcagaagttctgaaatatggtaaaattagtaatggtggatatatttttggcaaatgcatgttcagtggattgttggtgtagaagtcactttatactagattaaagattaaattgaagatggggagtattgatacattctattctctagaataatgatgcttggcatttagtaagtaatcagtgttggctattatgataattactgtggttgctctaacaaattactttgttatatacttttatgtgtatatacttttatgtgttccaatactataacatttttgtcttcagctgtttggtgtgtgtcttgatatgtacataatattaaataaatactgatctagaaagatgtgtgttttagtaattattttaattattgccattgccatactattaaaattaatgaaaacaatttagaattttttttaaaaaaaagaattagtttcaatttctcatttgaatagattattatttctcaaaaaaagcagtgaggttggggggcacttagcaatagtttcctaaagattaaaatgatggtattctggttgaatggtttttttatgttatatcaagaaatataatttggtttgtgttttttcatttaaaataatagtgtattgtagctatggttattcatgcctgaaacaaaaaattaaaccttggtcattgtgtgtatttctttcaggtttgatttaattttggatgagatcgttcttgcagcaagatgttaa

SEQ ID NO: 4081 - DNA, 1017 bp, Homo sapiens
tgtggcaaagatagccactggctgctctaacctacatcgttctcataactgtttccactgaggattcaagtgacactttcccaatagtttttgcaaatgtactaagaagcattctacatctcccatttagtcccatccatgaacaaattactgtgctaggagaacagggtaatctgatcagcctgagagtcacttgtttatccttccattcaggtgcctaggattggggccactgtaatagttgagtaagaatgtgtccctatctggaaattaaggttactattagtaaaaatagaggcaatattagaaatagaagattgctctataacagtttttatagattttggagtgtcctgaaaaatttccttgtattgctggatccagtaaagttgtctaggaacaatatttcacaaaaaaattataattgaatggtgacattacttacaaaatgattttggtcagtttatgtgtctctgagtttgaaaaattttgtgacagaatgtcttgtagagttactgctaataaaagaatgaaatagatttgttcctttttccccccttgtcttcaaaagttaagagacctaaatcaaatgtcaatataaaataactcctagggctaagaaaaacttattatggtattgttaagatagagttgctctgtcagttagctaattattgtgtaacaaattactttgaaacttggtgatttaaatcaataaacattttgattagaacaagtctgtgagtcagccaggtggcgtttctggtcttgactgggctcatttatgaatctgcatttagcagcaggtcaggaaggtggctctgcttctcttggctgggttctctgatatatttgggcattgactggccataaggttgatctaggatggcctatattgagctggctgtagtttggtctaggatgtgctgtgacgtctgggataccctcccattctgaagcagatgagagttggcttgttatcatggtggtggcaaggttttgaaggaaagagcagaa

SEQ ID NO: 4082 - DNA, 1048 bp, Homo sapiens
caagaggtggagtctacagaggcaggcaggcctccttgagctgtggtgggctccccccagttcgagcttcctggccgctttgtttacctactcaagcctcagcaatggtgggcacccctcccccagcctcgctgctgccttgcagttcgatctcagactgctgtgctagcaatgagcgaggctccatgggcgtgggaccctccaagccacgcgagggatataatctcctggtgtgccgtttgctaagaccattggaaaagcgcagtattatggtgggagtgacccaattttccagatgccgtctgtcacagcttccctttgcttggaaagggaattaattccctgaccccttgcacttcccgggtgaggcgatgcctcgccctgcttcggctcatgcttggtgggctgcacccactgtccaccactccccagtgagatgaacccggtacctcaattggaaacgcagaaatcacctgtgttctgcatcgctcacactgggagctgtagactggagctgttccttttcggccatcttggaaccgcccccctccccttttttttttaatatcttgtaattttttgttgaatactgcacatttaaaataatgtcacaactctgataatcagattctcctctctgccccagcgttgtttgttattttagtgattttttttttgaaactaattctatgaaatctatattctttgtcacatatgggcactgaaatctctgctcagttggcttagtggtcagctaatgattggacagagatttcattaaatgcctgggagcaataaatctttttgttgaagttatgtgtgtgttgggatgctccttcaacacttaaccaggcagtttacaactctgccttactttttacttcctgcttgtgtagagcctcaggtttagccagaggtgagcacttaggtctttcctgggcgtgtatacagccctttctgtacatgtggctctctagagtctcaggaatatgttggagctttacaaagcccccagcttttctttttaaagcttttagtctattgtttg

SEQ ID NO: 4083 - DNA, 1698 bp, Homo sapiens
ttttcttagttgagctaaaggtttgtcaattttgttcttttcaaagaaccaacttttgggttgattgattttttttttctctactgtttttctgttctctatttctgctgtgttctttatttaattttttcttttgtctgctttgagtttagtttgtctttttctaatttcttagaaaattaggttatggatttaagattttttttaatgtagtcatatatagctataaatttccctgtaagcattgcgtttacttcatcccataagttttagtatgttgtgtttttgttttcatttttctcaatatactttctgatttgcaatgcaatttctttggcttactggttacatagatgtttgttgcttaatttccacatattaacttaccaatttccttctggtattgatttctagtttcattccattgtggtcagagaacgtactctctatgatttttattcctttaaaatttattgacacttgtctgatggcctaacacctagtacatactaaagaacattccttactctgctgttgttaggtggagtattctgtagagtttatagtgttcaagtcttctatttccttgatcttctatctatactatccattactgaatgtgaagtattaaggtttctaactattatttttgaattatattctgcctttcaattctgtcagtttctacttcatatattttggggttctcttattaggtgtacacatgtttataagtggcatgtaattttgatggattgacctttttattgttacaaaacattctctgtagtagcaattttttgtcttaatgtctgttgtttctgctgtgagaatagctgcatcaactctcttttggttactttctgcatggtataactttttttatcttttactttcagtttatttgtatctatttaatctcaagtgtgtctcttgtagccagttatagttggattatgttttttaccccttctgcctatgtgctttttgtttggagtgcctgattaatttccatttaatataattaccaataaagtggaatttacatctgctattttgctctttgttttctatgtgtctcattgttttttggggtggttattcctctagtcctgtagtgctgccttttgtgttaaatagatattttcaagtgtatcacttaaatcacttgttttgtactgtatacttttagttcatttttgtagtggttgccctgggaattataattaacaacttaattttagtctagttgaaattaatactgtaaattttaataatatacaaacattttgctcctatatagctctattccctctccttccttcgtgctgttattgccatacatacatccttttataccttttaaatcagacaggagaagaaaaagttacaaagagaaaacagttatactgtcttttatatttacctatgtggttaccttcaccatgctccttatttcttcagatggattcagattgctatctagtgttctttcatttcagcctgagggacactctttagtatttgtttaaatctgtaaatgtcttaatttctccttctgttatgaaaaatagttgtagaattcatggtcgagtctttttctttcagtactttgacaccattgccatccggcctccatggtttctcatgaaaaattagttgttaatgttactaaagttgtttgtctgtgacaagttg

SEQ ID NO: 4084 - DNA, 1035 bp, Homo sapiens
tttttgtctttctactgtgcttttcaaccttggttattcatgtatcaccttcatctgtgcgattattaccatttaactgcagcaagtaaagacgttaatagtgaggtttttgggaatgtggtaaaaccgggaggtatatttgactttgtccaagttatctgatgaggcagatcagctaaagcaaaatacagtgggttgctccctactatcactgggacctagagatttcatctacatctctgaaaaatggggtttctgtatgatagtatgggtgagaaggaatgacagcagaactatcaactgttttctgattatcctgatgaactagtggtataggaagcttttctgaaaacgctgctctgaattgcttgcttaagtagttgcttttttattcctgtgtatggctccagagttcttgggaatagccctacctccatttgtttgtagatgagagaaagctgaaccttctgctgtcagtggagaaggcctagaattagtctagaactggtgctatagggccctggaatgcttcaggaattggtggctgcagggacctctgaaggaattgtctaaaagtctgtataacaagtaagcaacactcatggtttcaggaatggatctcttgcctcatccaagttttcttctttgacattcaacctgaggatctctgtacttgagaacagtaggcatagttcaggttaagggcatcatactggaaaacagggagaattaaataaaaatctgcatgttgatctgagagttattcccagtctctttttccctcccagttctgagaatactggctgacaagttcttgccccatctagctgtgagattaaaagattcatcctgtgacagcaaactgctgagatcaggaaaaatatctaactgataacagatgtggcccagattgataatcctacagtatgtctactcattaagacagaatccctaggcaacttttaagtgcctcaatcttaaatatgagattaaggatcaccaaacatttgaggataaccttaatatgaaagagaa

SEQ ID NO: 4085 - DNA, 1076 bp, Homo sapiens
atatattggagggtgcctaattcgtgtctcatacatgagcacttgataaatactgaattaactgggtgcattggctcatgcctgtagtcccagcactatgggaggctgaggtcggcagatcgcctgaggtcaggagtttgagaccagcttggccaatatgatgaaatatcccgtctctactgaaaatacaaaaattagctgggcatggtggtgtgcacctataatgccacctacttgggaggctgaggcgggagaattgcttaaacatgagaggcggaggttgcagtaagccaagatcatgccactgcatccccacctgggcgacagagtgagactcagtctccaaaaaacaaaagaaaaaagataaatattgaattaatatttagagagaattaatatgacactacagaaaatgctggaaaaaacatcctaacaaagcctagtcgatcttcaaaagggaaagtgtttcatttagggaatattgatgttctgtgattaacaatatgatggagattgataaagaaggatgagaattgagaaaaggtttttagatttagctattaattggttacttgtttttaagtattttttttaggtataacatacagtgaagtgcacaaatcttaagtacaactcagtgaatttatacatataagtatacctaggtaactcccaggtagtgggaggtactgggttacacctggggagaagaggatgtaaaaaaagcacagacatgagaattgtggaatgcaagcattttccgtgattagagcctattttaaatgaaatacccagatagagatgtagaatatttttcttcactgattaaaggtgccttgtgctccctcctattaatttctccctacagaagtaaccactattttaacctctaacctctatcaccataaattagtttttgcttgtttctttttcttttccttcctttttttttcttttgagacagggtctcagtctgtcaccctagctggagtgcattggcgcaatctcagctcactgcagccttcacctcccaggctcaagcgatcctcctccttcagcttcctgagtacctggaa

SEQ ID NO: 4086 - DNA, 2070 bp, Homo sapiens
cagacacacacacacatagaatcacaattgcaattgtaattatgcatatataaagaggcaggatatgataaagtttgaaagtgtaagccttgaagtaaaattgacagggttcagatttagctgtgtgagcactaggcaagtggaattagtaattaccatcttcaaagaggtttagggttgatattacataattcatgtaaagtccttagctttctggcatacaatgctgagtaaagtaagtgttacctgttagagtaataatagttattattaccattgtttaattattctttctacattaacttgagattttcacctgtgagtgatttgcagttgtatacttttgctaatgtcccattttaagccatgccgataaagacaaggttgttatagaggaagtgagaggtaggcatcaaagtgtgccttctctgattctagcagcagaatcttataaccaggttaaatatttcaggaatgcattcccagcactgtcagcagatgagtagatacacttgggaatgagtacattttaatgaagttatttcccagccagtgcattggtttgtctttgttataacatgctgaatttcttcactctcctttcaatttttgactgtgaggccatgtggtgactattagtagagagaagaaggtgagtggctatgcgtatttgtaatgtacgtataaacccaagatgagagtgaggagtggctggtaggtagctagattgaggcgggtggaatataatcttttcattggatagtctgagttgggaatttcccaaacagcatttccttttgctcttttcctctccacactttgttttgtatatgtctgtgctggtatggtgttaaagttatcagttccccctctttaattttctttctaccaccaacctcctcctagcacaaacacggattttaagcttataagcaaatttgtcaaagacagctagtaaaaataattttaggttcatttgaggaggggtactagtatgaaattgtaagtttttcatttatgcttgaaaaatacagcaatttggaaagtgagggaggggaagtcacccataatcttattaccattatataattattagtattaaagacagatgacgttaattaagcatctactatattcttttaataatcctgtgatgtatatattcccactttacatgtgaggaaacacatccacttaataatggagtagccaagtttgaacctaggtatatcttgagaaggtctagagaggagacctttctgttctaccttcctgttcttcttacatatatatccttttacctagttgttacacaatttgtaagtttcatctcctagttttaaaacttagcattataaaaacatttttctccccccccttatttcaagtggtgtcgtattgctctcattgtctattcataccaccatataaaggctctttgtcttggctgctggacattggtacaatgatgttgaccaaaatggatgctgccctttactgagtgactaagatgaaaaaaatcaggcttaatcagaactaatactttatgggatttggattgctacaggtttaatcatgctatctatccttgctggtgggacatttgacttagaattgtatataagtaaaatatagatgaaaaattgtataatttatagctatctgaaaacaacttttttttaatatttgaacactttgaaatgccttacacttccttgttaaaaatcttaaagggatattaaaattaaatggcacttaattactattagtaattcctaatataatatttaattcataaaagaaaaaagcttaatgttgaattctggcactcatcgggaagatgacattatatgttaagagataatttgtggggcatagtaactatagttaatattgcatacttgaaagttgctaggagagtacattttaagtgttcacaccacaaaatataactatgtgaggtaatgcatgtgttaattagctagatttaaccattgcataatttatatgtatttcaaaatgtgttgtacaccataaatatatacaatttgtatttatcagtttaagaag

SEQ ID NO: 4087 - DNA, 1029 bp, Homo sapiens
tattcttctcacttcaaaaacttttcctatacagtatcacccaagcccgtgtctttaatcactgactatgttttgataatttctaaagctgtatctcccatctagacctttctttctaactccaaatccatctgtataatcaccttcctggacatatccacctaacagttaacatatcagacatgtcagcatctgaactctgtcttcttcttacctcactctacaccttttctttttgccttagctcaatgaatgaactctttactttgttaagctgctaaagtgtccttctaaatagctcaccccacatgtaaataatcaccaaatcttaattattttgcctcctgcacatctctcatatttgttatttccactctatcctttctgctgatactctagcttaagcattcattctctcttgtttactgcaataacttacttttctctctgctttcagtctcattatccttcaatccataatattcaaagtgatctgacagacatatctggttgtgtaaaccttctgctgaaacatcttcaatagttatcctttacctataagaaaaacaaaaaacaaaaaaatctccttaatatggcaaataagcttcaacgtgatctagcacttaactacctgtgcagacacaatggaccctgccttctccaactttgtgctccagaaatcctgaaaacttacagttctccccaaattctctgttctctcatattgctgtgtcttttacatggtgttctcccttcatagcataggttccctttgctcttgccctgcttcacaactacagctctatcaagctgaaattccgactactcttccttcatatgttatcacctcaggagtctgtctgtcatgtggtatcaccttagaagagtatgtcttacttccattgcaggtttagatcctccttcctctgcattcccattgcactctgtacaaacttccatttttagtacatatatacattgtgtgtctcagtgtgtgcacatcaacatacaaaagtagagtaatgtgaa

SEQ ID NO: 4088 - DNA, 1130 bp, Homo sapiens
agatagagatagatcttagcctgcaaggagggaggcagggatcttagcttgcaagaagggaaggaggaggggagggtaggagggattttagcctccaaggaggatgggacagagaaagcccttggaggatcttagcttgcaagaagggagggaggaggggagggcaggagggattttagcctccaaggaggatgggagagagaaagcccttggaggatcttagcttacaaggagggaaggagagagggagagagggagggagagaggggtcttagcctgcagtgcaatcctaagaacatttggcaaagttgataggaactcttatagatgtaccttagcatccctgccatgctcagtcattgactggggccatctcatgaaagtatgatctcggtgtaaacatgatgatgattcagagcacagcagctggggccatcagtcactgacacgtcttgcagtaggaggtctgaaaggtacattctcatgtcctccatgctccctaccactgtattttatgaaatatcctgaatttcctgttagaatattaatctttgaaatatcctgaatttcctgttagaatattaatctttgaaatatcctgaatttcctgtaagaatattaatcattcagtagctatattaatagcaagttgtttctttatttccttgctttacttgcaaatctttaaaaattacttttcattccctctgctttgactcattttccttatgctttcctttctaggttatgtttttctgtcttacctaggaaagcttcatctctattaataagccaacaagtattaagtcttttcttaaaacctttcattttctctatcaggaagagaccttatattaacttataaatatttagggtaagaggaccatctttaaatatactgcaatggttaactagttctcgtggtaattataatcttgatatttcacacccttctctcagaagctcctttttataaactaatccattattcacatgttggctgaacatattcaccaggatcctaattgagagcctggctacttctctattcctgattgttagttttatctattgtaccatgtccttggtgcttgtaactctgttggaatgccaaaaatcttttcttcttc

SEQ ID NO: 4089 - DNA, 1212 bp, Homo sapiens
tatttcttttttttgtttgtttgttttaaaaatcttttttttttttttttaattttttttttttaattatactctaagttttagggtacatgtgcacattgtgcaggttagttacatatgtatacatgtgccatgctggtgcactgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcatttccggggacagtgccaggtggggagtttgactggggctgtacacctgtcaaacggtaacgcaggtgtcctaaggcgagctcagggaggacagaaacctcccgtggagcagaagggcaaaagctcgcttgatcttgattttcagtacgaatacagaccgtgaaagcggggcctcacgatccttctgaccttttgggttttaagcaggaggtgtcagaaaagttaccacagggataactggcttgtggcggccaagcgttcatagcgacgtcgctttttgatccttcgatgtcggctcttcctatcattgtgaagcagaattcaccaagcgttggattgttcacccactaatagggaacgtgagctggaggttctatttcatagacaagactgatgaaatcactggccattgctaattaaacttgatcttcagcccctgaatggataagtcatctccattacttattctataagatgtgaatgttttattaggaaccttaacggttacttcatcccttagggatattgtgaacaagttacttcgatagattgtcttttgatcaaatataatacagtacagtcataaagtgtttccttgtttttagaactttgcagagaagtagttcttacattgaaatggttattggatatagtgtttgggatgatttaatctgctaatatacttagtttatatcttttcctttttggggggatacacaatgctgatttgattggctaggaaaactgtcttatctggtagcttctgtggcgtgaaatgcagttgctgacaacttttaattcataacaagtctgttaacttattc

SEQ ID NO: 4090 - DNA, 1111 bp, Homo sapiens
ttgcacagtgatatatttctatgtgtatgcaagtacaagtatataatatgtcacctggcacattcattttctcagttgaagaagagaaaatttgaaaatgtccttatgcttttagagttgcaacttaagtatatttggtagggtgagtgtttccactcaaaatatgtcaacttaaaaaaaaataggccctttcataaaaaccaaactgtagcaagatgcaaatgcatggcaaatcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgccactttgcagctaaaataagctcagtgatacctccttgttaaaaaaaaaaaaaaaaaaaaagaatgccaggggggaattatcatgctaaattattttactgctgaagatagcttcattgcaaattattctttttccagaatttcccccaaacaacttagaattccataagtagaacaagatagattctacccccaaaatattcataagcaaatcccactgcccttaaaataaggaagttatgcctggttgtctgtgaatggaacctcagtaggtaatcctgatgaagcttaaaaccttagggcagtgtctacatgggaaacaagtatgtggaaattgacaatcatttttaccaaatcgttgagtaataatatgacttacctgatagatatacacattcaataaggaacatttttttttttcaataaggaacattttaactaaaacattactttagggctgagatttccaggctatctacattgatctactgaaaaatttctagatttccatatacaaacgaagaagacatgagtttagagaatttttttcctttaatttttttttaacagaagggtatcagagtggaggacctagattacgctacctgtgtttgaaaatattgcgctttgcctaaccttcggtggaatgtattgtttcagcatattctatgtataaaaaagtttaaagatgtcttcaaa

SEQ ID NO: 4091 - DNA, 1061 bp, Homo sapiens
ccctgtaaatattgtaactggctaccgggtgtgtggtccctgaccacaaaatgaatatgcacggacccatactatttgtatataacacaggcctaattcctgatatgaggatctgtttgttgagaaagtgacacagtgagctccaaaatgaagtcatttgtattttattaaaaaaacaagctggaactcagctcttgtcgaaagatccaaatattacctactatttgtaaatcatgtccctttgagtttgccagaacattcaagtgtgctagttgtggagaaatcgatgggttgtttggatggaatttttttggtgtgatatcatgtctgatgatgagcagcactgcaacttggtagttgtaactcacattgtctattacgagagctgcaggctaatgtcctaactgcggtgcctgaggccttaaacctctcttgcccacaagcatccaaaacaagtggagtccccagttaatagttttcctcttgcctcatgaataaactttgcccagttaatgtctctcaatccagatctgtagtttctttcccctgtgtttgaagagtacttctaaaaactcaaaggttcttgttgaataatgtaagaatccatagtcaatacaattattataataagtacataaatgaataaaagggagaaaaggaaaagctcatctttatagtaaaatgccaactagaaaatctagaaggagcaaaggagttagaaaatgatcattttgcaaccatcataataaaagttgaccaggcaagaattatcaacagatgctaaatctagcagagatggagggagttcaggaagtagtatatttagatattcttaaaatatctttcatacaaattacttattaattacacataaaaaatagtgactatataccttggggatatcccatgataccttaaccaggtgattaaaattcatatcagcaatgtggggcagatggacgctgtgtgcctataaatgagagagaacacagcatcacttttgtggtatttttgccagaaatgcatataacctgaatctaatcatgaagaaacgctgacaa

SEQ ID NO: 4092 - DNA, 1052 bp, Homo sapiens
aaaattgtatgtttgttgcattgcacaggtaactgcagaagacctagtatgaatagatgttgtagaacaggttagaccaattaactcttttccatttaggggaagaatcagcaatgtatgagggatggtgttacataagggatgtggcagatcagatttgcttgcattttctcacaccatcaggaataccgaatatccagcactgtttgaaaccagcatggttagaacaggaactcttggattaggcttcatggaccagtttgtggtcaaagtacgggtttcacgagaaactgcatgtgaaagtttttttagttctgagtcttcatctattaagttcttctgctgaaaggatgacatcttaagaccagcggtgtaatttgtagtttaattagatggatccattttgttaccattgttgctcttagaactttcttactcttttacgatggggttcttaatctgggttaatgggtgcctaacggggagttcatgggccctgcaatgaatgtaattccctgacattgtctgcaaaagtttgtgtgatatggatgttttttgtttggtttggtttggtaaggagagggtgcacacatgcattcagttctcaaatgttccatgactcccaaagatttacaaagaagccagtggtttcgagactggtcattgctgctcctttgagctgcatcccctttggttctaccagccttcacagcttgcatggtcccagtgttcaattccttattacttatcagcccatagacaaagctgttaacctgtatttttatgtgtaaatttgacataggattgatggtcaactctttaaactactgtttggatttccaagctggagatttctggatactctttgtatcatttcttcatgggatatttatttgctgtagtctgcctcagctcggcctttagaccatgagcactggagagtgtaaccacaaaaagcttcaggatattcttatatttgtaactgtagtctaccctgagctataattgatcctaaggaggattttctttttcttttcttttgtctttttttt

SEQ ID NO: 4093 - DNA, 1051 bp, Homo sapiens
ggggactgctgccatagaggggcctttgggtggccccgttaggtgttttctttgtgaggtggtgctttccagcctgccctggactctgtggttcatggtagatcattcgtactgacctggaccagggagcactggtaggagtatctgatttctatgaacagtgcttgctggcactgactcaagaaagaagacaggaaggaatggtgaatacaacttccattgagaaactagagtggaaaaaatgtgcaaattatgctaaaattgtaattaatctgggctgtacaggttgaatatctcttcatcctgaaagaaaaggggaggtcaccatgagaaaatgggattgagggaccataagaactttgtcatacctagttatacatttgtttttttctcttagaacttctgaaaagcttgaagccccagaagcaatagaatagagcttttagcatggttttgttgtgaactaaattcccaacagttcacctttagtgcataagcttaactttctttgatggtttgccattcaaattagattactgtggacagtgtccctaatattgtcactaatattatgatacagtatcagttttacagcaggtttgtgcatcatgaaggaagtcagaacgttttagtgagttacaaggaaaatagccatcaaaagtccatataggttactctgtggatgggttggggagccatcttctggtcttcatccagacttgattgacttaaaattgagtatataagagtgtaaaagatggtaagtgataggcttgaggcagagacacaggcctgcagccagaactggaaaaaaacccacaagtatgaaaagtataggcaaaactataaagcagccaggcacggtagctcacacctgtaatcccagaactttgggaagcagagatggacaaatcacctgaggtcaggagtttgagaccagcctggccaacatggtgaaaccccatctctactaaaactacaaaaattagctgggcatggtggtgagtacctgtaatcccagctactcaggaggctgaggtagggagaattg

SEQ ID NO: 4094 - DNA, 1033 bp, Homo sapiens
agctgaagaaggatgtgctggtgcttaggaatggctgtcaggagccatcggtttgctccttcaaacaggaagggcaatgctggcttcagctaagagcgagagaggttctttccccagacacccagtatgtctctctttgcaatcattggctgaattgactcagcttttcctcccatccttgaatcagtccctggtagagtaatggagttacagtgattggcttaggacagtcagctggagaatcagtcacaccactcaccacagcggcctcctactaaatataaatgtgagcgggacttaaaatagaagaaatgcacatctaacaggaccataacttagggataaggtactggacaaggtaatgaagaggcgatcatggcccttgtttgtgtttcctccgttccctcggcagccttctaggggaccctctaatgtgctacctcactgtgtacctgtctctctatcctgactccacctgtcactctctctcgactctgggagtatagctgcttaaggccaaggcactctgtcttactatttgtggccactgtagctggcacatagcagggacttaatatgggtttcagcaaattgaacgaaaaaggatacttcgtattcctttgtgtttaacttttatcaaacattgcttgaatcaagtggatttttttttttttgagatggggtctcactctcacccaggctagagtgcaatggcactatctgggctcactgcaacctctgcctcctgggttcaagggattgttctgcctcagcctcccgaagagctgggactgcaggcacccaccaccacgcctggctaatttttgtatttctagtagagatggggtttcaccatgttggccaggctggtttcaaactcctgacctcaggtgatccacccgccttggcctcccaaagtgctaggattacaggcgtgagccactgaacctaaccacaagtggactattgatagtatattcattgcacattttataacaagtttattgagatataatacacataccatacaatt

SEQ ID NO: 4095 - DNA, 1046 bp, Homo sapiens
ataatcacttttaaatatattttataataaggatattcatagtggttttgccagaggtgagtggttttgccagaggtggaatataccatcttgtttatggaataggaagttttgcttttggagtttgaggttataaacaaatattaggccagtgctttcttatatgcatgagaatcacccagggatcttgttaaaatgcagattctgttttagtaggccttgatgggtcaaagactgtagatttttaacaggctcataagatgctgataccgttagtctgaggaccacatttgacagcataggtcatctgttttctcaatgcacaaattgtaacacagaaactgcaaacacctagacaatttcttagtgccataaaagggagcttgattttagcatgcctttacaacagctaccttgaacacctttggtaaacttgtttgggtcagagggatccatgtgctggagaggaagttggtttgaggcagtgagttccacagatgcctttagctctctgactgtaagtgtggtgcacctgcagaaaccaggtgcatctttattagctggggctacaccttgacataatcctaacagttgttaaagaaggaattcttcccgcccccaccatttcttccttttatgtgcctcttttgccttgtctcatttcttgccttgtgacttagtagaccaaggtaggagattcgtgttgggtcactgagggcggggtcattggtcccggaacctgtggccaagggactcttcggtaatgagaggtgatatgggctgagtggataaaagggggactttaggtgggttagcgagggtggctctggagttagggactaaaagttaaaagttgggtatacctcatttctgctagcagggctctaattttctagctcaggtttccccattgacttcctactttattctttttttttttttttttttgagatggagttttgctcttgttgcccaggctggagtgcaatggcgtgatctcggctcactgcaacctccgcctactgggttcaagcgattctcctgcc

SEQ ID NO: 4096 - DNA, 1027 bp, Homo sapiens
attttggctagaaatatttcttcagttgacagaagacattccttagtatccattaataaaaatgcaactcctaggaaaggtgaattgaatataaaatgtcactttgttatagagatgaaattttgttataaactcaaaatcaaccaaaataactaagtataccacatgtgtccaagccctaaactcataaggaatagaaagtactataatggaattcctacacaacaaaataatttaggtagttctttgaagtgctctgtataaaagaatgacttgtgctaaataagagaaaaacttttttggatcagtaactactgtttttttttttttcctagatgaagacattgtccacatgaagatactgggtagtttttcattaaaaagatgaattacatttaaaaagttaatttttcatgttatacttttaaaatatgtactagtttattataaaggacactacaaaggatacagatgaagatatgtgtagggctaggtatgtgggaagggacatggagcttcaacgccttctctgggcctgccaccctccagacacctccatgtgttcagcaaccaagaggctcttattaattatttttaaaagctggaaatcagctaaagaaagagagtcttaagcaagcctttggctgggtgcagtggctcacacctgtaatcccagcactttgggaggccgaggtgggcggatcacaaagtcaggagttcgagaccagcctgaccaacatggtgaaaccctgtctctactaaaaatacaaaaattagctgggtgtggtggtatgtgcctgtaatcacagctactgaggaggctgaggcaggagaatggtgtgaacccaggaggcggagcttgcagtgagctgagatcacaccactgcactccagcctgggcaacaaagcaagactccatctcaaaaaataaaaaaaagaattatataaattaatacactcagtgagcagatatctgcaatctctgaaacagtgtcaggccattaagaatggtcctaaagggaaactt

SEQ ID NO: 4097 - DNA, 1026 bp, Homo sapiens
aaaaagagttagataaaagacaagctgtattgcttgatagcacattacagtgactataattagcaacaatatattgtatatttcaatgtagctaggagagaggacaggaaatgttaccaacccatagaaatgatgaatactcaagaggatggataccccaaatactctgacattattatacattttatacgtgtaacaaatacatgtacccataaatatgtaaaatatcatgtatcagtaaaagaaaaaggctggatagagagaggtaaaaataggagaaatgagagcagtcagtgcacataagagtaatatgcttgttatactgtgtggctacactggttaaggaaattcctgctgcatataacccaaatttgccattagaggttaagaaaactttccacttaacaatttaaaaattatacaactaaaacatccattatttaaaaatcaacataaagaagcaaaaaaaaaaaaaaaagaatagtaatcaaaattacaccgttgttgatatactgtattcccttctaggttttgggttaatacgtctgtacattttttcttttttaaaaagaaaatgagatcatactaaaagaatcacactgttttataaccttttttcccattcaccaatatgtactgaaaaacagtattttaatggctgtatagtttttccattatgttaatatgtcataatttactatgaatctcctgttgagttattttaattctaatgtttcactaaacatttttaaaaaacatctgcagtagaatcataacatacatctttatttccccaagataagttgatagatgctaagtgaaaaggtatgcatatttttgagggttttagatcctctctagtattctacttttcctattagtataggataaataagacaagatgactgaaatgaaaaggataggtgtgagacattaatattatcaattattcagcatagacatgtgtagattttatttggaatgctgcaagtaacatgtactacttgggtcaaaataagctcatta

SEQ ID NO: 4098 - DNA, 1506 bp, Homo sapiens
atgtatagttttaagccttagaactggaaatcagtaagcctccttgggtatgaaattaaaagcaggtatttgtgaacatttcaaatttttaattataactattttaaaactcttaatttactttttctagacactgaaagattttaagaaatcttaaaatgtgattttctttgtagtatttattatttctttaaaaacgatctggtaaccttgagagaaaaaatattcttattctcacagcttcttcactcctacatgcttctaaaaatattacagtttatcatctgaaaaatttgtggaattatgctgaacagaatatgtaaaaaatttctttaggctacttttggcatgtgtttttattacctgaagttttatgattatgggctattgccattgaaaacagctaaggttttaacattcaaagatctagatttgcactgtccaatacagtagacagtagacacatgtgactatttaaatttatattaatttttttttccttttgagttggggtctcactctatagcccaggctggagtgcagtggcgcaatcacggcacattgcaataacaacctcctgtactcaggtgatcctcccatctgggattacaggcatgagctactgcgctgggccagtactctttattaatatgtgattatttccatttgagaaatttgaaacattaaaagaaaacgtttggttagagatacatttgctttttaaagtcctgatttagtaatttggttaaaatttttggctgaagagaattagtgaagcttaattgtatatttgtaccaatgaatgattataaaactttatcactgtaatcccagcactttgggaggctgaggcgggcagatcacctgaggttaggagttagagaccagccagtccaacatggcgaaaccccatctctactaaaactacaaaaaaattagctgggcatggtggcagacgcttataatcccagctactctggaggctgaggcaggagaattgcttgaacccagtaggtggaggctgcagtgagctcagatcatgcctctgcactccagcctgggcaacagagcaagaagacaccatcttaaaaaaaaaaaaaaaagttttgggaatcagatttaaaagaatttccattacaaagtaaaactgaaaggatgaaagaaaaaaattttcaacttagaacttctacaagaggaaagtttttcatggatacaaattctttggttatatttttgcaaatattccagtctgtggcttgtgttttaatagtatttttcaaagaacagaaattttaatatttatggagtccaacttatcaattttattcttttatgattcattatttatgggttctaagaagtctttgttaacccagatcacaaaggtaatttcttgtagaaattgtatagttttaggttttacacttaggtcaatgaccccatttcaagtaaactttttatgatatgagatatgggttgagagatttttttttcttttattttgac

SEQ ID NO: 4099 - DNA, 1055 bp, Homo sapiens
ttgtttcttgtcttctgctagcttttgaatttgtttgcttttgcctctctatttcttttaattgtgatgttaggtcgtcgattttagatctttcccactttctcctttgggcatttagtgctaaaaatttccctctaaacactgctttagctgtgtccaagagattctggtatgttgtgtctttgttcccattggttgcaaagaacttatttatttctgccttaatttcgttatttacccagtagtcattcaggagcaggttgttcagtttccatgtagttctgtggttttgagtgagtttcttaatcctgagttctactttgattgcactgtggtctaagagacagtttgttacaatttctgttcttttgcatttgctgaggagggagtgttttacttccaattatgtggtcaattttagaataagtgctgtgtggtgctgagaagaatgtatcttctgttgatttggggtggagagttctgtagatgtctgttaggtctgcttggtccagagctgagttgaaatcctgaatatcgttgttaattttctgtcttgttgatctgtctgatattgacagtggagtcttaaagtctcccactattattgtgtgggagtctaagtctctgtaggtctctaagagcttgctttatgaatctgggtgtttctgtattggctttatatatatttaagatagttagctcttcttgttgcattgatccctttaccattatgtaatgcccttctttgtcttttttgatctttgatggtttaaagtctgttttatcagacactaggactgcaacctctgctttttttttttctttccgtttgcttggtaaataatccttcatccctttattttgagcctatgtgtgtcttttcacatgagatgggtctcctgaatacagcacactgatgggtcttgactctttattcaatttgccagtctgtgctttttaattggggcatttagcccatttacatttaaagttaatatcgttatctgtgaatttgatcctgtcattatgctagctggttattttgccaattagtt

SEQ ID NO: 4100 - DNA, 1034 bp, Homo sapiens
taaaggccgggaagagtgccaacaattattctgaaacctgaagttaattcccaggagcatttaccaccccacatccagctttcctttccctttccatttcctattgtacgtctgctttcttgctgaaagcacttagtcctgttgggtggataagttgcaggtcctaagtcaactaaccttgtggagctcaacgtacatatggtgtcttgttcagtttcctccacctatagctcatgagctgtataaaatcatctgatattttaatattgcctcatcagacatgacaaattgaagcattttcagcactaaaacagaatttgttaacagcaccttttagatatgtttaggaagttggattttttaaaaatagcacatcattagaagtattcaataaatagagaagtattcaataaatagaaaactatttgagggagatttgtcatacagtaaaattatatttgctttttatcttctctttctaccctgttctgatcattgctttccctatatgtgtcacctctattagctagaactacctgaatcatgtgttgttaattggtttttttttagtaattcatttttatataaagatgccaaagaaaattttttttaaattaggtaaatcgtgatttgggatgaaggtttatgagaaaagtagcagtctctttccttcctgacagatctatagtagattcagtgatttgaacccccgttcatccctcttcagctgaaaatagctatttgccatcattgactagtgcttactctgtatcaggtgctatttttttttaacattttgttgtgaaacttttcaaatgtacagcaaagttgaaagaattttatagtgatcattggtttacccaccacctagagtctatgattctactgtactaacttcatcatgtatctatcactccaccctctgtctatcactccgtcagtctattttttgatgtatttcaaagtaaactgcagacgtcagcatactttctccgaaatatttcagcatgtatttcattacattgattaaatat

SEQ ID NO: 4101 - DNA, 1029 bp, Homo sapiens
ctctgggcctctttgagctgatattgtggcttatttttgctttgttatatgcttctcaaaaatgaatggaaacttaagtctcttctgtttctgagtgctcagtaattctaaatggaaaacagagtgaccagtgttctcaaactggcagggttcgttcctggtgtctggaaagtgaatgaaagtacggaaattaaagttaaaaactgtattttaaatgtgcaattcttcatttttgtagtgtcaaggtattagaaaaacacatgaattacatgaattataaagctttctcaatttttcgtttgcttttcagagaacacgtaacaacaaatggtttacaggaccacagttgatttcccttcttgatttggtactttttctcccagagggtgcagaaacagatttactgcaaaactcagataggtgaggtgaccattaccaaagttcacatagtaaattcagaataaaatgtgaaacatctgcttagggaacctaaagtaataaaatgtcttttcctgtgattttatgatctatggctaattcattaagttacataaagatttttcatatttaagtgatttgataatgtgtagaaacaaaattaaaacctcctctttctagatgaatgaccagcactatgatttgatagcttttatgtacccagcattccatagaaatttgcaatgacagcacttgtgacttaaaactaaaaatctgtgtatgtaatttatgtgtttaggttttgttgttttattgttttccaggtcattttttttttcatatagaacatataatttcagtttcagtatactggaatggatattgagaaatggtttaaagcatttaaaaagtaatcttaaaattcagaaagcaagagatgatgctctcaaatattaaagataacaaggctttctttaaacaaggatgataattttcacaattgtatgatttaaacaaatggaaaacagtgataagttattactactcaaaaagatattaatggaaatagtttctattggcaaacctaattat

SEQ ID NO: 4102 - DNA, 1051 bp, Homo sapiens
agacagatcaaagatggattaaaacttttgatcaagttcttcaacagaatttctccttaatgatatgcattttaaaagtgttaaaatttcagtttttgctgtatttttcataagatgaagtatcattctaaaatagtttacaaattcatgataaattttaatattatttttcagaacagaagagtctgttatctccaaaggattggtaagatgtttgttcccattataacttaaatacatagttatgtcaacaaataacagctgttgacttcactatatatgtatctgcatatattttaatctgtaggagctgctggagaatagtttattgagaatagaagacaatagtctactttaccagtacttagaaatcaagagttttcttactgtacctcaggtaaataaaatatgtattctaatattgaaaatagccctttgcctgttctgaacttaaagtaaggtcttttctgattcctttcccactcttttctctgcaacctttgaaaactctggtgtaatgctgtccagtagaactttgacaatatgaaagccactagccaaactgaacacttgaaatgtgactaaggaactattttttttttttttgaggtgtagtcttgctgtgtcgcccaggttggagtgcagtggtgctatctcagctcactgcaagctccacctcctgggttcattccattctcctgcctcagcctcccgagtagctgggactacaggcgcccgccaccacacccagctaatatttttgtatttatagtagagacggagtttcactgtgttagccaggatggtctcgatctcctgacttcgtgatcagcctgcctcagccccccaaagtgctgggattacaggtgtgagccaccacacccagccggaactaagtttcaaatttaaattttaatttatttaaacacgaatagctattagaggccaccattattgatagcacagcatccagtagaaaagcataactttcttcttttaacactttatttctgtagggatcttggaaaatgaagcttctttatgtttctca

SEQ ID NO: 4103 - DNA, 1046 bp, Homo sapiens
ttgacttcctcttttcctaatcaaataccctttatttctttctcttgcctgattgccctagccagaacttccaacactgtgttgaataggagtggtgagagagggcttccttgtcttgtgccatttttcaaagggaatgcttccaattttttgcctattcagtatgatattggctgtgggtttgtcataaaagctcttattattttgagatacgttccatcaatacctagtttattgagagtttttagcatgaagggctgttgagttttatccaaggccttttctgcatctattaagataatcatgtggtttttgtcattggttctgtttatgtgatagattacgtttattgatttgcatatgttgaaccggccttgcatcccagggaagaagccgacttgattgtggcgcataagatttttgatgtgctgctggattcggtattttattgaggattttctcatcgatgttcatcaaggatattgccctaaaattctctttttttgttgtgtctctgccaggctttggtatcaggatgatgccggcctcctaaaatgagttagggaggattccctctttttctattgattggaatagtttcagaaggaatggtaccatctcctctttgtacctctggtagaattcggctgtgaatctgtctggtcctcgactttttttggttggtaggctattaattattgcctcaatttcagaacctgttattggtctattcagagattcaacttcttttaggtttagtcttgggagggtgtatgtgtctgggaatttacccatttcttctagattttctagtttatttgcatagaggtgtttatactattctctgatggtagtttgtatttctgtgggatcagtggtgatatcccctttatcattttttattgcatctatttgattcttctctcttttcttctttattaatcttgctagaggtctatgtattttgttgatcttttcaaaaaagcagctcctggattcattgattttttttgaagggttttttgtgtctctatctccttcagttc

SEQ ID NO: 4104 - DNA, 1651 bp, Homo sapiens
gaacttgcccttttataacagcattaatctcatccgtgagagtggagcccccttggcctaattcccacctccttatggcagttaaatttcaacatgagttttggagagcagagtcattcaaaccatagcagtgcttatgttatttttcaagtaaaattaacttagatttgaagacctagggattttatacttggaagtgttgatttcatagttacctatttcttatgccttagttgtttcaaaagcttgaaatgccctttgctgacagcacaattctttgaacagtctgaagaaggtggaaatgatcctttcaggtattttgcatcagaaataatagtaagtacagctaatttaatctgctataatcttaaatgttatcccactatattctcagtactgcacatgtaaattgatacattcattaataaagaaatgtgtattttttgtagaacacacataaacaaaagatggaaaataaaacagcaataattttattatccaaagataaatattaacatcctccaggcttttttcttatatacttatttataataatacatatatataaatttttcaaagattttatatatatatataatcttgtaatctacctttttcctcttcaacagtatattatgaatatttttccattggcttaatagtgttccatggtatggacttagtataatgtatttcacctgtgccatatagttcaacatttggattgtttctaattttccattattgtaggacaactccaagttttctttttttaactgttaagtctatgataagtaacctagtaattaaatttttgcatacttttcaaattatttccttaaaactcctagagtggaaattccatgccctgtgataaatattttcaaaatagctccatatttaagtaaattttattttaaaagcaatttggctttatgcatcaatagtattttaaaatgtgctcagattctgtattagagaaataatctgaaatattaaaaaatttattttaagttgatgtttctgaatttcaaaagagaaagtccatgtggctgtgtagttttcttcagccatgttcagctacatgagtgcaggtgcagcataggagtaacatttggttgaattagggtggggttttaagaacagggtaagttgtagagagcaagaggggggcaagggattgagcatgtatgtaaggtgatttctttttcaattatactttaagttctagggtacatgtgcacaacgtgcaggtttgttacataggtatacatgtgccatgttggtttgctgcacccatcaactcatcatttacattaggtatttgtcctaatgctatccctcccccagccccccacgccccaaccagccatggtgtgtgatgttccccaccctgtgtccatgtgttctcattgttcaactcctaccaatgagtaagaacctgcggtgtttggttttctgttcttgtgatagtttgcttagaatggtggtttccagcttcatccatgtccctgcaaaggacatgaactcatcctttttaatggctgcatagtattccatggtatatatgtgccacattttcttaatctagtctatcattgatggacatttgggttggttccaagtctttgctattgtgagtagtgctgca

SEQ ID NO: 4105 - DNA, 1028 bp, Homo sapiens
tcctaaccactctgctctacctctggttagtgctgtatggcgtatggttttagggtagaatacaggggattgcttgattgagagggagaggcatcaaaaatgactgggtttctagcctctaaaaggataacatatgatatcaaacagaaaaaggcaacctaagtagagggaaaagttttctgaaggaacaagtgagttgacttttagaaattttgagtttaagtacagcagtcaattggaaaataaggttttgagctcagtagagatagaggaattaagatgtagatctctgagacacatatctgtgagactttaattacctaaagattgggtaattgaagcattgaggagtgaaaaaaaaaaacaagaatttacctgagttcacataaaaggggcagaagagaagaggcccaagatcccatcttgaagaatttaagaaacaggtagagagaagaggcctgccaaggagatgaggatcagcaccacatcagtgaggcagaaggaaaagggaagtataaacaaagtatttttcaggcattgcatgccttagcgttttatttttagcatgcttctgaatagctaatgggatagatttaaacatgtgaggcttagtcttaatagtttgagaatcacctttgcaatatgtggtcagctaaatgcaaaggtttagatattgataagacaatgttcaaaactgactacaggctgggcacagtggttcatgcctataatcccagcactttgggaggccgaggcgggtggatcacctaaggtcaggagttcgagaccagcctggccaacatggtgaaaccctgtctccactaaaaatgcaaaaattagctgggcgtgatggtgcgcccctgtaatcccagctactcgggagactgagatggggggattgcttgaacccaggaggtggaggctgcagtgagccaagatcgtaccactgcactccagcctgggaaacagtgagaccccatctcaacaacaacaacaacaaaaaactgactacaatttaattttcttgc

SEQ ID NO: 4106 - DNA, 1054 bp, Homo sapiens
atgaaactgacttgatcgtggtggataagctttttgatgtgctgctggattcggtttgccagtattttattgaggattttcacaccaatgttcatcagggatattggcctgaaattttgtttttttgttgtgtctctgccaagttttgttatcaggatgatgctggcctcatgagttaaggaggattccctctttttctatcgtttggaatagtttcagaaggaatggtacaatctcctctttgtacctctggtggaattcagctgtgaatctgtctggtcctggactttttttggttggtaagctattaattgctgcctcaatttcagaacttgttactggtctattcagggattcaacttcttcctgctttagtcttgggtgtatgtgtccaggaacttatccatttattctggattttctagtttatttgcatagaggtgtttatggcattctctgatgatagtttgtatttctgtgggatcagtggtggtatcccctttatcattttttttattgcacctatttgattcttctttcttttcttctgtattagtctggctagtggtctattttgttgatcttttccaaaaaaaaaaaaaagttcctagattcattgatttttttgaagggttttttgtgtctctatctccttcagttctgctctgatcttagttatttcttgccttctgctagcttttgaatttgtttgctcctgcttctctagttcttttcaatgtgattttagggtgtcaattttagatctttcctgcttcctcttgtaggcatttaggtgctataaatttccctctacacactgctttaaatgtgtcccagagattctggtacgtgtgtctttgttctcattggattcaaagaacatctttatttctgccttcattttgttatttacccagtagtcattcaggagcaggttgttcagtttccatgtagttgtgcagttttgagtaagtttctgaatcctgagttctaatttgattgcactgtggtctgagagactgtttgttatgatttccgttcttttgcatttgct

SEQ ID NO: 4107 - DNA, 1076 bp, Homo sapiens
gcagttgtaagtttcttctattccaaactttcctttcctttctaccttttttacttattaatgtgggtgcatgttttttccttctaaaaacgtcagctttaactattgcattatatacagttttacatgaaatctacaattttttcattctaaattttatattttttatgatttacttagcttaaaaccaaaaacattttcagcattatgtacctagtattatttcaataaaattcttgaattttttttagttttttttttttaagtactgtagattagaattttggctcttgtctgtgtaataaagtaatgaagaaatcatgacctccagtcgatcacttttactgatttcctgttctgattctctggaaatcattttgtttgtgtggttattactagtctaacctttgtcatgtttacaattcagtgtttaaagaagctgataattgagaataaattttgcatatcatctcccattacatttattttagattttgaaaacagaaaactattaaaggtattctataaggaatccaacaaaattactgaccaaactctgaggatggaaaaaaaagtaaagcctctagaacttagaaatacaaactatgtgattattagatctttccatgaaaagtaaaatacattgttatttaaaattgtatatattacatatcacttacagaaatgctacatttagctcaaaaagctatagctctttgttttataaagattaattatacaaactcaaatgtacgaataggagcttttataatctgatatgactcagtcttggaaacttactgcaactgttttgcagttcacttggtgtcacatgattcacttcaatggtttaaaccctgtctagtagtgatcaaagttcatttggttaggggttttttttggtgtgtggatgacttttttccactttgttgtggattgattgtctttcaaaatacccaatgcagcccttcctcttattcttttgaatctcagaaagtggtagttgtctgcacagtgcaacctccagtcacacacaggggaaattttttttaagttgaaataatatgcatgaaagc

SEQ ID NO: 4108 - DNA, 1058 bp, Homo sapiens
agtggtttcttgagctagaatcttctcctggtaaagatactgtgaacattgttgagatggcaacaaaggatttagaatattccgtaaacttagttgataaagcagtggcagggtttgagagcatttactccaattttgaaagaagttctactgtgagtaaaatgctatcaaacagcatctaatgctacagagaaatacttcatgcaaggccgagtgaggaagtgcagcaaactttattgttgtcttactttaagaaattgccacaaccaccccaaccttcagtaactggccagcctgctgccaccagcatcaaggcaagaccctccaccagcaaaaagatccattacttgctgaccactcaggtgatcattagcattttttaggagtaaaccatttttaattaaggtatatacattgtttttaaacatatactgttgcacacttaacagactacagtataatgtaaagataacttttatatgcactgggaaacaaaattcatgtgactcgctttattctgatatttgtatttatccattcatcagttgatagatatttgctttattcccactttttggctatcataaataatattattttgagcattcatttacaagtttccatataaacgtatgttttcattggtctgagtatatgcgtagtaatggaattactgggtcatatggtaactgtatgtttaactatttgaggaactgccctactgttttccaaagtagcagtaccagtttacattcccaccagctgtgtatgagtgttttgatttatccacattcttactaacatttattatttattttttcgattaagtagtatctcattatggttttgatgtacattcctggtggctaatgatattgagcatgttttcatatgcttattggccatttatagcttcttcagagaaatgtcttatttagatccttcgcctatttttaaattggattgtctttttataattgagttgcaagagttctttacatattctaaatatgtgttccttatcagatacattatttctgatttttaaatatttttct

SEQ ID NO: 4109 - DNA, 1114 bp, Homo sapiens
tctgtttcaaaaaaaaggtctcactttgttgctcagaccagagtgcagtggtgtgatcatagctcactgcagccttgacctactgggctcaagcaatccccccacctcagcctcccaagtacctgagactacaggagcacaccaccacacctggctaatttttatattttgtgtagagatggaatttggctatgttgcccaggctgatctagaactcctgagctcaagcgatctgcccacctgggcctcccaaagtgctgggactacaggtgtgagccactgcacacagcctcgttgctatattgggtgcttactgtataatgtctggtacataaccgtcattcagtagatatttgtatttgaccaaatttgaccagtagatatttgaattttgacaataattcattcatcttctgatgttgtttctacaataaatgatttttaatgtatgcagttgtcactatattcacacatttatcaacttgtatatgttcttttattattaggtcactaccagttaggaaggagaaaatgaattcagcctctgtccaaatgaatttaccattacagagtaggagtgactgagcttaggtcccttctctgaaatgttttttaatggaatttaaacctctgaaaattaatgtatatttattgttggtattaatgactgtaataacatgcaagaagatgccaactattatcagaatttttttgctatcctcacatatgctttagaacccagttttctgtttgaatgtctcagtctaaaggaacttcttttagtagcctgcaaaaataaatatgacatatcttaatcagaataaagagcttcaagaaatttagttatgaagaacaagaggattttaaaatcctgaatgtctctgtggtcccaactttttgtctttttgttttcttctaattgctagagattctgtattggttaaaagaatggatttttgagtccaacctcttattagcctcttatctttgacaagttttttaatgtatttgttggttcactcattcaaaactgaggattctaaagctatctgccttatagttgttgggatcaaatgagaaaactcatgtaaagtgttctttcttgcctacataa

SEQ ID NO: 4110 - DNA, 1051 bp, Homo sapiens
cgggcagccagcagcatactgtctgagctccacctcctgtcagatcagtggcatcattagattgtcacaggagcacgaatcctattgtgaactgcacatgtcaggggtgttggttgcactctccttatgagagaatctaatgcctgatgatctgaggtggaacagttcatcctgaaaccattctcccaccctctctatggactacgaaatctgtcactagtaccaaaaaggttggggaccactaattgttgcaacagtgaatcataatttatctccagccccagcctgtttccccttaccaataattttctaaatggtttaataatttaaaaattatgaaacatgatgtacagagaagttaataaaacaaagttacattgtatgtgtacaaatattatacataaaacttctaaccaaggttaagacagacaaaattgcctgtactcaagaagtctattcagtcacaccctgttccctatcctgacttttatgacaatcactcttttgcctttccttatgattgtgtcatcttcctatacatttctgatctatacagtttagttttcccagcttctcagttttgcatatcgccaactcttcaatctttcaaaatagaaaagtctaagtaagtataaaactaaataaaaggtaatttgagtcatttttcaaacttttttgagtctataataacatttctcttctccctaccactccgttagttcatctgcttaccccttacctgaactgttgttgtaacctcccatccagtttccttttctccagcttcagctcttctacagattaaaaaagctgtctctctaaaacatagaaatttcattgactaccttttaaataccaatcatatcgaaactccttagcataaaatcctttttattattgcccaaactgaatttgtagcttcatctctcaccattatctccccatcctcatcacctacacatacatgctgtattctgcccactgtgaattatcctattcctgcacctatcacattctttcagaattctgtgccattctgcatgttgctgca

SEQ ID NO: 4111 - DNA, 1033 bp, Homo sapiens
tttatcatatttctatattatcaaaactatcttcaaaagaaaattcaaagctttaaaaataaatatgtttttacagggcacagtaactcatgcctgtaatcccagtgctttgagaggccaaggtcaggggattgctggaggccaggagttcaagaccggcctgggcaatagaataagaccctgtctctacaaaacaatttttaaaaattagctgagggcatgatagtacactcctgtagctctggctacttggaaggctaaggtggaatgatcccttgaggccagaagtaggagttccatattacaaggagctatgatcaagccactgcactccaatctgagtgacagaatgagaccttgtctcaaaaaaaaatttttttaataaaaataaatgtgttttgtcacttcttatgccttacttcttgtataatatgataaaagtagtaagttttccctatggacaaaatactatgtttaaaatcttatgtctttcaaagtctttaattatattgtactccaagtcacaatagtctttgctgtaacatctagaattttcttcccacctgaaatttccttttgtctttaaatttcaatttcaaatgtaattaatttccaaacttacatattatattataacttcattttttgatctggatcaaaagtaaccacaacacattatgatttgtatgtttataaaaaggtatcctttatgttctgctggtagtagtccccataaagtgcacatattcagaaaaacctcagacatgagccaactgcataatatatttgtaatcagttgtttaaatcatgctatcgtatgtgattttagcattagtctgtacttttctaaacatcaagaaaatcctaagaatttgccatatttctatacatcttaatcacaaaatagtaaaatttaaatcactctttttgttgattctgaaatatttattaaaacgaagaacctggtatgcaggatttttgtttaaaatgaaatgtaatgtgttacattatttttgaaaaatagaaaattcat

SEQ ID NO: 4112 - DNA, 1313 bp, Homo sapiens
tatcctctttgtctgaacagtaacttactctttatcctcgtgactgtgattcttttttcagtaatcattcatttccaatttttttttattgtggtaaaatagacataaaacttaccattttaaagtatacagttctgcagcattaagtatatttgacactgttgtgcagccatcaccaccatccatatccagaactttttcatcctccctaactgaacctctttgcccattaaacactaacttcccattccccagcaactggcaaccaccagcaactggaaaccaccattctactttgtctctatgagtttgaccactctggttacctcatataagtgggatcatacaatacagtcatatgctgcataaggacatttcagtgacggacagcatatatggtaatggtcccataggatgataatgaagctgaaaaattccttttgcctagtgactatagccatcattatgttatagtgcaacacattactcatgtgtttgtgatgaggctggtataaacaaacccactgcactgccactcttataaaagtgtagcacgtacagttgtgtatagcacataatacttgataataaatgactatgttactggttcatatgtttgctatactatttgttgttttgctatactaatattgctattttagagtctaattctacttatacaaaacaagagttaactctaagacagtctcagatccttcaggaggttttccagaaggcattgttttcataggagatgacagcttcatgtgtgttattgtccctgaagaccttccagtgggacaagatgtggaggttgaagatagtgatattggtggtgctgaccctgtgtaggcctaagctaatatcttagtttttaacacaaatgttttaattttttttttttttgaggcaggatctcactctgttgcccagaccggagtttagtggcacagtcatagctcactgcagactccaactcctggctcaagcagtcctcatcagcttcccgagtacctgggactacaggcacacatgaccacacccagcttatttatttatttatttatttatttagtagcaatgaggtctccctttgctggccaggctggtttcgaactcctgggcttaagtgatccgcccacctctgccttccacagtgctgggattacaagcatgagccactgcgcccagccttaatttttttttaacttaaaaaattttttgttcatcaggtgtaatgactcatgcctgtaatctcagcactttgggaggctgaggcaggcagatcttgagcccaagagtttgaaaccaac

SEQ ID NO: 4113 - DNA, 1475 bp, Homo sapiens
tcacatttgacttatttatttatacatctttcaagagtttttttagtggttgttccaggttttacaataaatagagtttaccttcaaataataaattataaataataataaatgaataaataactatacacttcatgtgtaatctaaggctcttacaacagtgtgttttcaaatctttctacctcttttgtgaaattgtcatacattttacatattgtccaaatatatatgctactaattttgcattaaagttttctttcatagaaattgaaaaacttttaatgaaatgtgtttttccttcaagatattctgtttcagcactctttctttgtgcagatccatgtttctgtctggtatcttatcttttctgctttaagaagttcttttatcatttcctttagtgctggtttttgtttgataaaatgtttatttcttcaattttaaaagatatatttgcaggatattgaattctgccttgacagtttttttcttttaacactttaaatcactctgctatcttcttgtcagaaaccatgccagccaggattctgttgtaattcttatttttgttcctcaacatgtaatgtattttttcctctggttgccttcaagcttttctctttgtttgtagcaggtcgaatatgatatacccagatctgggtttttttttctctcttttttttttttctctgagtttctttgatttatagatttgtgtatgccacaaattttggaaacttcttggttgttatttctttcttttttttttttttttgagatggagtttcactcttgttgcccaggctggagtgcaatggtgtgatctcagctcaccacaacctcagccacctgggttcaagccatgatcccctgcctcagcctcctaagtaactgggattacaggcatgtgccaccacacctggctaattttgtattcttagtagagacggggtttctccatgttggtcaggctgttctcaaacttccgacttcaggtgatccgcccgtctcggcctcccaaagttctaggattataggcgtgagccagcacgcccggcccttggttgttatttcttcaagtatttcttctcatgctcccttcttgaggggtttcaattatacatgtgttagattgttcaaggttgtctaacaactcttggttgctctgttcgttttgcccctatcatttttctctgtgttttcagtttccattgactaaaacatttttaccgacaaattattaagttcactcattctttccattgctttgtcaagttgtttgatgagccaactgaaggtattctttacgtctgttactgtttttcatttctagcttttctttaacaaaaaaaaaattttttttttttcaaagagaaaaggtctcactgtgttgcccaggtctcgaactcctgagcccaagtgatcctcccatctcagcctccccaaagtgctaggattacagtcacgagccactg

SEQ ID NO: 4114 - DNA, 1049 bp, Homo sapiens
gatcttgaactcctggcctcaagtgatccacccgcctcggcctcccaaagtgctgggaaaccatgcatatcttttgaagaagatttctacatttctaaggacaaatacaattttgttattttggaatttagatggttcacattattgtaggtaccctgttttttttctattagattaaaatatatttttcagtaatctttacatgtcttctgtagtatataacagtactatcaaatagcaatataatgtgtcacatatgcaatttaagattttctaatacccacattaaaaggagcaaaaaaaggtaaaattaatatttttatttacctcagtatattcaaaatattattttaatgtaatcaatataaaaatcattgagatttttttatttcatattaattcttcaaaatccagtttgtattttatacttataacttgttttaatctgtattagccacatttcaagtgttcagtagccacatgtggctaattgctatcctatttattgtgcagtgtaggtctgtaaagtcagaaaaaattctttgtatctggatggatggacagataaaaggagatgtttatcttatatgaatcagatttgatcagcgtaataactagttaccaaaacccaataatgtggtcatctttatagatatcaaaggtgggcttttttactcattggagaagttaattggaggagatacattggaaatattgggtagatggaacttctcctatttagttgcccttaatgtaatataactgtattatgtggttgcattgtttttattgtatatacatgtttatactttcatgaaatttcagtgtatgtctgtaacctttagcataaatgcagttccaactacaacgaagattttgtgctacagctagagaaggaattggtccaagcccgactgagtgaagctgagtctcagtgtgcattaaaagagatgcaggataaagtcttggatatagagaaggtaagaaacctacacaaatgcagtcattcccaaattagaggggatatgtgatatttattaagtacttac

SEQ ID NO: 4115 - DNA, 1082 bp, Homo sapiens
catgtgaggaagggatccggtttcagtttgctgcatatggctagccagttttccaagcaccatttattgaataggagatcctttccccattgcttttgtcgggtttgttgaagatcagatggttgtagaagtacggtgttatttctcaggtctctgttttgttccattggtttatatgtctttttggtaccagtaccatgctgttgggttactgtagccttgtagtatagtttgaagtcaggtagcgtgatgcctccagctttgttctttttgcttaggattgtcttggctatacaggctcttctttggttccatatgaaatttaaagtagtttttttctaattctgtgaagaatgtcaatggtagtttgatgggaatagcattgaatctataattactttgggcagcatgcacaattttttatttagagttgtgataagtgttacaaaagagatgagaacagggttccatgaaatgtttgggttcctgaaaagagcatataaatgtcatatcttgaacttagttaaaagcttaatgtatacttaaattcaagcaatattggatacatttgcatggacaaccctttttctaatttcaattttttttcacttaataatatgagaaacttcccccaatacaaatatttactttttactgtattactcctatttccttcaaatattgaaattttttttaataatatgagaaacttcccccaatacaaatatttactttttactgtattactcctatttccttcaaatattgaagatttttttttaagctcaagacacaagcaaaaaggattactgaggactttctaacttacctttacctttgtaatttttgcaacaccagaaaagcacataggattgaaaagcagactctgcttactaaaaagaatttctgtcagtttcattggaatgggattgctggtatcacagaaacattatgagattcatttacataaattaacttgatgtaagtatagagaagtcatctgtcatttctatgcttttaaataaacggctccccttgctgagactgccagccatcataattgtggcagttgtcatttggta

SEQ ID NO: 4116 - DNA, 1061 bp, Homo sapiens
tgcttcaataaattgtttttaaaaagactaaataaatgataatataaagctcaaagaaactcgacacatttaagtgattgcagtagaagacgagtttatgggagaacgtgtaaagtccctgtgctagaacccattggtgagggtcaggttagaaccaacaacaagtgatctggtttgcagggggagcctgggaggattaggagattcactcagggctggggttgggcatgtcttgatcagagttgtggttgccttgagacttataaaggagaatgcaacgtgaagtgaagcagagcaggttggtggcagcaagagaagtgagttgcaacagattatcagaccaatgacctgtagcccaaaggcaaggggatttagatataagagacattaatttggagtatcagcatttactagattaatgggagagcagcttggacaaggatgaatatgggggctattacccacagctaagatttgatatgatttggggatgtgatatttggataggatagctcaatttaatgtgccagagtagagcagacataaggttctttatgttcctctagttagaaataaggttggtcccaaaatatcagtgaatctgagcctgtaggtaggggtgaaatagtctcagttgcaaagattagaaattacagaggccaaagtaggttgctgtgtagctatggaaatgtgtagagcttgatagctaatgacagtgactttcccccacagtggacttctaggagtgaaggatcaagatggtctgcctataattattggacataatattttaattacaactggaaaaaaattaaaaggatgaaaaagatataatatggaaatctaatcaaaacaaagcctggagtgtctgcattagtatcatagacaaggtggactttagaacaaggaatagcaccaagagtaaagagaactatctataatgatagttcaccaagaagacataacaatcttatttaagattgtatgtgtttaggaatgtatgtcacctaatatatgtatgctaacaggaacagtaacttgaactgatagaactgaaaggt

SEQ ID NO: 4117 - DNA, 1047 bp, Homo sapiens
ctcattgtggttcaaatctttttttaactttaaaattctttcaatgcaaagactatatcaaatagacatttaaataattttttgaccgagattttgtttatggttcctctctttctccttttctccaaatataagtagcggccaatttagtcatgggaaagataacaactaatttctttattctgtaatttattgtaaatatatcaggttcaatttgtgtaaatactttgtattttccttagtcctatatgtgttaatcttataatggaatgaacttattcatatatttatttgaaaactaatgtgcaaagtattgtcttaagtgcagagggtacgataatagtaaacaagaaaaacgaagactgctgttacgtgaagtgttctagttggggagacacattaaacagatacaatttcaggtggtaataaggtgatgaagaaaaataaaaataaagcagaggagaggtggtttgtgcaggtgctactgtaggtaagctagttttggagagcttccctgaggagctaagatttgaccagagactcaatgatatgaagatggaaactatttgaagatctgggaagaaacattccagatagagcatacacttagtagaaaggcctttatcaaggaataaatttgtggttttcaaggaacagtaaaatgtatatttataaaccatagggaaaccacctaaaatttttttagagaaaaatatataattaggtagcaaataacagagataaaattgagtaatttaagaaattatttaatcaggaaaaagaaaaaaggaacagcaagtaagtggatcagatagaaaatttggaagattatagattttattccaaccatatcaataattatattaaatgtattttaaatataccaattataagattggataaaaagttaaaacatatctgtaagaaatttgctttaaatacaaagatcttgttaggttaaaagtaaaagaatgcgccagcaatgaataactagagaaggaaattaagaaaaaaagtccattcacagtagcttccaaaagaataaaa

SEQ ID NO: 4118 - DNA, 1073 bp, Homo sapiens
tggtccaagaagagacttgatatgattttgatttttgaaaatttattgagacttgtttcatgggctaaaatatggtctgccttagagaacatttcatgtgctgatgagaagaatgtatattctgtggttgttgaatagaatgtcctataaatgtctattagagtccaatttatgtccagtatttctttgttgatttcctgtctcagtgatctttaatgctgtcattggggtgttgaagtccttctctattattgttttgctgtctcttttcttagatagagtagtttttctttggttttcttttctttttctttttatttatttttgtttccaaggcactgtctcaggatgtcctgagaacatgtgccccagtagtagttgtcttatgaatctgggtacctcctatatcgggtacatatatatttaggattgttacatcttcccgttgactttatcccgttatcattttaaaatgaccttccttgtcttttttcactgttgttgatttaaagtctgttttatctgatacaaagatagctactcctgcctgcttttggtttctgttggtgtgggatatcattttctaccctttttccttcagtctgtattaggtgggtttcttgtaagcagcatattactggatcatcctttttgtaagacctgtaagttttatacttttgtctgtttttatgatgttgagtattgaccttttgtttacatgtttagaactcacttgaacatttcttgtaaggctggtctaatggtgatgaattctgttagcatttgcttgtctgggaaagactttttctccatttatgaagcttgttctagcaggataaaaaattcatggttgacaggtttttttttttctttaataagtcttaaaatgggattgtgattttttttctggcttgtaaagtttctgccagtatgtccactgttagtctgaggggatttcctttactgatgattagacacctttctcttgctgattttaggatttttttttttccttcatgttgtcattagtctgatgagtatatgtgttggtgaagtccttcttgcactgtatt

SEQ ID NO: 4119 - DNA, 1015 bp, Homo sapiens
gcatctgttgagatgatcatacagtttttgtttttagttctgtttatgtggtgaatcacagttattgatttatttatgttgaaccatccttgcatccctgcagtatgacccacttgattgtgatatattatctttatgatgtgctgctggatttggtttgctaggatcttgttgaggatttttgcatctgtgttcatcagagatattggtctgtagttttgttatttttgtgggtccttccctggtatcacggtgatgccggcttcatagaatgagttaaggaggagtccctccttgatgttttttggaagagtttcaggagaattggtactagttcttcattgtatgtatggtagaatttggctgtgaattcatctgatcctgggcttcttgttcttgttgggagatttgttattactgatttaattgcactactcattattagtctttttaggatttctgtctcttcctagttcagccttagaaagctttattcttccagggatttatccctttcttctaggttttctagtgtgagtgtagagatgttcatagtagtctctgttcatttgtatttctgtggtatcagttgtaatgtctcctttttcatttctgatcacttgttaatttgggtcttctctcttttcttggttaattgagcagtatattggttttgtttatttttttcaaagaacccacttttcatttctttgatccttagtatattttgttgttgttgttctcagtttcatttagttctgctatggtctttgttatttctgttcttctgcttgctttaggttcttgtttttctagttcttgaggtacgatgccaggttgttaatttgtgatccttctggtttttttatttaggcatataatgctgcagacttcccacttggtgctgcttttgctatatcccagaggtttttgtatgttgtgtctccatgttcatttgtttcaaaaaagttttagatttctattttaattttgttgctgacccaaagatgatttg

SEQ ID NO: 4120 - DNA, 1049 bp, Homo sapiens
tcatgaattaaattttttacattgtttttcaaatattgagacttattgatagatgtatatcaaagggatagaatgctggtttatagtgaaaaatttaacttggtgagcaaaaatggccataataaagtgaatgagcatattacggctagaaagtgaacatctgttgctcattgttttaattatagccttccaatataactttatgaattcttcaaagtttcagaataagggttttaaatttgtattccagcaggaggtattgaattaccaatataagcatccaccgccaccactccctactgccaaatagtggcaatttatatgatataaagagctttggattttatttatggaactagattctagtcctgttttgccaactatgtgatcttgtatactcaaagacagttttgtgtgtgtgtgtgtgttttttcccaaatgattaaatagggctagaccttctcaggtctctctctttcacttttaaaattaactttattaaagtataatttatatgtaataaaattcatcaaatgtaggtatgtagcttgatgtgttggaaatgtatgtagttatgaaacactaccacaatcaaaacaaataatatttctatcattccctttatggttcaccaccccccaaccccagcaacctgtgtgctttctttcactatagttttacctcttctagaatttcaaataaatagaattgtaaggtatgtgacttttatgtctggcttctttcacttagcatatctattcacttttttgatgatttttgaaagttttatttttaattgacacatcaaatcagagtaattagctaacacattgattgcctcgaacattcctttgtggtgagaacattcaaaatcccctcttctagctattttcaaatatacaatacgttattgttaactatagtcactctactgtgcaatgtaacaccagaatttattcttcctatctaactgtaactcatacctgttgaccattctcttcccatcaccatgttcccaattccctccctagtctctagtaaccactatt

SEQ ID NO: 4121 - DNA, 1077 bp, Homo sapiens
tcattttattgattcagaaatgaagttgtgatatcctgcattcttgaataacagtattttcctttttttttttttttttgccttcaacagccctttgaatgttgggtactgtaccatcattcacagctctgcaggtttcaagtccattaccttaagaggtcacacactgaggtgaaatgatcattattaatcccctgaccagaagaggatacacccagggcccaatcttacccttgacttacagggttccctagtcttattataaagctagctttgtgagttacaaatttaatgatgtcttctacttcattccaaccccctaataagtcttccttggcttgcaagataggacacttaaataattcatttttgtaattttattttatttttaggaacttgttcataaagggataccccatcactttagagcaatagtttggcaacttttatgcagtgcacaaagtatgccaattaaggatcagtattcagaactcctgaaaatgacctcgccttgtgaaaaattgatccgaagggacattgctagaacttaccctgaacacaacttttttaaggaaaaagatagccttggacaggaggttttatttaatgtaatgaaggtaagttttatttattcattttttgaaatgaaatgaattcctggaaggttgaaattatacatttttcatgatgaagcatgacctcccaccacaataatcagttgctttggcagtgaaattggttttagcatcatttttgccttaattcttatgctacattactatctagtatagagaacttgttagaacatttactacgttatttagcattagttgatggaaatggaatagcttaaaagtcacatatcatagagggatcctcatgaaaaggaataattcaccatctgtgaagttcaaaacctgggatgtgggtttctcctatcatatctgtgttcctacagtgagcaaatttttctgctttctatggccagcactgttaagagcacttagcccttgaaaggtgtaccattgtcattttttcttcaatattgccatttcccttcccacagttactttttct

SEQ ID NO: 4122 - DNA, 1057 bp, Homo sapiens
cagtaaaatttgtttctttattgcatttacaattcttagggtttagaatcatgtggaaaattacctatgtaaactaatttttccataagatatattacggacttactgaaataatatgtattttaaaacagtatttaaagtaaaacatcatcattaattctttttttatctttttattttcctcagagaccttgttctgaaataatttttttcaagtaaaattatttataataattagttgatgctcactttggctgtttggtatgtttttatgtttttagcaatatttgggaaattttattttaattattgttgccatgaaaatatattaaattttccttcagtaaggatagaatttgtttgttcagtttatactgttgtattattgaaaatgacatacctggaatttggaattttaaaatttggacttatgattttatttcattttgataatatactttgcattgagctaaatgttctaagggatataaagatgagtagcatataaatctggctctcaaagggtggttgtataatctgttaaataggatttgacctctatatgtttattttctttctcagcttttgtattttatgaattagtattgtgagcttttgttgtagcctaagcagatgacttttcctgaagaattactggaagtgagtagtagctatataaaatagtgatagagctacgttttccaccttccttttataaataaaagacttaatgtagtgattagtcatggattggatcttggaaattatcttaacccttctttcaacagataaggaggaggcctaacacagggttgcaagctcaaaattcaacagggaccttatgagtgaggaggtcccagtttaacagtgtaaacctagtaataaatagcagctgttagctggcctgagttttaggggagactgtagggattatggaaagtgagcagattaaagtccttctgcatttgaaggaagaagctcccacgcagctatatcctgttcttactgtgcaggaatatggaccggttttgccttatctttttatttttcaagagaa

SEQ ID NO: 4123 - DNA, 1411 bp, Homo sapiens
aagattttgagcaaatcctctggtcagaagttttgggaagagatagtcttttaaaataatatgtagattctgaaagtttcttggataagatgaaattagaagaggatcttgaaagatcaaagtggagtgttaggttgtgtgagggctgttatgagcaaataggttctcagaaaaggaaatgaaagggactattaaatagagcaaaaggagatatgtgatagaaaaatagtgggaaaaccaaacactgcatgttctcactcataggtgagaattgaacagtgagaacacatggacacaggaaggggaacatcacacactggggacggttgtggggtggggggaggggggaaggatagcattaggagatatacctaatgctaaatgacgaggtaatgggtgcagcacaccaacatggctcatgtatacatatataacaaacctgcacgttgtgcacatgtaccctaaaacttaaaagtctaataataataaaatttaaaaaaaagatattgatcaaaggatatgaaatatcagttagataagaggaataagttcaagagatctatagtataatacagttactattgttaataacagtatattatattcctgaaaattgctaagagagtagcttttgtgttcttaccacaaaaaaaagtatgagaggtaatgagtatgtgaattagcttgatttagccatgtggtacatgataaatatatacaatttgtatttgtcagcataaaatataattttaagtaattaaaatagtgggacatgaagttggggcaggactgacaaagtaaagcacttacagacagtgctaaagggtataaaggatttttaagtgttcagttggttattatatacaaggatgaagtagtttccagtaaagataacttctggtatagattttgtaagtgaccaaagttgaatttatttttacggttgtgatcagtaattactgtgcaactaaaatacacaaagcgttatattaaaattgttgtaggtaaggtgtggttgtagatgaattgcttattcccatacaattcacaatttaccccagaataccagatgtgtttaatatatatgttgacaactaaggaataattactggagttttaaaaaaaattattgttatactttaagttctagggtacatgtgcacaacgtacaggtttgttatataggtatacatgtgccatgttggtttgctgcacccattaactcatcgtttacattaggtatttctcctaatgctatccctcccccagccctccaccccttgacaggcaccagggtgtgatgtttccctccctgtgtccaagtgttttcattgttcaattcccacctatgagtgagaacatacagtgtttggttttcagtccttatgatagtttgctcagaatgatggtt

SEQ ID NO: 4124 - DNA, 1055 bp, Homo sapiens
gctgagtgttttttaatatgtctctattaaacttttgaatatataggatacagttataataacttttaatgggctctctggtcattctaacatttgagttaatgctggtttgcttttgatggattgatttcccccccacctcattattggttatgcttttcttctgctttgcatgcccgatttttttttttttttaaacaaaatctcactctgtcacccaggcttgagtacagtggcgtgaccacggctcactgcagctttgacctccttggctcaggtgatccttcgacctctgcctcccaagtggctgggactacaggtgtgtgccatcatgccctgctaatttttgtattttttgtagagatggggtttcaccgtgttattcaggctggtctcaaagcctgataattttttattgaatacctgagattgtgaattttatcttgtcgtgtttgactattttctattttcctataaatattcttgaattttgttctggcatgcagttaaattacttcaaaagaatttgttctggagtaatacagaacctaggactattattcccccctactgaggcgagacccttttgtgtactcttcccaatgtgtcttgaaacagtaacttttccagtctggctggtgaggataggtataattttctaccatgtgtgaatgttagccatggttacatctaatcttttctggtggttgattctctggccatggatagtttccttacatgaatgcattgatcagttcccagctgaatatttgatggagatctacctatctctgaagatctctgtatagttctttcatctctggtcatgacctgtgaactctagacaccttggtctcactgccattgagtacctgaaatatggtttatctgacttgcaatgactcttctcatcatctcctcagttcagggagcacacaagactgtatctcaattttccccacctgttatagggccctgaaactgaatttcaaggtggttaaaatggcagtcacagagtttactttacttatgtcccgagtctcaggaattcttct

SEQ ID NO: 4125 - DNA, 1072 bp, Homo sapiens
tcaagaccaacctggccaacatggcgaaaccctgtctctactaaaaatacaacaattagctgggcatggtggcgggtgcctgtaatcccagctactccagagggtgaggcaggagaactgtttgaacccaggagacagagattgcagtgagcagagatcgcgcctctgtactctgcactctagcctgggcgacagagcgagactttgtctccaaaaaaaaaagaaaaaaaagaaaccatggcaagtgaaactgtggataaggggtgactattattggtacatctttgttggctttctgtttacatgttatatcagatattgagagaagagcagtaacttcaaattataattgtggatttatctatttctttttaaattctgtctttcatgtaatttggagttctattttaggtatataaacatttaggattgttatatcctcttgtaaaatgaccttctttatctttggtaatgttgtttccttggaaatctactttatcttatattaatatagtcactctagcttccttttgaatagtgttaacatcttatatattttcccagccttttgcttgtattctatttttttttgtttatctttaacttttttttttttgagacagggtcgcactctgtcacccaggctggagtgcaatggtatgatcatggctcactgcagccttcatctcccagactcaagcagttcttccatctcagcctcccaagtagctgggactacaaaattttattatttttttaagagatggggtcccactatgttgcccaggctgttcttgaactcccggattcaagcaatcctctcacctcagcctcctaaaatgtttggattacatgtgtgagccatcatacctagaaaaaatctttggagtttgtctgttagtagcatttagttgggttttgcttttaaaaatacaatctgacaatctttgtcttttaattgggttatttaagccattttatttttttaaaaaattaaagttttattttttgctcacatttacattcatctcaattagtaggttggatacatctttgctttactgtgctttgt

SEQ ID NO: 4126 - DNA, 1066 bp, Homo sapiens
ttatagttggatgcctcaacacctctcagtaatttatagtgtagcagacagaaaatcagttaggctatagctgaatagcaccatttatcaactggatttaattgatatatatagactgcttcatccaacaacagcaaaaaacacatttttctcaaactcatatggaacattcgccaagattaaccacattctgggacataaaacacatcttaacttgtattctcagaccacggtggaattaagttagagatcactaacaattatctatacaacttgtgttgtatagttagaaagatatttggaaaatctgaaaatacttgggaattaaaaaacacacttctaagtaacacatgagttgaagtctcaaactaaaaatattttgaactgaaggaaaatgaaaagcagcaaaagcagtgcttagagtttgatttatattgaatcatatagtagaaaaaaagattcaaaaatcagtgattaagcttctactttagggaactagatagaagagcaatataaacctaaagcaagcagaataaaataaataataaaaattagtagaaatcagtgaaatagaaaacaggaaaacaattacaaaattaatgaaagaaaaactgtttcttttaaaaggcattgaaagtgacggacctctagccagggtaacaagaacaaaagagagaagacacaaattactaatgtcaagaatgaaaggggtaattttttcccccagatttcattgtgataaagtattcataacaaaatttacagttttaaccattttaagtctataattaagtatattcatattgttgtacaaccaccatcaccatcatctctataattttttcatctttccaaagaaactctgtggccactaatcaataactccctatttcctcttcccatggcaaccaccattttactttctgtctctgtggatttgactatctcataaaagtggaatcacacaatatttgtcattttatggctggcttttttcacttcgtataatgtcctcagggtgtgttcatgttgtggtatgtcagaatttccttcccttttttttttg

SEQ ID NO: 4127 - DNA, 1026 bp, Homo sapiens
tttatttcaagcactgttaaatattttaattttgttttgtgggataatgtgatattgttccagttactgtagcggtgtaacaaaccaccatgaaacttaatggcttcaaataatcattttagtatgtgcttagattctgtgggtcaggaatttagacagaggattatgaagaggacttgtctctgcttcacgtctttggtctcagctgggaagacttagagtctggggctgactcttcacttagggcctagaatcagttgggggtatgttcacatttgtgcctggtggttgaggctggaacctcagctggactgttagtgagaatgcctgtactctccatgtggtctctgcgtgggctagtttgggcttcttgaaagcatggtagccagattccaagagttaagctcagtaataacttttggtacccacttttggttgaagcagtcagcgagctttgcttgggctcaaggggaggggatgtggacttcaccactctatgggaagatgtgagataggaaatgtggccgtgttacagattggattgtgtccttcaaaaagatatgttgaagtccagctatcacagtacccttgtacctcagaatgtgactttatttggaaacagggttgttgtaaatgtaattagggaagatacagtcactggaggggagaatgtcatgtgatcatggaggctgagatccaagtgcttgaagtgctgcaactgcaaaccaagaaatgctggtcattactggcaaaccacccaaagctaggaagaggcaagggaagattctccctacaagttttagagggagaatgaccctgctgacaacttggttttggacttctagcctccagaactgtgagacaatacatttctgggtggtttttttttttgtttttttttttggtgagatggagtctggctctgtcacccaggctggagtgcagtggcgtgatctcagctcactgcaacctccgccttccgggttcaaacaattctcctgtctcagcctctcaagtagctgggac

SEQ ID NO: 4128 - DNA, 1702 bp, Homo sapiens
cagacgggagccactgtgcccggttgggaaaattatttgtaatctaagagtttatagtgcagtcattttcaagtgtaacagtagaaaaagcattttcacatatgcagtgtctcaaactcacctctcatgcaacccctttcaggaaggtagtagaggaggtactccaccaaaataagagtgttttgagcaaagggaagacatagtgtttaggaaacaaatgatccaacccaagtgaggtgaaaggaatacctgggatcacagttgtgtaccaggtgtagagcaactagtccagaatggagcaagtcagaaggttgcagaaaggacttgtacaaaaatataagattgatagcacatgtgatatgctcgaatatgttgaggagatttatataattggatgaattgggggtgaatttataagtacaaataaagctaaacaattagacatttattaactccagggaaagtaaaaaattggtccaagaaagtaaaagtaatcacagtatacctcatagaacaactgtgactaaagttacatagtcatgttaatgcatacactgaatattggtgtaaccaaaaatatgttttttatttatttttattttttttgagagggagtcttgttctgtcgctcaggctacagtgcagtggtgcgatcttggctcattgccagctctgcctcccgggttcatgccattctcctgcctcagcctcctgagtagctgggactacaggtgcccgccaccatgcctggctaattttttgtatttttagtagaaacggggttttaccgtgttagccaggatggtctcgatctcctgacctcatgatccgcccgcctcggcctcccaaagtgctgggattacaggcgtgagccaccgcacccggcccaaaaatatgttttaattacatagggataatggaatgtatgaagtgtttgtatgttatggtgggcaaggttgatgatatggatgatggggaaagaactaattgacctttttcacaggaagaagtcaacagataaaatattacttttttttttctggtcataacctcatgtaagtggtaaaaattaaaagtaaggggaaaaaggcaacggggtagacatttattatagccaaaggagggtcaggaattctacttctggatctggggatgataggaaagttcaaaaattatttgcaaaattttgttcatatgtgcatgaatttctcaaaggagtttgtgacccctaaaatgtctaaagagtatagtgtagtgtgatgattgtggtgtttttcagcgtgttcgtgaaagtgttagttttagttttgattcttgatttatttttatgttttcatgtattcattatcttgttatatgaaagatgacttagtttggtaaagcaaataccattttttatttggttttgtattaaaataaacctcttaagtattgatttgtatctgtgctgccttctgagttaatgtcttcggctcttctagttcattgattttctgtttatgtctgtttaattctctatccctctgtcttccccacatctcacctccctttttttcctatttcatttattaaattttttatttctataagttccacttggatacttcaaaaatttgcatgatctttgtttgtatcctattccttgctcatttaaaaaattcttttattgctttaagcattttaaaagtagttatatattctg

SEQ ID NO: 4129 - DNA, 1035 bp, Homo sapiens
attacaggcgtgagccacctcgcctggccagtttctttttatatctgttaaaacttgtagtattatgttacttgtcccagtagttatactttatggaataaatcctagagaaacgtacacatgtggagaaatgtctttaacatatattaataatagtaaaaaatcggaagcactccaagtatccatcaatagaggattggttaaatcaagtatagtacatttatatttatatgatggaatgctatacagctgatggagtatggtgtctatactgtgttactttcctgtgcggctgtaacaaattagtacaaacttagtgacttaaaacaaatttaatctctcacagttctgaaggtcagagttcaaaatgtttcactgggttaaagtcaagattgtagcagggctggtttcttctggaggctctgggggagaatcttctctagcttctcgagctgcgttccttgtattccttactttgcattccttgtctccatcctccatcttcaaacccagcagcatagcatcttcaaatttttttctgtttgtgccttcacattgttttctctctcataaagacttatgtgattatatcagtcacaacccagataattcaagataacctcccttctcatgatcttttttttgttgttgagatgggagtctcactctgtcacccaggctggagtgcagtggtgccatctcggctcactgcaggctctgcctctcgggttcatgccattctcctgcctcagcctcctgagtagctgggagtacagatgcccaccaccacacccggctaattttttatatattttttttagtagagacgaggtttcaccatgttacccaggatggtcttgatctgaccttgtgatctgcctgcctcggcctcccaaagtgctgggattacaggcgtgagccaccgtgcccagcctacctcaagatctttaacttaatcatagctgcaaagcaccctctgccgtataagataacatagtcacaggttccaggtattgggatgtggagctctttgcc

SEQ ID NO: 4130 - DNA, 1030 bp, Homo sapiens
gcgtgcgcctgtagtcccagctactcaggaggctgaggcaggaggattgcttgaacccaggaggtggaggtagcagtgagctgagattgcgccactgcacctccagcctggcgacagagtgacactccgtcacaaaaaaaaaaaaaaaaagattttggcatctttgactaggtcagttatccagctgctttccagcttccaaaattttgttgctattgtctcattctccctgtcataatggcttgtgtcctaaaaacagaacaaacaacaataacacaactttctttatccttgttttagtaacgttttgggaggaagcaaaattagatgtgtgtgtgttcaatctgccatctcaccttggaagtccactgtctgctttccattatacagaaacttgttgccacctgtcctccattgttgtctcctccttatggggttataccttttaaatttcttcatagttgtctgaaaagagtgtcaggaggtagaggacctaaatattggtcaagatatcatttctttaggagtctcaaaattctttttagaagtactcgttgtcccaggatcttataatctcaagattggaagtgattttgaagataatccggtttaacgagctatttgataccttctctaaaggaattgtccagcctaaaatgtgagaaacttgtggtaggaggagatgagtgcctggagaaatggattgggctgtagatctctgcaaggggtctggaaatccatgtgtacattaaatgttgcatgaataatagttcttgcatatttgtaatatataataaaatttattaaaaagtcataatgggccgggcgtggtggtggctcacgcctgtaatcccagcactttgggagtctgaggcagctggatcacctgaggtcaggagtttaagaccagcctggccaacatagtgaaaccccatctctactaaaaatacaaaaaattggctgggtgcagtggttcacacctgtaatcccagcactttgggaggccaaggcgggtggatcacgaggtcag

SEQ ID NO: 4131 - DNA, 1053 bp, Homo sapiens
tatatatatatatatatgccaggagtggtggcatgtgcctgtagtcctaactacttgagatgctgaggtgcgaggattgcttgagcctgggaggtcgaggttgcagtgagccaagatctcaccactgcactccagcctggacgacaaagtgagaccctgtttcaaaaaaaaaaagaaaaagaaaagaaatctgtgttggagaatgtttactttaacattatttatgatagctaaaaatgtccagatatgaggagggagttcattaattaattggagtgctgtacagtttgacatgaaaattaattcaaaaaaggtgaaataaaatgagtatactcttagaattgtggctattagaggctgggaagggtacagaggagaggagaataaggagaggttggttaacagatacaaaattaccgctagataggcagaataagttctagtgttctatagcactatagggtaaagggattaataatttttggttattttcaaaaaactaaaaggattgtgaatgttcacaacacaatgataactgagacataaatatgctaattaccttgatttgatcattacaaattgtatgtgtgtattgaaatatcactatgtatcccatgaattttttttctgtgtgctcccgttcacaatacagacaaggcgcagggcctgggctgaggtgtacatgggagttcacctcctcattctatacagtcagtataagaacacagcctggggtaagcaccaggaggcctggggattttttttctttctttctttttttaaaagatggttggttatttgttttgttttgttttggcagggtcttgccctggtgcccaagctggagtgtgcagtggcatgatctcggctcattgcagcctcagcctcctgggtttaagccatcctcctgcctcagccccccaagtagctgggatcacaggcgcaccaccgcacctggctaattttttttttttttagacggagtctcgctctgttgcccaggctggagtgcagtggcatggtctcagctcactgcaaccttgcctcccagat

SEQ ID NO: 4132 - DNA, 1030 bp, Homo sapiens
ttagggttgctagatgtagcaaataaaaataaggatgctcagttacatttgaatttaaaataaactaggactaccttgagtataagtatatcccaaatattgccaataaacaacaataatttttcagcataagtgtatcctaagcagtattttgctcggcaaccctaatgaagaaggtcccagaaggctttctggaaaaggttacatctgagctgaattttgatgaatgagcattgcagacagaaggaggcatgtgcaaagctacaaacatgagaaataatgctacattccaggcatagcatagctagagcagagaagatgaacggcagtttgcagaggtgaaggaagcagggtcaaactcataacagaccttgtatctcatggtaaggagttcgccttttaccttcagagcagtagagagtcagtagaagtttttaagcagggaagtgactgatccgatttatgttttagaaaaattttgctacttgtagtggagagggtggattagacaggagacagcacaagcagggggatctgttttatggcagttgtaataatccaggcacaagtgacgagggtttaaactatggcattgacaatgggaatggaagggatgaaacagcctcaaaggatatgaaggaaataatttgattgccagcaattggtgaccagttgagtttggggaaattgggaagaacaagaaatttaggacaactcactgcttcctccctcggtgcctaggtggttgatggcaccttccactgaggcaggccatgaaggaggacaaccttgggacagaggagggaagggtgtgatgggttcagtctttgatagattgagtgtgaattgcttttaggttatccaaatcgaggcaagagatgttcagggagcacttggatatttaattcacgaaaaaggcctaggctgggatagagccaggattcctcagagctgtgggaatgtcactgatgatggtatacagagaacacaaggaaaatggaacaaaaccctggaaaacactaatacttaa

SEQ ID NO: 4133 - DNA, 1103 bp, Homo sapiens
cactgtcctgcacccactgtctgacaatccccagtgcgatgaacccagtacctcagttggaaatgcagaaatcacctgtgttctgcatcgctcatgctgggagctgtagactggagctgttcctattcggccatcttggctccaccccgaaattttttattttattgaaagaaatgaaaatagaaacacaatataacaaaacctgtgggatacagcagattaagagggaaatttatagcaataaacacctacatccaaaaagtagaaagattttaaataaatgaattaacaatgtatctcaaggagctagaaaagcaagaataaaccaaacccaaaattagaaataaataaataataaagatcaactaaaaaaaaaccacaaaagatcaatgaaatgaaaaattggtttttcaaaaagacaaacaaaattggtaaaccattagctggactaaccaagaaaaaagagaaaatacctaaataaataaaatcagaaatgaaaaaggagatatgacagctgataacacagaaatacagagtatcattagagactttgtatcatgaagaactgcacaccaacaaattagaaaactagaggaaatggataaatttttggacataaacattctaccaagattgaaccaagaagaaatagaaaacctgaacagaccaattacaagtaatgagattgaatctatgaatttgtaataaaatgtttcctatcataaaaaggcccaggacccaatggctccactgcagaattctaccagatatttaaagaactaataccaattctcaaactctcccagaaaactgaaaagaagggcattcttccaacttattctataatgccagtgttacttcaataccaaaaccagacaaggacaccagaaaaaaagaaaactataggctaatatacctgatgaacatagatgtaaaaatcctcagtaaaatagtaacagactgaatccagccgcacactggaaaaataatttaccatgatcaaatgggatttattcaagagatgcaaagataggtcaacgtacacaaatcagtaaatatgatacatcacattaacagaaccaaagacaaaaaccttatggtca

SEQ ID NO: 4134 - DNA, 1048 bp, Homo sapiens
aattcagccagaggatataacaattataaatatatatgaacccaacactgtagtactcagatatatataaagcatatcttatttgatctaaatggagagatagagtctgatacaataaaagttgggggtttcagcactccacactcagcatttggatagatcatctagacagaaaatcaacaacagaaatgaatataaagtacattttaggccaagtgcaattgctcatgcctgtaatcccaacactttgagaggctgacatgggaggatatttgaatccaggagtttgaggttagcctgggcaacatagggtgacccccgtctatacaaaaacattaaaaagcaaaatagccaggcatggtggcacatgtctgtggtcgcagctactcgggaaggtgaagtgggagggttgcttgagcccaggaggtcaaggctgcagtgagccatgattgtgccagtgcactccagcctgggtgacagagtgagaccctatctctaaataagacagactcatacctgtaatcccagcactttgggaagtcaaggcagaaggatcacttgaagccaagagtttgaaaccagcctgggcaacaaaacaagacctcatctctacaaaaaccgtaaacaaataaaaattagcaaggtatggtggttcacacctatagtcccagctactcaggaggctgagatcagagaatcccttgagcccagtagttcaaggctgcagtgactatgttcataccaccgcactctatcctggatgacaaggtgatatgttttgtgatatggtttgaatgtttgtcccctccaaatctcatgttgaaatgtaatccccattattggagatggggtctggtgggaggtgtttggatcatgggggtggatctctcatgaatggcttagcaccatccccttggtgatgagtgggttattgctctgagttcatgtgagatctggttgtttaaaagtgtgtagcacttcccccttcccccgttgctctcttcaccatgtgacaggctggctccctgtcactttcaccatgactgta

SEQ ID NO: 4135 - DNA, 1081 bp, Homo sapiens
ggtgtgcaccaccatgcctggctaattcttctggctcagcctcctgagtagctgggactacaggtgtgcaccaccatgcctggctaattcttctggctcagcctcctgagtagctgggactacaggtgtgcaccaccatgcctggctaatttttgtatgtattgtagagacaaggtttcaccacgttgcccaggctgcagttacatttttacttgaaaatcgttcatttctaatgcctttttaattttttaaatcagaaaagaacaaatttgttctgccagactattattaggttcctaattctgtgaagctgtgacctggggtaaaggttaatctgtagttagcttaaaaccagtttcattactagcctttacagtatactttggtatttatccaagatcggggtgctggctttttatgtgaaaggccagaaccttaagtagcaagaaaaagtagtccttaacttttcattaaagtataacatgaatattgaaatgtacatttatgctcaaggaacaccattttaccagcatgctagatctgcagtcagttaggaattgatttttgtatatggtataattacagttaaagatacatgtattttttccaattagatattcaaatgacctggtactgagattttttaaaaagcagcattgtccaaaaaagcaactttggcaatagttggttcattcaccactagaatgaattccaatcctagcccaaaaggaggctgaaagatgtgtcagagcctctttttctttccggatcaccatttagtctgtaaaaaataaagcatgtggggatttctgttgtgatccccacaaattgaaagtcacatctgcaaaagttagatagaagtatatcatgcagtatctgtgaagtaatacttgcaaggtatttatgataggttagtcaccagttaatgtgctaggaagaagtcaccatgcccggctatttttttttaatattttttagtagagacagggcttcatgttggccaggctggtctcaaactcctgacctcaggtaatctgcccgcttcagcctcccaaagtgctgggattacagatatgagcca

SEQ ID NO: 4136 - DNA, 1042 bp, Homo sapiens
gcggagctcgacgggccgccttctccctggtgttttcggggctttcccccctcccccgtgggcccccgcaggtcggttgcccttgactcagtgtcttgggtcttaagtcggtggtaggaaaggtggtgtagcattcctccgtgtcttagaaaattatgacaatttgtcacaccagtgtttccccaggctccaaaaagcagcgtgtgcctcgtgccgagccccttggttgggtcgttccatcacacccaagatttaaatgggaggtggagaccgataagcctgaaccaggcggatgggtgtttgctttttaaaggaaaggggctagtggctggtctgtggatcccaaataccctagtaatgcaaacgtaattctcagtcatgtcgtgtgtacggttcgcgtgttaatttttcatgatttcccgttccaccctctgttccgctgccagtctgtgccttggaaccctactactgcctaagtgtactgtttggtcaccagggggacctagtagacaccgcgagtagctgagcgcaaatccatcactccgatggaaaaacaactacaaatcaatgccttgcgtgggtcagcagtgttagccaacgctgcattcagaggacagtattcctttaccgcttacattaaaaggccaagaggtagatgatttggggtcagctggtgcttttataaattatgaaaaaagttgagaaggtaaccatcatgaggcaagtaaatcttacatttttgtttgaaaattgtatgtgtaagtcattaccctgaaatgagtgacgtattgcaaattggaagcatgatttgacaacccatgatattaagcgtgtacgaataaaactgagtctttgtagcaagcaccaccaatagtaattgtgcacttgagtaacactgtcacaaccccttctagaattcaacccaggccaggtacctctgtgtaatcttttatgtgagtttaaaaaaaagcttaccggccaggcgcgatggctcacacgtgtaatcccggcacttgggaggccgaggcgggctgattccttg

SEQ ID NO: 4137 - DNA, 1031 bp, Homo sapiens
aattctaaaaggacacgtaataccattgcagaaagaaaagacagttccaaatgataaattttagagttgttttgctaggatgcaagagaaattggataagtggaccactcatacgttgctggtgagatatgaaatagtagagccactgtggaaaatattcttggcagtttcttataaaactaaacatacatttaacatataactggcatttgtactacttgacagttatccctgagaagttaaaacttaacattcacaaatgttacatagcaccttcatttataatagccaaaacccggaaacaacctggatgtccttcaaaaagagtgaatggtttagtatgtccacaccatggaatactaaatagtaatatgaaggaacaaactactgatacatgtaacaaattgcatggacctcaagggaattatgcttgggtggtttggggggacaatcctaaagttttacacactgtatgattctgtttttgtaacattcttaaataataaagctatagagatgggaaacaagattcgtggttgccaggtcttgggactgaagggaaggagaatgtggctataaagggagccttgtggtggaaaagttctgtagtttgattgtggtgattacataaatatacatgtgaaatgttagaagtatttatagctgaaacatattagtatgttggtatatacatatttctgactaattaatttcgccatgttgcccaggctggtctcgaactcctaagctcaagtgatgtgcccgcctcaacttcccaagtgctgagattacaggcgtgagccaccatgtccggcctgttttttcctatgcatgcataattacgatcaagtttaatttgtaattaggcacattaagagattaacaatagctaacaaaatggaacaattacaacaatatattgtaataaaagttatgcaaatgtggtttctctctctcaaaatatcttgtactcacccttgtgaggctgtgagatgtcatacaatgcctacatgaagagatgaaatgaggtg

SEQ ID NO: 4138 - DNA, 1052 bp, Homo sapiens
ttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaattttaacatgattgctgacttggataattcattattaccagcagttatgaaggaaatattgctaaaatgatctgggcctaccataaataaatatctccttttctgagctctaagaattatcagaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaaggtttagcactgggtgtacatatttattaaaaatttttattataacaacttttattaaaatggcctttctgaacactttatttattgatgttgaagtaaggattagaaacatagactcccaagttttaaacacctaaatgtgaataacccatatatacaacaaagtttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatg

SEQ ID NO: 4139 - DNA, 1023 bp, Homo sapiens
tggtttctttttttttttttttttttttgagacaggatcttgctctgttgcccaggctggagtgcagtggcatgatcatgcctcactgcatcttcaaccttccgggctcaagcaatcctcacactctgctaatttttgttatttttttgtagagacaggattttgccatgttacccaggctggtctcaaactcctgagctaaagtgatctaccagccttgccctctcaaaatgctgggattacaggtgtgaggcaacacactcagcctgttacttcttatttttacctttagttgcttttcatcacaaatagaaatacaggtaacttaaaacatgtacttttttttatacagtgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggtcagtatggtcttctaataaaataaaaattattaacagccagaggccttactatggtaataagttactgaactaagcattttatctgcattatccaggaaaatctgtttctaatattttatttttgccataaatactttgacctcaagtatcagcttaattttattttatattaatatagcccttttatagttttcaaataacttatcttccaggaccctattataaaaatagcttcagatgtgcaaataagactgcatcttggtaagtttgttttataaatgtgcagttagaatttttaaattataaatagattatgcttctgattatacagcaggcatatgaaaagtaaaatgttttctaatttcacaactattttgtggtattaaaacattgggtgttttactgaatactaaattgttcagataaacatacaaagaaggaaatattataaacacatgcattatgtaataggtaaatacctaaa

SEQ ID NO: 4140 - DNA, 1035 bp, Homo sapiens
aactccgctggtctcaaactcctgggctcaggatcctcccatctcagcctcctgagtagctgggattactgggattatagatcttgtacatattttggtagatttgtacctaattctttttttctttttttttcttttagtgctaacgtaaatggtattgtattttttattcccaactccagttgcttgttgctggtgtataggaaagcagttgactattgtatgttaatattgtatactgagacttggctatcatcacttattagttccgggacgggtttttttttggcagttctttaggatttctacatggactatcacaaggacagttttatttcttcttttccaataggtatgtcttttctttccctttcttgttgtattacattagctcgagcttccagtatagtgctgagtaggagtaatgagggagtagcatctttgtcttgtttctgattttagtgagaaagcttctagtttctcgccattaagtgtgatcttagctgtaggatttttgtaaatgttcttaagttgaggaagttcccctctattcctagtttgctaagatttttttaatattaaatatcatggattgatattggattttatcaaatatgttttccatacccattgctgtgatcatctgagttttcttccttagcctgttgatgtgatgaattacacaaaataattcatgaatgttgagccaggcttatatacttggaacaaatccatctggtcatggttgtaattctttgtttacattgtcgaatcagctttgctaatattttgttgaagatttttgcatctgtgttcctaagagatactggtatgtagtttccatttcttgtaatgtcttttctggttttagaattagggtaatgttggcctcacagaatgagtaaagaattgttccctcagcctttattgtctgtaagagattttagagaattggtttcattttgtccataaatgtttggtaggattcaccattgaaactgtctggtcctggtcctttcttttgggggaggttat

SEQ ID NO: 4141 - DNA, 1048 bp, Homo sapiens
atgacccaagaattctactcctaggtatctacccaagagaaatgaaaacatgtccaaagacttgtatgcaaacgttcatagcagcattattcataatatcccaaagtggaaacaatccaaatgtccatcagccagtgaatggataaacaaaatataacatatctatataatgaaatactatttagcaataaaaagaaatgaaatactgatatcacaacatgaacgactctaagaatgcaaaagaccaggtgcaaaagagcacatattatacgagttcatttatgtgaaatgtccagaaaagacaaatctacagatgcaaaaactattagtgtcttcctaggggtagaagtgagtacagggactaattataaatgggtccaaaataccttttggggatgacagacatgtttcaaagctggatcatggtgattgttacaaaacttataaatttactaaaaatcatagattagtacacttaaaacaggcaaattttatggtatataaatgatacttcaacaaagctgtttaaaaaaaattctgtgccattcttatatatggcatctgagaaactggggaaaagtgtagaatggtaagtgcaggaaaaaaaatagagatttagacagaagagaaattcatgactaaaagtatagagaaaaagaaattagaagctaataaagcaaccacaaaatgatagtcttttctaaaacactttagtaaaattcttcttttccattacgtaatcacacatacttactggcaactgggatataatcttttccaaacttcttagttctacccttgaactttcaatttcttgttgacataaatctagtcgctcattctgtgctgcaacacggacctttaattctcggttttcattcattaaagaaaatttgtctctaagtatttcgtctttgttctctaactcactctctagcttcaaaatactttgtctagattcagttagttgtgccatgacttctgaatttttcactgccatgatccttaatttttcttttccgttgttattttcttcttttaactgcct

SEQ ID NO: 4142 - DNA, 1711 bp, Homo sapiens
gatcctcccgcctcagcctcccaagtagctgggagtacaagtgctcatcatcacacctggctaattttttttcactttttgtagagacagggtcccactatgttgcccaggctcacattcttatctgcacatggaatattatccagaatacataaatatgttaggccacaaaataagtctcatcaaattttaaaggtagaaatcctatcaaatatattatctaaccactatggaataaaaatagaaatcaataataagaggaactttagaaattatataaatacataaaatgtaaacaaatgcacctgaatgaacaaagggtgagtgaagaaattttaaaaaaaattttaatgtcttgaaacaaataaaaatggatatacaacataacaaaacctacgggctactgtgaatgcagtaccaagaggaaagtttatagcaataattgcttacatcaaaaaaatacaaaaatttcaaacaaacaatgcacctaaaggtgcatgttaaaagcattattgaaaatattattggacatattactgaaaatgatgcttttagaattgcattgagaatatatttgataggatttctacctttaaaaatttgatgagacttattttgtggcctaacatattacatattctggataatacataatacatttatgtattctggataattccatgtgctgataagaatgtgagcctgagcaacatagtgggaccctgtctctacaaaaggtaagttcaagttggtcttgaactgcctttcccacactggaatagcaacagccaaacccaatattattagaaggaaagcagtaataaagatcagagcaaaaataaatgaaattgagactataaaacaatacagaggataaatgaaacaaagagttaatttcttgaaaagatgaacaaaattaacaaatacctttagatgactaagaagagagagaatccaaataaataaaatgagatgaaaaaggaaacattacaactcataccacagaaatacaaaggatcactacagactgttatgaacaactacataccaacaaattggaaaaactagaagaaatggataaattcctggacccacacaacctactgagattgaaccatgaagaaacagaaaacttgaatagaacaataacaagtaatgagataaaagcagtaataaaaagtcgcccatcaaagaaaagcccaggacctgatacattcactgctgaattctaccaaacatttaaagaaaaactaataccaattctactcaaactatttcaaaaaattgaagaggagggaacattttttttttttttttttttttgagacagggtttcactctgtcgcccaggctggggtgcagttgtgcactcatggctcaatgcagcctctacttcccaggctcaagcaatccttccacctcagcctccttaatagctgggactacaggcacatgccactacacctggctaatttttctactttctatagagatggggtttctccaggttgtctaggctggtcttgaactgagctcaggcaatctgcccacctcgacctcccaaagtgctgggattacaggcacgcaccaccgtgcctggcccacttctaaactcattctacaaggccagcattaccctgataccaaaaccggacaaggacataacagaaacagaaaacaacaggccaatatccctgatgaacacagaggc

SEQ ID NO: 4143 - DNA, 1026 bp, Homo sapiens
gaatggacagttaaatctacaaaagctgaagaaaaagaggatactaaatttgtttattatacaaagagttttttgtgactttcaagaaaacagtaaatttaatattcaagagacaaatacagtaagttacaaagtgggaagggtagtaaggaggtagcaacaatggagaaatagaatgaataaaaattttttttgagatggggtctccatgttgcccatacttgtctcaaactcctgggctcaaataatcctcctgcctcagcctcctggatagctgggattgcaggcatgtgccactgcacccagcttagagtgggtatgaatttaagatgtctggaaatgaaaggaagagggaaataaagaagcctgaagatacagattaaatcaggaagcagagaagcaaaacaggcaagcatattaaaggcttgaaagtacatgttcaagaatttctctctaaaaaagaagagggatatatctttcttttaaagagaaaagggacaaaagaaggaaagatgaatataaatattttagggtgaaaaattataaggatgaggacagttggccttattcatgcttttaaataatggctaattcagtaaatcaactttccaaggatcagtgatagccagcaataacttattttgacatacagagcccaaatgaacagtaaattatgacgaagttatgagaacattcacctcagaacctactttctctggattcctctcactgcatatttcttaccatttttctttttttcagttttttaatttttttatttttaagcactttcatgtctatcttcctatttttcgttctacttcctgttctgtctccctctgcctctctctttccccgtattgtctcacaccatgcaatagagaaaatgtcttttggtattgattttacttaatgtataaaatgtaaaatcttccttcttcaaatattagtagtttttcatttaaatatatgaattttcttccaagtaataaaatgatattctttggaaacaaattattacagttt

SEQ ID NO: 4144 - DNA, 1050 bp, Homo sapiens
gaattgacccctttatcataagacctgatttgtctctcttcttatagtttttgtcttgaaattatattttattttctttctttttttttttttcaggagaagttttgctctgttgcccaggctggagtgcagtggtgcaatctcagcctactgcagcctctgcctcccaggttcaagcaattctcctgcctcagccacctgagcagctgggattacaggcatgtgccaccaggccctgataattgttgtatttttagtagagatggggtttcaccatgttggcctggctggttgcaaactctgatcttaagtgatctgcccacctcggcctcccaaagtgctgggattacaggtgtgagccactgcacctggccttgaaattattttttctgatagaagtatagccactcctactcttttttggctttaatttgcgtggaatatctttttccaaccctttatttcagtctatgtgtgtctttataggtgaagtgtgtttcttgtaggcaacagaacgttgggtcttttttgattggagagtttggtccatttacatgcagttattgataagtagggaattgttcctgccattttgttatttgttttcttattgttttgtggtcttctctccttctcttccttcttgtctcccttttagtgaaggtgattttctctactgttgatacgggagctagaaagaaattatctaggcagatagtgtgcataaaaggagtcttcgacaaggcttctcttttaacaaaaagcagctcccaaatcatttcttttctaacaaagagcagcctgaaaaatcaagctgcagacatagataagcaagctgaaagctttgcatgggtgagtgccaacagctgtgccaatagaaaagggctacctggaagccaggtatgttcaacatgggggctccatcttcccttttcattgtcaccacatgtacagtaaggagcaggcaacatggcaccggccaggtagagaacccttctgcataataaaagattaggatgggacagccagcttcttcacatgctatgcaaa

SEQ ID NO: 4145 - DNA, 1030 bp, Homo sapiens
atggattgagttttctttcccacatggatattgaattgtaccagcacagtttattaaaagatgtctttttttctactgaatcacctttagaactttcttgaaaatcaattgaccacatatgtgtgggtctatttctggatactcatcttgaattcagatattgagtcttccaattctgtttttgttttcaaagctgttttggctttctaggtcttttaagtgtcagcatgaatctaaaattcattcgcttatgaatttctacaaaaaatcctgctgtgattttgattgggattttcatctgcaaataacaagtattattacttcttttcaaatctggaggccttttatcctttttgttttttttaccttattgcactggctaacatctccattaaatgttgaaaagaaatggtgagagtggacatccttaccttgtttctaatctttgcatgaaaccattcagtttttcaccattaagtatggtgtcaactgtaggttcttcatagatgccttttatcatattaagggaattagtcttctatttctagattgttggggtgtgtgtgtgtgtgtgtgtgtgtgtgtgtgtgtgtgtgtctgttgaagatatatacaacataatgggaggaagtggagcaagatggttgaatagaagcctctaccaatcagcccctctgcacactaaatttaacaattatccacataaaaagcaccataaaaaccaaaaatcaggtcagcagtcacagtacctggttttaacttcatatcactgaaagaggcactgaagagggtaagaaaaacagtcttgaattgcagatgccactgcttccatatcccccagcagtaggttatatagcgcagagagagaatctgtgcattttggggagtaagagcgcagtgattttgggactttgcattggtactcagtacagccctatcacagtggaaaacaacactgggcagaactcagctggcacccaacaagggagcatctagaccagccttagccagaggggaatcacccattcca

SEQ ID NO: 4146 - DNA, 1076 bp, Homo sapiens
taaaagaaaaaaaaagacaattatttagcccaaggggaagtgaagtgaagtaactgctgtttcattctaatgcctgtttgggcctgataatttaaaagggcttacattcctaagataaagtctcttttcttctttttttacattgtttttagtgatcaggaaagagtagtatgtttgatatagcgacaataatccaaactgatcatgagataactaaccatgttgtgagttgtttgctagcctaaggcattattcaatagccaaaagcaagctgtggtattgacaagatcctttcactgttgcacttctggtactgtaaagaatggactagatccgggcaagtaaaaagttagctggctgttttgttagtccaagggagagaggatgcaaacctaacctagagcattggcacataggatggaaaagatgggttagaccaaagatatttctgaaagagaatttcaagattagtaactgaatatgaaaggagtgagagggggaggaattaagaataactctgagatctccggcttgggaaaatgggtggatgatgacaccattaactaagaacaggaatataagatcatttgtatttgtacaaatacaaatttggaattcaaggttaagattggcatttgagaaacagatttgggaattaataaatgaagctatgagaatagataaggccatcaaggaagcacactggagaaaaaggaagaggtccaaggaaagcagtgcaacatctaaaggcagcgagaaagcccaaaataagaattatcggagtgacgggaaaatggcatttgagaagatcacagaagagagagcatcaaggcatggtagtctacagtgttaaatggggcagaaaagtcaagtagactgcagaaaaaaaagccagccgttttgcaatgaattcaacaggttaaaataactaccacttgtagaggaggaaaaaaacttttccctatcctcttaggttcagtacctggggccgtacaaattaaactagcaaaagacagattaacaaaagtgaaaagtttattacatgagcctattggagcttcatagaaaagttgtga

SEQ ID NO: 4147 - DNA, 1058 bp, Homo sapiens
atagccattccccaccactcgcattactcgcattactgcctgagctctgcatcctatcagatcagcagaggcgttagattctcataggagggcaaaccctgttgtgaaatgtgcatttaagggatctaggttgcatgatccttacgagaatctaatgcctgatgatctgtcactgtctaccatcactcccagatgggactttctagttgcaacaggttcagggtttccactgattctacattatggtgggttgtataattatttcattatatattacaatgcaataataatatacataaagtgcacaataaatgtaatgtgtttgaatcatcccaaaaccatcccccataaccctagtccatggaaaaaattgtcttccatgaagctgttccctcatgccaaaaaggttggggaccactgacccaagtgataaaaacaaggaatctttttattacccaagtgataaaaagagatccggggggctctccaagcagaatgagcaagaggtgggatggcctgaagcatgaacaaacttggtgtgttcatgggacagagtatcagagtggttagagctcaatgaacaaggagaagagtggagagagatgaggtcagagacacagatggggcaagatttggagagcctcatagactctgatgagaagtttgttgattattctgatgcaatgggaagtctttagataattttaagcaaggaaattatattctctggtttacgctttagaaatatgactctggctgctatgtggatagaggaaggacaatgaggaatcaagagtgcagccacagagaccagtgagaagtgatgatggcattgacctagattggaagagtagagatggaaagaagtggttaggttcagaatatattttggaagttggagctaatggaacctattgatgaattggaagtagatactgatggattgaatgtgctgtgtgaggaaaagagaagagacaaatagggctcctaggtatttgtcctgagcaactgagtgtataattgtgtaatttactaggaccggaaaggctcaggggaag

SEQ ID NO: 4148 - DNA, 1026 bp, Homo sapiens
tcttagcttaattgctattttcatcaccttcataaattcacatctagttcacagcaacattctagaggaatggtatatgtcagccaataaaaaccacctcattagaaagtgttaaaaaagtcattttaagaaacaccattcaaaatttgagtacgaaaattaattttgcagcacagatatacgttgagtagaacttactgttcaaatatagaaaatgaccaatacatataagaaaaatatacttatttaattcctaaaaaacacatagattttgctgataggaaaaagagaagcagggatataaaggcataaattgcatgctttcaaaacacacaggctgtattgatgagaaacagagatgtgtggacatggatgcgtgaaaggactcactaaggctataatgaagggccatgaggaaagaaagcattgacatttgttctttcctggaccttgaccttgtgttatcaggaccagatatagcagatcttataaagagggtggaaaacaaaaccagtagattcacataattcaattccaggccaagaatgtaaaagacatgagattggtgtttttgaaagccaatgctacctaaaggggtaaaaattcaaattgtttcttccataaaattactttttaagaaatgataattagaattgaaacaacaaaactctcaactactggttttttacaaatacaacttttgaaggaagagtcaagaataattcattacccttcttaaaaccctgtcccactgtttctcattatcagccactttatgtcccaaatcacagagaaaagggggtcttccttctttttcccaccctttttttttttttagacgatgtctcgctctaacgcccaggttggagtgcagtggtgcgatctcagctcactgcaacctccgcctcccgggttcaagcaattctcctgcctcagcctcctgagtagctgggattacaggtgtatgccaccacgcctggctaatttttgtatttttagtagagatggagtttgaccatgttggcc

SEQ ID NO: 4149 - DNA, 1034 bp, Homo sapiens
gagacccccacacactctgaccctatgtctgaaactctgttcaaaagtccaaatctcaaatatctatggaatgcctagcaagtgccaggcactgggctaagtttacctaacccagcttgcttgcttctcttaagattcactgtgccattccacaccacgctcaagcaatcaaccccaaactctcccactcactctgaggaacaagggttcacactgggagatgaagtgggcagtggagtcagggaggccagtttagggagctccacatcccagctctgtgaacttggctggttactctgcctttttgtgctttcattttctcgtctataaaaagggcttaataacccccacctctctaggttgctgaaaggattaactcagatgatgcacacaaagttcttagccctgggctggtaagcatagcttttatgattcatatttagtttgtgtttcccccatcagaacctttggtgctctctccctctttgcagacacctaggccaattcttgtgtgtctccttatgcttgactgtgttactatctggaaattattcttaccatttggaaacctcagtactgtcgacagcaccattaaaagcagttccaaatggttaccacacaagaggaggcaaaagcagtgccccacagcagctgtgtgtgcactggggaggggggttcctgtgaggaaggaaccagagaggaaagggccaaactgacagcctcttgcagccctccagcttgctgtgccagctgctcttgcactggatgccgagctgtgcggcgagcacttcattcctaatgatgcagtgtcagttataaatcacttatttaaaaatcaaactggccaaccctagattgtctttatcatagcaccactttcactcacttgcattccaaaggaattttagaaacattatttaacttttcatcatggcatttttcaaccatatgcaaaagtagagagaatagtgtaaccaagtccagctttaagagttgtccacattttagcagcaaaaggtctcttgagtgaaaga

SEQ ID NO: 4150 - DNA, 1022 bp, Homo sapiens
cgacagtacagtgggaaagacaaacgtttcatgggatgtgcctgagagagcccagagggaagctcaggatgcttctagctttcaaacccagcttacctctgccttgagcagggctctagctcctgtgtatgcagaagggccagcctcttcatcatacaatacagattggtggactgagagagatccaaggaaggtcccagattctctcttgtactcatttgttgctaatgtaaagtgctactatcggagaagcactttacattagcaacatggtcttctcaatatgactacctctaaagtaggctcattttatgggtatttacccctgttgaaacgtatcctcaggaggaagaaagggactgatcaggacagcttgccaacttcatactttacctgggcctaaccctgcaatcaagcaccattgggaataaatgattttgccattaaattctaatgtgactaagactctcatcatgctctgagctttggctttccaatctgtaaagtgaggataataatgcttacctaacagggccattgctagggtgaggggagattgcagatatgaatgccctgggtaactgtaatgtacagtgtgggtggtgggggctattcttgcatacagcctgctgcctcccaggcctcaggctaatcaggcctggctaggttagatccatgggtcttccctgcactttctgtcccctcccactacacatccccatgcccttccctagcatccttttatgtgacatcgtgatatcatactgttggcaccatttagccttaacctttctttttaagaaacagacaacagtaatgtggactgagaaatgacaggcacacagaccaatctatgatctttatacaaagagacacattaaataaatacctatttacattatagacaaataatgtagtcagtgtacttagttgtagctgggtaagaatgagcttgtctgtacttcctggctgattgagtgctcttagcaaagtccctacaacatttttcaaacagagttaac

SEQ ID NO: 4151 - DNA, 1090 bp, Homo sapiens
atggggagccttgcttgacagttttgtctttctgtatgtggatggtgcacagagcagagctggggacagtgacccttcaggggtctgttagcatgagttgatgtgcatggaggctttcatttcttagcaaaggaggtggaaagatctcttgcttgttaactgtgcatcatgaaagtgagagaaggacaatggaggagtgagatgtgtctgtcttcagcctggtccctggtgctgctgtcttcagcccctatggagagagagcttgaaggaaaaagtttaaagagctattttcatgaggtactttgtgatacttagagcacatattctgcttctgtgggaccctggtgacaaggtgtggcacagagtcagggagaaaaccatgatcccaactcttgcaggaagtcagcactgtgggcctgcatgctggtgctcttatcataaaccctgagagcccagacagcagtatggtaccctcaagtggcttcttgggtgaggatatcaatgagagaaaaccggaaggggacaggaatagcagggaggatgctattgatgtaatcaatggactggctcatgggcatgtaggcaagtggggtaagaacacgatctttgtgttattgaatttctttggaattaaacaggatccacaggaaggtggcctggggatgttcagattacccatgaaagtgaaacattagaagaccacattcatgctggcttggctggcttgagctcgggggtttgccgtggctgccccagctgggatggctgagggcacacagtaactgcagggctaggtgctctcaaggtaattcatctgtctccaagcctttctgggtcaccacttacgcctgctctcatggtgaaaacaaagaaaagacttcaaccaaagaccagcctgtggtttcagcaggtccagggtggtccttgcctgagctggagtgtcctttggtgataggatggcacctactaaggtgttaggtattaatctcagtggggaaggggtgggtgaatttcagaagcagggttggagcttcagcctcaggaggccagacctcctctctgagcagttctacactggttgtgttcactg

SEQ ID NO: 4152 - DNA, 1062 bp, Homo sapiens
cccctataacgattagctggtccaacatgtcaatagtgctgagattgaaaaatcctagcttagggtatatatggaggagtagaattctcactcaatgataggatattcacagtttcaactttattatataatactaaattgtttacccaagtggttgagcaagtctatactcctaccaaagggaggctccacatcctctgatattgtcaatcttcttagattttgccagttcatgtttttttccttctgaaatgcacatttgtgtgctttgtccatttttatagagtaaatgtttataggattgatttgtaggcattatttatatattctggatactaattctttgttggttgtatgtgttgaaaatatctcctcccagtctgtggcttatcctctcacttcttcctggttcttttgatgaacagatgttcttaagcttcatgtagttaaatccatcaatcgtatactatccatcaggcttgtgatttagggtcattatttaagaaagaatgtcctgccctgaggttatcattgcttcccaagcctggcagcattttggggttttatcttttccagctggcaagacctggagttcctcttgctgaccccagaggtgcctggccttccttatcctccactgtttgctcagtccttatgaacactcagattgtatttcctaatgtactccattttctctgttgggctctttctacaacctctgtagccctctctacccaggactggactctactgtctcgggactggcctcaaaatgaactgacttctctggaaccacagtgccccacttagtatcagcactgctgaagatgtcccttagagattagccatggcaggattgagccccagttttctaaagtacttggatggtttcatttgcactcatgtggggtattctcctctagggctaaaatcaaaaatggggcaaagctgaagatgccaagtggtccccaggaacattactgctcacaggagggacaccccaagatgagcatatctgctctgaccacataccttctagccaggcctatctacccagggccc

SEQ ID NO: 4153 - DNA, 1029 bp, Homo sapiens
agagcgtcaacaaaggaacaatggatttaaactacaccctagaacaaatggacttaacagatatttacagaacattctacccaacaactgaagaatatatattcttctcatcagcacgtggaacattctccaagatagaccatatgataggccacaaaacaattctcaataaatttaagaaaattgaaatcatatcaagtatcttctcagaccacagtggaataaaactggaaataaactccaaaaggaactctcaaaacaatgcagatacatgaaaattaaataatctgcgcttgaatgatctttgagttaacaatgaaatcaagacggaaattaaaaaattttttgagctgaatgatgttagtgacacaacttatcaaaacctttgggaaacagcaaaagtggtgctaagaggaaagttcgtagcattaaatccctacatcaaaaagtttgaaagggcacaaatagacaatctaatgtcacaccttaaggaactagagaaacaagaacaaaccaaacccaaacccagcagaataaaagaaattaacaaagatcagagcagaactaaatgattattcctcttaagttttcacccaccatctgtctcagatgccccttttcctccattccttcaagcttaatgccaagcccactatatccagtcattggggacacagggcctctgtcagctgagaattgaaaccctgctccctcccctgacaagacacggactgcttaaatgttaaactatgagcatttctttaagaaataaactgcaggagaaatgtcttaaaggattacatggaagatgtgtgaagtatagatctctaaacttagaaacaatcagtgattcttaggtgcaaaagaatcatctggaaagtgactgaaaaatgcagcttcccaggccccattctaaggcagttagctgcaggggacagtgtgaaaaatcacagttggaggaacattggcccagatgatccactaaaatgcttagtcttcacacttaaaaagagtttggagcaatgctac

SEQ ID NO: 4154 - DNA, 1043 bp, Homo sapiens
ttctgtaacttttaaattatatccatattaaaagtgaatgagagagagagagaaactgtcctagtttttcagagctttggacttgtggtagccacacccgatttgagtcagtgaaagctttctcattgagggggtgggggcagtgaggtgaggcctctttttagtaaagtgtggcttcagcccactgtggagccctgacctttgccctggactgaccagagtgactgcacacaaagcttacctgataatagatttacctgacctatgagacggcctttgcttaaacattttgagggagtgaatataattcacacctataggtggaggaagaacagtggaccaagctgaaggcagaatggagctctgggggctggggacacagggagcattccagggcctgtgaaatacagagaaggagaaaggagggtcatctgggggagggatgcagggtggaaccaccacctacagctttgctggggcaatccttccaaaaggtaagactgctggaatctgaatgagcaggggaaatgttaacagtaaaaagactgctatgaggggtagccatgaaaaaggacatagagtagaaaaagccgatggagatgatatagacaatgatgtgtgttagaaccacttggaggactattggaattctgattcttttaggcctgggataggggggtagagaatttacatttctaacaaactacctggtgctgctggtctggaccacactgtgagttgcagtggtgttgcagatgattgtgtccagcccaccctggaggggtaatgcctgtgaggaacatgtgagagtcacaatcaaagaggtccagggttgaccctgtggtgcctctagctgggcagtagggattagggacagacagcctcatggatgaaatgccacttaaactgggtttcagaggagctggggtagaggagggccttctaaggaagcaaagacctagaaaacagtccagtccagttcatcatttgggtttcccagggaaatggtgggcagaaaggcagttgaagggcctgagtgccag

SEQ ID NO: 4155 - DNA, 1030 bp, Homo sapiens
cactttccttctacacgatttgtctcctcctcaaatctaacctttctcttctgttcatcttcttacatagtctcactgctacttggccctactaaaatttatttttgcttcttaccacatttgccacaaatgttgatataaaccatttccattcttctgagatgtatcacctacttacagaggttattatctacccaaaatcttctcttcttcactccacttgaacatacttgcattcacattctcctctctgtttcagatatcaactctttcctcctggctcaaaggaaggtgcattcttttctgactacacccacatctctgtttattatccagttcagttagcattaggctcggctgcaaatagaaaaatccttaattaacagtggcttttaacaaggtgtttccatcaggtgaaaaatctagaaggcggctcttgagggctcatagggcagctccacaagttgatttttccatctcactgctatgccatctctaaagcatgccttcatccttatggcacaaacttgccgcctgaaaaccagcgaacccaactttccaggaagtaaaatgcactttaaaagatcaggagggctgggcgaggtcgtttaggcctataatcccagcactgtaatcccagcactttgagaggccgaggcgggtgaatcacctgaaggcaggagttcaagaccagcctgcccaacatggtgaaaccccgtctctactaaaaatacaaaaaaaaaattagccaggaatggtggcgggcgcctgtaatctcagctactcaggaggctgaagcaggagaatcgcttgaacccgggaggcggaggttgcagtgacccaagattgcgccattgcactccaccctgggcgacagagcaagactccgtctccaaaaaaaaaagtcagggacggcctcctctcttttagatgccgtccctaaagacatgcacacaatttatacctaattggctaaaacgtagtcacatagccacatttggctgcaagagagactataaaataagctatt

SEQ ID NO: 4156 - DNA, 1030 bp, Homo sapiens
acaaagaagcaagactatagattcattttctgaaggggatcatgtatggaattttttgatgagtttttacttttacctctctactcttgattttctattattgaatactcttttaaaacactgatttttaaggctttatatatgttttccaggctgatgttcacatctttttttcatgaactatcagaatatagtgaacacttttcaaatatttaaggacttaatgtttaaaaagccataaaatagagagtggtaatactaccaaataattacttaaaactgaaagctaagttatcaatagtttatataagagatgttttctgaggagatgtgcatccagtgagaccaaggtagaaagtttatataattgttttttttccagtaaatatgaaaaaaaaagctgtagcttgtttattacatgtccaaaatacagtggagccttactttaacacaatgtactgtaacttggaatttgttctgttatgagtctatcttgaattcccatccatgaaactgtagtcaccaaaagcaacaagtattttcacatgatgtaaaagaccatactatgatggccattgctagaaattgaatcacaaataatagctaataatttttcatttttcaaaaaagatcatttggatagcagctatgtataaaatggaaaataaaaaattattctattttgcatgaatagttcagactttcccataccacagccaagcagtaactaaaattaggatcttaattttcaatgataaaaggtctaaggttcatttaattatgctcctttaacactgtctttctagatttttcacccagtattttcaaaatttgggaatgtaaacaattgatatatttattgtatgttggctagcagttcatccttctgcaaaatatgcattcagagaaatgtgaagcttgttttaatgaagacttaaaccatttgtgtcatttgtgttttcatattcaaatacaccaaattaaaattctgaacctatatttttcatcattaacttcctaatataccaga

SEQ ID NO: 4157 - DNA, 1021 bp, Homo sapiens
catatgatggccatacatgttttgaaggtcgacaaaaatttaacctatgtttttcacagaggtcatgctagaaaagtttaaccatgacatgaattaactatacttttgctattcacttcccatgttttcactgtaataaggacaaataattaaaaagtatttacatctcctataagaagctgaaccatgagtgtggtttgtttttaatatttagtttaattcttctatgattgttaaattaatagatttttctaaacatagaatgaaatcaactgattattattctttggagtgttgagttttgttttttgtcattgttgttgtttcagaaatgtaaataaacatttaaatagttcccaaccttcaggatttggacctgccaactctttagaggatgttgtacgccttcctgacagttctaataaaattgaagaggacagatgctctaacagtgcagatataacaggtagttttccaccctaaagagagtgctaatttataaaaggtcaggttgttcgaatgtgattgttaaattaattggtgctctggaatttaaaaatcaggccttagtttgtaagtttatgagatcttattcacagttgttaccatggtgcctgtcttaacgttgataactggttattgttaaagaaatttgaattgtctcacttgatagaatgtcagtattttaccttatgaaatctacctgtagccaagttttgactttattctttttattaaaggtccttcctttataagatcatggacatttgggatgtttagtgattctgagagcactggagggagcagcgaatctagatctctggattcagaatctataagtccaggtacatctatatttaagtctggcaatgaaaactcattgaaagatcagtccttttttaggtattttttaactaccttgtttttatagtgaactttcacacataatagagaggaaagtgtacaatttaaaaaatagtttttaaaaacccctcatatattcgccacccaggctaagaat

SEQ ID NO: 4158 - DNA, 1042 bp, Homo sapiens
ggaattggggcccacaccagaccctgaatctgatagtgccttggtcttgatctctcaatctctacaactgtgagaaataaatctttgttaagtcactctgtggtatttttgttgtagcagcctgatgtgactaagaacatacagatgtagtagtacatatatggattctgtcatatatgaaaatggatattgtgtcattaagatacaaaataagcattctggtaaaaaaaaaattatctctttcatggaacagaaatagaagttctgagattactagttacctgaaagtgtagtaatgaactgtgaaaaactgttgaagaagccgagcatttaatgtggcttccagagttttatgaaaatgctagatgcattaaaacatgtactaggacaattcagcctaaaatagattattctataaatagccaagtttaaaaaaaatggttgcacacttatctatatttatacatacacttaatttttttacagtctacttagaactagttttttaccacttcaagtggaacacagaagcatcaccaccgtagaagttcctttacctaatctgggttgtatttgatatatgtaaattacatccatatacgttgaaaacctcaccagactctcataatttttgcttttaaaagtcatacatattataaagaggttaagaggaaaaaagtagtctattatttactatttctattcattcttcttgcattctagtggttccatctttcctctggtaacactttgtctacagaacttcctttaccactattttatagcaggtctgctggtaatggattcacttggttgtgtttcatatgagaatgtctttatttcgtctttatttctgaaggacaccttcactggatatagaattctaaatacagaaatcagttctttcactgctttaaaaatattgttccactgccttatggcatccgtagtttctcatgagataccagtaatcatatgaattatcattccccaattgtggcatgtgtttttctttggctgtttttgtgggattttttttgtc

SEQ ID NO: 4159 - DNA, 1047 bp, Homo sapiens
caagttcaggaaaggtgagcattttttaatttgtttttatgacctgttttaaattgtgaatacttgggttttacaacccatttcttccccaattcaaaaatagcagaacagagttgttgagaaggtgatggagtagaagggggagcgcgcactgtggggaggggtggacaacaggcctggtcctacctgtgactctgcactaccctgtgactctgggcagggccccctcggagacccaggttcctcagccaaccggctggatcaggtcatctctaaaggtcccgccatgctcacatttctccctctattgaggatcccaggcacaaaatttgtttttggttcaatgcataatactcccttcctttttcttttactgcagatatcttctaaaggggctcaatagggttcaatatgcctaaattggatcttctcagtcttggaaaaggcatttttagcagtgatcaagggaaactgattagcgaagtcacttctaatccttcacgtgtcagctgtgttcttgtaggctttgcttagaacctaggtttttacttccacagtgacttaataaaggggaaagaattgactcagagcccagatgaattaagaactctatctttttacagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagaggtgagtggctctgccagccatttgcctgggggtatgggtgctgtgggtgacttctggaggagtagctccaccctcagggctgggatatacttccttggttaaatattcaggaaaacaaactgcctggaggttttttgttgttatttgtttgttttggttttgattttgctttggtacaaaaaagattttggacatttagaaatgtttctgtgttgattgtgcccttgtattagcaggtgttttcttgagcacctgtcatgtgct

SEQ ID NO: 4160 - DNA, 1030 bp, Homo sapiens
tgtctcttaatgtcaagtctgcagaggtgaaatagactccagtctcccatagcgctcccaggcttattaggaagaggaaattcccgcctaataaattttggtcagaacagttgatctcaaaaccctgtctcctgataagatgttatcaatgacaatggtgcccgaaacttcattagcaattttaatttcacctcagtcttatggtcctgtgatctccccctgcctccacttgccttgtgatattctattaccctgttaagtacttgatgtctgtcacccacacctatttgcacactccctccccttttgaaaatccctaataaaaacttccctaataaaaactggctggttttgtggcatcacggatcctaccaacgtgtgatgtcccccgtggatgcccagctttaaaatttctctcttttgtactttgtccctttatttctcaagccagcagatgcttaggaaaacagaaaagaacctatgtgattttcggggcgggttccctgaaagaccgccaccatggacagctcagccagggccatcttctgctctgacattccctcatgccctgccttgctgttgtatcatggaaaagggtgggatgaaggtttaggaggtgacctgcattcatgtcccaaccctgccacttttagctatatgaacttggttgactcacgctctctgagtctcactcaaaaaagaccctatatgtgtagatttatagatggggatggtccagatggtgtgagtggtcagctccggctctaaatcctggcattttctgggatgtggatgagtatggcgagaggcaggcagcccagctgctggcagcacgtggctagtggatgccggtgcctcgagctctctcagagaccacatccaggttccctgtataccagccccaggatgtacacacaccatagtaccacccctaaatgtagatggcaaatatttatttgaagtgttaccagaaagggatcctaatttagaccccaagagaggactcttggaccttgggcaagaaagaatt

SEQ ID NO: 4161 - DNA, 1027 bp, Homo sapiens
aggggttttcagtgggtgagtgtgggccattgctgattcttttgcctctgagctgagaaatcagctcctaggggtcttgcaggatgtggatttagttgtggtttacctgccttgcttgccagcagtaacaacactgggaagtgaaatgagaactgtgtccttgacaccaccagggacacagcagggagtgagaatcggagggaggataatgccttcagtttcgtttagttgtctttcagctagcaagatacatgaaactgaagaaacagtaatataccatatatttcaaaaagaaaaaccaaaccaaggctagatgtgtggacccaagttatgcatggagatgtataagcaatgctgtgtgagtgaagggatccagtataattaaatctctatgtacccaaactactgggagttttaaaaatcacagtactatttacttttatgataaagtgataaaagtgctgggcattttttatgataaggtgctgggcaattcatcactggaatatactgaaacattatactgtatgcaacacatgttcagcacatttgttaaaggcagatatgtttaaagaagttgaaacaaggggaatgcaattctccctgatacatccttggctgtggagacacttatttcatctagaataatattttcgtctactttctgtaaagcaagaggtgaaaatactttctttttgtttttaaagttaagactatcttgaaaatggcaacttggaagaaaccttaaaggtaaaatttagttaatcggtgtaataagttcctatggtttctctggtctattccatgccatacacaacttaatagccattctagcagtgttataacaacactgttttaacaacttcagaagtaactccactgatgggtgtagccaagagagttttatctgaactccagatcctggcagtataagacttttcaagcaaaatgcagtcggtgccttagcttcatggagtgcaagcctcatctcctacactgcatgtggatttccatccctctaggtctc

SEQ ID NO: 4162 - DNA, 1076 bp, Homo sapiens
gacagggtctcattctgccgctagggtgcagtggtgtgatcacggccctctacagccttgacctccctgggctccaatagtcctcctgcctcagcctcctgagtagctgggactacaggtgcatgccaccacgcccagctaatttttgtatttttttggagagatggggttttgctgtgttgcccacgctggtcttgaactcctgggctcaagcgatctgcctgccttggcttcccaaggtgctgggattacaggcatgggccacccactgcacccagcctgaagttcacgtatgatttctgctttataacaggggaagtggaggaggtgtggtaaggagcccacgctcacatggccagtaagtgaaggaggcctggcaaaggccacactcttggtctgtcaccctgctgcttctcctcacttccttgtgtaacagctctgtcatcaatgggctgtgtgactgcacacgctgctgcacccctgtggctttcagtttccctatctgtaaggggttgcactagatgctccccaaggccgaggtatgtgggcctgagtgctctgcattccctgatcaacttcacttcatcaagggtctcccatggatgtagcccagttgtgggcacttgggagatccaggagaagtaacatcatggcctctggctcctcaaggaatttagaatccacttgaggacatgactggtggcacaagatagtgaattattaatttcccaatgtgtgattcagactagagtgtaagggttctggaaaggcaattgaatgagtcttgcctagtggaaaaattgatcatcctaaagggagagcaaatcctccttaacatttgctaaaaattgctcctctgttaggcaagagtcagatgcacttgggcacatcatcaccatctgactcccagtccaccccaacacccagcccgggagccctgggaagctggcggatgtgccacatttcaatgagaccatgaacccttagagggcatgatggttttttcctccacattatacacttccttatgttgaaacgttttttccacagggctgcagggaaagaagaagatgtat

SEQ ID NO: 4163 - DNA, 1031 bp, Homo sapiens
gtagagacgagatttcaccatattggccaggctggtcttgaactcctgaactcaagtgatcagcccgccttggcctcccaaagtcctgggattacaggtgtgagccactgcacctacccattctgattactctttctaaactgcacagctcattcatgtacctgccttacttaaaacccttagcaattacctatttatttccctagggtaaaaatccaaatttccttaccatgtcctgaaatatactcacctgtgatctggccccgagttcctctctggatttatctcctgtccacctcccctcccacacttcacactctacttcaagccatactcagctgctcaaagcaccacacttgggccacgctttctcttttataacttgaatgccctcctgcttgcctggcattcctttggtccccttctttgcctgctcagctctgactcccatcaggaatgagaccatattcctcaggaaacctccctggttctcctgagccagaatggactccctctgtgctctcttaagttgtggtgccctcctgccatggcagctaggccggggcattgcctgtttcccttggtgttctgtgagctcctcaagtgtgggcagcacatcttagcttgttctgtctccccagggtctggcatggtacctagcccttgattagtgcttgctgaataaatgaatgattgagtctctgtcatctcacagagtacttgcaagaattaaatgacatgtgaaaatactttgtaaactgtaaatgtgttagggacatttctgagagtcaaggggtttagagaggaaatgagcatgctaggcctctggacagtgaaccgaaaggatgttgagctgtggtgttctaggagagtaccaggactgctctggacatgacatactacctgggactacttgtgaaaggaaatgagcatcctgagaaatcactttgggtcctgtgtactcagggaggattgtttttatatggttctggtttgttcaggaagcacagtctgtcctccagtcaggcact

SEQ ID NO: 4164 - DNA, 1038 bp, Homo sapiens
ttgcgtatgttgaaccagccttgcaacccagggatgaagccgacttgatcgtggtggataagatttttgatgtgctgctggatttggtttgccagtattttattgaggattttcacattgatgttcatcaggggtattggtctaaaattctctttttttgttgtgtctctgccaggctttggtgtcaggatggtactggcctcaagaaatgagttagggaggattccctctttttctgttgattggaatagtttcaaaaggaatggtaccatctcctctttgtacctctggtagaatttggctatgaatccatctgttcctggactttttttgattcgtacgctattaattattgcctcaatttcagagcctgtttttggtttattcaaggattcaacttcctcctgatttaatcttgggagggtgtatgtgtccaggaatttatccatttctttagattttttagtttatttgcatagaggtgtttatagtattctctgatggcagtttgtatttctgtgggatcgttggtgatatcacctttatcattttttattgtgtctatttgattcttctctcttttcttattagtcttgctagcagtctatcaattttgttgatcttttcaaaaaatcagctcctggattcattgattttttgaagcttttttttgtgtctctatctccttcaattctgctctgatcttagttatttcttgccttctgctagcttttgaatgtgtttgctcttgcttctctagttcttttaattgtgatgttagggtgtcaattttatatctttcctgctttctcttgtgggcattcagtgctataaatttccctctacaccctgctttaaatgtgtcccagagattctggtatattgtgtctttgttctcattggtttcacagaacatctttatttctgccttcattttgttatttacccaatagtcattcaggaacaggttgttcagtttccatgtagttgtgcggttttgagtgagtttcttaattcttagttctaatttgattgcat

SEQ ID NO: 4165 - DNA, 1035 bp, Homo sapiens
gcggattattgatcccagtaacctgtctttaaggtttaaaaaccatgtattttgcaatttgttctcaatggcttgctggctttcttcttgggtttcttttcattcctggtaagtaattgtgctagaaatgggccacagtcactaggaaattgtctcttagggtcatccatgcatcataggactggatgggagggaacctggtaggtaggtaggtctgctaaagtgtttgcctgtcgttcagtaattttagatgttactgcttagaaaaagagatagaaaagaataatattgactgctaagatctacacatggggagtagggcttttattctaaaaattttgaattattgaaatccagcacaaatgtgatgcataatttttatcccaaaataaaattgtgttttcatttgtgcatgtcacctgctagttcttgtgatgtggacatttttttaacctatttagagtattatcatgaatattttaaattttcacctaaatttacgtattagagattaaaaaaaaaaaagaaaatgggctgggtgtggtggctcacgcctgtaatcccaacactttgggaggccaaggcaggcagattacctgaggtcaggagttcgagaccagcctggccaaaatggtgaaaccccttctctactaaaaatacaaaaaaattagccgggtgtagtggtgcgtacctgtaatcccagctactcgagaggctgagacaggagaatctcttgaacccaggaggcagaggttgcagtgagctgagatcacgccactgcactctagcctaggaggcagagtgaggctccgtctcaaaaaaaaaaaaaaatagaaaataacaattagacctactgttggtgctgatggatgaagcagcagaatgatgacagtaagcagtggctttcctgcctggctttgcctttggggccttcaacatttagtatttcagcttggcctctaaaaaaatgggagcttacgaatagctaccttacaaatatattaggtggaaaaatcactggtgtgtgattttggg

SEQ ID NO: 4166 - DNA, 1146 bp, Homo sapiens
aaatgggcttctaattcaagcattcagtttccagagcccttgctcctaaccattttaatctgaggccagagctcagggagaattgacatctttcaagacgagagggtactgagtccagagagggcagaccagagcaagaaatcccaggataaagtcctttaacaagaagctggaggaggagagattagagggccctcctggaaaatactaggtgctacagagaggcccagaggatgactggagacaggccactggatttggctactgagaagtcactgatgacctgttttgtttgagacaggatcgtcctctgttccccactccctgcaatccccctcccctgtttccccccaggctggagtgcagtggcatgatcttggctcactgcagccttgacctcctgggctcaagcaatcctcctgcctcagcctcccgagtagctgggactacaggtgtgcaccaccatgcctggctaattttttgtatttttcgtagagacagggttttaccgtgttgcccaggctgcactggtgaccttttgagagatcgtcggtagagcaaatttccaggggttaggagagagtactaagggaggaaatgggcaggcttggcatgaaataaatgacaaacaggacagtgtatgaggctggcagcaggttcaattaaaaatttgccatttcagggaagacagggtagcctgtgcccattgatggaccaagtaaaggcaacagcccaaaacagatggtgtgtgggggcaaagcagaagggcaggagggtcagtgggaagagaaggggcccagctcagaaggggaagggaagaggaccatgaaaacgcagcactgatgtggagaagtcctcttttcatctgaaataggggtgtcactttgctcctgaccttattatgctagagccactgatgtccgatggggaagagagcaggaataggaagagatggcccaggctaagccctccctgtgagcgcactgctgattgggctgcccctttggagcttgggcactggttcactctcctctttccattggcccttgatctggaagggatgggaagttgggtttattttgttagagcctggttgtctgtagcaagcctttactgtattatctccaagagacctttgtgttgggg

SEQ ID NO: 4167 - DNA, 1049 bp, Homo sapiens
ttccctctttaacagtgtatccttaaagtcataatgaatctgatctgcggcataaaaaaagtaagcacaattggatcgttttggtttttcacccatcattagcattgtattcaggagagtgaggaaatgcattttcttctctctcttttttatttttttgagatggagtctccctctgttgcccaggctggagtgaggtcgtacgatctcggctcactgcaacctccacctcccaggttcaagcaattctcctggcttagcctcccgagtagctggaattacaggcacctgccaccacatctgactaatttttgtattcttagtagagttggagtttcaccatgttggccaggctggtctcaaacgcctgacctcaagtgataacacctgccttggcctcccaaagagctgggattacaggtgtgagcaactgtgcccagccctgcattttctttctcagtgaaactaggtggtggttggagaaagcttgtccttagaatttgttggcaagttccatttaaatctaggcattaccctcctgtagcatataccatgtgcattggctctccttaactctgaacttattttatagcccaaatgggctcttaacttatttatgtgtacttgtaccctcagatttttgttaaggattcttggaactcataggtagatccaggttgtttgtggggacgaagtttatacaatttgggggtcctcattatgaaaaatatataaatatcttttaagttttacaaaaacctatggccatgtgaacccttttgaacttgaagacttctccatacctgtcatacaaggttcttgtcagggaaagtagagcttagtggttaagaacatggactgtgggaactgggttggattcctggttctgcatcttactgtgaactttggcaagtgacttaacctgcctgtcttgtatgtaaaatgaggatatcataacactcatctttatagggttgttgggagaaatcagatagataatccatgtaaagtgtttagaataatgcctggaatcaaaagcccacattata

SEQ ID NO: 4168 - DNA, 1033 bp, Homo sapiens
ggcagtggtagctcatacctgtaatctcaacactttgggaggccaaggctggaggatcacttgaatccagaagtttgagaccagcctgggcaacacagcaagaccctatctctaaaaaaaaaaattttttaatctaaaaagataaaaaattaattttaaaaaaccaaatatttttaatgtatctaccatttcccaggaatattcttggtgctggcagatacaacaatcaatggactttacaatccatccctttcttatatagaggaatcgaactttgtctcatgtcttaaatttgcatgcagccaaaggcaggctgtgggggaaatgcaggggatttaaattactaataaattttttttagtgttatatagagagagatgagtacttttttgctctcaaagggcctctcagctctatttttaaaaataattgtatgattttataaagtttaattcatagcaatgtctccttccaagacactgataatcattataataagcatttattggatactcacagtgcctcttagcattgtattaattgccttacatttaatcctcacaatccagtaaactataggtactatttcccttttctctataaaactgacatttagagatgctctgtgacttgcctcaagtcaaacagctgccaggtggcagatccaacattgagacctagtcctgcctgactttggatgctgtgctttttagcccctgtgctcactgcaccgccccgtccctcctgtcggcccttacccaaaagtgtcgtatctctgggctgggaatattaacaaagcattagaatagattttcctgtaccatttttgccatatcttctgaagatttttgccctctgctgaagtacaattggaatcagtttttgaacaaatcatgtttccaccaaccaacatctatggtgcacttggcactataacaatgctgttgattcattatgaaccttaagaaattatctgtggccggggaccgtggctcacgcctgtaatctcagcactttgggagtcggaggcaga

SEQ ID NO: 4169 - DNA, 1052 bp, Homo sapiens
actgagaaagcttgagtatctgcttagggttgcacagctggctagtggcagagccagggcttagcctgtcattcttgtgattccatgactcttccctttcatgctccacacaacaaaatccacagaatctgcaggtacccgtgtctctcatgagacacagagacagtcctgaaaagctcttccatcagataagttgcttttctactccgtactacattatcggtgccaactcagaaggtggcagacacaagtggtggcaaagcctcatccagaaaaaattaccatgggaagttgaatcaacagaaaaatatttgatacaagagtatgacagttaatcctaggatttcactttttgttctgaacttctgacctacagctgctagtccaaccacggaacatctaaaagatactttaattagattttaaccctgtcgagcgagcatttggccaatcaaataagtaggtctttgtttatttcctttaaactctaaagccaggaaattacttttgatatgttaagacccctgccttccctccaaggacatcctgagacatagaaataaaatctagccaaacatattttcaattactattcataaggaaacacccatcacattataggtaatttgaaaaagcaaatttatggaaaaaactgttaaaatattacaatattttttagaaggcataatttgatgtacttaaaaccaagtagtcactttttgatatgttttggatactaaccgcaagtatctaaagttaacagtaataatagtagtgagtgcacaatgctgagtcttttacatgtattaattcactaaatcctcacagcagccctagagagtagttagtattaggttggtgcaaaagtaattgtggtttttgccatacttttagtggcaacctttctgggccctgtttgttcctctggatacaatacagatgtaatcaggcttcctgggccccatgtctgccctggaggtcagttgcctgcattgtcacatgctaaaatcccctaagtatgattccaaaggctttgaataacagtgttggtt

SEQ ID NO: 4170 - DNA, 1031 bp, Homo sapiens
ctctgattggtcagactggagtcatacatcctctccttacagctgggtgtggagtcaggtctacacaagcacttaaattgagagcgaaggatacagtggttcgttcccgaggaaaaggtgatggatgtgggatggttaaaaaaaaaaaaaaaaagggccaggcgcagtgactgatgcctgcaatcccagcactttgggaggccaagacaggaggatcatgaggtcaagagatcgagaccatcctggccaacatggtgaaaccccgtctctactaaaaatacaaaaattagctgggtgtggtgatgcatacctgtaatcccagctactcgggaggctgaggcaggagaatcacgtgaaccagggagtcagaggttgcagtgagccgagattgtgctactgcactatagcctggtgacagagcaagactgtgtctcaaaaaaagaaaaaaagaaaaaaaaagctgtcagtcaaccacataagtgtatggttagaattacagatggtcaagtttggcaaaggaaacatttgagtcaatatagggtaagcaaagacccactccttctatactcccttgcttcttcctttctttcttcctttcagcaaaatttagtgaatggctgctttgttctaggtgcagagtatacactgttctagaagcggactctgcccataaggagcttacagagtagtgaggaagagagatggcccgggtggtggtgtgagacacattcactgataatttatattttgagaaatggaagtatgaagagtatttctgtgttttttaaaattaaaaagacagttccaatcattatatcatttaacatctttacttagactgtctcagtgagttctgctttgttcaatgcttggaataagtctctctggtatgcttctttgaataatgaagactccataatccacttttatttttttgcctaggctgctgcaaaaagaggtaaaacctttgtgtaattaaaagtagctttccttagattaggtttcctttgagattagtttgcttttttttt

SEQ ID NO: 4171 - DNA, 1044 bp, Homo sapiens
atcactaaggagagagaaagtaactccctgtagatctttcgttagtaacaggacatactgttttcttaaacagctaccatttattagtgtgccaggtagtatgcaagaccctgaactggctggtgccttgatcttggacttcccaggctccagaactgtaagaaataaatatcagttctttataagccacccagtttatcgtatctcattatagcacctgaaatagactaagatatcatccttggatttttgtgacttttatcacaaagcactctttctcctgcctcagcctcctgagtagctgggactacaagtgcatgccaccaagccttgctaatatttgtatttttaagagagatggggtttcaccatgttttccaggctggtcttgaactcctgacctcaagtaatctgcccgcctcggcctcccaaagtgctgggattacaggcatgagccactgcgcctggcctgtgaccagtaatctttgatgttattgttgtaattgtttggggacagtgtgaatcgtgcttacataagacagtgaacttaataaatgtatgtgttctgactgctccaacagcctgctgtcctctctctgtctcacacacacatacacacacacacacacacacacacacacacacacacacacattccttgggcttccctgtctatgagacacaacaatattgaaattaggccaattaataaccctgcagtggcctctcagtgttcaagtgaaaggtagtatttcttatgtttcacattttaaatcacaagctagaaatgattaagcttagtgaggaaggcatttgcaataggcagttagtcaagttgtgaatgcaaaggaaaagttcttgaaggaaattaaaagtgctactccaggctgggtgcggtggctcacacctgtaatcccagccctttgggaggccgaggcaggcggatcacaaggttaggagatcaaggccatcctggctaacacaatgaaaccctgtctctactaaaaatacaaaagatttgccggccgtggtggtgggcgcctg

SEQ ID NO: 4172 - DNA, 1028 bp, Homo sapiens
taagaatcagtggcagtttggtggttgcaggatttatcaaccagctcttctaaaattaacatgacattcttccactgaacaccacctactgttttccacaaggtggggtgctaacttcgcacagtggactgagactgtgtacagcttgctgagatgtctacattgagtgtatttgttgttactttccacagttcctaagcagttcttttttccctttctttttttttctttctttctttttttttttttttaaagagacggggtctcactgtctgcccaggctggggtgcagtggtgcaatcatagctcactgcatctttgaattcctgggctcaagcagtcctgcctcagcctcccaagtaactggaactacaggtaaggcccatcacacccagctaattttttaatttttgtttttgtaaagatggggtcttgctgtgttgcctacgctagtctccttctgccttggcctcccaatcagttctgaaagaaatgtttgtaactgtatagtttaaactgtggggttttatttaagtttgtcaactgtaatgtatattacaactggtggcttaacatagttatggttttgagtgtgtataatgtatatgtgcacttttcctcattcatatggaccttaacttactgaattataggtaaaggtaaaaaaaaatctctaatttgaaaggaggccggtctaaatgagcaaaatatttgaataagaaaatatttgtaatttactgcaaatagagattctgatgtggccatttcagtgaatagattcttatttttgaaatagtatatcaggtagatatatacatgcttttaaagtattttaaacagcttaatctcttaaattcctccccaaatctcaattattccttcctctatctctagacctaaagccagtcaggttaaactttctttaaatcatgttctgaacagatgaaattaaaatagctgtgaataacatagtgccgttatttcaaccttgtggtaatttaaccaatttcccagtgccagttaaattt

SEQ ID NO: 4173 - DNA, 1057 bp, Homo sapiens
gctagctttaactgttagaaaaataatgaagaaagagacctaaaatattaaacactgggaaaggagcttgaataaaaggaaatgatcaatatgggcccaatagtgaaatcttattgagacattaaatatggtaaaaataaatacagaagcatgttcctgatgtttaaaaacttaacaaagattttcagttttcccaaatttataatgcagtaggtgtcagaatcctaatgctttttttaaaaaaaaaatactttgtttattcagcaataaatatttgctttccatttgccaggcaatattatagatagttgggatacacaagtgaacaaaaaacacaaaaaaatgtctgccatcatggagctcactccacttgacctggatgagaagacagtaataccagacatagtgaagaagaaaatagtaaagtctgttagaaggtgatcagtgctgtgggggcagattgcacagggatggggaactgggaattttgatggggtggaaaagttgtgattgctcttaggaccttgaaggcgatggggactcctgagagaagagtgtttcaagcagagggaaaagtctctggaaaagccatagagaggaatattcctggatgttggtgcaatagcaggtaatcctggtccctggaggagagtgagtggaaggagagacactgaagaggagatgggaggagtgggcaaagaccagataatttaggaccttgtaagcccttttaaaaacttcctctcttaatctgaggaaaatagagacctgttggaaagttttgcttggaggagtgacacaatcatactgttttacacaggtcactcgtgtggctgtgttacaaatacaccaaaagcaaaaccaaggaaatcagttaggaggttgttgcagaaatcccagcaagagataatgtggcttgcatcaggagggccaggagtaagggaaaatagttggattctggatgtttttgaaagtggagttaacagaatttcatggcagaaaacagaggaatcaaacatgactacaaagctgttctgagcaattgtaagaatgggat

SEQ ID NO: 4174 - DNA, 1055 bp, Homo sapiens
gcaagctctgtaaatgataaagcttgaaagctgctgacagtcatgttttcacttagaagataaaggtagtctatagatagaagaatgaagataatgtacaggaagagaggagaagccagtgtctggtgctgccttcagtggctcaagaggccctgctatagctgtgttggtcctggattggtggttcttttcttgggaaatcaggacccactcctagaaccctaccccactccctttgttcccacctttgtgacatacgcacactctctctctctctctctctcaaggctgtttgtgttaacttttggtcatttgtaaaccttatccccaactaacatactactaaaatgtattctcaaaaaatccacgtcaaacaagattggtatataaatctgcttgctatcattcagctatagcaaaatgtgtggtactttttttcctctgtggaaaataagccaaagtgatttcgtttttgttttaggaatcaatactgtattagtttcttagggttgctgtaacaaaactgggtttttgccacccataaactgggtggcttaaaataacagaaatgtattttctcatagctctgaagggtagaagtctgaaatcaaggtgtcatggggccatactccctccggaggttctgaagaagaatccctccttgcttcctcctggcttctagtggtggccagcaatgcttggccttccttagcttgcagctacgtcactctaatctcggcttccaccatcatatgaccttttctgtatctctgtcttcacatgccttttttatgaggataccggttggatttagggcccactctaattcagaaggacctcatcttaacttgatcatatctgcagtgctcttatttctaaataaggtcacattcatagattccaggtggacatgaattttagggggacagtagttatatactgtgcatcacaacacttagaaccaagtaagttgggtttgcttcacattaatagtcttaactataaaaatattttggatttttatttttatttatttgttgttttttttttaaaca

SEQ ID NO: 4175 - DNA, 1213 bp, Homo sapiens
tatttaaaatatataaggagctctcacaattcaaaagcaaaaaaaaaaaaaaaacaacctgatttcaaaattttttactcaggatctttgaagaaaaaaaatgtgaaatcatagaaaaatgaatgagagttatgtgtcttgagtgtagacgttaatattctttgaataaagaacccgagtaaatatctttgagtaaagaacctgagtaaataatggaccaaaggagacataaatggcacagatatttgaatagatgcttaacatcactgatcttcaggaaaatgcaaatcaaaactacaatgagatattatcttacacctgttagaataactattatcaaacaagataaaaatagcaaatgttgatgagggtgtaaagaaagggcaacttttgttcattgttggggaaaatgtaaattggtgcagccattatggaaaacaatatggaggttcctcaaaaaattaaaaacagaactacgatgtgacctagcgatccttcttctgggtaaatccccaaaggaaatgaaatcagcactacatatagatagatgatagacagatagatagatagatagatagatagatagatagatagatagatagatagatagacagacagacagatagttagatagatctgtactcccatattctgtgcagtattattcacaatagccaagatatggaagcaaccttaagtgtctatcaatagatgaatgatgaagaaattgcagcatatatacgcaatggagttttgttcagctgtaaaaaagatcctgccatttgtgtcaaaataaatgaacctagagaatactatgccaaatgaaataagccaaacacagaaaggaaaatgttgtatgatctctcttatatgtggaatctaaaaaaaaaaaaagttgactacttagagagtagaactgtagttatcatatgtgggtgcatgaagtaggaaggttacaaagagatgcagttcaaggatacaaaattgcagtcatgtcagatgagtaagtctggagatctaaagcacagcacaagtaatctagttaataatattgtattttatactagatatttgctaagagagtagattttagacactcttaccaccagaaaaaaaatgttgctgtgtaaaatgagagatgtgttaattggcttgactgtagtgatcatttgagtgtgtatatgtataacaaaacatcatgcagtacacttaa

SEQ ID NO: 4176 - DNA, 1039 bp, Homo sapiens
aattattttttcataattccaaaagtcaatgataggagtttatgtctgaattgcattttattaattatagaattctatataaaagttagatcaaacatttgctataattataacatatatctcattcagattaaataaaattgggaagaatattcaaaatgccaaaattaaatatctacatgcattttctacattatatgccaccacaagtttgttcttaaatagaaataacacatagcttctgtgtttatcatttattttttgtttctttattaatcttaaactgtgacagaaaaactgaaccttaagttgttattaaatgaattattaataagtatattcagaacatctaatatataattactaggagtaatattaatctgtaagtctgtattaagttgatttaatacctaaactctcttttcaaaggattttaaatatttaaacattattaaagacattccccagaaattttaaatgtgaaatatgtctgacagaacacctgatctgtatctaattgtaaatatatctttggtatgttttcatatgtttagttagacactcagagtatgtataatgggctatattggcatttacatttcattgtgttaatatttatatttacatttagaatacaaattaattgcatttctggtaaacaacattgttcatcgttagaatattttattgtagactttgtgtcattttgattaccttgcataagtatttaacttcttttttaaattcagtaaatgatttcattctcttttgatatacacccagaaataaaattgctggatcatacggtaacctatttttaattttttgagaaacttttatactgtgttttctttttcattttctttccttttttttttttttttaaagacagtttctcactctgttgcccaggcaggagtgcagtgagtggcatgatcatggctcgctgaagcctcaacttcctgggctcaagtgatcctcccacctcagcctcccaagtagctgggactacaggcatattccaccatgcccagctaag

SEQ ID NO: 4177 - DNA, 1007 bp, Homo sapiens
ttatttctgttttgtatatagagacaccaagattatttaaaactgtgtgccttacagttagcaaatgggtagtgctggttgaatgcaacccagtgtctgtatatcttctgcctcatcaactgcctacaaagaagatttgccttactacactgctgatgggtaacaatgcaggactgttctgtggctaaaaatatgtttttaaagcttcaaaaatatatattgaaaccgttatgataccatctccaaatgatatggtttggatgtttatcccatccaaatcttatgttgaaatgtggtcctcattgttagagttggggcttagtgggaggtgtttgaatcatgggactagatccctcatgaatagcttggcattgtccttgcattgagtgagttctcaccctgtaagttcacatgagacctggtttttaagaagagcccgacacttcctcctttctctcttgctctctctctcaccgtgtgacataccagctccccctcccttctgccacgattgtaagtctactgaggcctcactagaagccaaacagatatgagtgccatgttagtacagcctgcattggcaaataaacttcttttctttataaattacacagtctcaggtactcctttatagcaatgcaaaatggactaagtcatccaatatgaagattttctctcactcaataccaggagctttcaacttaattcttgaattttcataatggcttagtctatatgatcaataataaagagttggtaagcttgttgatggccattaatttagaaagtagcttctcctaggtgacataatgatttgccacaagtacccacatgtgcaaaaacatctgtgtcttattctgtcaggcatggcttcccagggcatagttctctgtggaaataaatgagagcataacttcaggggatgtgccaatgtacatatgtctgtgtgcctctcttgaccaaatcctggtatgctgagctgacagtgagggtttttaccctcactg

SEQ ID NO: 4178 - DNA, 1056 bp, Homo sapiens
atttattttctcacaattctggaggctagaagtctgagatcagaatgccagcatggctgggttctggtgaaggccctcttcctggcttgaagatgtctgccttctccctgtgtgttcctatggcctttccttggtttatccgcatggaaagagaaagacctctgacgtttcttctttctataagggcactaatcccatgatgggggccccaccttcatgagtttaactaaaactaattacatcccaaaggccccatctccaagtaccatcatgtttgagattagggcttcagcatatgacatttgtccttaggatcatcatgatgttttgttttgttttacgtttggtaatcatactataggtctgcattgtcctctaaaggtagaatattgatgttgaaggataaattttaggatacttaacaaaattagaagttactgagatagtggatattgtcaagaagacttttggaacatcacagtacacaacccttcccctccgcccactgtaattcaatgaagctaaatgtggagaattcaagactacattgtattcatgtgcacagtacacagtggttttcaaatagagctaggagatgtactgttggatagctattttcacactacaaaccacacagctcttatcttacgaatcgctgctatgtaaagtttggtgaactgaagaagacatacacagaagaaaagaggggttagtaagagaaaaggaaaatggcatggaaatggcagggattgatgcaagttggaggaaactaggcatatttccatatatgatatatatttctttctagaacaatcttaccaaagtacagaaatgtgaaattttgggggataatttatgttttatccgttccttatttcctgtttattccagttaagctatgccatctttcgttagcaggattaaagtgatctaataatctctttctctgtcatttaaacagcttttttgactttaagtgcttaacacctgtatactctaaagcaagaccaaagcttttaagggactgcattaaatattttaagtaaatctatttta

SEQ ID NO: 4179 - DNA, 1037 bp, Homo sapiens
ctgcaatactaataatgttatcaaataactatttgaaattcaccaatgtactaaaagatatgttttccattatttgagtatatactaatacaattattaatacatgtatctgtaagaacttcatctacaaagaatctttgtactgaaggaatatggaccaataaaataaccaatacattgaaatatccaaattaattacataagcaaattattccaaaaatgtggaataattaaattgtttatcactctgagtagttataaccacgaaacaccttctaactgaaataatcaatagtgtttcagctttttaatttaattttatactattaagtccccttaagtatattatttgataatgctatactggttcacaatacagttgtctccatttgactctgcactgaggtgtgaatacagcatttagaatgtagagtcctttcatatttatgtgctgtgcattttcatgctgagaagtgaatctttgacattttggtgtagtgatgtgaggaatgcagttatgctctatttcagtattttgtatgaaacatatacgagaaaaatttcatcatgtcaaaaagaaaagcttcagtctgtggaagacaagtagccgtattctctaggaaatgtttatttgacactcatgagtgtcgatttgggaatttatgacctttgtattaccatataactggcggttacttggacagccacacaaccttacatgtttttgttcattaaccttgcttccatattgtaattaaacattactcacttattttatctaccctttctcactgattttgtaggaggaaatgtagaataggaattccatattatttaggatatacatttgggcagtttcagaaaacaatagagggtaaaacaatataaacgtttagttctttctcatgtaacaatgtaagccattttcaaacctgaattccgtctttggtctgtgggtagttaccatgttcacattcatgctaatagaagtgggaaagagggaagcagctccttcagtcttatatttatgagccgga

SEQ ID NO: 4180 - DNA, 1016 bp, Homo sapiens
atacaatagactttgtggacttagggggaagagaaatggtgggtgggaggatgagggatgagacaacccattgggtacagtgtacactacttgggtgatgggtgcaccaaagtctcagaaatcactactaaagaacttaccagtgtaacaaaaagtcacctgttccccaaaaactattgaaatatttaaaaatgtaagaaatttctgtggttttaagccaaaaaagagaatggaactgacaagcaattgtagatgaaatcaggtgactcattcagaaaagaggtatctgtagattttccttttttatgtttttaaacattttttttattttactttttgtctctcagcaggtttctaaactatcacctctcatttgactttactcaatccttgtcgtatcagcatatactatttgcagtaatgcaataaatactttgaaatatacaataaataattaactacagttacactattgtgctactgaacagtagatcttattccatgtaagtgtattttcatacccattaactatctggaattgaattggatttttcattaacacaaataaatgacaaatgcttgaagtgttggatatctcaagttaccctgacttgatcattacacattgtatgcatctatcaaaacatcacatgtacaccatacacatttgacactaatatgtattaataataattaaaaataaaaaataaaaaattgaattttttcatgtaattgataaaatgtattttgttttatttgctttagattgaacatatattatagataaaatgctaaaggccatgatattcccttcccaagtcaagcactctgattcattgatgaatatggtctatgttttatgtttcctaagaaataattgtacaaagaatgtggaattctcaaatgaatgttgaagtttagaaactttctcatctgtttattgaccattcatcttcctcatctttttttaaaaagtttattctttgtacattgtgtcatatgtgtggtgatggagg

SEQ ID NO: 4181 - DNA, 1050 bp, Homo sapiens
tattttggtgtcatatctaaaaaaatctttgtctaccctagggttgcaaatattttctgccatgttttcctctagaagttgtgtagttttgtgttttacatttggctctaggttacatttcacgttaaattttatatatggtatgagttatggtcaaagttttttttcgttttgttttgtttttgtttttttcatatgggcatccaattgttttaacaccattgtggaaaagactcatttctccacggaattgactttgcacttttatgaaaaccagttgtcagtatatttgtgggtctctttctggactttgtattctgtggcattgatctttttttctatattaacactggtatcatattgtcttcacagttagtcttgaaatcagttagttatagttctcaaagttagttttcctttttataagttgtttggctattctaggtcacctgaaattccatatgaattttagaataagtttgtctatttttactaaaagcatctgctaggattttgattggggctgtgttgacttgatatatcaatttgaggtgaatcaccatcttaacaaaattgagtcttctgacccatgaacatagtataactttccattttgtaaggactttaaatttttttctcagcatggtagttttttaaaacatattttaaaacttaggaatagttttagggttacagaaaaatagcagagacagtacactatatagagatttcccacctacaccaagtcagtttcctttatctttaacatcttatataaatgtgctttgtcaaattaatgaaccagtattgatacattattattaactgaagtgcatactttattcgtatttcctcagtttttacataatgttctttttctgatttagaattccatccaggataccaaattatatttacgtgttatgtcttctgaggcttctcttggctgtggcagtttgtccaacttaccctgtttttgatgaccttgacagttttgaggagtattggtcaagtattttgtagaatgtgccttacttagaattcgtctga

SEQ ID NO: 4182 - DNA, 1043 bp, Homo sapiens
tatacagtctgcaaatgtggagactgtaaaatgagttcagacaggaacttttagtcttgccctctgacattttggcagttcttattcaggcagaagaaagatttgtcttaattaaggcttatgttcatatgttcataattaaatagttttaaaaacctgaaagaatttgctagagccaactgtcagaattgtgctgtatccaactacaaatttatctggaaggcatttcactgccaagctttttgaatatgtagtctgaacagcgtgactctacgtctttacctcccagtcatacctcaacccactacaatctggcttctttgcatcattttttctgttagacatagtgccctttacaaagtaaaagctcaattgatatactgatgaattttaattttaatttcttatttatattttatatcctacttctaaaatattaaaaggagatatgttaagtttgtatgaaaattagacactactagtcaaataataaaataaataatctttatcacattttaaattaaacaattgagacaagaactacagaaattggaaaaaaacatgctaagcagtgaatagttactgcacatggttgaaatttcaataagggagaggaggcaaaccataaaacagtttcacagaatacaggaaaaaagaaacacgagagagaaaaataatgggcctttccatttgctgatccctctgccctcagatatttgcatgcccccagatacttcctctcatccttcagttctttcctcaaatgttaccttctcaggttcgccttttttggctaccatataaaattggaattcaacttatagcattaacacttcttatccatttttctaatttatttttcttctgagaacttacaactatctaatatactatatatcttacattttaaaaatctttaatgcatctctctcagtaaaatataagctcgtggcagggccataattagtgacataagctgtatccatttgaggagtaggaacagaagctaaattggtgttttggtcagttttggctgctatagc

SEQ ID NO: 4183 - DNA, 1050 bp, Homo sapiens
attaatttgagtttttgagttacattgtttaaacaatactgtcaggtctctgtttgaacaagtcatatcacacagtgtgcacagtgtagataaggaagatgaacaataaagaaataaacaaatagacaaaattttagatactggtgaatataaaatagggagaagtaagagttgttgactggtcagggaatttaggttggatagtctccaaagaggtatcttttgtcatacttgggtagtatattattgtggcttttctttttgcttatttaatatattttttctctatgcttttctctttaattggatttctcagcttgtgtctggcttgtttctccttagtgtatgtttgaatttaaatataattccaggtgaaaaatgtagtctattattgatgactggaaaccatttaaactcatagtaataaatgataaatttgtttctatcaagtgttaaatgcttttatgagtttgtttttaaatctttttactgttttctgttttatcgtacatatactctggtatattttattgtcttctgtagtgatttaggaggaaaattcccctttaaaaaataatagtggttatctttaagaccttattaactatgtttaaactgagattgttctaattttctaagtcagtgattaaataatagtaaggattttaggatctacacttctattcatgaatattttcattgttttgcatttcttactttatgacatctttgttttatttacatttatacatttctcctggtacatatgtggaaaagagtctttagagtgtagggggtcatagaggctgcaaatgtagaacattgtagcagaatgtcaaattgtttatgctatttatacttccacagcaacattttagaaataatcttaatccctttccgcattgtctccaacaattagtattgtcatcctctaaattttggttcacgttggggtgtaaaattatatctcaatacattcataatttgacttttcccaaattactagtaagggatgaatctaatgagtttgaacatcgttttatgcttagg

SEQ ID NO: 4184 - DNA, 1033 bp, Homo sapiens
atgggcatacaatggcagctgtctttctaatcgttcccctattcaaacactaatcggtggaacccacgtaaaatgctagaggcctgaataggtagacaatggcagcagcgtttttaatcacagtcctattcatgcactaatcggagtgatgattaaaggacattagagggagcactttgacatctgatcctttgaactgacgtctgtgcaggctgcactccatagagctcacttggccaaactgatttccttaaataaagtgctgtgatttccaatgtaggaaatattacattagagcctattgaaatgattaggaattgaggagcttttctttaggtgggaatgtggtgtatgctgtatactcacaaaagtgagatcattaatattgcatgtactactttgaatatcagggaccacagagaaatagcatgagaaacgccttcctgcagtcatgcacttaaaatgaatatgaacaaaaatgtggaactctgctgtcatagctctccgttattgaagtttatgaattttgaaatatttgtatttttatataacacgataaagatccacacatcctaactgcatttcatatttttgttttcattaagccaggatatttttaatgttacctatcttgaagttgctttaattacaaaaaaaatgtgttataccctatttgcatggtcatgctttgattcagtagtcattagtgagacagaatggaatattttattttctcttttctttcaaatttctaatatctatttagattttactaacctattccccagaatatttcatgtgatttatcctaaaaatgttaatatctattcagcatttgcaaattgaatcagtagttaaaattccaacatcaatatttgaatatggagctccaaatatcaataactgtatatactacatttatgtgtaatgtatgtaggggaagaaaaaccttttcctttaacctcttatgttcagtggctggggcatgtgaattaatctgacagaagacagattgacaggaaaacatgcatac

SEQ ID NO: 4185 - DNA, 1031 bp, Homo sapiens
tgaagaattgatacaatgatggtttccctgtaggataattgttggaattaacacatcacagataaacttctcggcacatagtaggtgcttcacacaagttagttccctcccgcaacaatcatttctttaatgggatttttttttttaatttcacactaggatactcccatacaaagacttcatggatttaaaagtttatacagatattgtctatttcatacatcgcacaaatgcaggaaatactgtagtataaaatgttgcatatattagtgtcatagcaatagcaaaacaatcctgtggtttcttgccaagacaaatatgattatacattactgtgttccctgtgataaattcctttgaggtttcagaatgctgtgcgtgagtaactctggcaatctatttaagattcagttgattttctataatgcaaatctttgttttacagagctgctgaactgtaatataaatgttatataggaccttgtcaaaacaatcttattagtgattagatattggaatagttagtggaactaaatatgttcatatttaggcatttttcttaatctaggctttgagcatttattaaaaatatttgaagtaagtcaatatttacatgctatactgtgttctcatttgtaaaatttaattttgtttaaaaaaaggaaattgaaagtggaagcttaaaaatttccaacaggcatcaacattttaggttgaaaatactggcacattctgttattattttgccatatgtcattttcctatttgtactccagtatactcagaatcaatttttccacactatttatgaattattacatactacatgaaaaataaaagacagcttttcccttcagttatctaacaggccttttataaaagcatctttcattaaattactttggaatatagactagaagctttctcatctgatttatgtgaataaatatagaattgatgactgtatctttaaattatatgattcattcagtcattagttaaggagagaataatcaatgatagatttaaaa

SEQ ID NO: 4186 - DNA, 1005 bp, Homo sapiens
ctaatttgtaagcaggaatggaaaggaataaagacaacatagaaattcaggaactggcacagttgacaatggcaaatacttttctaatggaagcctttaataataattttaaaaaatcaaaccaagcctatccctgtcatacctatctttaaaatctctaaatggattgagatatcacctagtaagtcctttcaattggatgaaatggctaaatgaacagggaataaaggtgttggtctcccaccaagcttgataggctcaaggtacctagaattaagtagacagataaatggagatatgtcaaggaaagaactgtgttatggccattggcaaatgaagctgattggaatctaagagataagaaaccagtaatgtttataagataattgtattgccaaaggagccaagagcctagacaaaacttaacatgtctctttggcctacagccctctatacacaggaaatgagctcaggatactggttagcctccaaagagtgcatattctccaataccctcttcacatataactaaaaaatataataaaggaagaactgtctcccagaaggtcaaatcaaggaacataaagaacaatgaattgggaacccccttctagagggcagaattagcatctaattcaagaactatttaatatcacctacacccaggatagcaggacttcacaatgtgttgccactgagcagtgtcagctctgttcattgactttactctcattttttcccaatgactcaccacatctcttccctctaatatactttctgtgatctaagaatttgcctgttctagatattttatatgtgttatcatacaatatttgtccttttttatttaacttctttcatttagcaccatgttttcaaggttcatccatattgtaatctgtatcagaacttattccttcttctggctgaacaataacccattttatggatataccacattttatttatcccttcatccatcagtagacatttgagttgtttcta

SEQ ID NO: 4187 - DNA, 1044 bp, Homo sapiens
tcatttaattttaaggattgatttattctcattgttttgcaagagcctttaacttcttattacaagtaatactagggaaaccgttaacactggatgtatttagaaaggatggcagtggtagaaaggggaaacacagaaatgcccttctttctcccccagattttctcatttgtattaatttgatcagaatttattgtgtaatgtgtgttaatacttgatcatgactactttgaagcactagaaaatttcgaagagcttttggtcaaaggaaaaagaaatcttattttaaatatgagttagaaattaatagtgttactctcaaggcacgtatttttctgtcatgtatcacttatgtgctagtatttaaatttttatagcacttgtagaattttcatttttcccaccatccttatcccagctcttaaaattttattataatctactctttactgaggatactttggtttatgtataaaattaccatttgcttaagaaaccagtgaagaatgtgttctgaacaaagctaagctataaatagaacttagttacattatcttatatatatgtatacatatgagataaaccttcaaagttaataaagactttgttaaataagttattaccattttctttttaagtggtgaaaatgtagggttggaatccaaatacctgaagaaaagggaagatagcattcctttacgcggactcagccagaacctatttagtaattcaggtaagcagggatttctggatttttgtactttatagttgaattaaatttaatgtatgaagacttaatgaataccagtaacctttttttgtcctcatttgcagaccatcagagagatggcactttaggagcattacatacatcttccaaacccacagcgctcccctctgcgtcttcagcctatttccctgggcagttaccaaacagttaattctagtgtcatgttttactttttattggtattttagaaactcaggtgcttaaaaaatatgtcaacacaaaccagatcctcaaatagcaagtttcaaatttta

SEQ ID NO: 4188 - DNA, 1022 bp, Homo sapiens
cttacaatgcaggtctgtgaggaattaattcttcttttgtcttataatgttgttattttgacttcattttctctgaatatagaactttaggttggcaagtttttttcctatctgtattttgaagatgttattccgttgttgcctggattgaatactttctggcaagatgtcagtagtcatgtttatatataatgtttcctttatataaagtgacctttttctctgggtgcttttaaattttctctttatcattcattttcaacaagttaattatgccttggtgtggagtttgtgtattattgtttaattggggttttcatgaagtttttaaataggtgggtttgtagtttttatcagtttaggaaattctagtcattattcacatttctttttctgttttgttctcttttttggtgttcctccttggtactccaattatacgtggttgattacatgatactttcccagggagacttagtttatttcattattatttatttcattttatgtagattctgatgctgtgtcttaaagtttattagtcttttcttactgcagtgtataatttgctgttaatttattcagtgagaaattttcattttatatattgactattttatgtctggaattttcttttcactcttttttatatcttcaattttctcatactttttatttccattaagttcttacacaattacatttgtgtccctggtctataatttctaccatttctgaatctgtttctgttggctaatttttcttctgagtatgacatcttattgttgtctttgtaatttttgataagtggagcattgtgagtgttacattgttgattgtctggattttatatttctttaaagcatggcaggctttttttttttttttatagacagggtcttgctctgttgcccagtctagagtgcagtgatgtgatcataactcactgtaaccccaaactccagggcttaagtgatcctcctacctctcatatatctgggactacaggtgtgcactaccac

SEQ ID NO: 4189 - DNA, 1026 bp, Homo sapiens
cacattcttggctcactgcaacttctgtctcccaggctcaggtgatcatcctacctcagcctccctagtaactgggaccacaagtgcatgccaccatacccccagctaattttttgtaattttggtagagacagggttttgccatgttgcccaggctggtcttgagctcctgagctcaagtgatccacctgccacagcctccaaaaaagtgctgggattacaggtgtaggccactgcacccagcctatagtgcagtttaaataaatgtgagagcagacattctggccttgttcctgagcttcagggcagagcattcagtctttcatcataagcatattagctgtaggtttttgctaggtggccatttttcagaataagggagttttattctattcctagtttgctaagagcttttatcatgaatggttgttaaattttgtcaaatgctttttcaattgatatggtcatgtggcttatcttttatcagttaacagattgtattgattgtttaagattatattagcctttcattcttgggataaacttcacttggtcatggtgtattctttttatatatcgctggagttaatttactttttgtttctttttcttttttttttttttggagacagagtctctctctgttgccctggctggagtgcagtagtgtgatctcggctccctgcaacctctgcctcctgggttccagcgattcttctgccgcagcctcccgagtagctgggactacaggtgcctgtcactgcaccagctaatttttgtatttttaatagagacacggtttcgccctgttggctaggctagtcttgaacttctgagctcaaggtcagaggtgggtgatccgcccacctcggcctcccaaagtgctgggattacaggcgtgtgagccccaacacccagcttggagttaattttctgatagtttgattttgtgtccatgttcataaagcatattggcctgtagtttacttttcatgtactgtctttaacaaatttaaatcaggacaa

SEQ ID NO: 4190 - DNA, 1244 bp, Homo sapiens
aggagacacagtaatacacagcattattttgagtgagctccagcttttcattctaacccttgaaccgaggagaaacagctgtcctttttcattgagtctgcaacagaatggaaatgtgactcagtttatcagctcccacagagcaggcagagtaagagactattttaagctggtttggggagcccctatcccaagcatagagtggatgttgaaggttgttcccggcatccactggtggtggcttgtggctagtcctgggctccctgggtcctaggcatctcttgattctcagtaatgaacttgtcagttggccaatgtggacctgttgacaaattactctgaattactgtaaggtctcttttggctttattctctagggtttgagtttctacaggaacgtttacatttttattttctcggaaggaatctcttatcctcctgacactgtaattgtaggtgctgaaatgcttgttttctgtcagtgtcatccagtacagatctctaacatttgtgtgtgactggaggtgccccaaggccctgttgcctcaatttctttatcttggtagtgtttggcccacagtgtgtattcagagacagattttgtgtacagatagcattattcagttgggttaaccatctgattcacctagatggtttaaattaatttttcatttatttggtattaactttttaaaaataatgtgtaagtatgggaagctttgaaaggtacaagaggatgtactatctaaaagtccctactgtggtccccagtcctcttagagaaaaatactgttaggaatttcttatgatatattccagaaatattcagagcatgtattagaccatatgtatgtgcatgtatatgtatatgtgttcaaatatatgagtgtttttatatataaacataaatagtacttgccaattgttctgcgccttgcttttttcatttaatggtattatggaataggtaactgcagtgtatcagaatataagtttttgtttctttttaatgacttcatagtattccagtatacggatgtactataattaactaatactctatttatggatgagtaggtttttttcaatccagatgctcatacagtgctccagcaaatatttttgtgcatacatctcggtggcctggtactaatagatttataggttacattgttagaagtaactgtgtcaaaggcatttttgcataactggtgactaaaatagtatcttattgtaatgttaat

SEQ ID NO: 4191 - DNA, 1063 bp, Homo sapiens
taattatgttcttaaatacaggagcaagactttcagtgtttcctgtatcggtgatctccatattcttttaattatgtatccctaacagggaaaaaaaaaaaccctaaaacagaacaatttgcgctctcatctcaaatacattaatgtgtatttatttgtgaatttatgcatatactactgaaatactatatgccgtataattattggttaagaaggcggaatctgatgttaggatttaaaacctgcctctatcaacctgaagttgatcaagccactgaaaaacaaacaacattcaactcttacacttcagttttcccacttataaaatggagtgataattttctctaccttactggattattgagttaagtgaattaatgcatttgcttagaatagtacctggttcatgataagtgctctgtaaatgttatattattaataataaaatatattcaaaaatagaaattaaagaatcagactaaaaatggatgtaaatgaaagttgtaagattttcttctcagacctcagtgaatggtcctaattactgcctactttgtcctccccgactcaaagacccactttaaagcaccaaataccacctactttggtgatcattgatctaggtagttttgtgctagcagctatgttgattaaaacatgtacttttgaattacagtttttaaaaatgacgcttttatttttgacgttgaacctgtgatcttcctgatgtcttaaaatgttactgtcaagattgaatacattcaaggatgtttaactgtgggaatgtaaaataacatgagaaatttggcaagaaacaaaataatgctgaaagaatatgtgagaatatttaacaagattgtgctgttctgacaaatagaacaaatacttgataattttaaagcaagatacacaaaactacgtgttttttctcttttatttttggatacaatgatagccaaagattcattcattgaacaagtatttaatgaatgtctgttatctgctgtggccaggcatagttttagttgcaggagatgacagcagtgaacaagacaaatgccct

SEQ ID NO: 4192 - DNA, 1056 bp, Homo sapiens
ttagcatttcctcagtagacatgagtagagattttatttcaaatgaattcttaaccttaatgcccagttctttattagttttacatcatcttgtaactaatgctgtttttctttcaccagtgttctctggtacataattttggtgtactttttgtgagctctagctgttatgatggtctcccacactatgtacacgtagctacctggaaagtgatctttatgaaaggtacttacttcatttgagactgaaaacagttgggcttccatatcagtggccacctggcctaggagagaataggctctttggaagaagcctggcaacgtgttacctgataccctggtcttctgagagacagaagctcttttttctagtgtggattattgtcagttctgctgatatatttgccacttttgaaatgccataccagttaactttaaggaaactaaaaataaaattgaatgtggtatgttcagtggtaaagaaaattttcatcatgttatggtgtagcaaggactgggtctaaatttccccaagcctctgataggaggatattcctaaactttcaactcctagcacttgcttaacttttacagacctccatgtggcttttaaagagcggaatgtctacccctatttaagattctaactctctaaagactaataaaaaaccagcagcactagaaaacaaagctgtctgcaatataactatgatacactgatgttgttggatttctttacttctgagaagaaattactcaaaaggccagatctagtaaaaacatttaaaaacaacaaactttcttttaggacttagttattcgtctgactgatgacacggatccattttttttatataaccttgttatatctgaggaagattttcaaaggtaactaaatttttttctgatcttatatttagtgaaaaaataagtttctaagttttattggtactgttctctttcaaacacatacctacatattagatttagttactttgggaatattgggctatttgtactatctttacttagggtgttttggaaaataaatatttt

SEQ ID NO: 4193 - DNA, 1053 bp, Homo sapiens
ccgggttcaaacaattctcctgcctcagcctcccaagtagctgggactacaggcatgcaccaccacgcccagctaatttttgtatttttagtagagacggggtttcaccatgttggccaggatggtctcgatctcttgaccttgtgatctgcccacctcggcctcccaaagtgctgagattacaggcttgaaccactgtgcccggcctataccatatatttctaaaacatacgtgaaaaattgtggggtggggtgacattctccttagatttgcccagtgcacttagaagttgcatattatatatatataataacatatatataaaaatatattttattgctgttggtcatacacacacacacacacacacacacacacacactgctgccttgtagaattggcatttcatggtataaatgtaaaaacaataaaccgaagtactgcagggagatatttgtgaatcttttactttacgttttgaagagaggcatttagagtatcagtctcatataaccttcaaaagtgtgagtcattaacagaactaaggatatagaatagaggaggggtccccaaccccctggccacttactggtacggtctgtggcctgttaggagccaggctgcacagcaggaggtgagtggcaggcagggaagcgagtgtaacctcctacgatccacctcctgtcagatcagtggtggcattagagtctcataggagtgcaaaccctattgtgaactgtacatgcaagggatctcagctgtatgctccttatgagaatctaatggctgatctgaggtggaagtttcatcctgaaaccatccttcactccctaattcttggaaaaatgtcttctacaaaactggtttctagtgccaaaaaggttgggggccactggaacagagaactaagaaatacggcatctgtgccaagggcagtgcctcacacctgtaatcccagcactttgggaggctgaagtaggcagattgcttgagccaggagtttgaaaccagtgtaggcaacatggtgaaatcccatctctacaaaaaaatac

SEQ ID NO: 4194 - DNA, 2093 bp, Homo sapiens
ggcagggtcaggactagaactcaggccttggctccgagcctttccccctcgttctcttttgaagtatgttggcagtaaagttcaacttttaaaaacctaccaatttggtggcgtactttggctcttcacatcagttgctttaaaaaagtaaattacatttaaccgactaaaaatgagaaaagcagaaacgtcattaattcattcaataaatattgcctccttgtaaaacaccttactgggcactgggaatacagtggtcaggaaaaacagtccttttcttcatggagtttacaatcactggaggaaataaagaccagtcgcacagagaagtgcaactttgattaaggaggtggtattattggggcgtaaatagatttgaccagaggtcaggagacttactttttttttctcagttctaacactcaatggttgtctctttttttctctgaacgttctttcctcatttgtaaaactgatataacatgcgtattcacgtgtttgtaatgaggatcaggtgtgaaatcttttgcgtattcacgtgtttgtaatgaggatcaggtgtgaaatcgtatgtgaaaactaagtggtgtacaaatgtaacataaaaaatgaagacattgccttattgagttgccagtaatgtcaaactgtagtatatatagttcagaattcggtcaaaaatcaatggcaagccggtcaaggagatggtcccaaaaccagcagctgcatatggagatctgtaggtttagttgatcattcttttaatgctgtccagtatggtagccactagccacatgtggttattagacatttgaaatggggcttatctgaattgttgtgctttacatatgaaaatgcacgttggatttttaagacttactatgaaaaaagaatgtaaaatatgtcaatttttatattatgtgttaaatggcaatatttttgggtatattgggttaaatacaatgtattattaaaattaatttcacctgcttttaaaagtctttttaaaatgtgacttctagaaaatttaaaagtaggctaggtatggtggctcacacccgtagtcccagcactttaggaggccaagacaggaggattgcttgagcctaagcttgaggttacagtgagctactatttgtgccactgtactccagcctgggtgatagagcgagatcctgtctctgaaaaaaaaaaaagaaaaagaaaaaaattaaaattacatacctggctcacatttgtggcttacattgtatctccattggacaacactgttttagaatgattatagaaagataaaggaggccatgactttggtttcaatatggaaactcctagatggtctctttctggttacattgccatcacagttaatctaaaaactcaatttctctgcttagaaacctttaatatattcctattatctgtataataggggtcagcaaactggagcacatgggccagttggctcactgttttcgtaaataaacttttcttggaatacagccatgctcatttgtttacatattgtagctgcttttgcacaggaagggcagagatgagtaattgtgacagagaccttatggcccgcaaagcctaaaatatttgctatctggccctttacagaataatttggtgatccttgacctataggaagaacaacccagactctctctctttctctctctctttttttttttttttctagacagagtctcgctctgttgcccagactggagtattgtagcacgattacagctcactgcagccttgacctcctgggcccaagggttcccctcaccttagcctcctgagtagctgcaattacaggcgcataccaccacgcctggcttttttttgttgttaatttaatttaaaagagacggggtctccctgtattgcccaggctggtcttgaacacctgggctcaagtgatcctctcaccccagcctcccaaaattcggggattataggcgtgagccaccacgcccagcccagacgccttggttgagtatttgaggccagttcagctcaacaaatactggcaaatgtctgctgtgtctcaggaactgtcctaagtgtggaggatgtaaata

SEQ ID NO: 4195 - DNA, 1030 bp, Homo sapiens
agcagctcatgtttgtgatcctagcacttctggaggccaatgcaggaggatcacttgagcccaggagttcaagaccagcctggagaatgtggagacatcctgtcactaccaaaaaaaaaaaaaaaaaactggcacactggttcttgctgtagtcccagctattctgaaggctgaggcagagggggcccaggagatcaaggctactataagccatgattgtgccactacactccagccttggtggcagagtaagcctgtctcaaaaaaacaaaaaacaaacaaacaaaaaaccacaaaacaaagaaatacctgaaactgggtaaattacaaagaaaagaggtttaactggctcacggttctgcaggctttacaggaagcatggtgctggcatctgcttctcagggagctttcaatcatggtggaaggcaaagggggaagcctgcgtcccgcaaggccagaacaggagcaaaagagggagcagggggaggtgccacaaacttaaagaaccagatctcccaagaactcactgtttcaaggacagcaccacgccatgagggatcctcctccatgatccaatcacctcctacctagccaacacctccaacgttggggattacagttcaacatgagatttggtgggaacatatattcaaactatattgtgatatagtatatcttttcctttatggatatgctttgtattctgttttaaaaagtgttctctactttaaggacatcaagataagtcctatattgtcacctaaatgctttattttttctactttcacttttagatctacaattcacatggaattaattttggtaatacatagatattcaactgtcccaatataatttctcttaaaaaattattcccatggccaggtgtggtggctcacacctgtagtcccagcactttgggaggccaaggcaggcagatcacttgagcccaggagttcaagatcagcctgggcaacatggtaaaaccccatctctacagaaaaatacataaattagccaggtgtggtgg

SEQ ID NO: 4196 - DNA, 1040 bp, Homo sapiens
cataatttaaccaattatctattgataggcatttattgagttttaaatgaataatgacatgatcaataaaaatgtcctcctcacttaaagaatagaaaaaccaggagaagggagttctgaaataagtaagtatgtaggtccagcatcaatggctcaagatactctattcccaaataacccttaagttatctggttctattccaacccttgggtattactatcttctctttggtctcatgcattgagaattcagcaaaggatttgttccctacagtgtgcacggcccttaggatagcaggattccctgaagagggccaaaggggcaggagcgcagccttagtggcagtgctggtccatgaggctctacaaagcaagggatgggtgtttgggaggaggaaaaggctcttgctgtactcctagaggttggaattaaagtggaaaagccagaaaattcaagtcctttactaacatgtctggagattagaaggtatatgtacatgggggagaagccaaaattattgctgcgagtggtcagcaagaaaatcaaggctcttttcattattttgagcattcctctgatatttgaaaaggaagtacaacaggaaaggaagtctgaggatggaagctaaaattggtatgaatttatattttagagatcaaaatgtaccttatgttgaaacctatgtaagaagtgattatgtagaaagagtgaaagtgatagctcttagtctggaaagcccactggcttgtttgggcatttctcatggcttcccactcaaagtggatccccaaaatcacttgatggatttccttgctgatttctaagtaaactatggtttaagaaagaaatgacagggctcagcactgccctacagtaccaagaatacaaatgtttccatgaagtcttcaaaggcatttgtaaaattcaggctgtaagtgattagttagttcattctgcacttatttattaactgtatattcagttccaggctctagggtagagattatggataaaggtgaattagatagatgaagttttt

SEQ ID NO: 4197 - DNA, 1032 bp, Homo sapiens
acattgcttagtacaccatctgaaagtaaatgctgggctagatgaatactgatctaactcagcatggcatttacatccttaatatgatctgtacttatgactgtttccataaaagtgtctcatttctttttcttttaggtatgtaaaagaaggagatacagtgtctcagtttgatagcatctgtgaagttcaaagtgataaagcttctgttaccatcactagtcgttatgatggagtcattaaaaaactctattataatctagacgatattgcctatgtggggaagccattagtagacatagaaacggaagctttaaaaggtattgtaagtctgttaatctattttaccaaattgattattggtctctttttgtcattgggtcccaattaaaagtgatctttgtttttttgttttttttttttctattcctatttatttttagctcttgaggaaatgtaatcttttcaacgtgaaaaaaggtagcaagttcaacacaaaatagaaatctgaattgtaggataagacaaaaccaaaggtgggggggaaaaggcaatagcaaaaggaagagatgaaatgttgcaaaaaagatggaggatgtcccatcctttctcctctgggtaatgactcaaacattcaggtggcattatacattgttccacataagtcagtgacgttattccttttggaggggtaagaacgggtggggatgggcttttaataacttacaggatttgagttggagttttagaagccgaaatcaggaaaattgaaaaggttctctgtgagtcatgattatcttttggccagttgccatgttaaaaatgtgtacagtaacacttcatttacctgaagtcctgccttctcgagatgttagtgttcaaagaggcaacaagctctctcagtaattaaagattcagactataaatactggccacaaagaacaaaaattggagtatctaaagatgaaatctaatataatggattgctctgtttgccactgatacaaaaaaaaaagcactcttgttggagat

SEQ ID NO: 4198 - DNA, 1078 bp, Homo sapiens
tttctaggatcagaaactcaagagaggcatttctctgctttttcactaaaggtcagttgttttaatttgaaacctgaaatgcctctttagcaaaagcctgtggtatggggtaaagccatgtaagaagagaatagtctcagtcacatatgaagaggaaaatttgcagctgccagtgctttccttgtggccctgccaaccagctcttccaggacgaactcagtccagcatggttttgatgtaaccatccatgcttttatttttgttaagtcttttgtgactgggacagttaattttagtagctgaagaacgtctagttgtttgcttgatatttgtgaacatttactgcatggatcacaaaacaatataccctgtatttcttacacgccacttatatgcagcaaggagtaaatgtgttactagattcgggtagtgcattttgtcactgaatctgaccttgagaatgtacattaattcttatattttacataatgtatgtgttgtttaagaaatgtataaaaaacctgaaaaaaatgagtaagaactggcagaagttaaaaccctttgtatcaaaagatctttattggtagagcactggttatcttctggatactaaaaagttgtattacaaagccaaacacttgcattcacaactttaaaaaaagatccaaggaactattcataatgatgaaatttcaactacatacaaggaggagaaaataagaacccagtcataacagaggaattctataggagtctgcatcaattcattcttaaggttgcctactctctgttatgtgaattagcgtctgtgtttcacccattgtctgtgtttagtccttgttcaccactaaggcaaggaattcttaactaggcctctgtttaccaacttctctttctcctcctttccctcttattcctccttctcctcttccttcttatataatgctagtatattctcaaaattgcaaagctgtgagaatattaaaataatcatggctaatgttccaataatgaggtctttgtgcatttagttccgcatatgatggttttttttttacattaaagagtatatgtgtct

SEQ ID NO: 4199 - DNA, 1027 bp, Homo sapiens
ttttttcctaaatcatagcttgaataagcaggcataaattggtcagtatcctataaaagccgctctctcctattgaatatgtgttagtaatagctaacttttacaagttgcactgccattacctgaaaccggaactgcatggaagtacttcgaagccgtgtcaaataattaaacactgtgctacccagtaaatgatcgaatttatgccatggtaacttttaaaattagcttcttgggatataacagcattcgatattaatggtaagtgatcacaatactcagcagatatcagcatttttaaaacttcagtttttaatttcatgcctagtgtgctgaccaacgaaatttttccatatcaacaatttttttttccagtccttggaatgaaatgaaatacatgaaagcttcttggacaaaaagttctaatgtgataattcaactgtgagatttctattgatgcttaaaaatccatttgcccaaaatgtaaaaatggaggcagaatatggggactgtggttaattggaaccatctgagtaaactataaattaaagatatataaatatgatttcaggttttatttttaaaaatatcaaaaacaatttcagtccattgaccaacttaaattcagtccaacccaaaccctgcatagcataatgatctgaggtttgtgtataagcaagcaagattcgagtagacattcatctgtgtctttgtatttgcccattacctccacttttagtgttttcccttttccctctctagccaattgtgaaatttctttcattctcctagattgtataaatagcgcatcttctctgaaacctcccagcctttatcccccatcccctgaccttcccctttgcctcccagcaacacagttgtcattctaccctcaatgtgcccattgaatttacccagctgcacttaaaacaactttctcacagtattgtatttccttgtttgcatatccatattatacccctctaccctctctagactataagtgctttgaaatagcatttaactc

SEQ ID NO: 4200 - DNA, 1238 bp, Homo sapiens
attttcctgttggaaatcctagcactattactgaaattacttggtaatcttgggaagggcatgtaatctctgtaagcatctaaactattaaatgggaataataataataaataataaattagatccaagaactctccaatggcttctcatctggcgtatagtaaaatccagactctaatgagggtcagaggtcccacataatctggcccttgcttattctgatttattctttttataaacagattctcttcatacccgctaccccagattatcttttgaatttgtttattgtgttatctgtttctccctatcatctcctctgctactaacagcagacaccttttgtatctcattaattgctgtatccacagaacctggaacagtggtggcacaaagtaagtgctcaggaactatctgttgaatgagtaagtacatactgtggtatatgaagcacatagtacagggctggtaagtaatacacctaccataattgtttgctgcctcatgtattatggctctgtatgattttgtttgggaaaaagtctgctactacagaagtgtagattcgaaattaatatattactaagggaaataaaatcccagttgaaaaataatctcagttctggagatatagtgataaaatgatggcaaatttttaaatgcttaatttttccaattttgtgtgtataacatcttttgtctgcaactgcgtaacaagcagggcaagaaggaagggaatattaaactggttttttaaaatctcttaggccaaattaccttattgaggaggaagggagaactgaatttgaatcaactaaaataagattgatatctttcctcattggaaaaaaacatgaaaacacagggactcgtaagaatgctaacatttgtatgttgtttccatttctactccaggtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaat

SEQ ID NO: 4201 - DNA, 1032 bp, Homo sapiens
tctcctgcccccttgtaaagaaggtgcctgcttcatcttccgtgatggtcataagaggcctccctagccatgtggaactatgagtcaattaaacctctttcctttataaattacccagtctggggtatttctttatagcagtgtgaaaacagactaatacaaccctcaatagaaagatgaaaaccaaaatatagcaccaacctcactggaagtcattaatcatctacctcattgcctaaatataatttttagaagacagaataacaaattttaatttctaaagtaactcaaggcttatggacaatggcattgaaagcaccattttttgttttgtttttaaatttcctgctgactgacagaaacatcacagaaaattctttgatttatcttaatagtgacaagtgagcctgcttctgtcaattactgaagctataaggagattttttaaaaattaaacttcaacacaatgaggtaagtaccaatattttttggcttttgtttaactgttgtaaaatacgtataacacaaaatttatcaccttaacgggttttaagtatatagttcagtagtgttaactgttttcacattgttgtgcggccgatctctggaactttttcatcttgcaaaactgaaactttatacccactgaacaacaactgtccatttcttcctactcccagcccctggcaactgccattctttctgtttctataaatttgactttcctaggtacctcataataaatggaatcatacagtatttgtctttttgtgactgcttatttcaattaacataatgtcttcaagattcatctatgttgtggcatgtatcagaattccctaatttgtaaaaacagaataataatactcttttgtacctgtgtatcatattttctaaatgtattatccattcatctgtcaattgacctttaggttgcttctgccttttgactcttgtaaataaggccacaatgaacatgggtgaagtaccagtacttttgtctgggaaaaattatctcctatagagttggtt

SEQ ID NO: 4202 - DNA, 1026 bp, Homo sapiens
tgatttaacttgggagaaggcgggagaagtaatagaaataattaaatttcagcaactgatttccagcataatcctaactcatcaaggtcagctgcattttgaacttttttgtattctgcctttgaaaataagtcctatattttatactgtattgctacaaatcagaaatcgcttaagtggtttatggagaaacctacattacctcttttcaaatagttttgaaatgggtacgagaaattgaagtttaatttcagttacatcagtttccagagactcccaaattcccccactccccatcccccaagatatatgataggtattcccatgaggaccttctcctttcaaaaagtgatggtgatgtcttcacatctttcagtcttaaagagcataatgaccaaatttaaaactaaaggcattttatttgcaatataaaagtgtaggtggacactatttaaatcaggaaaagttctatgagtgaaaaacgtcaggctgtgcctcacttcttttgtcattgtcaaataatgtttgtcccatatatgttaacctatctttgttgtcatatcaaatttgtttctttcattcattcaacagtcatttaatgaatgtcttctatgtgccaggctctgtgctgggtgctggggatacaaagccagataaataaaaagttccttccctggaggaattttatggaaaagagtagttatgaagaaaggggggggttgtgacaggcaaatcagtctcgtcttttagaactctgtgatgtttaaaatttacacaagggatgcccttggagcagtgtgaagggacagctgtcactcagtaagtctttccataaatactaagccattccttttgccctttcaatatgtcgtattggaaaatcaaaaatgattcttcaactctgttcaaatggtatcttgcaagtcaccaatcagaattcttaattcctttgtatgttacaagattaaatcggtttataagatcataaaatacatatactattgaacatttttaaactaaaaaatg

SEQ ID NO: 4203 - DNA, 1038 bp, Homo sapiens
tgtagtggtgtctttttttttttttttagacaagagttttgcttttgttgcccaagcaggagtgcaatggcacaatctcggctcaccacaacctctgcctcctgggttcaagctattctcatgtctcagcctcccgagtagctgggattacaggcatgcaccaccacgcccagccaattttgtatttttagaagaggcggggtttctccgtgttggtcaggctggtcccgaactcccaacctcaggtgatctgcctgccttggcctcccaaagtgctgggattacaggcatgagccactgtgcctggccgcagtggtgtctttgttgtggttttaatttgtatttcccaatacctaatgatgtggatcatcttttcatgtgcttattcaccattcttatatcctatttgatgaagcatcagttcatgtcttttgcctacttttaaattggattgtttccatatggtgaaattttgagtgtttattacatattctggataaaaccttttgtaagatatatgacctgcaaatattttcttcccatttgtagcttgtcctttcattcccttaaccatttttgataaagcaaacgttttaaattttgattaaatccagtttatgttttcttacatagattatgcttctgttgccatgtctaagatcccatcacaaattcaacagactcaatatttgtatgaagtgagttttagatccacactcatttttttttttcatgtaaatgtttagttacaacatcttgataagaagactgttcttccattgaattgtttctgcaccattgtaaaaatcattaagccctatttatgtaggtttctttctgaactcttgctgttctattgatctgtgcatctctcccttctatgatactatgctgtcttaattactttagctttatggtaagtcttaaaaacaggtggtgtggttcctttaacattcttttttcaaagttgttttagctattctagttcctttgcctttccatataaacgttagaatgagcttgttgacatatacaaaa

SEQ ID NO: 4204 - DNA, 1020 bp, Homo sapiens
catttcccctactggctctcattctcactcttgccgccctgtgaagaggtgccttccaccgtgattgttaagtttcctgaggccttcccagccatgtggaactgtgagtcgaaaattaaacctcttttataattacccagtctcgggtatttcttcatagcagtgtgagaatggattaatacctggatgcatgcatgtttgtgtaacaaacaggtcttttggcttatctagtaagtataaaacaagtgaccaaaaagaagttgactcaacaatgcttggtttcttgtggcagtgagttttttccctatgatatcatcagttgttgctgctattttggcaaattttcaggatgtacacataaagcagaccaggctggaaagcttgtggatagacatccactgacagaatcatttaagagcagtttttatttatgaaaccaatttatacaaggtggttgttaacagaatataacttagaggtaactggaatttgaatcacttgaatctgttttaaagggtaaaaaatgttatgagtgccaagaaaagcaaataaaagattagtaaatgttcacaaaatatgtttataattttcttctttttaaaaaagttagctgtccctactgcatgaggagttgtcctgacagcagctggtattagtgtatataaacaaaggtagaaagattacatttccatccagcagtctgacttaaagctcagctgagcacatgccacaaaatgacattcttctgaattcactgtcttggttagctgacatcctaattacgtggctcatactctgctgtattttggaggttataagattgtttaattataaatgttcagccagccttgtacagttgctgtttggttttaaatagcatctttcacatccaagcagacaaatggaaaacttgctgactacaaaataaaatttttaaaaatgtaagttttaaggcaacaatggattagtcaagatatgccatataacttaattcagttaatatgccattgtatatgtgcg

SEQ ID NO: 4205 - DNA, 1064 bp, Homo sapiens
taatagctggcctttttctctttactttttggactagcgcttatggaagaaaaaataacctaaatctgtggttctcagacttagtatttattagaatcacctagagggcttgtaagacaggttgctgggcttcatattcagactttctgatatagtagatctgggatggggtctgagaatttgtatttgtaacaaagtctcaggtgatactgaagctattgctacaggtaccatactttgagaattaccaacctagacaaattaaaaacttagaaagtgaaagaactgtgttgtcttttttttggcatggcaggattggaagagtaggtttttaattcccagtatacacttgttaaatgtaggatgttgagaggttatcttgccatgctctcttgctcaattttttaaaagggagataagaaccactgtgaaaaggcattctgtcatctccatgaaagagctttccatgagttcaaaaacagccatcaagttattgaacagagtagattaaagagtagcagtatgaaatttctaacctagaaatagacagacttttcagctatcaatttatcaaccccctttgaactattctgttgtttttgttattttctaaagaaacaacatgcagagttcagaatcaaccactgagtattgttcattacctttgtagtttattagccaacagaaaatttttgtttatcactatgatggtaaaaattgttgtataactatctaacactccttcatacacacagacattcacacacacagccagttgatacacactatcttacagacttgccataaaataaaattctctaccacaaactccatattcctgatgaaaattttccttgtaaaataaaaagtgtattagaggcttccaagttagacatctttaaagagaatagtgatccattcattcaacaaatactgttaacctacttatttttctaagtgcctttggatacagtgataaacttgaccaatagggtccttgctctcaaagagattctattttagtgggcagaagagacaacatcaataaaatgataaatattaga

SEQ ID NO: 4206 - DNA, 1539 bp, Homo sapiens
aggcctcagattactttaaaatcttatagaaggaattaagaactgctacttgaattggccatgcatttaaataaaagttgtgtgtaaagaccaactttgatatatacatatatgtggagagagagagaaaataagtcttgctctgttgcccaggctggggtgcaatggtatgatcatggctcactgcagcctcagcctcctgggctcaagtatcctcccacctcaacctctcgagtagctgagactacaggtgggtgccatcatgcccagctaattttttgtattttttgtagagacagggttttgccacattgcccaggctggtcacaagttcctggactctagtgatctgcccacctcggcctcctaaagtgctgggattgtataggcacaagcaaccacacccagcctaaggccagctttgatttaaaaaacatttttttttctcattttttcactcttaggatagaaccaaaatatctaagctcgaaatgatggaaatgtgcgtctctaatcagtgattaaggaaaagtaaaaggaacttaacaccttcaagaaaagacagacaaataacaaaacagcagtttgatagaatgagatatcaggggatggcatagaggaaagtttggttatagttttatctttgttacatgttaatgtgaccttggacaagtcctttaactttagtgtcttttttaaatggggtaaaaaacatctactttaggtgttcagcataattcttagcataggttcttaactatggtatatggcacaaaactgttcagaaatagaaattgtcaatgttcacatttccaaacttctctgaacctcagtttcttcatttgtcaagtggcaattaccagttggagggttatgtagtgttttattgagatgatgtatatgaaagtgctttgtaaattttcagtgctagctaaatgttaattttggctgctgttattttgtaaagtatttttttccaaagacaaaacttctggagttactacttacagagtcaagacctgaagctggacccagccttacctacagtaaattatgtgtactttgttaaggtgctggaatatctgtttcttcacagtaataagtactgacatttatagaacagttacagaacagttactgtgcactgttttaaatgctttacatgtagattaggattattattctaattactgttcattttgcagggatagagaagttaacaaacttgcctaagttcatgcagatagtgaatgatagagccaggagatgaaccaaagcagtcctgagttgaagtctgccactctttttattattattattatttattatgtttttttattttgagacggagtcttgctatgttgcctaggctggaatgcagtggtgcgatctcggccccctgcaacctctgcctctcgggttcaagcaattcttctgtcacagccttctgagtagctgggattacaggcgtgtgccattgcgcccggctaatttttgtatttttagtaggatgagatttcaccatgttggccaggctgg

SEQ ID NO: 4207 - DNA, 1007 bp, Homo sapiens
atactttgttttggaaaatttaaatgctgcagatttgtgtagagttctaataccaaagacagaagtaaatgttttccatatactttgtcttgcctgtatgcagccctcgtgtaatacggtgaattagagtggtatttcactttgtattattttgtaaatatgtcaatataataaatagtgactaaattgatttctaagagttggagtctttttattgaatgatccctgtattagtcagggttcccctgaaaatggatggcactggattgttgggcctgtaccaggccatcgccagcagtccagagtgaacagaagcagtgtatgtgtggaggtcaccacccccccgcccgccagccccgtggacgctatgcgtctagtaggagggccgctgcggtgagtcttgaagcccagggctgggcccgggcagagccgccgcaggtgcagatgttggtggtagtagcacatattctaaagagaacttcaaaggccgaagtggagaagggttccatgtgaacagcagttggacatgggtcattcggtcctgagaaataggtgagcgccattctgaatggacaggcgatggcctctgttgccctcagccaatcgaaagggagtccggttcagatcccgaatccggagtggcggagatggacactgccaagcgtccagcacagtaatgcgaaggatcccagagaagccaatggaagccccggggagagttcttttctccttgtgaagggcagggcgccctggaattgggttcgcctggagagaggggtccgcgccttggaaagcgtcgcgcttccagcggcatctggtgagctctggagggcccttgaaagtgcgggggagagggtgtaaatctcgcgcccggctgtacccatatccacagcattcctccctctggaactaagacctctaggccagcacaacagaatgtcgcgggaacaggaagcaaaaattttgctagtggatcacttagggtgatggtgagtggtgccacttcc

SEQ ID NO: 4208 - DNA, 1094 bp, Homo sapiens
tctgtttgggtggtgtctgggaatctccttaataagtcactgctatccacaaatatcactaggaccctttcatgacaagagtattaactttggaagaattctgtggctgtcaagtcaagcagttacctgaacagaggcagaatatattggaagatgatgtgaactcattcccagttgtcttagctcacttttacctcatgcttggctgtagaaaactttttgtcacagttcagattaggccatggtacaagtaacagcaacccaaaaaccttaaataggcttcaagaagataattatttctctttcccaaaaaatcctagaaatactccagggctggagggcagggctggtcatctctgttccaggaaatctttagcgatccagtttctttcaggctcatgctccaccatcctgaaggggaggctttcctcctcatgaaccaagatagtagctttcatattccagacagcaggatagaatgaagagccaaaaagaaaggcaaaggcgtgtgtccactgtattgttaggaaaggtcccagaagctgtctcatgacacttttgtttatattccattggccagaacttggttgtatggctataccgaactgcaagggaggctgagaaatgtagccttctctctaggcaaacatagcccaatgcataatctaagacatgaaagaaggggagaataaatactgggagaaagtatacaaccacaccttccttttccattgcagtggcaccatagtatcagcaggtcaatttatatagctgcctgcggaggtgcctgaagcagagtggcagttgcacagtagtgcagcagtcgctaagagcaggtaccctggagtcacatcacttaggtttgagtccagatttttctcatatgtaaaggggaaataatattagtaccttcctcttagagctgtgacaattaagtgaaatactgagtatggcactttcagcatggtacctaagacttcaaaaccatttgataaatgtgattagctcttatattaaaagtaaaatgaaagttttagagcatccatagacatgtaacttttctgtacatctctacaatgtggaggatgtattta

SEQ ID NO: 4209 - DNA, 1053 bp, Homo sapiens
aatagtttttgttactgtggacaataatagaagtaattgatgattgtcacttgcatggcttgaaggccttctctgaacttctacgctgagttaaatgctcccctcattgctctcaacatgcacatcccctgtgcttccttttttttttgtgatgctttccagtgttgttattatttgtatagtgtctaattttcctactagaccacatgcttcatgagggcaggagctctttctgttttcttcacaactcaattgcccggacctagtaagtccacagcacatataatgagtgctcactaaagatgcattgcagtaaatttgacattcattcactaatcaaagacttactggattcctgtagatgtcagggactgagctaggctctgggtttgcactggagaataaaacacagcccctgtccacagggtgctcatcaactagcaaaatgtgctaaatttgccttatttaactgacatttatatatggcttaaagtttctagattttttttaagcctcaaaataactctgtgaagaggtattgtttccctctatagatgaggacatcgaggaacagatcaagtaacttactcagtttcacataggattgggacctgcctctgtctggtctccaaatccttcacctgagacctgtgctacttccagccagtaaatcacatgggggtgatagtcataacttgcacctggtttatcagaaattaaatttgtttctcttggctcatgtgtttttgggtttgcattaaaagctggggcaaggaattatgatgtggaaatgagcccactactgattgaggcttttgcatctcattaaacctttaatagtcttattttctttgagactcttttcccattaccacaatttttcatggtgataattttgtttgactttggaaactgactagtctacattttgggcctattggattaagtttaaaaatcttttcttggtatttgggttctccatagtctgaaaaacttctgctccttttaacccctcactattcaagtgagtccctagttgggcctacagataca

SEQ ID NO: 4210 - DNA, 1097 bp, Homo sapiens
atgggcataaatttttctccttcagcactttaaatatgtcatgtcactccctcatggcctgtaaaatttccactgaaaagtctactgccggttgtactggaattccattatgtgttatttgtttcttttttctttctactttttggatcctttctttatctttgatttttgggagtttgattttcaaataccttgaggtagtcttctttgggttaaatctgcttagtgttttagaaccttattatacttggatatcgatatctttctctacattgggaagttctgttttattatccctttgaataaactttcttccttatctctttctctacctactctttaaggccaataactcttaggtttccctttcgagctgttttctacatcctctaggcatgcttcattgttgtttattcttttttttcttttgcctcctctgactgtgtattttcagctagcctgctgtcaagctcactaattctgcttaaacaattctgataaagactgttgcattcttcagtgtgtcattgcatttttaaacttcataatttcgacttaacctttgaaaattatttcaatccctttgttaaatttatctgatagaattctgaattccttctttgtgttatcttgaatttctttgaatttcctcaaaacagctattttaaattctctgtctgaaaggtcacatatctctgtttctccaggattggtccttggtgcctaatttagttcattaggtgaggtcatgttttcctggatggtcttggtgcttgtggatgtttgtctgtggctgggtattgaagagttaggtattgtagccttcacagtatgggcttgtttgtacctatctttcttccaaaggctttccagttccaaaaggacttgggtgttgtgatctaggctgtatctgcattaggaggcaccccaaacccagtaatgctgtggttcttgtagagttgtagaggcaccgccttgatggtctttgataagatctggaagcattctctggaccaccaggctgaggcttttgttctcttcccttactttatcccaaatagagtttctctttctgttctgagccacctggagctggg

SEQ ID NO: 4211 - DNA, 1035 bp, Homo sapiens
atcctctgatcttctcatggtatagggctttcctcacagttcttttggaactcttagaactctataacttcgcttgtctatggcaaacttttcttctctgttgtagtcatctttgtgcagatgttttatttagattcattgaatataagacttggaatattgtggctttcaaaaatgatataattggcacatttgaatctgtcgatttgtctgttggcaatttcatatgtgtaacactctacccagaattgggagacctgcattccacatgactccattgctgataaactcagtgatctctaagtctccattttctctgtgatcaccagtgggtggcattttatagcaaaaaggttataggctctagagttcaaattttggatctgctgctaattagctggatgatctagggcaggctcttttccctctgggttcccttggcttcctctggaggacaccactgtctgtgctgtaggctgctgtcatgatttgataagataaagtatgacaaattcctgcctcagagctttgaatgttgtaaactcttaataaaagagtggcaaaacaccttccactaaatactattatggttggtgttattaatgtctatttcccttgggtagttgagggatccagtaatagaacataactattatagctgaagaattttagaagacactgagcaatttcttcaaggtcacataggaagtgataatggaatagcatgtagttgtgaaaatgaggaatagtccatcttattaatatgctccttatttgtggaatcagttatttggattattttcagtccttctcttttatggatagcatgactgtccatgtccttgtgcagattattttccccctttggattttttccttcagctttgttttccaatgcgaaatttctaggtcaatggtcataaacatttttgtagctcctgttaacatattgccagatagtgtgcagagaaacagttctagtggacaaaaagcacagatttccaaagtcttggttaaaaacaaagacttgagtgg

SEQ ID NO: 4212 - DNA, 1030 bp, Homo sapiens
ggttagagtgaatgggcatggctaaagtttggtaggtgggtaatgcttttctggatacatagttaattttgctcatgtgtacattataccactaatgtcacaaaatggatttatttatgtgtgtgcatggctcaaggtatttctctcctgtctttctttttttaggttgaatttatgtgtgtatatatatatatatataaagttttgttataagttcggggcacatgtgcaggtttgttacataggtaaacgtgtgtcatgggggtttattgtgcagattatttcatcacccaggtattaagcctagtacccattagtgatttttcttgatcctttccctcttctcatcctgcactgtctgataggccccagtgtgtgtggttcccctccgtgtgcccatgtgatctcatcatttagccctcacttataagtgagaacatgtggcatttggttttctgttcctgcgttagtttgctaaggataatggcctccagcgctatccatgtctctgcaaaagacatgatctcattctgcatagtattccacagtgtatatgtaccacattttctgtatccagtctatcactgatggacatttaggttgattccatgcctttgctattgtgaatagtgctgtagtgaacatatgtgtacgtgtgtctttatactagaacagtttatattcctttgggtgtatatcctgcaatgggattgctgggtcaaatggtatttctgtctttaggtctttgaggcatcaccacactgtcttccacaaatgttgaactaatttacactcccaccaacagtgtataagtgtttctttttctccataatcttgtcagcatgtttttttttttgactttttgataatagccattctgactgatatgagatagtatctcattatggttttgatttgcatttctctgaagatcagtaatgttgagctttttttcatatgcttgttgactgcatgtatgtcttcttttgagaattgtctactcatgttttttgcccactttttaatggtg

SEQ ID NO: 4213 - DNA, 1036 bp, Homo sapiens
gtatcccttaaattattgtagctattattacttttaatagttttctctttcctactacagatgtaagtgatttgcataccatcattacagtattattttgaatttacctgtgtactttcttttatcagccagttttatactttcagatgtttttgtgttactcattagcatctttttctttcagcttgaggagctccttttacgtttcttataaaataggtgcggtcatgattatctccctcagctattgtttgtctgggaaagtatctctccttcatttctgaaggacactttgctgggtacattacccttggttggtatttttctccttgaacgctttaaatatatcatccctttctctcctgacctgttaggtctctgctgaccagtctgtttccaaccatattgggactgtcttatatgttatttgcttcttatcttttgctgttttcaggatcctctcattgtctttgatttttgatagtttgattgtaatatgtcttggggtagtcttgtttggattgaatctgattagagaccttggacttttcctgcatgtagatatttacctctttctccaggtttggaaaattttctgttactgtttctttaattaagctttttaccccttttatcttccttttctccttcttcaactcctgtgactcaaaactttgctcttttgatgctgttccataaatcttgtaagctttcttcattcattttcattcttttttctcctctgtgtattttcaaataacctgtctttgagttcatagtttctttcttcttcttgatcacttctgcagttgatgctcccatattgcattttaattttgttcattgtatttttcagccccatgatttctgtttgattttttcttttattatttcatctctttattacctttctctttgtggtcactcgttattttcctaatttcattgaattgtttctttgtattttcttgaagtttgctgagctttctttgaattctatgtcagttcatacatctctgtttctttagggatggtc

SEQ ID NO: 4214 - DNA, 1026 bp, Homo sapiens
tttaagtccctgcttttaattctttgggtatacatccagaagaattgctggtttaaagttttttgagggaccaccatactgttttccataggggctgccccattttacattcccaacaatgcaaaagggttctaatttctccacatcattgccaacacttgttatttttttgtttttgttttttgtttttgatagttgccatcctaatgagtaagaggtgatacctcactgtggttttgatttgcatttccctaatgataagtgatgctgtataccttttcttgtgcttctggccatttgtataacttctttggagaaatgtctattcaagtcctttgtccagtttttactgggttgtttggtgtttttgttgttgagttgtaggagttctttacttattcttgatatcaatctcttatgaaatatatgacttgcaaatattttctcccattctatgagttgcctttccactcttggcctaatacattgtaaatacaaacaaattcttggatttattggagactctaatatcctcatcactaaaggccctaacaaagactgtagttacctttccagcctattccctttcccagccaaggctatatgaggtactgtagtttttcaagggttgtgtagcagttcttggcttggacctccaggtgagaaatctaaactctatttctctgttacgtaataaagaggtcacataagataatgaaaaagtcttggatgaatcggcaggaatcttgaattttagacttgctctatcacttactactagtataatgttgggtaaatcatttgccttttctgatctttatttatttgcaaagtagaatcctaataattgccctcattgcctcacaaatcctgtggaagcctttaaagatgggtgggcaatactcttctgatatgatccagcagtcatgctcctcagtgtttaaccaaatgaggtgaaagcttatgtctacacagaaacatgcacacacaaatgtatggcaactttattcataattgccaaaactt

SEQ ID NO: 4215 - DNA, 1028 bp, Homo sapiens
ccagagtacttcagatgacccacttggacgttattcagatttgactatatttctctatttaatgctcactcaaaatgtaactataagatatgtgactagatttcagaaattgaacaaactgtttttcttacataatttctcagaccaggttgtgtaggacagtgttttttattccaagccctggatacaaatcatttagtaaactaacagttaagtgctgctggcaagtcttggtctatggtacaagaagtcttttggtagctgaaatagaaaaatataagtaacctattttagtcctttctaactcagccaggccttagcctcagccttagccatatgtttctcttcagtctgtcttcgtttttcttttttaatccagatatgaagcattgacgttttatatataatcataaggtatgtataacgacctttcttcctcatttttatttttaaaagttatatttaggctgggcacagtagctcatgcctggaataccagcactttgggaggctaaggcaggaggatcacttgaggccaggagctcaagaccagcctggacaacacagcaagacctcatctccacaaaaaataaaaataattagccaggcatggtggtgtgtgcctgtagtcccagttacttgggaggctgaggtaggaggatcacttgagcccaagagtagaggacaaggctgcactgactacgatcatggcctggcactccagcttggctaacagcaagatctcgtctcaaataaattaataaaatcagattttatttttatatattttttagacatagggtctaactatgttgcccatgctggagtgcagtggctattcacaaacgcgatcattgcacactatagtctcaaactcctgacctcaagcgatcctcccacttcagcctcccaagtagctgagattacaggcatgcaccaccacacctggctcacagtcacattttccacaacagatttttcaaagaaaactagggaggtagtataatatagttagtagaaagcacatt

SEQ ID NO: 4216 - DNA, 1044 bp, Homo sapiens
ctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagtt

SEQ ID NO: 4217 - DNA, 1042 bp, Homo sapiens
caactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaactttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtga

SEQ ID NO: 4218 - DNA, 1041 bp, Homo sapiens
atgaactggaaatagctactctttacaaataatatgttttcctataatcctagcactttgggaggctgaggcgggcggatcacttgaggtcaggagttcaagaccagcctggccaacatgatgaaaccccgtctctactaaaaatacaaaaattagctgggcgtggtagcgggcacctttaatcccagctactcgggaagctgaggcaggagaatcgcttgaacccgggaggtggtggttgcagtgagccgagattgtgccaccgcacaccagcgtgggtgacagggcgagactccgtctcaggaaaaaaagagaaaaaatagtaataataatatgtttttttttaattaaaaatttataacagtctggtttggatgaatggtaaagacactctttgaatgaaggtcttttggatgtgtaggcctaaccttcataggtaacggcctctcctggttcccttttggtgttgggcagctagcttttgcacagcatcaggctgaagtcgccaagatggagccattaaacaatgtgtgtgccaaaaagatggactggactggaagtatctggggtaaggtgtttgtgcacttgtccttattttgaatagaaattctgagaatgaaagaacatagaacaaagagaatgataaaataacaggaggctttccatgactgaatctttaatatcagaagaacatgcaagaagcattttaggtttaaaaccagtgactttttatgctcatctaaagtcacagggaaggaatagaagttgtatatatgttggctctgatattatctgtcttccttcataagactgtgtgaaggatcctatgctcgcttttgttcatctcgttctttgcacagggtctggcatattctcaatagaagtttattaaacaagtgaatgaatgtatatatgaattaatatccatcttaaatttaatggccttatattgacttgtgaaattttatgttgtagctttacttttttttaactacgggaaaaattagtttttttattctttcacattttataaacattctc

SEQ ID NO: 4219 - DNA, 1034 bp, Homo sapiens
cagcagtcgtaacccagatggatactaagtgactggagtgtgacacctacagtgtggacatcgtcccatgtgggatggaacaggacaggaagagagttcctcacactatccagagctgtgcataattgaaaacttaggaactgtttacttctggaattttccatttaatattttcagactgcagttgactgtgggtaactgaaacctcagaaagcaaaaccgtagatggggttaccactgtagagttactgtgttaccttgatccaaaacctttacctgaatgattcctttaaccattcccggtaggctttctctgttaaagctgctgtaccaaatccaggggtcagtttgctgccctctgatcgcctgacctcttagcggcattcaacatatttgtctgctctctcctttcttcacttggcttctgaaattccaacctctcttggttttcttcctgcctcatagcactcactagaattatctcttgctggttcctcctcttctttctgatccccgaatgttggcttgcccaggactcagtcttttgtcctcataataaatcttctggtgatcttacccagatcatctcttttaaaccccgtctacattctgatcgttctcaaatgtagtcccactgctctccttagcttcatcctgcatatttataatctctacttggacatcagtggacacttcagatttactatatccaaacaaaactcttgatctttcagaacttgcagtcttcttcagtcttttcccttctcccagttgccctggccacaaacatagaaatcgtcccaaatcttcacttgtccttaccgacatccaaattttcagcaatttctatagtgtatttctgtattagagtagcaagagatgttataagaaataaacccctatatctcagtatatgccataaatgaaattaatttttgctcacatgaaagtgaaaagctatattcccacttagtgggtggccttccaggtggtcatttaggggcccaggtgcctgcatagtttggctgccctcc

SEQ ID NO: 4220 - DNA, 2086 bp, Homo sapiens
caatcaacgaggccaatcagcggcccgcaacgggggagggacacgcagccgtcagccgaacaattcgatgacgaggcccaggaagcacgctgaaaccctgggcggcggcaagctgtgcgacctcttctgcggccggcctgggcaggtgtcttcctcgagaggcaggcaggggatcccggacgtgagtccgtgcagttgggtgtgttgtgcggcgggtggggcgggttacccgccgttacgccctggcgggtccagcggactcgcggcgcagacgctggggaggccgcaggcgcgacccggggcggggaccgtgctagctgcgtgcgtccgctgcggcctgtgggtgccccgggctcctacctcagctcccgcgccggcggctgcctgtccgccgcggttgcgcgcgttccggggaggtgcttggcccagagagcggcctacggagaaggcacagcgagggcaaagcgagacctgagcgcacgttgaattctgttggctttggttatctctgaaaactttaagcataatttgaataaatgctgtcagcagaatagctcggatttagttgtagttaattttctaaaacttcaaatctgtgaattaacacagttaacaacaacaacaaaaacggacacaaaacaacctccaaaatggattttttttttttttttgagacggagtcttgctgtgtcacccaggctggagtgcggtggtgctatctccgctcacggcaacctccgccttccgggttccagcgattctcctgcctcagccacctgagtagatgggaccacaggtgcgcgccaccaggcccggctaatttgtaaattttatttgtagagaaggggtctccctgtgttgtccaggcttgtctctgactcctgggctcaaaggatcttcccatcttggcctcccaaagtgctgggattacaagcgtgagccattgcgcctggctccaaatctgatttgagtgtaaaaagttagacacaccataagctgtaggtttattactgggtggtgaaaaacaattcaggttttctttataatagtgattatgaagtgttcttcccagactagctttatcgtcatctgggaaattgttaaaaatgcaaattcgcaagtttgagagccatggttccaagaaactgcataagcatacgaaataagttgcagcctcccgacttataccctggtacttctagtctaaaacaggatttgactctactaatccaggttagtcttgcctttcccattactcatgtgctttcgttgaaaccaaagactttttcttttgtgcccatttctactcactgcctggccgtctgcacgacgatctgtgtttcctggtagttctccagtctagtagctactataaactactctccctatttcccgctctgtggagatgtcgttccaacaggtcctctccactctaagaccctatcctctcagagaagcccctgagagccattagtacttttgccctggagaggcagtttaggtagagccagtctgggttctaccacttactagcttggtggtcttaggcaagttactttgtgtgatctgtaaaatgaagatgagtgaagataagagtactacttccagtagttttgtgaggattaaattaatgtaacagtgcttagcacatagtaacaaaatattagctacttttttttttttagacggagttttgctcttgttgcccaggctggagtgcaatggcgcgatctcggctcaccgcaacctgcactctctgggttcaagcaattctcctgccccagcctcccgagtagctgggattacaggcatgcgccaccacgccctgctacttttgtatttttagtagagacagggtttctccatggtggtcaggctgggctggagctcccaacctcaggtgatgcgcccgccttggcctcccaaggtgctgggattacaagcgtgagccaccgtgcccggcctttagctactattatacatattataatttaaaaattattagtaccgaagcctgagacaggagagaaatggtaaaaatagtagggactgcgggagagagaaagagtagtgtcccctgacaagt

SEQ ID NO: 4221 - DNA, 1054 bp, Homo sapiens
aggactatcctggacatcatgttgaaaacttgtctctacagaaaaatacaaaaatattagccaagcatggtggcgtgtgcctgtagtcacagctacttgggaggctgaggtgggaggatcaattgagcccaggaggttgaggctgcagtgagccttgattgcaccactgtactccagcctgggtgacagcaagatatcctatctcaaaaaaaaaattttttttttcagtgattactatgtgctaacaccatgctacaatatgattgaactgctatggtgaacaagaagataaaacatgaaagaaagggagtgtgtaatattttaaaaggatatctttccacttgaacagagacacttaaaatggagaaaaatcatttgaaatatgtaagcttgaaatgcatgtatttcaggcatggactggcactggaattggagtctgatgacctgagttcaagttcaagctctattttctagctatgcaatcttaggaaaatgacttgttttttgagtctgttacctctttgtgaaatgggtcttataaactgtttcacaggttattgtgcaagttaaatgagataatgcatatggaagttctgtatacgttgcaaaattaaatgaaatgttactttttgaaggttattttattctttatacagttaatagctcttacaaattcttctttgtggacataaaaggggacttcctgtggccattagtaattcatagcacagtctggtagccaaaaaactcctcagtcttttgtttttgaaacggagtctagctcttattgcccaggctggactgcaatggcgcgatctcggctcaccacaacctccgcctcccgggttcaagtgattctcctgcctcagcctctcgagtagctgggattacaggcatgctccaccatgccggctaattttgtatttttagtagagacggggtttttccatgttggtcaggttcgtctcatactcccgacctcaggtgatctgccaccctcggcctcccaaagtgctgggattacagatgtgagccactgtgcccagcccaaaga

SEQ ID NO: 4222 - DNA, 1085 bp, Homo sapiens
aaaggacattggtggaaaaacttgtaaaatctgaatgaagtctgtacctgtaccgatgttaatttcttagctttgatgactccctatggttgtataacatgttaacataaggggaagctggatatagggcatatgggaaccctgtactatttttgcaactcagctgtaaatctaaaattatcttttttttaaaaaggcaaaaaaaagtacagaatccaaaacagaacgataggaactattggctcctgtgtttgtttttttactcctgtttctggacctaaagactcttgccagtgtaaaaccctagggatatgtctatctcaggctggtttccaagtcacccttttcttctgtaggcctggtctactttcttctctttgtacttctactagtttttacttcttctaaatagaggaattattcttaatttactcatttcttcctttagaagtattctatgagtatcttttttaaaaaaaaaaacttaggtacaataaattgtgcaagtcttaagtgaacagcttgctgaattttatgtatgctatacagtcggctctctatgtcatgggttctgcatccatggattcaaccaacctcagatggaaaatattcagaaaaaaaaactgtgcctctattgaatatgtatagacttttttccttgtcactattccctaaacagtatagtataacaactatttacatagcatttacattgtattaggtattgtaagtaacctagagatgatttaaaatatacataggatgtatttagcttatatgcaaatactatgccattttatatctgggatttgagcatctgcagattttggtatccacgggaggtcctggaaccaagctcccaaggatactaagggacaactgtatacatgtgcgcacacacacacacacacactcacacacttgtaatcactactaagatcaagatacagaacacttccagcatttgacagcatttcttaccatttacatatacccctttgataatctgataaaagttataattattcccagaaaaatgcccatgtacagataatgtataaaatttttccgtatgatttcagggt

SEQ ID NO: 4223 - DNA, 1025 bp, Homo sapiens
caagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttatattctctgtatatctggaagtcgatcctgctcctatttctttctctttttttagacagaatcttgctctgtcacccaggctggagtttaatggcgcgatctgggctcactgcaacttccaccttctgggttcaagcaattctcctttctcagcctcccgagtagctgagattacaggcgcctgccacccacgtccggctaattttttgtatttctagtagagacggggtttcaccatgttggccaggctggtctcaaactcctaacctcaggtgatccacccgcctcagcctcccaaagtgctgggattacaggtgtgagccaccgcacccagcccctgctccaatttctctttttttttttttttttttttttgagacggagttttgttcttggtgcccaggctggagcacaatggtgcgatctcagctcactgcaatctctgtctcccgggttc

SEQ ID NO: 4224 - DNA, 1631 bp, Homo sapiens
gcagaaactgcccctcccctcattgagggtcactgctcaagagtgcaggagtggactctccactgatgggtctccctccccatcctggtttccaccccgggctggctagctctgttggtttgaagactgacagccagcctggctcattctcattattggctagttagctttctttatcaacctgctcactcacaaatgtgtgccctcagccagagagtaagaaagcccaaatctgttacagcttctaaaaaaatagatttctaatttgtcctactcatgttaggagcattatctttgaaggtaaaacatagtgtatcattgtgtaaactcccaggcttgatgtagcagaagagatcatttctggaggcttcagcaatggaatttagcattataagagagattggacaaaccagtccaaagtggtccgagttcttaaatccaggtagggaactcactcttctttcttctctggacctaattgggcattgggctttagtgagaccacagaccaggcccgtctctcctgtaggcttttaattcaatggcaactctatttcaaagaataaaagcctttggagagttgcggcagttctgggggcgggctcaggagagtccatagatcagccgtaactggaacgtagaatctacgtctgcctctgaatggacttcccacctcctctctcttgctctgatgcttgcctctgggcctctccatgcccaaggtggtctttcatccttgacaggctggtaatgtgctggccacctccagctcctgcatcgagtctgtaaaccagagctggttctcatggccttcgtcacgataccaggatacggaggggagcccagggccatccatacccaccccagggtaacggggctggcctggcattagtcattatttagtttccaggccaaccatccagatagagattccctctttcctttgagcagtgctctcaagagctccgtgcctgtccacaatgacctagagtgcatcctgctcattgtcagtgtagcccctcgcccctatattcatccaggatacttggaagtgctaaaataggaagggattcggctttcaactttgctaccatcttccctgaagcaggaaaatgaacatggacttaaatgttctttgaaaaaaccaaagttttaagatttgctgtgtgatgaagtgacagggagggccggagtcagcaggtgccagactttctgttctgtctgccatgggtttgtccagctcaggtagctctaggagcaccatcctgccctagcagagcccaggccttgccctcatgaagcatcattgaaatagcaggagcatgttgatttcttggttaggttgcattataataacaagagtcagaacattaattcgaaacaacttgcagtatgcatttcttcacaccagtacattcttaagtgtacttgtttataaggaataacataaactaatctgtacctttatatatatgtgtgtgtacatatatacatatataaactgtatagtgtacatggtaatgatttattgctatgccccagatccttaatgtagttctcatcctccgcatgccctcagccacaagcgggtgactgactgttccctgatgatttggcccacctcctgtgtt

SEQ ID NO: 4225 - DNA, 1055 bp, Homo sapiens
tttccttctcaccccttttttctgactttgccaagtaatttgttgacacgaaaattttggaggaaccaattgaaaacacacttccagtctagatgatgctttgtgtgatacattaagttcttattttggattaaaagaagttttccatttgatacctctctaaattaaataaattatagaatgtagttgggtggattttggggtggccatatagtaatggaaagctgcaataattagttttaatacagcttgaatatttgctatatagaaatatagtatggaaagtttttggtcttaatgtagctactgtgcgggtcacagtttctcccaatgattatgactgggacattctttggtagataccatttgctactagtttattttgtggctagaaagtcagttttgtgtgtttttttttttttttatttgaagtgccaaattaactttagtcagaatgtgagcagatggctaagttctctcctccccagaatggattaacagctgcgtggaaagtgggggagagagtggatggagacttttagagatgttaaaactgcagtagaatgaaatgagtcagggagcttcagttagaaaataaagttgaggcagtttttgtgaagataatatggttagggctggagtgcactagtctttttgcttattcattttgcatggttttaaaattaaaaataattccgaagatacaccagctcacaaatgaaaacgtcagcctctgccccaccctccctcctgcccaaagtgaatttggtactcagaaaagaactgtttataccactcacctttctcccagcatgtactcactgtgggcagatgcaccaatacatggtaatcctcttactcattttaagacgtaggaaactcaatattcttctctaaccatatacgatagggctcttcgcttttaatgatatctgggatttctgtggaacttggcaaattttcagagcaccttcactcacataatgtcatttgaacctcacaatgttcttgggatggagtcagttgttcagggtccccgtgtgtgtgataagcag

SEQ ID NO: 4226 - DNA, 1050 bp, Homo sapiens
aaatcttctttgcctggtaggtaccggaaaattccaggggacaaatgccagggtggggtaaatccagttcgagaagtaaaagacttgaaaaagaaatgcacaagcaactttttgagtccggaaaaacaggtatgttaaaataggtctagttttcaggtacaaatgggattttgtgttctgctaagaaaaatcaaagttaaagcatcaagagttttgttactgataaaaagtggtcaaactacttctctcaggcttcccttatacaggaagctgttagcatgaaggatgggtcatgtaacccagtgataagctcaccctactgaaagctcttttcttattgagggttgggggatgatattctgtaaagttgtaaaattcttaaaatcatacagttgtggaaatttctgaggctgagagtcatttaggaaaacaaaaaggttgtctgtgggctgggtacagtggctcacacctgtaatcccagcactttggaagtccaaggcaggcagatcactgaggtcaggagttcaagaccaggctgtccaacatggtgaaaccctgtctctgctaaaaatacaaaaattaaaattacaaaaattagctgggtgtggtggtttacgcctgtagtcccagttactcgggaggctgaggtaggagaatcatgtgaacctgggaggtggaggttgcagtgagccgagatcgtgctgctacactccaacctgggcaacagagcaagactccgtaccaaaaaaaaaaggttgtctgtgaagggccatgacctggaattgtgcatgtgtggaagagaagagcactgggcaataggtagggtggatctctgaccaagtcatgttaagtatgttcaaagtgaaaaattgagctatggtaatgggctggttttgatttaaatgaagcaagttacctgtcgggcatggtggcttactcctgtatagtcccagcactttgggaggctgaggtggggagatcagttgaggctatgaattggagagcagcctgggcaacatggagaaactccatctttacaaaaaaaataca

SEQ ID NO: 4227 - DNA, 1056 bp, Homo sapiens
gatttcattattgtgcaaacatcacagagtgtacttactcacacctggacagtatagcctgctacacaccacagctatatggtataacttcttgttcctaggcaacaaacctgtagagcatgttactgtactgaatactgtaggcagctgtaacacagtactaagtatctgtatatttaaacatagaaaaggcatggtaacaatatggtttcataatctggactcaccatcatataaacagtccattggtaaccaaaacatcttcatgcaacacataactatattctatcattgaagaccactgcagattacatttatctgtgtgcagaaatttgcagtgcacagcagtcttcattgatggatacttaaatttaatgaacattaagatttagcattttgtattgtgtaagagagctatacatagtattaaacctgtcagggttagacagctatggaatttttgcttttattttccagaatctaaacatggattcgaatacttctcaaagatattgttggaatgaacttttggaaaaagcttggaaactctgagagttgagattaagtttgtttgtttttcctagctgtatttcatgtactgagtgccttacagacttctgcctagggatggtaacttctatggggaaaaacttcaagaacttgctacagcttcatttacagctttttcataactactgtggattaatagattagttagaagcctttgggagcactttgcatagatctcaccttaaactaacctgaataataagggaatagttgattctgtaactaagtacagaggaatgacaggcttcagggtcgattcaattcagtgtcataggctctgcttctcggtattctgaaattaccttctctgtgctcccattgtgacagaatgacgatagcagtctttactgtgtgttcacatactgcatcattggggtttctcaaccttagtactcttgacattggggccaggtaattctttattattgtgggactgtcctgtgccttgtaggatgtttggcaacatcgctggccactacccactta

SEQ ID NO: 4228 - DNA, 1047 bp, Homo sapiens
aagagtttttgaggtgcatgcttgaaaaagcctacatagctgttaatgaaacttaaagatgattctggtgaaggctcagaaagaaaagaggagggctgtagagaaaaattccatcttagagaatacctaagtaatccatggtagaatattcgtaaaaatgtggaccacaaaggccattatgatgggtttctggcagaaatgaggaacttgttgttggacagtagagaaaaagcaatccttgttataaagtggcagacaactaggctgaattgtgttcatgttctagtgttttgtggaaagtagaacttgcaagcaatgaaattgcatatttagctaaaacaatatctaagtaaaatgttgaagttgcagcttggttcctcctgactgctcgtagtaaaatgtgggaaaagagaaatgacttaaagacagaattattaagcaagaagaaagcagtactaaaagatttggaaaattctcagtctatctaaattgcacagactgcaataataggatgtgaataattaggatgtggccaagtgaccatttgataaagagattagcataggtgtaaactaagaactcaatcagtcaccccaacaggaaaactgccagtttgaacccaatgagggaaggctttcagatttcaaggaccacagagctattcagttgcgtatgtgtaatcttctttaagacaaggccattcagggatcaccaaggctgcctcctcaatttcaaaagaagggaccatcacccaaagccatgggagaagggccacccagatccttgtgggcctaccccctttctggcaaggctgcagagcaagaacacaatcccagcgtgtctgggaagaggagggaccccctccccaatattggacctgtaggacagagcatagagccaaagagaattgttttcaagctttaatatctaggccaggcgcagtggctcatacttgtaatcccagcactttgggaggctgaggtggaaggattgcttggggccaggagttttgagaccagcctgggcaacatagtgagacccatctct

SEQ ID NO: 4229 - DNA, 1084 bp, Homo sapiens
acagtagttgaaccattttagatgaaaaacatcctatttggggagagaaaaatgcattttaaaatgtgtaactttgcttcagtaactctttcctgtggttaagaatgtttgctattataaattccctcctcacaaaattagctgggcatggtgtcacacacctgtggtcccagctacttgggagactgaggtaggagcatctcttgggtccgggaggttgaggctgcagtagctatgatcacatcactgcactccaggctgggtgacagagcaataccctttctcaaaaacataaaatatctcctcatgatagtttttcttaccaacctgtgtttcattataaaagcagtataatcatattataggacatttgaaaattttaaaggaaagaaaaaagttcaccatacagccacgtgtaatcttaatttgtttgcagtttattatcttgaccttcccctttgatgttgtatcatataattgtagagtattgggaggcaatgtggaatagcaaaatgttgccaagctttgttggcaagtaggctcaggattgaatcacagcactgtcattgcaaacagaatgaacttgggaaagtcatttaacctcctaagtcttttttgtcatctgtaaaaggacaataataatgcccacctcagagccgttgtgaggtatgctctgcagtgcctggcatggagtaatagcttggtgctgttagttgctgccatgccaatgatcagggatggcatgtagccagcaggtactggcattgctgtaccagttgttaaaatgaatttgaagccttcaggcagattgcctgcccccagatgcctccacgtcttctacaaatgcacactgcaccccctagcccctgccaacatgcaaatgttactaacacctggcattatgacctacatccatgctgatgggtcggtactcataccttcactctgctggtaacccctcatttttttagattgacataatttacttaatcattgttccattggatagttaggttgtagctgtttttttcgctgtaactaatactactgtgatcagtatcatacatatttgtgtcatagggga

SEQ ID NO: 4230 - DNA, 1031 bp, Homo sapiens
aagcatttttaggcgggaccggcacagcgttaagtctggggttatttttctttaccacagaggtaaatgtttctgagtactctacccaatttccttgaaataacgaggtttcctattatggttgctggtaacaggaattattcctgttcctgtgtgaggtctgaatattgttctctgccgtcctttcaggtaattatttccctggcctcaggtagtttcctcacatgcgtgtgctgatgggtgttcagctgaagacttggtggggtggctggggaggccccctgctcagatctccagaattttttttctgtgtaagtctttcttctctaatcttctgccctgtgaacctctttggcctccccagacgatatatcagcttcctctcttcagtttaggaagaactctggactctgcctgggtgcccctcccctgcactgtgcctgaaattctctccaggcagtaagccagttagctgtagggtcctccttgttcagttccttgtctttcaggaatcgtcgtcctttgtgcctggtgtccaatatcttggaaacagtcatttcatatattctgtcgttttgggtttttttttcttttcttttcttttttgagatggagtcttgccctgtcgcacaggctagagtgcagtggcgcaatcttgcctcactgcagcctccgcctctcgggttcaagcaattctctgcctcagcctcccgagtagctaccgcgcctggctaattttttgtatcttttttttttttttttgagacggagcctcgctctgtcgcccaggctggagtgcagtggcgcgctctcggctcactgcaagctccgcctcccaggttcacgccattctcctgcctcagcctccggagtagctgggactacaggtgcccgccaccacgcccggctaattttttgtatctttagtagagacggggtttcagtcgaactcctgacctcgtgatccgcctgtctcggcctcccaaagtactggggttacaggtgtgagccaccgcgcccggcccattctg

SEQ ID NO: 4231 - DNA, 1080 bp, Homo sapiens
ggacggtaagggatgagactggagaggtatggaccagcttgggaatgtccttttttagtatgctaagagtagacaggagcaaaggaagtaatgacgagtaaagataggtgggtttggcggtaaacctggagagatgtcccacatttccccagatttttcctagtgattgtaaagtcatctgccgagggtaggtgaatgcaacagtaaaattgagaatgggaaatatttggaaaagttgttatgagaagacagggaagagtaaaaggattgctgggccatattaaaatcgtagttgaggccagtaatcccagcactttgggaggccaaggcaggaagatcacgtgaggccagaagttcgagactagcctggccaacatagtgaaaccccgtctctactaaaaaaatacaaaaaattagctgggtgtggtggtgcgtgcctgtaatctcagctattcgggaggctgaggcatgagaattgcttgaacctgggcagtagaggttgcagtgagctgagattgcactccagctgcactccatcctgggcaacagcacgaaactctgtctcaaaaaataaataaataaaatttaaaggccaaccaaggctgtaattatatatcagtaattaaaccaatcagtacttaccaggatatttgttgaccacactcatgagaaaatggatggttggattaatccatggtaggggattgactagttaagaacagaagattagagaggactggagagtattgttggtgaatgtctcacccatagaaccagctttcataggctgctgtgaaaggtcagtctaagaaggactgacatttgggagccactgcgctagagcccatctgctttaagttcttagtccattagttgttccttggagctccagcctccctacatgaactgcttcccctaagaaaaggaaaatatccggccaggcgtggtggctcatgcctgtaatctcagcactttgggaggccgaggctggcggatcacgaggtcaggagattgagaccatcctggctaacagggtgaaaccccttctctactaaaaatacaaaaaaaattagccgggta

SEQ ID NO: 4232 - DNA, 1029 bp, Homo sapiens
tcagtaaagtggtgctggcagaagccagaattcagtgagttaaagaatgaggcctggcgaggtggctcacgcctgtaatcccagcactttgggaggccaaggcaggcagatcacttgaagccaggagttcgagaccagtctggccagcatggcaaaaccccgactctaccaaaaatacaaatactagccaggtgtggcggcacgcacctgtagttccagctactcgggaggctgaggcatcagaattgattgaacccaggatttggaagttgcagtgagctgagattgtgatactgcgctccaacctgggcgatagagcgagactctgtctcaaaaataaaataaaaagaatgaaagggagatgatgagtggagaaaacaatagtatgctgctttctcaagaagtttgattagtgtcagcagaagatagcattaaagaaaaggattgtgtcttttttaggatgtggaaaagtcttgaaaatataaacggagatgaaactagtgtatagaaaaatgttgaaagagttgggcgcagtggcctgtaatcccagcactttgggaggctgagacaggtggatcgcttgagggcaggagttcaagaccagcctgcccaacatggtgaaaccccatctctactaaaaatacaaaaattagccaggcgtggtggtggacgcctgtaatcccagctacttgggaagctgaggcatgagaatcacttgaacccgggaggtggaggttacagtgagccgagattgcaccactgcactccagcctgggcgacagaacgagactccgtcccgaaaaaaaaaaaagctgaaagaaataaaaggagaggttaggatagtgatggaaaagttatagaagaggtaaggcatggtacacatgaaggagttggttttgaaaagtaaaattcattcagcatcatattgagtacccattatatagcaggtattatgctagatgcccagggttacagacacagaaaatccaattcctattcaagtagtatactgtgtagtgcagggaacat

SEQ ID NO: 4233 - DNA, 1035 bp, Homo sapiens
tacaataaatgagtaaaggaaccagttgaggaaacacacagcactttctctctagggaccacaccaggtcaatgaaaggcactctgtagctctaactagatgccctctttcagctcctgggtccatttttctccaggaaacattatatgcagttacagaggtgaagctttcctccttcctctccttgctcagcttcttaatggtctttcattctgccaaggccaattgtcaggggaactgcggagatttacatagacaccacaaccaactccaggactatcccttggagacttgggagtgagcatttttataatacaaggaaatcagattacatttagataaatgaattttaggatgaatttactgcatgcaaaggacagaaaagcaaaccaaaatgaacaaggtagtcattgtaaggttctaagacagctcatggaaataaagtgcagccagtatcattttgaaaattgcatctgggaaatctgaactgttagggctcaaggtatcctctctctgtctctctctccccaacccctctttttctcttttcctctctcaccctaactgtaagatacctattcactttcccacacctccaatcatggattattatgaatgagatgtcatgattatgagtggctaagtcttctgtctcctcaagaaaacagcactattgtgtgactacagcatcctatggaaaatttcaatcttattataaccttaagagctctggtttcatagccatccaagccctctttgaaatgacttatagtccctctctttgattctctttctctggggcctctatggtgtctctatggtctcatctgttcatacatttgggccatttttctctctgcagcttgttcaagaagcatctctgcctcttaatgacttcagcctgtttacagcattgattgtaggtaaagttcccaaccctcagtaacctttgagctctgattgcattctggctgtgcaacacatacttgaaattctcaagagggtgaatctgattggctgctgaccagccaatag

SEQ ID NO: 4234 - DNA, 1034 bp, Homo sapiens
tcggcctcccaaagtgctgggattacaggtgtgagccaccatgcctggccagaaaataaaatgttttaaatgaacagagcatcatgagttgagaaataatttcaggtggcttaatatacatgtcactggagtctctaaaattgaggagagaagagagatagaaaaataatttgaagaaataatgactaaataaaatcctaaatttgatgaaaataatatccctatggaaccaagaagctcaatagctcaatgaactccaagcacaagaaacatgaagaaagctacactaaggtctttataatcaaagtactcaaggaacagtgataaaaagaaaatcttaaaacaaccaggggaaaaaaagacatgttatggactaaggaacaattgtaaggataagagcagacttcttattggaaaacaggcaagctggaagaaagtggagcaacacatttaaaatactaaagaaaaaaaattgtcatactaaaaatctatacccaataaaaatacattttaataacttaaaaaaaggactttaagatatacaaaaggtgaaagaattcctcatcagtagatccatactacaagaaatgttaaaagcaatcctctaagtagaagaaaaatgagaccagatggaactacagatttacacaaaggaacaaagagcaccagaaatggtgactacaggaataaatgcgcaatactttttttcttgttatttaaatctctttaattcatttttatttttatttttttgagacaaagtcttgctctgtgacccaggctggagtgcagtggtgtgatctcggctcactgcaacctccgcctctcaggttcaagaaattctcatgcctcagcctcctgagtagctgggattacaggcatgcaccaccacgcccagctaattttttgtgtttttagtagagagggggtttcgccatgttggccaggctggtctcgaactcctgacctcaggtgatctgcctgtctcagcctcctaaagtgttgggattacaggcttgagccaccgcacctcg

SEQ ID NO: 4235 - DNA, 1035 bp, Homo sapiens
acaactttaattctgtacagattttagcccagcaggtagttttctttaattgcaagtagaaaactccattgcaataaagaccgtaagtaatggtgagtccttaaaagcaatattataaaaggaaatggtcactaatagtaatgagccaaaattctgttgaactgtcaagatagaaccattgtatttcaaatcataaaaagagccattttttggtgtacttgtgtgtttttttcttttttcttttttttaattttgtggtggaagtttgggggaaggggcagagagtgccctgtgtacatatgagaaagtagaattactttttaaatgattaatttctgcagccttattttagtacctgaatacttactgacttctgacttagcttaatttatagaaaatttgttttaggattgcatttttaaatacaaaaagtaagataaacaactttactttgtgtgtgtgtgtgtgtgtgtgtgtgtgtgtgtgtacccttaactctgttatccagtttctaatccttttggggatttggagatttttaaattacaaattacattcataagtcattttgagttcattaactcattgatttatgcattgtttttattatttttgaatgtatttatttaaatcattgaggttttacatcatatatttgggacatttaccagatgactttctgaagcttcgacatttactttggttaatggttgcgtatttgattccattctgttctgtaagtaataaaacatccaaatataattttgtaaataatattaacggcccttgtagtttattggaaacttagttttcttatttttctggtaacatgtttgatggtactaaatcatttatttttataacttaaatgactatgattttcttattgtttgtagcttaaatatttcctgttactgcttatttaaaatttttcagtagcataatacagaattgtatattgttgtatattgtttgaagtatctcttaattcatcagaacatcacatgtaaaacccaaatttaatcttagagtaca

SEQ ID NO: 4236 - DNA, 1031 bp, Homo sapiens
ggttttttgcctacgcccattttatctatattctataactagtgctgattctgatgctaatcataaaaacattttgtgttttatataactgtttgtaaatatgagacccatggaaggcaaatgatttgcttagtcactggagggatcagtagttccataatacaaccttaaggttctccaacatccacagcatgagccaggcacacaggtatgtgcctacagtcccagctatctgggaggctgaggctaatggatcacttgaggtcaggagttggagtccagcctgtgcaacatagagagaccccattttttaaaagcaaaaacaaaactacagctattttgtttttttttttctttttattctctctgattaattttaaaaggaaaatctgtgattctggatagcagtgacctttgtgaactcttcattggcaactttatttcttgattatttattactttgttgttttttggattatcttttcccaggcattgctaccatttatgttcgttataagcaagttcatgctctgagtcctgaagagaacgttatcatcaaattaaacaaggctggccttgtacttggaatactgagttgtttaggactttctattgtggcaaacttccaggtttgtgttttagcccagcataggtattttccttaagtacataaatatatatattaaaagggaaacctgaagcattcagttacatgctgttgttatttctttaccttagcaaaatagaaatcacttcctttaaattatttgaccctattagaaatagctacttgcacaactagaaaaattcatatttaaaagtctgaacaaatacaaattattttaacttttttaggatccacaggacaattattagagtcttcattactacttagttggagattacttcaactcactactgaaacaaaattgatataaattagaagtgacacaattacagattttaaaagttttgtttttaatatgcctaacaatttataatcatttacctattttatctacttgtttgga

SEQ ID NO: 4237 - DNA, 1051 bp, Homo sapiens
tgggaagatgggacaagaaagcaagtttctagctctgtcacgtgggtgaatcttggttgcgctcactaagaaagggaaggagagcgagtattggggtatggcatgagggatgatttcagaggtgaaacagcttggggtggtaagtacaaggctgtgggcatggatggctaaagtaggatgaggaaactcttgtgaattatcttttctaatatgttttctctatttcagaaaacctgttagaaatgtggtggtttcagcaaggcctcagtttccttccttcagcccttgtaatttggacatctgctgctttcatattttcatacattactgcagtaacactccaccatatagacccggctttaccttatatcaggtaagtgaaatgtattctttgtataggagactctttatgtctcattcttattttaacattgaagtcaacatttaatgtcaaccttttaaaaatcagattttacattggcattacaacaataaagggaatataaaaaggaacttgaatttggctttttctttgtgatagagaaatgtagagacagcccaataagattcagtttgtgaactggttcttgaactgtgactctttagtgccttgttttctaagtaagtatttgaagttgtttcagaatatagaattggaattattcgccgcttaaaattaaaaaataaatgctacaaacaataataatgatatgaaaagataatggaaatgacaaacatgtcttaatatgcttactgcgtacgaagtaattttctttttttttttggagatggagtctagctctgtcacccaggctggagtgcagtggcatgatctcagctcacctcactgcaacctccgcctcccgagttcaagcgattcttctgcctcagcctgccgagtagctgggattacaggcgtgcatcactacgcccagctgatttctttttttttttttgcatttttagtagagatggggtttcaccatgttggtcaggctgctcttgaactcctgactttgtgatctgcccacctcagcctcccaaagtgctg

SEQ ID NO: 4238 - DNA, 1050 bp, Homo sapiens
ggtcactacatggagaacacactactactccacctagaacaaggccaatgcaccctccctgaactgacatcccaagacccattcatataaataagtctttatttatgaaacctactgcataacatttgaagagatgactttcctatcagatgtgtagaaatcaatgtagggacacattaacacgacaaagcaagaaaacatgtcaccaccccacaccaaaaaaaaaattctccagtaaaagaccccaatcacaaggaaatatatggaatgccccccccaaaaaagaatttaaaataataatattaaggaatcctagtgagatacaaagaatgcagatagaaaattcaatgaaataaggaaaacagttcatgatttgaataagaaatttaacaaagagatatcataaaaaagaaccaaacaaatcctagagctgaataattcaatgaatgaagtaaatatacaattaagagattcaacaacagactggactaagtagaagaaacaatttctgaacttaaaagacatgtcctttgaaataacacaggcagattaaaaataaaagaagaaagaattagaaagaatgaagaaagattacaggatttatggacatcattaagtccatactatgggcattgcagaagtgaagagaaaatgtgagggaaacatatttaaatgaaataatatcaaaaaacttcccaagtctagggaaagagacagacatccaggttcaggaagctcaaagaatgctaaattgattccacccaaacaggtcctgaggcacattatattcaaattgtcaaaagtaaaagacaaagaaagaattttgaaagcagcaagagaaaagtatcaagtcacacacaaaggaatgtctattcaactattagattagtagcagatttctcagcagaaaccttatagggcaggagagaatgggttgatattttcaaagtgctttgagttttcaaagtgaatagaaaaaattgccagtcaagaatattattcccagtaaagatatttttcagaaatggaggagaggagaagaggccagct

SEQ ID NO: 4239 - DNA, 1029 bp, Homo sapiens
taataaccattagcagcaataacaacagtcactgctatgagtgcctaccatgaatcagacagtttacatttataatctctatttttttaaacctttcaagaaaagtgtcattattgctacttttcaaatatgttgtccaaagtttctcaattagtaacccaaatctgcctgtttctaagccggggtgtgcccacctttttggctatgctttttctcaggtcattccaaagacagaccatttaaccactggatctggggcaacaaaggtggatcaatcgtgaatccttcactaaaaagcttgctttgtaatagatgaaacagtttaatttttaaatctagtgttataagggtttaagtagtagcacactgtcaaacttctgttggaatgaaaagaataagaactgacgaccacaaaaaagcaattctgcttaaaccagtgtctctcacccttggcactattaaattatcagtacaggcggtccgtgacttctgatggttcaacctacgatttttcaactctacaacagtgcaaaaacaaaaacaaaaaacaaaacaacaacaacaaaaaaagtgttgtcagtttgttcatcgacttatgatggagttacatcctgataaaatagtggttagttgaaaacattaatattttttattttactttaagttctgggatatatgtacagaacatgcaggtatgatgcatagatatacatgtgccatggtggtttgctgcacctgtcaacctgtcatctaggttttaagccccacatgcattaggtatttgtcctaatgctctccctccccttgcccccaacccgccgacaggccccagtttgtgatgttcccctccctgtgtccatgggttctcataaacattaatattttcaacttacaatgggtttatcgagatgtaatcccatcataagtcaaggaccctctgcactgaatatacttcattgtggagggctgtcttgtgcatcaaaggagggttagcagcatccctggcttctacccattaggtgctgtggc

SEQ ID NO: 4240 - DNA, 1041 bp, Homo sapiens
attttccctgcttaacatttagattaaaaagtaataattaggccaggtgtggtggctcacacctgtaatcccagcacttttggaggctgaggtggacagatcacttgagctcaggaattcgagaccagcctgggcaacatggtgaaaccccatctctacaaaaaataccaaagtcgggcacggttggttgtgtgtgcctgtagttccagctacacgggaggcagaggcaggagaatcacttgagcctgggaggcagaggttgcagtgagccaagattgggtctttgtactctagcctgggcgacaggagtgaaacagtctcaaaagaaaaaattaattgacaaacattgtgtatattcaaggtatacaacgtgattatttgatagacgtgtaatgagttatcacaacaagcaaatggtacacaatatagtttcggagggtttatgtataaggggactaattagaaaggtttggaaatggtgtaggagaaccaaagggctagtgcccaagggcaagggaagggagtggttacctgaaactggaagaaaagatagttttgtagagcatctgctttgagagcagcagtgacttttatcaagagatagagttaccttgatgccacatcacggggtgatccaggagaatgaatacgccgatttctgtcctcccttcctctactcttccatcaggctgtacccaacagagcccatttgatgtagtccaaacagacagactttcaggggcagcaagtgaggtggagaaagatgggaaatactaatagaagggcagttggaaaatatgtttagtctgcctttttgccccttatcatcctctcttgtccttaatataggtgaaatttcatgtccttaacacaagagatgcctagagtcccatcaactattttatcattatggggtgataaccatttgttcgtgcttccatcttaaacctaaaggattaggtatcattagtgtcctcatataaagcagcagtagaaaagtgagaagagaaaaacaaggaatgaaatatagctgttagagtt

SEQ ID NO: 4241 - DNA, 1030 bp, Homo sapiens
tataataaggaatttaattcccaaacaacatcctttaacattctggtgaaagcccagccagtgtcactggttgaaagtgccttcagtggatatagctatatttcacctgtccctgtgatcatgaggtaccagattccggtcaagcatttcactttgggaggcaccatgttgtaaacattaggaatttcaggtgcaaactaattttccattctggtagtaactcttacctggagtgtcagctaagtcatgaaaattgtttagattagaaaatgcactttttatatatagcctaaattagcttcatgttctgtagtttctgcagcttgtctcagaaatcctctgagtagaactgatgtatgagaccctttaagaccattatccaactgcagtttgcttggcagagttagcattaatgcaccctttgatctaggcacctggaggcaggtaagacaggctctgcgtgcaccaccgtccctggacctgttgtggcggactccttgaagcaagatcaacttgggctttgtttgagtttttaaagtcttttttttttaatgtaaaatttgtcattttaactttttaagtatacagttcagtggcattaagtttatttgcatttttgtgcagctttcaccacttccatctccaaaactttttcatcatcccaaactgaaactgtacttattaaacagtaactccccttcctcaagaccctggcaatcaccattcatcttcatttctataaatttgactattctagacatacgtgtaagtgggagcatacaatatttggtttttttagaggggggttctggcttaattttataaggtgttaacttgttcctcaaaatgtgttctataaactggcagcatttgcatatcttggaacttgcttgaaatacagaatgtccagatctactgagtcagaatttacattttcaaaagcttcctacgtgactcatgcatattaaagtttgggaagcactgacttagattaccttttgagaattccagatgggtcagaaaccagaca

SEQ ID NO: 4242 - DNA, 1499 bp, Homo sapiens
tttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgttggcctgtcttttttgaagcatgtgtgttatgtgtagttagatatatttcacttatgtgagtcatcatggtgttggtcttgtagcccattatttttcctgtgcttccccagcttcccaaagtagctagttagaacttaaggtaaatatttattcttgggttggtggagtggatattgccagttaggagtcatggatcaattactgattatattgaaagtaaatataatcaattatgtacttttgagctttgcaggttcaatttaggtaaaaatcacattatgaaactgggaaagtctgaaggaatatgggcaaaatatttctcagtaaagcttccatgcttcacccttgacatgattacccttgagtaaaacatgggaatttgtagttgtgtgatcctctggcgttgatgtggagtaggaataaagtcttgcatcatttttataatgtgggaggaaatagaatgggtaggtacaatcacttaagttctgcctctcgaagataaaactttaattttgtggacacttagagaaagtaaggggtgggggagcttgaggtgagtaggaatttgcatagcccttttcttcctggacttaagaatgatggagaaaaaactcagtgaaagagataaggaagcaaatgtgtggaaatgtgtgataaggaaggaaatgtgtcaaggtggttacaatatggaagggaagcataggttttttttttcttttgttgagatggagtttcactcttgctgcccaggctagtgtgcagtggcatgatcttggctcactgcaaccttcgcctcctgggttcaagcaattctcctgtctcagcctcttgagtagctgggattacaggctaatttttgtgtgtttagtagagacagggtttcaccctgttagccaggctggtctcgaactcctgacctcaggtgatctgcccgccttggcctcccagagtgctgagattacaggcatgagccaccgtgcccgaccagaaagcatggtttttgaaggaccatattttattgtaaaaaaatgttttggttcagatagatgtgtgctgatgggagtaattcacatctatcagtgaccaccaccaagatatttataaaccttatcaaatacagtaggaagag

SEQ ID NO: 4243 - DNA, 1032 bp, Homo sapiens
gctttaagatcaagagggtccatttctatgtttatccaaaaaacagtaaacatcagtttgatggaacagttgggccggtttcaacacctctttaacccttgctcatctccctttctaaccaagtaggagcaggcttcaggctcagttccttaagcagacaacagcatctggctagaattcagtaatgcaagtggtgtgtgggtatggcagaatcaccagggcagaagaagaattaaagtagtttggtaaacactgaactagtccagaactttgggcatctgggacataaagggtcagggagggagggtgatttgctgcaagtcaaccaactggtcaacaccagaccaagcctggtctccctgcttcaactaccggccctttccccaagctcttctgctctccacgtggagctgtcagtatttctccactttccttcaaaaagcagacctagtactatcttgttctttgctgtctttgttatttcttgtttgagctttttttttttttttttggagttggagaaggcatgggatcatgctattagcataactaaaaatgtttttagtttgcctctgcattttccccaagcctcagcttttcctaaaaatccagcatcttctgcatccttccctggggaccacactactcctcagtgctgggcattgtctgtttacaactaaagcagattttttcttttgcttttgtcttcaaatgtgagcttttcagagtctctagtgcaaccatattagtgttttagatgcttcctgattatagttatttgtgcttatgtagtcagaatttcccccaaagtgtttctggatatggatttacacctcagttctgcctgggctgctaactagctgagggaccttgtgcaagtcattcaccctcactgaacaggtaatagcactgccctacttagctctgagggttgccatgaggaccaaatgagtggtagtcacaaagatgctttgcagggcataatggaccccacataatgcaccccacaatgaaatgtgttattcagctcct

SEQ ID NO: 4244 - DNA, 1044 bp, Homo sapiens
cataaaatgagacaattattttgagatggccacaggtagacggaagtaaaggttagatcctatccttgttcacaaagacacgggtaaattgtgtgaataccaagctctgtgaggaaaggcaaaagctttgtaagacttgctgcccacaccaaacacagccctgagcccagcgaacatagatggagctgtcatcacagggagttgcttcccactccagatatgccccgtcagtgctgctgcttggggcagagcggcaagccttgggctcagaaatgctgcttccagaagcccataaacaaaaggcagctgtctgctctccctcttccaagaattcttagcaagtaccagttttcattaatgggaagcaaatccactaatggcattcaggaacagcgctcagagtgagaccaggggcctcactcttttctcttattctctatcccagggctctagaaaaaagatagcagggccccctgctgcatcccttggagccccatttcttcttcctctgctcagccctggctggtcatcagggtatcctggagcaggagggagagaagagctccatcatatcaacattcctcacccaggagggcagagagcaaagtgaagataatatacagactttggaattgcacaggcttgccagttggagatgtgtaacctctctaagactcagtttcctcatatataacatggttgtaataacagtaccagcctcataggattgttacaagatctttacatgtaaagttcttagtccagcgcttggcatgtacttactgctcaatataagttagctgctgccactgtgattattatctgctcctggccctcattggaattccagtgcttaacttgcgatggaggcaggtaacaaaattctgtctgcttagtgtcctgggacccctggcaatatctcggattcctgtgcaagatgtgttcctgcatcgtgaacccactgaaagtcaagggaccaagtgctgggggtcacaggacatgggtgtgcttacttgggctccacccctaggctgcaccagctgc

SEQ ID NO: 4245 - DNA, 1026 bp, Homo sapiens
tacaggcgcacgccaccaagcatggctaatttttgtatttttagtagagatggggtttcaccatattggtcaggctggtcttgaactcctgatctcaggcaatccacccgcctcagcctcccaaagtgctgggattacaggcatgagccaccgcgcctggccggtagatgtactttttatctttgcttctctataagtaagggtttttttctcatcgctggcttctttcaatatcgtttttttttttttgtcttagattttttgcagttttaaatatgatatgcctaggtgtagtgtttttgtcgttgttggtttcgtttttgtcatttaatctgcttggtgttcactgaacttcttggacctgtggtttggtggccaacattaatttgggggaaattcacagtcattgcttcaaatatttctgttcctttctctattttttctctttatggtattctcattatacatgttataccttttatagttgtcccgccgttcttggttattctttttcttctttctagtcttttttctctttgcttttcagttttggtttcgttttatttttgagatagggtcttgctccgttgcccagactggagtgtaagggtgtgatcacagctcattgcagcctcagtctcccaggctcaagtgatcctctcatctcagcctcttgagtagctgggaccacaagcgtgcaccaccatgcctggctgattcaaaatacatttttttgtaaaggcagggtctcactatgttgcccaggctggtctcgaactcctgggctcaagcaatcctcccagcctcctgaagtgctgggattacaggtgtgagccatcatgtctagctgcttttcagttttgaaagtttcttttgaggtagccttatgtgcagagcctctttcctcagctggacccagtccactaacaaactcatcaaaggcattctttcgtcgtagtgctattgatggagcaggatctctagcatttcttgcttctcctttctctttgttaacattgcctgttt

SEQ ID NO: 4246 - DNA, 1025 bp, Homo sapiens
agtagcatgagatgccagaagaggcccatttccttccacagggatgagaaccaaaaaccaaagaatagagagtagggtataggtagatttaagtcaggttgacgtcctatggaaggcatatgccattatttatgtggtaacctgcatgttcttgtgagaacaggggctggccaggacctgaggctttccccagcagcctggcatataatataaggcagcttcctttggtaaattcattcagccctattgttgagttcagactgaccatgacccccttacctctccactaccccaaagctttcctcaagatgtcagctgttctcttcccctcccatttccccctccttaatcccaccattggctcatcagttatccagttgactccattctgaaggaagacattctcttggcctgactcactcaggcccatttctccacaggcatccccttaccgcagaccacaagggccctgactagctcatgttttgtgttaatggatgtgaaaccagagcaaatcccctcaccaaaagaaaaaccaccctaaactctcccacacaggtctcagcaggttacacaaatattagtcctatcatccaaataaatctgcccccgtggcccagagctatggctcccccaacctcctgctgcctgtgcagagtgaagctgcttcaaaaacatgaggaccccaagggatattggagaggaactttggaaagacaggggcctgtatccagaattctttatgcaggctccttaatctacagacttttgttaatactttatagtcctaaagaaggactgttcctagagaagtcatgatgggctagaccagccaggggctttggtgaagaggatctgcgggctggagtttggtgcataattaaaactcagcgtctgacagctgggcacagtggcttgcgcttgtacgcccagcactttggaaggctgcagtgggaggattgcttgagaccaagaattcaagaccagcctgggcaacatagtgagctccatctctgaaaactatg

SEQ ID NO: 4247 - DNA, 1101 bp, Homo sapiens
caacgccctctcttttctatccctttacctttgaggtcagggacagggcatattactgacaccccactggctattgccctatacctgccaatcacccaaagaaaataatagcttctgagaaagctcaattcactgtagcaactgtgatatatttaccctaataaagccaccacttggtcttttccagtgcttctctcttatggagatcatccctggaatccaaagctctccagttttctaacccagttaagagttaaaaacaaccacaggtcatgagcagtaggcttggcagttataccccatgcagtcataggagactgctccatcattctcagcacatagggtgcacatctcactatctctggcatgaaccagccttgcgaacttatacagtctcagccactctgctttgatggtaattcttcaccactgatctctcctcaccatgcccttcctgcatccttcccccaaccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatg

SEQ ID NO: 4248 - DNA, 1049 bp, Homo sapiens
cagccagactagaccattcactattatctaaataaatcttatccttccccttatttattattttgcttactttgtttctcgtatctaaatgtctcactaaaaaaagaaaatagtatgtgaaatttctatataaatttgtctccaaatataggatggtaaatgagacagaattgagtatcaacacatgcttttttttcctcagcttttagaatgattccatacccgttagagaaaggacatctattttacccttatcccagctgcacagagacggctgatagagagctattacctagtaagtaaatattttagttttcttaaacttaaaagtagtaagtttagattgtttgtcatagtattctccattttaaaaatgcctttggtttaaattcaggacactgtttaaatactattttagccacttctgggatgtagttgtataattcaatttatttcctaataattattgagcaaaactctgtgctagatgcaacaaaggacaccaagattaaagatattaacaagaactgtcatcttataaacttttagaaaagaaatagtgccaatccttcacaaactcagaaaataaatgaggaaggaatactccccaaatcatttgatgagagcagtattttcctgataccaaaccaaagatatgatataaaaatactataaaacaacagcccttatgaatatagacacaaacatcttcaacaaaatattaggaaactgaatccagcaacatatagaaaggcttatataccatgaccaagtgggatttacctcacaaatgcaagtttggtttaacatctgaaaatgtaatgtaccatagttaatagaataaagcacagtagatgcagaaaaagcatttgacaaaatctggctctcattcaagataaaaagaaaaaatctcagtaaactacaaattgaagggtacttcctcaacctgatttaaaaaaaatccctgaaaaacccacaattaacattatatttaatggagaaagactgaatgctttccccctaagatcgggaataagacaaggatatct

SEQ ID NO: 4249 - DNA, 1027 bp, Homo sapiens
atagaagacagcctatcatcaaaaattacaagtctagtattatgcattattttaatgtaatatttagtgttgcagcagaatgatgttctttacctggccagtatcagatgggtgctgactttcatcagtttgtcaagttcaggaagcgttaggtggcagctagctggtgacatgtttgatatgagaaatgtatttttgttacacaagtggaatatattgactccttttctaagctgagactaatattttgtttccaaaggaaaattcaaacatttttcacattattcttcctggacagttgcaggttttgttccaaaagcaacactcataggttctctatttttcttatcaaacttgaaatgggccagtttgtcttctgagtctactttatttgtttatttaattaaagaaaactttacttactgtgaagtcttcattttggtacagtaaattggtagcaaaattaatattccaaagaaatcctaactcaggcctttgttgaatcctgatagaggctgacattttctagaggtactatattctaaattaattccttttttttttttgcccttttacacaaaacgcaagcccgtacattcttcgtagagtgaatcattcattagacaaagactttgtttttaagtttttgtatatttttatttttagcagttccataaaaccttttcagaatgataaaagtagaactgtaatatttcatattgattataatgtgatgtcacttaaactcaatgttaacaagcatttagatatataaatgttcatacataataatgatataattaacttgtttaggtaccctgtatattgttaaaataaatcagagaaagaatatatttttattttatgtgaagcttacaaatttaatgtaaatttctcataatagataatgtgaactaataacctagtttcttgttttgtatgtttaagaatatattatttaaagctttgcttactccactaccttattcttcataattttgcagattatttttttaccatctcatct

SEQ ID NO: 4250 - DNA, 1050 bp, Homo sapiens
atggtttaattgcaataaaggagtaaaaaaaatagatttatgtttatatgcttaatgtttatattaatggcaaaaggataggtgttggggaaataacagcagcacagtatcagtactgtatgttaactttaagggttgagtgactctggaagttaggtctcaccaccctttctctcacagcccctctcacagagtgacactgaattgcaaacgtcagcaggcttttaaaatagcaatcatggctatctactgaagttgtggtattaaaacatttttatttgaatatctcccaaaagaattttgaaaaagaatatgtcccttcacacatttttaagttgacatcataaggttaaataatcatagagaatgtaatttttgacatattgcaaaatacagacatttaaaaataatagtataccctatatttcaatctatgttatgaaatcaaatgatttaatacccactacaatccattgaaaaatacataaataggccaaggacagtggcttatgcctgtaatcccagcactttgagaggccaaggtaggagcatcccatgagtctaggagtttgtcagcctgggcaacacagtaagaccccatccctacaaaaaaagtttaaaattcatcagatgtggtggtacatgcctgtagtcccagctacttgagaggctgaggtgggtggatctcttgagcctagaaggttggggctgcagtgagctatgatggcactgctgcactgcagcctgagggacaaagaccctatatctaaaaaaacaaccaagcaagcaaaacaatacgtaaacaaatgctctttttttttttttttttttttttttttcttttgagaccaagttttgcttttgttgcccaggctggagtgcaatggtgcaatctcggctcaccacaacctccacctcctgggttcaagcaattctcctgcctcagcctcctgagtagctgggattacaggcatgcaccactatgcccggctaattttgtatttttagtagagacagggtttctccatgttggtcaggatggtctcgaac

SEQ ID NO: 4251 - DNA, 1029 bp, Homo sapiens
ctcggcctcccaaagtgctgggattacaggcatgagccaccaggcctggcccattctgtcttcttttctttcaacattcatagccccatatctaggcccttaaacatctcttcccttggctattgctatagtatcctaagtggtttcccttcctcttacacttccccttctagtacatactctctccttactaggtaaaaaaaaaagtggttctcaaactttttagactaagaaatcctttacattcttaaaaaattatccaggacctcaaagagcctttgtttaaatgtggactatatccatcaatatttatcatattagaaattaaagcaggaaatttaaaaatattttaatagtagtaaatccattacgtgttaacatgttgtagactgaaatgtgtcccccaaaattcacatgttgaaactctaacctctaatgtaactgtattaggagctagggtttttaggagataatcaaggttaaatgaggggatcctaatctgatagtattgatggctttgtaagaagaagagagggattgctgtctctctgccatgcaaagacacagtgagaagactgctctctgaaggccaggaggagagccctcaccagagcccaaccattctagtaccttgatcttggacttccaaccttcagattgtgagaaaataaatttctgttgttaagccactcagcatatgatactttgttatggcaacctgagctgactaactcagattttgttacgaagaagtggggtgccactgtaacaaacacctaaatatgtggaaacagctttggagctgggtaatgagttgaggctggaagagttttgaggtacacacttgaaatatggataaggacagtttggtgaggtctcaagtggaaatgaggaatatgtggttggtaactggaggaaaggtggtccttgtataaagtggaaaagaactggctgaactgtattctagcattttggggagagtagaacttgagagcaatgacattggatatttagctgaggagatttcta

SEQ ID NO: 4252 - DNA, 1055 bp, Homo sapiens
ccaggttccagcaattcttctgtctcagcctcccgagtagctgggattacaggtgccggccaccatgcccggataatttttgtatttttagtagagatggcatttcaccatattggtcaggctggtctccaactcctgacctcaggtgatccgcctgccttgtcctcccaaagtgctgggattacaggcgtgaggcaccgccctggcctaaagatcctttatatggttataataattataaattattattacctatggattagcatttccaaaatgtattcagcatttgaaaagagttacctattcaaacaagtttggggaacactgcatctcccaatctacttttaagagattgacagtatttatttacatattaaaggcttattgtaaactgtagtcagggagggcttggggtgtgttggaaattaaatgcctgcagagcccaagttggtaacaaaaatgagtgaaatggatagagtttaataattaaattcttatttctttgaggactgggtagcctggacagtgcatgccccttctaaaagaggctaaagctaattgttgccatatagacttggaactagtattaccaggtttttcaatttttcaaatgatttaaagagaacccagacaggccggacgtggtggctaacacctataatcccagcactttgggagcctgaagcaggcagatcacttgaggccaggagttcaagaacagcctggccaacatgatgaaactccgtctactaaaatacaaaaaataactgggtatggtggtatgtgcctgtagtcccagctactcggaaggctgaggcataagaatctcttgaacttgggaggtggaggttacagtgaaccaagatcttgccactgcactccagcctgggcgacagagagaaaccctttctcaaaaatgaatgaataaataagtagaacctggacatacagtttttatataaaatttgcccattaaaaaaaaattgagatggagtctcactacgttgcccaggccagagtacagtcgatattcacaggcaccattatagcacact

SEQ ID NO: 4253 - DNA, 1045 bp, Homo sapiens
ctccttggtaaatacaacacatctaattaaatgtagacagatatttcaaacatcagctgaattcacttaagtttttccaaaacctcagttaaactgtgaagctattggaatttttttttcctggaatttttcccctttgattcacagtggtcccatttatatctgcttctagcttagtgctatgtgtgagatatgtgtgtgtttggtgtttttgtttttttgtttttttttttttaaggtttgcaaattaaaaagggccagaaaaatttggcaccaggcaaacgaataaagataggattgggaaagaagttgctaagtgtgcttagttttaataagtaattccttctcttttttcagagaaggccttacagaaaattgttgtgcttagaattgctggatgcatttttaccctccacacaaacctaaaaattttgtgacccctttcacttacctgaaaagtagagaaatggattcagtataaggataaggagggaaggtggaccagaatgaaaactgtaaatatttttttaacctaatatcacttaaatcgaggcagaaagatacagacattcaatgaattatattcaatgcatttaaaataccactgtaattgacagagtaaaagtatagatacaaaaccttgtgtaagaggctgacttttccaaataaacattttttaagaaaacatttcttctcccaaatgtctattttcttgaggaaaatattgctgtgtcttcattttcattaccaggtttcattttgggccttgctaaattgattgaattaaatcctccagcttttgaaccttgatatttgtgtatatgatttattttcatttgaatttctcctttcctcttctttgctgtaaggcaaggaggaggggaattttaaaaccatcttatttgaactgagagcatccagagcagttaaccttaaggaaacaatgaaaaactccctttgtatgcctgggcatcatggcagatagaggaagagtgttagaggagaaaactgctgctgagagtattggcaggcttggcctcagttt

SEQ ID NO: 4254 - DNA, 1051 bp, Homo sapiens
tgtttgtgttgttttacatatttaggtcggctcaatgacatgtatggagactacaaatacacatactgggcatgtggcgtcgtcctaattatttcaggtatctatctcttcattggcatgggcatcaattatcgacttttggcaaaagaacagaaagcaaacgagcagaaaaaggaaagtaaagaggaagagaccagtatagatgttgctgggaagccaaatgaagttaccaaagcagcagaatctccggaccagaaagacacagatggagggcccaaggaggaggaaagtccagtctgaatccatggggctgaagggtaaattgagcagttcatgacccaggatatctgaaaatattctactggcctgtaatctaccagtggtgctcaatgcaaatagtagacatttgtgtggaaatcataccagttgttcattgatgggatttttgtttgactccttaccaatagcctgaatttgaggagggaatgattggtagcaaaggatgggggaaagaagtaggttctgttttgttttgttttaatcttagcttttaatagtgtcataaagattataatatgtgccttaagttttagtctttagaactctagagagccttaacttcttaaaccatttttgctgaattcatctatttcgagtgttgtgttaaaaggaaaaataacaactaacttgtttgaggcaaatctaaaatttaaaattaatcttgcttcattgttacatgtaatatatttcagacattttcactggaagatttatgaacagaaatattggttgaaagttagagattttacaaaatgctgacaaaaatattttcctagcatcagtagatttctggcatatgtttctgctagctatatatttaggaaattcaaagcataaaactttggcaacatcttggctgttctagacacagtgtacttgtcaacccctctcaggtaccttttcttgggatgcttattagaagccaagtaaagtgcttaaggtttgttttcattaaattagctatttctgctcccctgttcaaagatgcatt

SEQ ID NO: 4255 - DNA, 1051 bp, Homo sapiens
gcccaccaccatgcccagctaatttttgtatttttagtagagacggtttcaccatgttggccaggctcgtcttgaactcctaacctcaggtggtccacccgccttggcctcccaaagtgctgggattacaggcatgagccaccatgcctgatccataaattttttaaaaacacacaaaaagcaaaaaaaaaaaaaaaaagtttatttcagtagcagtagtataataatagctaccatgtaagctcacagtgtaccagagactgtccttatcattttgtatctcctgttgtatctcacaagtccatatgaggtaggaccgttttaagtccccattttgtaagtgaacagaggcttcaaaaggtgaaataacttggctaaaatcatacagctagaaaattaattacaacttgggaactattcctgaaggttattgaatactttatctttcaaattaatagctcaatacataacacatagtgaaaaaataatttgacccttcttctggatgtgactcatactttaggaactttgatttggggagtgagtgagtatataacagaagatccatagctgccttttgagatcactgtcttcttccatctcatacccagtgagttactaagttctatgagtttttatgctctaaatcttgttctcatctgcccatttttctccatcacaactactacccttatccaaagctcctgtctcctgtttgggctgctcctaactgtaacctcctaactggtctacctgtatcagttctagctgttcttcagtctccttgaagtctccagttcagaactcttcaagatttcttaaaactctccagttgcttcccattactttcagggtgaaaagcaaattccctaatgtggcttgcaaggcactgcatgggctggccccagctgtccttccagcctcatttctaccactggcctcctgctctctgtgccccagcaacctggcccttctttcccctcacacaccatgctctctcctaccattgcgcctttgcactacagttctctgcctggatctaattcccatc

SEQ ID NO: 4256 - DNA, 1037 bp, Homo sapiens
atggttaatcagttggttcatttgctcttttattaatttatttatgaaatatttattgagcaacaactgtatgtgtgttaggaaccattttaggtgctgtagagatagagcaacaagtcaggcagttacactctttaataggaggagacaaacagtacaactcataaataaattaataaataagaaaaatatcaggtagtgataaatgctatataaagcctttaactgagtgttgtgacagggaagaactgggcaagcaatgaaggtcagggctcactgaagaatcaactttaagtagagacctgcataacaacagggaaccagatttgtgaaaatgtaagggatcatagaccgtagagcttattaacaaatgtaagaatggtttgctatgaggtcagggaggaagttctttgaatattacttttgctagcactatttattgaataatttctctctattaatttaaaatgctactttatcttacattaaatgtttccatgtatttcaactctgttcctggactttctatagtgtttctgcactttcactgacgaatttttactggttcctgaaacagggccacactgctctaatgactgtagcttttgtaaagccatttaaataatttgttctggttggtcccactttttcctctgcaccatcaaaaatttcctagtagctctgtatttgttctgtaagtatcctttagaatcatttaccttaatccgaaagtaaaattcactgacattttcattggattgcattaaattagtacattcaggctgggtgcggtggcttacgcctgtaatcccagcactttgggaggccgagccaggtggatcacgaggtcaggagatcgagaccatcctggctaatacggtgaaaccccgtctctactaaaaatacaaaaaaaaaatgagccgggcatggtggcgggcgcctgtagtcccagctactcgggaggctgagccaggagaatggtgtgaacccgggaggtggaggttgcagtgagccgagatcgcgccactgcactccag

SEQ ID NO: 4257 - DNA, 1032 bp, Homo sapiens
actcctgatttttctttagattgtaaatttggatacaaattatctcagcctgaaaatagatttctcagctccttatgttctgcattcccatcgtgttttcaattcactttataatgctcactcctatgcaagattaagatctctgcgtaaatgcctacatagctgtcttgtttttgttgcagttgaggactaggaagatggaacttgggtatgaggaaaacagtccagattgttgtgaattttatatgttcggcaatttgttattggctaccaggcaccatgagagacttaggattcagcagtgaacaaattttaccacttgccctcctagagttatagtctagctggaaaacagataaatatataattgccacagcaaatactctttacaaacaagtaggtactgttataatagggtgggtacaggttcctgtaggaacaaatactgtattgtgtaggtgtgagaagacacccaacttagtatagaagcaatttggctagacctctctgaggaaatactgtttaacctgagacttgaaggatgaaagagctagccaggcaagacagtgatgatgggtggaaagaacattccagacatgaacactgaagctacactcaagagtacagggtgtaatgcaagagctgaattttaccaaagctaaagcataaaaaagtcaaagagaatgggaagagatagaagttgaagagatagacagtatgagaaaatggagggccttgtaagccattttaaggaatcaaggagggtaaaaaaattaaagggatttttaagggataaaggagggtaaaaaaattttaaaggagcgctcttgtcttgaagctgattgaaagcagttgaaggattttcaagctggtggctcacgcctgtaatcccaacactttgggaggccaaggcgggtggatcacttgaggtcaggagttcaagaccagcctggccaacatggtgaaaccctgtctctattaaaaatacaaaaaattagccaggcatggtggcatgcttctgtaatcccagct

SEQ ID NO: 4258 - DNA, 1929 bp, Homo sapiens
taataaaatggatgtaatatctcctcctgctctgtgagaattaagatctaatggattgaaaagactttgtatactatggagagatttttattggtggtaatggagcatgcttttaatctcatattctatgtcaagtattagatctttagagtacttgtcatttagcatgtataataagcttcttgaattcttctgtattagacatagaatacattattcagtgtttggaagatacttggttttcagtatgtgaatagacactaagattgagaaatatctcttgtaaatacagagtagtataaagtttttttaattttgtttttaatttcaagtttttccataaactttgaataaaaacatttatcattcgtttctgttttttttttgtcttagaatcgtaatggagaattcttcctacaaggcaaaatataaggaattagtaaagtaaaaggagctatcttcttctgttccataaatgtttaatgaggatgttagattatctagggggatagtgagatgaataagatagaggttttgaactcaaggtgcttacgtgctaattatgttatgttgcaagtaatattaaaatttttcattgttttgatatttaaattgcttcatcattaatttttcatcactaaatagtttttctttgccagagggagactgatcaggaatgggggctagagcacatgacatatgttctctgtagcgatagctattggaatttcaaaatttattttacttgaaaacatgacctttgaaatatgccagattttatgcagtatatatatttttttccaagaaatttaccttaatttctattccttcccttagattaatttatatcttaagatggaaaaaaagccaaataagaaagaacagcttactctagtaaacaatgtattaaagctgtccaccaagttgttgaaagtaagtcataggctatgatacacttttactatcatttgagttaaatcagtcttttctctaagaaaacattaaatggcagatgataccttgggttgggaggggtcctggaagtggactcttccacagtggcatcaggggtaggggtcacagtggtggttaggaccagagctgaggtcacagagctcctggaggcaagattaaggacaaagagtggctccccatcaccaagttgggccatctggtcaaggacatgaagatcaagtccctggaggagatctgcctcttctctgtgcatcaaggaccaggttcaaggcatttgtcaccattgaggactacaacggctatgttggtctgggtgttagtgctccaaggaggtagccagcaccatccatggggctataatcatggtcaagctctttatcctccctgtgtgaggagactactgggggaacaagattagcaagcctcacactcacactacctacccttgcaaggtgactggcagcctgcatctctgtgctggtggcctcatccctgcctccaggggcgttggtactgtcttggcccctgtgcccaggaacctgctgctgatggtggttacccaccactgctgcactttgactggggactgcgctgctaccctggccaattttgccaagggcacctttgatgccatctccaagacctacagctatttcacccccaacctctggtaagagacatgttcaccaagtctccctatcaggaatttagtgaccatggcctaaagacccataccagactctccatgtagaggacccaagctctagctatggccaccatgtggtggttttataccagaaaaataaagtgagttaacctgttttaaatacattaattaatgttttacttctcagaacccagtaagagatagatgctaggctgtgtagattcaaaatgctgacctgatggttttgggttaataactactgtgaaaaaatttccaattttgttacc

SEQ ID NO: 4259 - DNA, 1278 bp, Homo sapiens
taacaatagagtatgtgcaagaatatgctcactgaagctcctggcagcagttactcagtagacagtgtagttctgggtgtcaggcagattatagcagcagctgacagacttgctggacagcaagttggatgtcatctctctgcaaagctggtaggggtaggtaaagaagagcttagaaagggaaaagaaaatctaaatttcctaggggcaaagtgacaattaaatagtttatatttttctggcttttttgggaaatactccagccgaaagtatgtcaatgaatcagtcacccttaatttggaaatgcatggatttcagtacttaaagttgatgacgtccaaaatatgttaaaatcctatctcagaaacttcttataaacattattttcacacgaatgtagtacaattcagagtgttaataatgtgagggcggttgctgtctgccagtaactaaaacattaacacatgtgtctcactccacagagacgggggccacagcgttcagttgatgtggttgtatcctcggttttcctactgacactttcgattgctttcatttgttgtgctcaggtaaaagtttcacatctgctttaaggaaaaatgaaaattctattatagagttcactttctgttttagacttaggtcactgtccttaagtatgtatttttaatgcatctacattttttactattttggatgtttggtaatttttctaacttttcaaaatgggaatacaagtaattctgaagtcctttcaaactgtaagatcgctctaattttagttggtaattattaattgataataaaactatcatatggttgcaaaataactgattttctgactacattattccttctgtatttattagttatcactccaaggtagatctttcatttctttccctcttatttattcattcatttatttattatactgtggaatcatgtattctcatttttatacagtgggttaaaatctgttactataggctgggcatagcagcttaacacctgtaatcccagcactttgggaggctaatgtgggaggattgtgtgaggccaggagttgaagaccaacctgggcaacataatgaggacccatctccatgaaaaaaaaagaaaaaaacaacaaaaaaaacctgttactatatttgctttgctgcctacattgtcctaaatttggccagtgggagcccctagaaaccccctcctgtacccttttgacagggtctgctttttgtaaagcacttccgtgctttctgcattaaaagaagttac

SEQ ID NO: 4260 - DNA, 1306 bp, Homo sapiens
ctcagcactttgagaggttgaggttgttggatagcttgagaccaggagtcggagaccagcctgggcaacaaaatgagaccacatctttacaaaaaaaaaaaaaaaatatatatatatatatatatccgggtgtgatggtatgcacctgtagtgccagctactcaggaggctgaggcaggaggatcatttgagcccgagtttgaggttgcagtgggctatgatcatgccactgcactccagcctgggtgacagagcgcgaccctgtatcaaaaaataaaaaagcattattgttacgtgaagccctgtgaaaaaatgaattcatggtgattgacttctgaaggctttcaagccattgctgtagataagttgttttaattttatttcacatgtaattatttttaaagatgaataacattttttgctttttgttttcctttaaagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcaggtctgtgcagacatgataagaatagctagtatttattgtgttcttactgtgtgtcaggcactctgtcatctcatttaactttacaatcatcctgtagggtagatactattattatccccagtttagaggtgaggaaactgagcatagtctataagtgaagatgttgggattagaactcagggagaagtaatctagagttgccctaacctaaatttttctgtatattactttttcttattattttccttagaatggtcctttatgtgtattttatattttatatgagtagagtttgcatatagagaatataccttatattttcatgaacatcacagtgttacatatgaattactaggaaatggtattgcttgctttttgaacaatgcataaaataaataatgcttttaatttcaggttttatattaatatcataaagtcagatagccattagaaggtatttcaaccttccaaccaatgtagagattcattctacatctgtgtaaattttttaccatctgttatgtggtgataatagttcttacttcttaggaatagtgtgaaatagctaatgagataatataaagtacatagcataatacctggcaagagtaaatacccaataaatgttagcattattatttat

SEQ ID NO: 4261 - DNA, 1114 bp, Homo sapiens
ttaaaataaaaatattaacatcatatcacagtactgttatataatttaaaattatatatttaaaagtataattcagaattatgaaagataaattttaaaaatcttaacttgggtcatgaaaaatggtatgaactcttcaataagcatttattgaactacaatgtttaaggcattttgttgggtgctgagcacaagagaaaaatattaacaaacagaagtataagacttgtttagaggaagagcaagtaagtagcccaatatgattggagaataaggtacatagatagagtgataggccataaatctatttgaaggttacttgactgctttactaagaactttagatactattctgtagaaaattgaaaggttttaatggtttttgagtagaggagtcacatcatatctgtgtttttgaaagatagaaataaaaatatagacattataataaaatctatggaatatttccagagtagtacttattattctcaatgtctatattaacaaaaaatgtctagtttgactaggaaggtttacaatgaatcatattaatattgaagaatctagagaaagaaaatgtaatcaaccaaagtaaaacagggaaagaaataccaaaaataaaatgaaagcatccattacgtatttatttaacaaatatttgttgactgcttacctacaatgtggcagacactagctatgcctacataatggtaagtaaaaacattcaatcattttttttttttttgagacagggtctggccctgttgcccaagttggagtgcagtggcatgaacacagctcactgcagcctcaatctcctgggctcaagtgattctcccaccttagcctcctgagtaactgggaccacaggcatgcaccaacaggtttggataatttttaaattttttgtagagacaaggtcttgccatgttgtccaggctggtctcgaattcctgagctcaagcagtgcttccaccttgtcctctcaaagtgccgagattataggcatgagacgctctgcccagccatattcaatatttttattttcatggaatttatgacaaagtggttgagaataataaaaagaatccttctaataaatgcaaattactta

SEQ ID NO: 4262 - DNA, 1076 bp, Homo sapiens
catttgattctgtctagcacactttgtggatctgttaattccaatagccctcaagaatattttactagaaaatgtcagagtatccaattaaatgtggattctagaaaaattagattggccagaactgatgtcttcctgttcccaagtacctgtagcatttatttatattctttgtggaagaaatgtgatgcttttgattatgccgtatgtttgtactttatatattattttatataatttactagttgtttttcctcaggaatatttgaaatacttgtttcttagtactggaccagttaggttattacatgttaatgagacaatctttcaacctaaagttttgtgagtcttgcattctttccacgtattgagtcttaaggctaatcattttttttggtggtgctatttccgaatactgtagttcgttgcaaataattgctcaataagtatttattgaatagcattaaatttttattcatttggtggcatccaaatcttgggagtagaacttgtggcaagatgacaggactgccagttttcaccaccaatatgcaatgatcttgctctctttttatttttacttttattccctactttctcatttcttgtgtgtgtgtgtgtgtgtgtgtgtgtgtgttttaactgtacagaactagagggaattagtgatcctctggcttaaatttgtattgtagaaaaggaaactgaggcccaaagtagtaaagaggcctgttcaatcaaatcacagttaattcgcatgaagtgcaaaaaaattaaatattttttaaaaaggtgaatattggcataacaggcagtagaacccaggctcctgaatcctgcttcaagcttcatctccaggcttcatgatgttgctttctcttcctgctattcattttttccactcctttgtttaccttttccctgtgctttgacattacagtggctttatatcatcgaggatctctgacctggccccgttttatgggggatagtggcaataacatgtgtaataatttacaatctttctctgaagattgcacaggccccatgttctttaaaaaacacacttctgacct

SEQ ID NO: 4263 - DNA, 1028 bp, Homo sapiens
tcttctgtttggtctcttgacaagggggcgggacttccgcagaaagcaagattgggcctatccgcgatgagaacggcgtggagggggaattaaggctggaactggagagggaggggtctgcggtcagtcggacgcggcgctggaaatccggcggaggacctagaagtagcgggagcgatctgtgggcggggcgaacggcctgccggccgacggtagggcctgaagagcctagggtggggctcgcggtgtcgcggagggcgtggaagtgtgtcagggccagcgtgccggccctacggaagccgagcctgaggcgagatctcgccttttgtattttcactgactcatatttcctttactcaggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattaggtatcacctacctcccttcgcgtgctaactgctccctttgcaatccccatcagggctcactagccccagtctctctgaaagggtgaattagctttcacacgtggcagttatatggttcggtcttcgtcctgctgctttggagtaccatgtcagtctcccctctgcagcatcttttactcagctgggtagtttcctccatatcacgggcttgagcaattactggtgactcttggatctataatatagctagtacagacttccttttttagcttcagacccacgtatcccactgcctgcttggcatttccacgtgcgtggtttatcaaaagtatgtccgaaatagcccggacattcttccgtcttcctcaaacctgttcagcttacatttgtgttgatgaatgccaccagcagccgactatgcgtgggagccaaccttgaggacacctgatctctcacttcttatgtcagatggtttgaat

SEQ ID NO: 4264 - DNA, 1062 bp, Homo sapiens
agatcacctgaggtcaggagttgcctggtcaacatggtgaaaccccatacaaatattacaaaaattagctgggcatggtagcaggcccctgtgatcccagctacgtaggaggctgaggcatgagaattgcttgaacccgggaggcagaggttggagtgagccaggatcgtgccactgtgtactccagcctggaggacccagtgaaactgtgtctcaaaaaaaatagaaaaatctgccggtcatgatggtgcacgcctgtaatcccagctcctagggaggctgaggtacaagaatcgcttgaacccgagaggcggaggttgcagtgaaccaagattatgccactgccctccagcctgggcaagggggagattctgtctccaaaaaaaaggaggtatatatacatgtgcttgtgcctgcaggtatgtgtttgtgtgttctaggttttgaccacgaaaaaagaactgatttacttgtggcattttaatacatgccaaaacagtacaagatacctgagaaactctgcaacctgtgctcttcttcttcataaataactgagtccacataatggtgatactgggatctgagagaattggtcttaggccttatgctgcaagtactgctcatcactactaagagacccccttttaatgcggaggtgccatttttataatgcattccagaaagtaatcaattgatgcgtgactaggaaaatttagaggagtttttaatcacatgacttcacctgacgagatttcacaactataaaacctcccttttttcaaaaaattattaagaaaataaaccaggccccagtccagggaagtagcttctctagagcaggctttcttataattacgtggactaattgcctatttccctgtctagtggggactggatatgcacattttgtagagatattggaaagccagaagttgaatatgattgtgataatttgcaacatagtaagaaggggaaaactgcgcaggggttaagccccgtggaccaaagggtaagtgtcaaataagttgatttgtcactgggattcagtagttgtctgcctat

SEQ ID NO: 4265 - DNA, 1265 bp, Homo sapiens
atagtatgtactcttttgaagatacctagtatcttaatgcactttattacccaaaatggcagaaattcaagtatgtatatttgatttgattgctaatttaaatgttgatgctgcctaatctgaggctgacactgtgggaatatatgtgcttttttttcttaatgtctttatcttatgatttcccaattgatatttaattttgagactaatgtggatttttttccctttaagattactttccagttgcgtcatattttgaaagcacggtgtgatcctgtccctgctgctaatggagcaatacgtttccattgtgatcccaccttctgggcaaagaatgtagtcaatttaggtgagaaataatgagttttatgaatataacttggaacactgaattagaaggagaaaatacttaaagcaaatttagataaaatttttaactttataaaactaatgttttacattttatgtaaaaatatgttgttattcattggaaactcactttagctgtggttttgtgtggctgttattacatcttaagaaagttgagcgtctactctgtatattgttttttaatgtgtgctgtttctagtcccccgaccctccatcttttaaatttatattgactgtttcatatagaaatcttagcaaatgattcattgtctggaataatttcatagatttttagttgtttaattaagccaaattgtgcattagcaacagacttttaggatgctaatgtgtccagtagttaggtcctgaggaatgtttgaaagataagagtagctcttttcacatggaagagaaatggattttccttttgttacagcgtagtatggacctaaagaccatagatgaaagttacagagagctcagttaaaacacatgcacacaaacttcctagcaattagagagctatttacagattgagtaaactcactttcagaacagttaagtcctaaacagtgggaattgtaaaagcagaggctggttgccctttttttttaaaaaaaaaaaaaaagtaatctttgcatataataaaaaaaaattatattcaaatttagctatagccttagttctgacatcagccagctgtttttgtgtgacgtagtagctaagaatggtttttacattttcaactggttgtaaaagcaaacaaaaaccaaggactgtgagacagatcttatgtggcctgccaagcatgaaatatttactctatagcccattacagggaaagcctgtcaacctgtgccttaaatcacatcttc

SEQ ID NO: 4266 - DNA, 1031 bp, Homo sapiens
attctccagcatttcttgttttgcaggtttgctgacaatgaatactctcatcttcttgtcatatgaaaatcctcaatttaagctgggcacagtggctcactcctgtaatcccagcactttgggaagctgaggcaggtggattgcctgagctcaggagttcgagaccagtctgggcaacatggtgaaaccctgtctactaaaatacaaaaaattagctgggcgtgggaacatgtgcctgtagtcccagctacctgggaggctgaggcaggagaattgcttgaacccaggaggcggaggttgcagtgagctgagatcaccccactgcactccagcctgggtgatcaagcgagactctgtctcaaaaacaaaaacaaaaaaaatcttcaatttagaaggataatttgctctagaattctgggtgggcagttttttctttcaacattgaaaagatattgatattactactttgtattctggcttccattgttttggatgtcactcgtattgttccttcctgaatgttttatggcttttctctggctgctttcaagatttcctctttttctttggcctttcccttttgaccatggagtttttagatatgtttgtctttctgtttatcctctgtggcgttcgctgagctgattttcatcaaatttgggaaattggccattattcctcaaaacagattttccagccagttgtggtagctcacgcctgtaatcccaggaatttgggatgctgaggtgagaggatcactttaccccaggggttcaagaccagcctgggcaacatagtaagaccccatctctaccagaaaattttttaaaattagccaggcatggcagtgcttgcttgtagtcccagctacttgggaggctgaggtgggaggatcgcttgaggccaggaggttgaggctgcagtgagctgtgatcatgccactgtgctcactccagcttgggtgagagagtgagacctatctccaaaaacaaaaaacaccccaagtctcctaggacttcagttacacgtat

SEQ ID NO: 4267 - DNA, 1047 bp, Homo sapiens
gacagtgcagatatagaacattttgtcatggcagaaagttttgttggactaatggcctgtaatcccagctctttgggaggccgaggtgggcagatcacctgaagtcaggagttcaagaccagccgcgccaacatggtgaaaccccatctctactaaaaatacaaaaatattagctgggcatggtggcgcacatctgtaacctcagctactagggggctgaggcaggagaatcacttgaactgggtaggcggaggttgcagtgaggtgcgatcacgccactgccctccagcctgggcgatagagtgagactccatctcaaaagaaaaaataaatgtttaagcactctttcagctgtatcccatggggaggaaaaaaccaatataaaaaaatatatatatacacacatatatatatatatacacacatatatatacacacacacacacacacacacatatatatatagttttttttctttttttttgtttttcttgggttttttttcggacagtgtctcactctgttgcccaggctggagtgcagtggcgcaatctcagctcactgcaacctctgccacccagattcaggcgattctcctggctcagcctcctgagtagctgggattataggcgtgtgccaccgcacccaactaatttttatagttttagtagagatggggtttcaccatcttggccaggctggtcttgaacccctgacctcgtgatccaccaccttggcttcccaaagtgctaggattacaggcgtgagccaccacatctggcctatggttttaattttgtgtttggttcatttacatttataattgttacatgtatctgatgtattgattctttaacatataaaatgcttcattttacttagtaatatgctttgagaatctttttttcttctttcttttttggagacagagtcttactctgttgcccaggctgcagtgcagtggcgtgatcttggctcattgcaacctccgtctcctggggttcaagctattctcctgtctcagcctcccgagtagctgggattaca

SEQ ID NO: 4268 - DNA, 1003 bp, Homo sapiens
tcggcctcccaaagtgctgggattacaggcgtgagccaccgcgcccggccccaaattcttgtttcaagaaagctgtgagaaataattattgttgttttaagtcattaatttttgaggtaatttgttacatagcaatagataactgatacactttttagagagctgtcttttcatgtttttatattaaaatagtttttcctccttttttttttgctgttcttagtagctttataataataagcagtaagttttgttcattaaggtaatttcactgccctctctacgtataccttggtcatcttcaagattatctcgactgatcttgaccttttgctcctttttttttttttaattaaaaaatttctttttccaagacaaaccttggccattcaccttttgctcactcttatactaaaatgtattatcttgtgaaagttcattttaaaaacttattaagctgtgtgtggtggtacatacctgtagtcccagctactcaggaggctgaggcaggaggatggcttgagcttaggagtttgaagctgtaatgtgctatgattgcacttgggaatagcaactgtactccagcctgggcaacacagagagacgccgccatctctttaaaaaagaacagaaaaacaacgacaacaaaaaacctgtcagtgtttttgttggaattgctttgaatatgtaaatcagtttgggagaaaatgtctttattgtgtctgcctatttatacacatggtatgcctccacattttcttaagtccaaaaatgtttttgagtgtatattttgagacagagtctcactttgttgcccaggctggagtgcaatggcacgatctctgctcactgcaacgtccgactcccaggttcaagcaattctcctgcctcagcctcccaagtagctgggattagaggcgcccgccaccatgtctggctcatttttgaatttttagtagagacaggatttcaccatgttggccaggctggtcttgaacttctg

SEQ ID NO: 4269 - DNA, 1059 bp, Homo sapiens
ccatagtaagacacataggattcagtgttcttgtgggaacctgggttaggtaagagatttagagggaacccagaaatacagattgtgtttgactgatgtggctgagggactgaggttatgaaattggctctctgaaatttatgaaggagagagaataatatgtaaatcccctcttcatttctttatcctttctttttgaaggagggggagtaagtggaagggactaaccaaatgctgtcaatcttaagtaatatttctctctaaccaatatctaaaacaaattgagtctggaatccaccatgtttttgattaaaaaaaatttttttttgagacagtctcgctctgttgctcaggctggagtgcagtggctcgatctcggcttactgcagcctctgcctcccaggttcaagcgattcttgtgcctcagccacccaagtagctgagattgcaggcgcatatcaccacgcctggctaatttttctgtttttagtagagacggggttttgccatactggtcagactggtcttgaactcctggcttcaaatgatctgcctgcctcagcctcccaaagtcctgggattacaggcatgagccactgtgtctagccatccaccgtgtttttagatagtctagaaaataatttgtcagtattaactcctatataccattctgctttgctctttaaaaagatcaagctgtgctggaaagagcactagattgggtgttaggggacatagttcagctctttagctattttacgctaaaggaagttcatactgtttttgtccttcagtttccctttaaaatgtagctgatagtcgtttacttatatctcaccaaggcaaataataaatgtgaaaatgctttgtaactgagaaatgcttcaacaatacaggatattattgatcaacctcagatatcatctctggtctggagatcatagctagtggttttaactcaccatctttttcaagtgattttgaaacaatgatgagtataatgccctcctgcctaactggccttttcctgtttctcttaatacatttattcacaccctc

SEQ ID NO: 4270 - DNA, 1077 bp, Homo sapiens
acccagccaaatgtctgattttttatagccactcaagtgtaattatttaagtaactttgatatctctgacattgaaaaaggaaatatctatttgttatttataggcatttatattccagattattgtgctgtttactttctagtagaatatagaatgcaccatgcatttctgactctctttgtccaagcacttcatggtgccttcatccttcatctaacgatgatgctttctagttatcacagcaagttatctacttcctatttaagtgactgtcatactaagccatggaaaaagtagaagacatgcattatcaaagctgagtacagggcagttccagttcctaatctgacaccctaattttatgattaatagtcttgtgctccctccactggcctgaattgctttaggtgtttgattctgtagcctgactgaaggtgaaatttaataatcatcaggttcagcctagatgtgtgaagatgactaatttagggctgttactactgagaaacaggacctaaaattttcttgacttgaactcagccctttgaggtaagtaaagctttgactagagcactgaatgtactggataattccggggagccattccaggatgcattttttaaaaatgctcttaatattttgatctatagtataacttcttttgggacagaatgcattgtatcaaaaagaaaggaaagacaattagaggttgagtctatcagtggctcggaattatacataagcaaatcactgggacgtgtagactattttttctgcaagtccacagtttccttcagtggggaccaccccagattgctcaaaatttagagataaatgagaatagaggatagatgctatccagttttaattggtattgctatgactgtttaaatagtatgcttccataattttattcttttaagaaagtcagctaatggatgtcttcttccacttaatttttttctcttgtgtgtagcaccatttactgatacaagtatatattcattgttagtaatatgtggcaaggagagaagggaactggacagtttcttcaatgtgaggaaaatttttatttt

SEQ ID NO: 4271 - DNA, 1054 bp, Homo sapiens
aacccaggaggcagaggttgcagtgagccaagatcaccaccactgcactccagacttagtgacagagcgagactctgtctcaaaaaaaaaaaaaaaaaagaattaatttattacaaaaatattgtatactgctatgtataatctcttctaaaacctcattctacctaactttaggaaattaaatatggcagaacattaaagctgacaatctgaaaaataccacaaataatgttttgttagtattattatctcaccatcttaggagtgcctttatgtagttgaattacttaatagattacaggtatgtttttacatatgcaatgtatatgaattatgtagggataggtgggcaatgttttagtggagttttaaattaggaaattataaaatgtgttaacatatttttgtgtcattttaacaggattattcaagatcaggttgtagccattttcaacaaggatcactgatcaaaattttctttttacaaagagatttacaagttaaacatgaagggaaaatactggaatcatttggattctgacaggataaagaatacaatatttcacatttacttgtaatggaacctttgtaagattcatcacttgtcattcacccagttgggaacatggatgttggtttttctcgtactactgttcagacactgtcaagaagccactgcaaaaacatcaaacaaaaaatttctcaatgggaaggaagggctaatggtatatctaatccagaaaagtggtgtccaaaggactttggagtgagatataactgtcaccaagagatccgtcttaagaaaaatcctatagctgagagaaagagcaaaaacttggatgtaaccagccgtgaaaatgtgggtctagatataaatgaaaataccaaaagccatgatcaaagtgagaatgaaaataagaaacatgaatatgacgatacacacttctttaaaaatgaatcagaatccaactgggtatgttctcgggtcaaagaaattgaaagctgtaaagaagatgtcttagatccagagacttcattacctccaggaaacttc

SEQ ID NO: 4272 - DNA, 1050 bp, Homo sapiens
acttttttattttaaaagatttgtttccaaataatttgggattttccagatatctttttgttactgatttctctttcagttccattttgggctagagaacattctcagtatgatgtcagtcttttaaaatttattgagtcttattttatggcccaacatatggtctattggtgaatgtttcatgcacacttgaaaagagtatttttggtggcacgcgtctatagtcccagctactcaggaggctgaggcaggaggattgcttgaacccaggaggcggaggctgcagtgagccgagattgtgccagtgcactccagcctgggcaacagagtgagactctgtctcaaaaaaataaaaaaaagaaagaaaagagtatgtactttatgtttgttgagtaaagtgttctaaaatgtcaattaagtcaagttgattgatagtgatattgaaatcttttatatatttactgattttctgtctatatgttttatcaactactgttgaaaagttaaaatccccaactaaaattgtggatttgtccatttggctttttagttctgatattttcttgcttcttacatttttgaaactcttattaggtgcatgaacattaggattgctaggtattcttgatgaattgcacctattaccttctttgtaatgtccttctttatcactgctgttatttcttgctcaggagtctaccttgtctgatattaacatagacaatccagctttcttatgatagtgtttactgtttatgtctctttaacagatctatctctttgtattcaaagtgcatttttttatgaacagcatagagttaggtcttgctttttaaattaagtttgataatctttgccttgtacttagagcttaacccatttatatacagtataattattgatatagtcaaatttaagtgtaccatcttgctattcattttctgtttgttccatgtgagttttttactattgttgttaccgttcttagggttccccctccaactcccctgcttttttggcatcaattatttttttagaattccatttcat

SEQ ID NO: 4273 - DNA, 1035 bp, Homo sapiens
atctctattttagtgggcccatgtttagtctttcaccatcctttaaactgctgtgaatttttttgtcatgacttgaaagcaaggatagagaaacactttagagatatgtggggtttttttaccattccagagcttgtgagcataatcatatttgctttatatttatagtcatgaactcctaagttggcagctacaaccaagaaccaaaaaatggtgcgttctgcttcttgtaattcatctctgctaataaattataagaagcaaggaaaattagggaaaatattttatttggatggtttctataaacaagggactataattcttgtacattatttttcatctttgctgtttctttgagcagtctaatgtgccacacaattatctaaggtatttgttttctataagaattgttttaaaagtattcttgttaccagagtagttgtattatatttcaaaacgtaagatgatttttaaaagcctgagtactgacctaagatggaattgtatgaactctgctctggagggaggggaggatgtccgtggaagttgtaagacttttatttttttgtgccatcaaatataggtaaaaataattgtgcaattctgctgtttaaacaggaactattggcctccttggccctaaatggaagggccgatattttaagttgattattttattgtaaattaatccaacctagttctttttaatttggttgaatgttttttcttgttaaatgatgtttaaaaaataaaaactggaagttcttggcttagtcataattcttatattcactgaagtgcctttatagaatgctaatattaatttcaaacttttggatgtgacatttggaagtgttggaatatctgagttcctcatttcatcataacatcaaatatatcaaagcctgctttaaagtattaccttggggatgattcatagctatttgtcagatttgcatacattaagatgccattggagctcttttgtctcgtttttgcattactgcacaatctagccatcttggtataggtgga

SEQ ID NO: 4274 - DNA, 1030 bp, Homo sapiens
tatatagggccaggttataattggtggaggtatgtttagatttctttaagtaaaataaacagcacaaataaaacagtccagttcatagcttagtgaaatacactgggtacttaatctgtagcctcctggctgcagtagagttgtcatttgagttactgtgttttcttaatcttttccaggaacacagtgaccatatttcttttctgcaggcatatagaatttggtgggttttcttttatgtagggtgatattggatactttttgtttgtgattatatattagcaatttgagggacaaaccagataggcagaaatgggcttgaatagttagatgcttatttaaccttggcaatagcattgcattccctgtggtttttaataaaaattgaacttccctccctccctgcccccttaccctccacacccccaggattcttacagaaaacaagtggttatagatggtgaaacctgtttgttggacatactggatacagctggacaagaagagtacagtgccatgagagaccaatacatgaggacaggcgaaggcttcctctgtgtatttgccatcaataatagcaagtcatttgcggatattaacctctacaggtactaggagcattattttctctgaaaggatgatctttgtgttctgaatctttatggggaaatgaggttaccacactagggaagatagagctttttaattatgggaagagttggttttaggttgtttgacattgagaatctagggtaattactgaaagttaatactggaatttattttacataatatactgttactataaagtttgataatacataagtgaagcttgctactgggaatgacttggaaccagagttgttgtaattagagatcacgaaggaatttcagagaggaaaacatctccaagaaacatctttcagtatgtaatggaaaagataggccaggcacagtggctcacacctggaatgtcagtgctttgggaggccaaggcgggaggatcactttcagcccaggagttggagac

SEQ ID NO: 4275 - DNA, 1030 bp, Homo sapiens
tggattttctcctctaggaaagaattagtactgcataagatgattaaaaataatgcttttgtagtttcatttcggaatagtgaatgtactatgattgttgtgcgctcaaatcattaactgcagggttttttttttctcccccccacaggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactga

SEQ ID NO: 4276 - DNA, 1671 bp, Homo sapiens
aaagaggatacttcagcagcttctttaggaaatactaaagcttcttgcccttatagaatttccacttccttggaagtaacatgcccagtttaatttctgattggctatgaggagcgcaggtgtattaaacattttcagtaagcttttttctcctcaatagcaaaaattagattcttaagattgaaagaccaattaaaaattacagcagactgagctaggcttaaggcaagactaccttttattcatatgaataatcttttagaaaatgctggaataagacatttttacagctgtaccaatcctttggcacaagaatatgtaagaactatagttgtttttattggtttttgttcttgagattgttttcattctgtttttgactgtatctctttaggaggctgaggatggcattattgcttatgatgactgtggggtgaaactgactattgcttttcaagccaaggatgtggaaggatctacttctcctcaaataggagataaggcaagataattctgctcattcgagagagggttaagagttgtcatcttaatcataaatcctgcaggatgggttcttcaaattttatcaagttttgctgaaatatattttgtgtttaagagaaatacatgaatatcttgtatttgaaagcagcttattaaaagtgtctgtcaagctctttgttaatcaaagccttgttaatctagctgtttaaacgttagataaaacatgcttaataaaatcgttattggtaagaaagttaaaacagttactactgaaacattatcaaagtaaaagcacaccaaagattttacgttgttgttcattttttctcatacttaatatgtttggtttttggatagccctctagagaaattcagaatctataaggaatacagactgaaagataaaagtttgatcctttgtgaaaagtgggatgagacataaatgttttggtgaaaatcaatttcattgaagtaataacaaaggatatttggaatgaaaagcatgcgctgggggagttataggtcttgttttctgagttaaggagattggtgtggaagtgatatggtgttaatgagcatccttaattttcacaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacaggtaaggcgtgactttcaggaactttacagctaacttaccatccattctttggtgttggaataaaaaacatttagtattgattgattatacttgttgaggttcagatttcatattggtagaattatggcaagatataaactgaagttaatcactgatcttactatatacagagcctgtggccaaaagaaatagaaaggcctgtgccaccttattttttgtgttggtaccatagagttggccatttggtgtataatgtagtgtaagagtaaggggtctgactgggtgtggtggctcatgcctataatcccagcactttgggggctgaggcaggtggatcccttgagcccaggagttcgaggccagcctgagcaacacggtgaaactccatctccacaaa

SEQ ID NO: 4277 - DNA, 1502 bp, Homo sapiens
agtttcacagccagtgaaaatattatttgggtttcagggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgtgagttgtttctgagaaaagttgggaggtgtttcttgatgctttctttttcaattgaaagttaattttgttttatcatttttaggatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggtaggttttgcataatccaaatgatttttgtagctgtttatttctcttctgctttaacagcacatagtaatagagtacatataatcagcggaagtttgtctctttcagaatttctgtcatattaacagtgaactaaacaaagtaaggtttcttaaccttgggattattgacattttgggatgaatgattctttactgtgggggatgggatgtttagcagcatttctggcctctacccactggaagttagtattctgaccccttttccctgcctcccattgtgacagccaaaaatgtgtccagacattgccaaatgtcccctgggaggcaaactcattccaagtagagaactagttatataaaatgatagtactgtcttccaggcaatttaaaactttcaaagttgggtgtatcctcagttcacacatttaaatttcatttattgaaaaatccactaaataggaaatagaaagatgtctgagatgaattctcctttcaagttaataacaaattgagagttttatagaaacaagtaattcatatagaatataaaatattgctattgaaggtcagcgatagtgctctggtgaaaattaactggtagggtatgtgatggttttactaacagatggagacaggaaagagcattcttcacagagtaaaagtatagatgagaaaaattcagggtttctttaggaagcaatgagtaactagtccgacaggaatttttttttttttttttttggttttgtgtgtgggtttttgttggtgagggaggttaggagaaataaggatgaaaaatcaggatccagctagactgggagggtgttgattgctgctctaaagaatttagaccttattgtcaggtgcggtggctcacacctgtaaacccagcactttgggaggctgaggcgggcggatcacgaggtcaggagattgagaccatcctggctaacatggtgaaaccccatctctactaaaaatacaaaaaaattagccgggcatagtagtgggcacctgtaatcccagctactcgggaggctgaggcaggagaatggcgtgaacccaggaggca

SEQ ID NO: 4278 - DNA, 1049 bp, Homo sapiens
attattttttttctagtactggtgctgtaagtgctcgcaacattatgctgttgaaaaagaaacaagcccgctgtcagggagtagtttgtgccatgaaggtaagtgttaaatttgagaaacttgagttttctttggccacttgaaatgttgtacttcaaactccagcctttgtttttttttttcttttttatcttacccttttaaaatatttcactgttaacctcaaaagtagtctcttaaaattccttggttgctaatacattatcttctttaaaattggctgtttaattgataatattaggttgtaccaaattatattattgtgactacagtataattttacaaaaattactggttttaagttgtaatcataaatttgtacagagtggtaataatgttcttggttttttattttgcttcaggaggcatttggctttattgaaagaggtgatgttgtaaaagagatattctttcactatagtgaatttaagggtgacttagaaaccttacagcctggcgatgatgtggaattcacaatcaaggacagaaatgtaagacagtcagttaacttgatctttggccttttaagatcagagttggtttatgtttttaagaaacacttaaaattatgtgattcttccttcctctgtccccccaccacctccaaccccttctgatttagggtaaagaagttgcaacagatgtcagactattgcctcaaggaacagtcatttttgaagatatcagcattgaacattttgaaggaactgtaaccaaagttatcccaaaagtacccagtaaaaaccaggtaaataatctttttcaggagagtcctatttcgcctcagtagtaatagaataatatggtgtggtatactgagattttatcttattcagttaatataatgtggtagtggaacaactaaggacctcttgttacgtatatttaaactaaaagagaaaccagatttatatattcataaatatggtgtttttttttttttttttctttttttgtgacagagtctcgctctgtcgccaggctggagt

SEQ ID NO: 4279 - DNA, 1044 bp, Homo sapiens
gcataatcaaaaaatttaaaaagaaaaattccataggacttccaagtgtcttagtttgcccaagtatgaccttagttagaacattaaggtaaaatgttccttttaatcacttttttgggggttgtgggggggatctttttctggtttcttttaagcactaacaccagctttttttgtttggaatgccttatataaaattgtttttttgaaatgtaactatagtctctgggcaaatgcttccacgtgtgtaagctttttgaagttggattgctgctcagctgtggactcgcagaagtcatcagcaccatggaggggaagtgtgtgtttatatgaataaagtgacttgtcataaagcatttaattttaagaaatttggcttaaaatgccagtataagaggtttttaagtaagtaaatcacagtatacagtgaatatgcatcctgccaaaatagtaataatgatttattaattcacaggaagtgttttatctgacttacacccctgaagatgtcgaagggaacgttcagctggaaactggagataaaataaactttgtaattgataacaataaacagtaagttctttttttttaaattttctcacctaagcggtttttttttcccccctccattaagaaatttgaatagagttaaaaacctaacttgtaagtctggatagttttcatgaactttcaattcatcaactaatgctttgaggtctatgaatattgtattacagccatgatgcagggtctcagaggaagatgataattaaaacattgttaggcattttaaggacttgttctagagatcagtgaaggtttttcaaaaaatagtgctttgaggtaagttttgagggaggggtatagtcactatagagaggtgagaaaaaagcattatgattagaagtatcatgacatgttgggggaaaatggccaaaagtttggtcgaactgaccagaaggtaaagtttgagcattcttctatgtaggaatctgcgttgtttaaaacaaggaagtgtgattggtttagatctttggaggtggt

SEQ ID NO: 4280 - DNA, 1063 bp, Homo sapiens
tgaatacatttttacatgctgttaggcaagcaactaaattgtggatttttttcccccctatttaaagaagaagtcaagtaacatttacctactgggtccttcctaccaccacctttgttagcatctttaattttttataaacaaggttctgttaaattatctacttccatttgtcctatactttcatgtaattgtttttgtgataacttccattttgcttgttttttgatggtgctgattaagaaatatttgcaatgccattaaaatatagtttagccaaattattaggaattctttgaaaagtattaacatgtcacatgtcacatcaacttatctaaagttgtttgagtggtgtgtttccctttggaaaaataaaataaaggcttcctccaaatggataaaggctagggaaagagagctctagtcagcaaagattctgggagaaggggaaggctttttcaactcttttggtatgtgtctagggatgagacggagactcgaacagtagagcccagattccaacattcttgttggggaacaacttagagtcttaaaatgctagctttgatgctttctaattctggttcagtctccctttgggtgagaaaaagaggatttctatctcctacctgcagtgatgtgtggcaggattggagacttgagaatggggatattttgcagctttaaggcatatatatttcagatcatatcattgtgttcttgtttaatagtaatcagaactatagtctaaacatgaggccaagtgcagtggctcacgcctgtaatcccatcactttgggaggccagggcgcagtgcaggggccggatcacttgaggtcaggagttccgagaacagcctggtcaacatggtgaaaccccgtctctactaaaaatacaaaatttggctgggtttggtggcgcacacctgtagtcccagctacttgggagactgaggcagagggatcacttgaacccaggaggcagaggttgcagtgagccaatatcgtaccactgcactccaggctgggtgacagcgagactccatctcaaaaataaattaatt

SEQ ID NO: 4281 - DNA, 1060 bp, Homo sapiens
tcctgatttttcagtcagatgtgggaactattgagcttacttttcatccctagcaaaaaccccagagccagtgaataaataacttggcagactagctcatgatagcataatggtcaatatggagaaatgttggatggatagcagttagtaagagactgattttagagaagtctccaggtgtatgctgccagatgctatcctcgccctgcttttttcagagacctaatgagtagttctgtgagtacctatgtgctacgtaagcacttattttaggctttttacgtgcagcaactcatttaaccatctcaacaactctgtgagacaggtgttaaggtaggagaatgaatgattaaaagataaactacaaagagtctgataatttaaaattagtcaccaaattggaatactagattaaccaacagaaggcattttaaaagcattaggttatagtttttttatttgggaacaaacgatccattacggaggaactgaaagaaaacctgatttcgctaatgtgatttgtgaagaaatgatggggatgtgttttagttttacaaagttataaaacttcagtctacagaatcaaggagtgtaatcactcagtactttatattggtcgggtacattaagaatagtagtgaaatgcactttaatgaataattacttagaacctatccagaagacagcaattagtgttaaaaatggttgtgttcagaaaattggaagaaacagtggaagtcaaggggaggtatgtctgagaatacagagtagttttctaaagatcttatggtgaaataggctaccttttccaaattgattgtcaatcagtagaagccaagcagaccagattaggggggaaaaacaacttagatgttgtaataaattacaaagcatagatttccaccccctctccccaaaggaacttggaaaccagttaggtgctcccactttacttttgaggaaaaaatcccagagatgttaaaagtacttgagagtcaggactgaaagccagtcttttgacttttatgttcttcagggaactttaatcaatttcttgagt

SEQ ID NO: 4282 - DNA, 1084 bp, Homo sapiens
gttgccacaggcattcatgcagaagacttcacttgatgctgggcttagaaaatcatagaatgcatggtcgctgctctgaagaaagaatttagtggcatattctcgcttgacttatgtgctgtttcatgcctagaatactcagctattttctttctcctagaattctgcctgattttccaggttcacttcaaattccacttatttaaaagccttggttgctttgatggacatgcagttgtggataaacaataaataatatttctagatagtctgtgacataatagatacctagatactaattgagcaaaataatttttggcatttttgtcctatactctgttttttttttccatgtttacatcttgtcttttcagcaagattgtctatgctctcatggcagggacttcttttatgttttccacagagctagatccttataaaatacttgcactaaattaaacattatgccatgtaactgagcttatttgggggaagaggtcaataaagactatggaataatttgaggtcttgggtatgagataccaaaggaggtagttgctagtacttgagagattgctccaaataacatcagatgagcatgcttccaagtttcctgcattacttgcatgacccatgattctaagttaatgaaatgagtttgtccctcttctcacccactgtccctgattattttatgtatgttatacttaatgtcttcattttttacctttagtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaat

SEQ ID NO: 4283 - DNA, 1031 bp, Homo sapiens
tgctgggggtgggtggatagccaggattaaaaacttcccatctagaatggtggaaaaataactgaagatgtttgacaggggagatgagaaatgaaattggagagtttttgttttgttttgttttttgagacaaggttctgatctgtctcccaggctgtagtgctgtgtcactatcttgttctctgcagccttgacttcccagtcctaagtagctgaggctccaggcgtataccaccatgcctggctaattttttgtatttttagtagagatggggtttctccacgttgcccaggctggtctggagctcctgggctcaagcagacctcctgccaaggcctcccaaagtgctgggattacaggcgtgagccaactcacctggccaaaattcaagtttttgatagtctggtggtggtatgtgacagaaaatggaaagtgtgcacactggaagttggcggatatattagacacctgagctaaaatatgtcacttagtaggataagagatgaatacaaaagatatagcgagggaaatactaacacaacttgcaacattgggtatggtgatggagaggggaagaatcaagatagttaaagaagtggccctacctcaaaccagttgtattactctgagtggaggctgggcataggtttgtttttgtttttttttttttaaagcttcccaagtatttgagcaccattaccctgagacatatatctagtctgggtaataggagaatgatctaaataaagttgaaagatcagacaagtgtatgtaacatttgatatttgaaggaacatgggatgttagagaatagaaaatggccagatcagctgttattgagtttttattttacatgtgaggaaagtgaaacttagagagattaaataacttgttcatggtatttactagtaccagtgattgcgattaggctcttctggtctgagctatttaatcagctctgacctctcacctgataatcattcttctgatgttttcaaatatccatttctcagcacgtacacctttttct

SEQ ID NO: 4284 - DNA, 1057 bp, Homo sapiens
agaggttcataaagtcacaacaaagcaggcaggtgttttacatccagctaagcaagcaaggtagcaagaggcttggagtttatcaagggcatggagtcaaaaggagagatcacttcctccaccgttccctgccaagtgctgggaattcaaagatgattaagacacagcccttgatcttgaggcactcatgcctttatttagcctccattttgcctttgattagaatttattccctgtttagtctttgctccttgagggcagggactgtgtccttttggcatcccctttctcccaatccctcagtacctaatagagttaagcatggctccagctaaggtagttgtgtgcactgaccctggagcaggatctgtttatttcctttcccacttctgtgctactaagtggaggccaaggaaaagcaatgggaaaacctttggtgatcagtgcctctcaaactttaacgtgcgtacagatcacatagggagcttattcagctttattcggattcagtgggtctgcatttctaacaagctcccaggtgatgctcgtgttgctggtctgggaacatgctttgagaacccctgttttagatgtggcctgaagaggtcagagattcagcagtggcacttgtttctgactgaagcagggtgtgccctgcttcttggcttactcacttggcttgtttttggcagttcttttaatttcagttaccactttacctttattaagtctcttttttacgctaatacttgatgctttctggaattaccgggaggccacctgtccattgttcattgcatttcaccttgttgttctagaacatcagccatgaagtgtctttgggtctccaaccatgtgtgacaaaagagaacgtaacctctatcccccaaccttgacagttaatatcgcgaagctgctcccttaaaacaagtgatgctatactgagcactgaaacaaatcatgtcatggttgctaaggaattaaagagagaatgctgccagcaagatggaaataccagatgggctgggagcacatcttacagatgaattaactcggg

SEQ ID NO: 4285 - DNA, 1050 bp, Homo sapiens
cctgagaataaggggtagggggttgggggttaggggatagttgggagcaaaattgcctccaggtaagaaccactgttttacagtttaggcttgggtatcagtgtgtaggctcacattagcaatgggaataatagggaagacaacaaagttggtagaatttggaacttggaaagttagcagtttccttttaatcttacatatttgttttaagggtgtcttcaggacctcagcaaaccctcctagcatttcctgttcattccaacatcccacaggtatctttgttgataagggctccccctactgggcatgatgtccttaagccttcagtttacaaaagctaagatcttagctaggctattcgagcaaccaccccctttctcccctgtcactattgtactaaagaagttcagaggccatctaccatcccattagtggaatagttccacgtaagggccttttaaagtcctagttagattcaaagacttctggaagagaggacaaagttcagtgcaagcatcagtgacccctccactctgaaatgagatatcagggttcaagtcagccaactgttatacaaaacattgttacctggagtatctccttgcttcattcccaaagtatgtgcttatctgtatcctcagtgagtctctgccagtgaccatgtgtctgaccctgagatgtgttttcttaattcaacaactgggaaaggctctataaaagtatcccttccttttctctccttatctcctctgtggcaccatggacttgggaaacccagtcatggctaaaatactaccttgtttctgaggcccatactgagtccaatagggtggcagaatttctagaaggaatgcctttgatattagcagggctttaaaatcccctgaaacaccctagacatatgtaacctaagagccaatttatggcatgcatccattggtttcaggagatgttaggggcagaattcattcattcaataattatcgaataccaactatatgccagatatcgggttaggtgctgaagacaggaagagatatgaacctgcct

SEQ ID NO: 4286 - DNA, 1090 bp, Homo sapiens
ttttttgtgtgtaaataataatttcttcaaatgctcttagaaccagtttatcatcctgctggttccctcatcaattattgaaggcaataaaagctttgacatagattaattctatattggtaagagagtcatgtttttaacttttgaggatttttctttgacatcatgatgcatttgagtgaaaaaatatataaattaatattttatatgacatacaattaacaaattaagtgttaattagatattagattagttcgtcttactccctaaaaatatatgtttttaagtgggtcaaaaactcttctacatattcagtgtttatttaccttgtattgggatctatatgccagaagtaattgatgattgtgagaacagaaaatgcaatctgaaatgacgtctgatgaattgacagagaccaggaaggggctggaactttttcctacaggtgatgggaaccactgaagtgttttaagtcggagtgatgtgagttttaaaagatgatttggcagcagcggaaaatgcatataacaccagttagacattattgtaatggcccaaacaggacccaatgagggcttaaaacagaacaatgataacaggaatggaaaaatgaagtcaaatttaaggtaaaaatcagcaaaattgacattttgcaggtgcaaaaaagggagaaatcatgaacaactcccatgtttagtcattgtagccagacttggggagtggaggtgctattaactgagacagggaacacagaagttgaattaggtttgtggtggcaggttgaggagcctacaacaagaacggtggggctgacaggcattgctcctttaaatggtcattgcccctttaagattctgcccttcccccttaacccacccaggcccctgctggatttccttgccctaatttacagtcagcaccaaagcttctgagcatgcgctcaaggaagagctggactaattaaagctctcctgaggttcaaggtattgcatctgtggctcttagcaaagagttccatttttgagagcatattttctccagcttaccattttttctcatttttctttttaaatctttttcctccataact

SEQ ID NO: 4287 - DNA, 1063 bp, Homo sapiens
aaaggagggaactttggacaggtgctgtagcagcaacagaatggaggctctggggcttatggggtatggggattaaattcacactgaggcaggagagtgttgagagggaatccagccatcttctcttcctgggctcacagggtggtttatcctgggggttgttgtgcagcagttctctgatgtcaaaaatgagcaggcttagggaaattgatctactttggtagagattgtgggctgtccaccaatatctagctaccttactttattaaaaatagaatccttaatttttagctaggcaaatgcctcctacccctagttggaataaagacatttttcagttttcttgcatcagaatgggtttgcatgagtacacctgggcagtgatttgtcagactttgggaaaatatgatttttttgttggcaagaaagcagcctggatggagctccagtgaccatcttaaaccactagacaaaaactcatgttgaagataatggagctataagatagtgactgatgatgactgtagagttgccatacttgtcccaggctgccaacatctggatttcattgacatgggagagaaataaatgtacattttatttatgctactgttttgtctgttttatgcaaccaaatctaacctaatctttgtccatataacaaaagtcaaaagagtataatgcaaactcatttataactttttaacaatggaaatatatgtatctcatctaaggacacatcttccaaggattttagcacccaagaagccaaagtattcattcaaagattgaggggtgaccagagtcttggatggggcaagtccatcaggtcagttcttgggctttagtccatcaggctctatagaaacttcaccaactctctttactgcacaaccaagccctccactctcatgagaggggagctcatgtcctctaagccccatgtctctttccactgaaagagcactgctctcagattcccattttccccaattctattcaatttgtgtcttgttaacataatcttcctttaaatcagatgcaatacaactgaggatgactc

SEQ ID NO: 4288 - DNA, 1032 bp, Homo sapiens
tctcagtaaactaggaatagaggggaaactttttcaacttgttaacaaatgcctacaaaaaaccctgcagctaacatcatctgtaatggtgagaaacttgaagctttccaactaagaccaagaataaggaaataatgttcttctcaccactccttttcagtattgtactataagcactaactaatgccataagacaagaaaaggaaataaaagttatacagatgagaagaaagaaagaaaattgttttagttctcagatgacatgaatatctatgtatacaatccaaacgaattgaccaaaaacctcctggaactaataaaaaactatagcacatttgtaggatacaaagttaatatacaaaagtcaatcacttttctataacagcaatgaacaagtggaatttgaagtttaaaacacaacaccatttaccttagcaccccaaaaatgcaatacttaggtacaataacaaaatatgtcccagatttatatgagaaaatcaacaaaactgatgaacaaaatcaaagaagaactaaataaatggagagatattctatgttcatagataggaagactccttattgtgaagatgtcagttatttccaatttactctataaattcagtgcaatcccaagcaaaatatcagaagtcatttgtggatatcagcaaactgattttaaggttaaatgggcaggcaaaagaccagaatagccagcaaaatattgaaggagaacaaaattgtaggactgatactactcaacttcaagacttactataaagctacagtagtcaacatagtgtggtactggtggaaaaataaaagacaaatagatcagtgaatcggaatagagagcccagaaataaaccaacataaatatggtcaactgatctttgacaaaggagcaaaggcaatacaatggagcaaagatgatcttttcaacaaatagtgctgtaacaactggacatccacatgcaaaaaaatgaatctaaacacagaccttatgcccttcacaaaattttactcaaaatggac

SEQ ID NO: 4289 - DNA, 1057 bp, Homo sapiens
agagagtgctcagcctaaccttagaacacatttataactgaatacagtgttttcaatttgtacataatagttagaatattctattaaagttatgaaacacggagaaaaaaaagaaaaagtgcaaatgagtcccaatttataactgatagatttgatttttgaagacagagaaaagatcaaacccacagaggtgtcactcaaaggagcactgtttgtacaagtcacacaattgcaagaagtttttaaaacgagctgcaaagttaaaatagttaagcttggagcaaacattcctttattaattccaccttttgagtgttacataatacccaaggcatacgatatggaaatgcaatttgttgtaaaagcagatagttgctttataatgggaacaacaaaaaataaaaccagtgtgcttttgccttttggtatatgtgtgctgcatctaactgacaagggggaagaagatgaccacatatagacagagcaagcaagttgaaatcttgaaaagttttaagtgttccaagagacaaaatacttgaaggaaataatttctgagtaagatccctctatagaattacatggaatattttaggggatttttaaaggttttgcccttgcaaaactttatgtttaactttatgtttgccattagaatttgaagacacaaagtaaaattactcttactgaaagtaagattactttccctgtaaatagtctggtaaaagatcataagaggaatgatattcctcttattgatttgaaataagtactattaatttgaaaaaattcttttaattattaaataatggtgatttatccttcttttacattttcttccaaattgatagttcacatatatacaacagattttgaaagtttgaggaatgttgcttgataggtcttaggtttaaatcctggagtagtgttgacatctgagacatatgtctgggcttctgaccctggtttctgttaaccaaatattggaggaccttctccttttaaaatgcaaaccaggagctgaacttaatgatcttaatggttcttttgaacagtaaca

SEQ ID NO: 4290 - DNA, 1068 bp, Homo sapiens
gagggggtcacagtttggaaaaagtcatcagggattctggaactaagtctgataaaagattccagtgaagccctgttctgagaacgagcagactgcaggggaggccatgggattccccaggccagtgtctgtgctgatccttcaagggtctgcaggtatgcaggtggcctgggctgctcggcagatactttgctgattcccagctgaggggagcatggtggcgattgctcagccattttctgacagacacacagacctgccttttctcccccaagtataccgtaccctcctgtgagacagtgtgtgcaggcaccaccaccttaatcctgctgttgcctgacatgctgattctcatttattatgctgcatcaacacattagaggtacaggagcggctcagtcatgaaaaaagaaggtcttttgccccatttctttatttcagagatgtgggctttcagtgggaatttgctgactcctactttataggctgagtcaatgagggaagatgactggcgtttcctctgtctaaatgggaggttgccagagcgctggctgggactaggatgtgtaactaagatttcagtttgaaatcttagatttcagttcacggcgataaagaagtaggtgctgcacacaaatatgtaaagcaattgtaggaaatttgaaaggaaaaaaagaaaccgaagccagtattttaataattgctttttctgtgtattttgtattgggctgggggatagcatcaaaggttgaactttttgagctttctatgaaaaaccccaggaccttctttctttggccatttctatggaaatgcgatgtcagatggatggtaatggtgccctccagtggctgtgagacctcattgcgcattgtctactggagctttagtcttctgagacggaggaaaactgctgaatactctggattcatctatgtctacaatgttgcatttatgaaaaactacactgtgctaggcgcattctaggacatgaatatgaccacaccctctttcaccgggtgtttctgtagcaagttttcatattcttttcaaacaatggtttctctg

SEQ ID NO: 4291 - DNA, 1043 bp, Homo sapiens
ataatatcttatagtatggatgttactatcatgtgtttaatgatggacatttagtttattttgagcaaataaatttaaacaaccccttccctgtttgtcccttgtcattccccagatgcttccctgcaggtggacacagtggtccccaatgccacggtctctgagaaggcagctttccagctggactgtagcatcgtgtcccgctccagccaggactcccgcttcgctgtggcctggtattccctgaggactaaagctggggggaaaaggagcagccctggcctggaagaacaggaagaggaaagggaggaggaggaggaggaggacgacgacgacgacgacgacccaacagagcggacggccctgctgagcgtgggcccagatgctgtctttggcccagagggcagtccttgggagggcaggcttcgcttccagaggctctccccggtgctctaccggctcacagtgctgcaggcaagcccccaagatacaggcaattactcctgccatgtggaggagtggctgcccagccctcagaaggaatggtaccggctgacggaggaggagtcagcccccatcggcatccgtgttctagatacaagtgagtttcccaagtacagagggaggatgtcactgttggttccaactgtgtctggaagataaatttgagcttgattatgggttaataaacagttttcttaactgtcatgggcatttattagtaggatttgagatatggtgggattggacatattagttcatataattgacccttgattacccatgcaaaaatagggatagaaattaaagtgataacataccatataatctttataataaactcgatgttctaccagattcaattttagtaatatttcattatactagtatattgttaggtgttactttgttattttttagaatattggaactagtctttagcgaattagcaagcgtttcagactcacaagggaaagggaaaaaaatgaaggctgactacctcactgtcattatttctttttgtccagtttctgcgttattgt

SEQ ID NO: 4292 - DNA, 1056 bp, Homo sapiens
atagtaagtggcagagccaggattcaagtccagacaggcagtttggctccagagtccaagttcctaattttattattatatgttctagacaagtgtttttcttctcaggaatcctctttggtactgtatacttgtatttaatgtttcctctctctggttaaccacccctgatttcctaatcccctttagcaaatccttaaatttgttttttggaagttggggtcataagacattggtagaggttcctcaagacacagtttgctgatggtgtagaagttttatcttgtgcctcttttaactcctgattcttccagcttctgccacaaggtggctctaagacttgcggataccagagctccgaaccagcgctgtcctctcttcttttgctctccctgcgtaccttgcccctcaaaacatagattcttagccctgctctggtgtcttccatagaaatgtcccctgctacccccgttttaaagaatattgtgttaaatattcttattccatcagaatcaaataggaacccagggactgttgactcactcatgctggtctgtttaccatcagccttccactgctgtgatatcatttatcgcagcaagcttctttgtggtctgtgccccagactcgtccctgctggagccacctgctgatcctgcccccatatcagtattcatcagaatctctggttggatggcacagttgacttgtggatctgttatttgaccattccctgtgtgtgcttcctgttgcatatgcatatccccaacagaatcttcaaggaatgccatcactgtcaacgttgccattgatctagcttagtctgatccccattgatcacatagtgtgacccctcaaggggtgcttaggcaagactttcagccagttcacatgtttgattattagctcttaatcagttcttttctcttttaattgtgaagcataattgccttgcttccttctgattttctttagctcaaaacaccctccaattacatatccttaaatacagaagcagtaagggaaatgttagcactcattttccaaatgtttatg

SEQ ID NO: 4293 - DNA, 1045 bp, Homo sapiens
caaatgactgcagttttctgcattgttttcctgtgaggtccctgatgttttgaaagagccaaaaccagacagggatgctatcaggttgcagttctgctctgctgtggtgtttctgtgaaatggagaggaggattttgaggaatgtgtagttgggtttacttttgtctttatttgtgggcacgtttcctgagtggggaccactgataattaggtgttctttggtgtaggggcccagatggacagcgtgggacccctttctaagggattgtcacagtgagagggctgagcactgaagtttatcttgcagcatgcgtgctgggagcagcccctccaaattggtgcacgtgtttggggagggcagagaccagggcatagactggctggcaaactcgcctgctgggctgaagagtcctgaccttgcaactggaagctctgctttcctgccctttccctgattcctgctaattttatgacctttcatcagtcacctgacctttctggacttcagcatcctcactgtagaatagaaacaatgatccctctttcacagggatcggaggatctgtcgcatgtcaaagccctttctacacctgtgacaacacaagacgtgcccgtagacacctgagcatgggcgtggcagaaggccaagctcacacccaggaagccacctgcccttctgctcctcatccttgtcagtcgctgtgcctgcatccccaggaggacctcacgggactgggagggcctgggacaggctggccacaggctggcctcagatcaccaggcattgagacctcctgctagcctcaggctgacagtaataaatgtacaaaggaggacagagctgctgaggagcagctgggagtccagacacaaacgactgtcggaggagtgagtcagggcctctgaaggtcacttgaggagtgtccgccctgaatcattgacctgcggcatgaatggagaagtagctgggataccagccctggggcagttccgttgggtggatctttagaagagagaggtggcgtgggaggggtaagagcactga

SEQ ID NO: 4294 - DNA, 1026 bp, Homo sapiens
ggaaggtgtgataactaaaggatataaggtgtcctaaatgccttgactgccttaaataatgtctgaaactcataatagatttgtgcaatcagtggttctcaaactctcgtgtgcatgttggaatcactggggaagcttttaaaaattctgatttcaggcaacaaccccagatcagtgaaaccaaactcgcttagggagtgggacccaggtctcagcctttgagctatctcaggtaattccatgcatggttcagtagagaaccagtgggtgagttcactagcgccagtgccctaccacccaacgcatgcagacaccctgctggtagtttagttagtcttctgttcagctgtgggctgggatacaggcagtgtctccatgtcacctgtatgctcaggcagagtcaagaaggcagggagcccttcatttgccagtctcttcatattggatctgtatttgttgtactgtatgtgtcattcgcttagtgtctgggtttaaatcagcaattagtgattcatgtggattcaacaggacacaaacaaggaaagcccttggggaggtttggatgtggggtggggtgtgtggctaaggcgggaaagagggctgagtggcagggtggggcccagggcaggagaagtaaccatcaatgggaaaacaaggcaatgtgacatttgtgccttttgtttcttctggctgctcaagtaatgtaaggctgcatgctggtccccctgctgttcgctctctgggccactctgtggagtggagctcgggccctggcacctggcaggtgctgtcattttccctccaccctcatcttcatgtgtaaacaggtgccatggaggaaaatgagcatcaaggtggctttaaaggggcacagtggcagacatccagatgcaggctgaagtgggaaggtttggaactgtaggcatgcatgtggatctctgcctgatttggagccccactggtggaacctcatctttctcttcacctgatggctctcagtatggcaggaaggaggcctggctacta

SEQ ID NO: 4295 - DNA, 1034 bp, Homo sapiens
gggttcaagtgattcttttacctcagcctcctgagtagctgggattacaggcacccaccaccacacccagctaatttttgtatttgtagtagacagggtttcaccatgttggccaggctggtctcaaactcctgagctgaggtgatccacccaccttggcctcccaaagtgtggggattacaggcgtgagccaccacacccagccaggacttcttgatttctgccttaatttcattatttacccaaaagtcattcagaagcaggttattcagtatccatgtacttgtatggttttgagtgaaattgcattgtcttgatttctaatgtgattgtgctgtcttccaagagattgtttgtaatgatttcatttcttttgcctttgctgaggagtgttttactgctgattatgtgatcagttttcaaatatatgccatgcggcaataagaagaatgtacattctgtttcttggggatggagagtttggtagatgtctatcaggtccatttgatccagtgctgagtttgggtcctgaatatctgtgttaattttctgtcttgattatctgtctaatattgtcagtgggtgttagactcccacacaataatagtcggagactttatgtctctttgaaggtctctaagaacttgctttataaatctggatgctcttgtgtcacgtgcatttatatttaggatagttagatcttcttgttgaattgaacccccaccattatctaatgtgcttccttgtctttttttaatctttgctggtttaaagactgtgtctgaaactagaattgcaacacctgcttttttctgttttccatttgcttggtagatttttcttcatccctttattttgagcctatatatgtcattgcatgtgaggtgggactcttgaagacagcataccaatgggtcttggttctttatccagtttgctactctgtgtctcttaattgaggcatttaaatcatttacattcaaggttagtattaatatgtatggatttgatcctgtcatcatgctgttagc

SEQ ID NO: 4296 - DNA, 1081 bp, Homo sapiens
agcagtgtgatgttagattgcataatctctgtgtccactttgtcaactgtaaaatagagggtggagtacaggaagacagggtgcatgtaattggatattgggatatctctagagataaggtacacaaatgttaaataacacctcttgcttagtaagcattggttattttcacgtgctaagtactttcaaaaacaactgtaaggggatacagctttcaaattctcttaagtatttgaactcatcgtctttaaacccttacccttatttatgtcatattaagggtttttagcctattgaaatgttggggagggtttttattcatctggtttagtctttcttccttagagatgagtaagcacaggaaaaataagcatttccaaagtcagcaaatagtgtttgtcctaataagccctaatatagacaaatggccataacttcaatcaatgaattatcaagttataaacttaaaaatatacacagaaacaatctagtaatttgtcgaaccttgaaggacactgactgcttaatggactttagtcataatatgttgtaaccctagattaactgaaatgggtgaaatggatatgtatatatagaataagtttgtgcaaagagaagataacctggttttcaacttctttgaaaacatgttttagtataatctttgtgcatcgtttagtaagtataatatattctattaagtttcatgtttgtcttatgtaatgatttggaaagcacatccaggtctttcagtgtctcgggctcatccttctcatactgtttcacttcatcctgtgtggtcagtgtagaaggttatcagagcagaatctgtactgccctaagaacaagtctgggacttccagagcatctttaaagtaagttcctattatcagtttatttggcttttgcctctttttctaaaagtaaattataatgttaaaattccagtttaattaaggtatgtttactgatgttatgggatggcttactttagactcatcaaattctgtaaaactggaaaagaaattgaaaggccttaattcttacagcttttactcaaggaaatgagcaaatctagcac

SEQ ID NO: 4297 - DNA, 1046 bp, Homo sapiens
ctgccttgatgttgatggctgctgactgctcaaggtggtggctactaaaggttggagtgactgtggcaatttcttaaaataaaacagcaatgcaattttccacatccgttgactgttcctttcacaaacgatttatctctagcatgcaatgctgtcctttagcattttactcagagtagaacttctttcaaaattggaatcagtcccctcaaaccctgccagtgctttaccaactaaggttgtgaaatcttctaagtccttattgtcattccagcaatgttcacagcatcttcaatatattccatctcaagaaactactttgtttgctcatccgtaaaaagcagctccttatgcattaaagttttctctcgagattgcagcaattcagtcacatcttcaggcttcacttctaattcaagttctcttgctatttcaactacatctgcagttactttttccatggaagtcttgaactcctcaaagtcatccataagggttggaatctactcccaaactcctattaatattgatatgttgacctcctcccatgaatcacaaatgttctcaatggcatgtagaatggtgagtctttcacagaaggctttcaattgactttgtccagatccatcagaggaattactatctgttgcagctattgccttacaaaaaatgtatttggtaagtaataagacttgaaagttgaattcactccttgattcatgggctgcagaatggatggtgtgtaacaggcatgaaaatttcatcttgtaaatctccattagagactttgggtgaccaggtgcgttaccaatgagcagtaatatttttaaagaactcttcttttctaagaggtagatctcaacaatggcttaaaatattcagtaaaccagccagtcgcggtggctcacacctgtaatctcagcacttttggaggctggggcaggtggatcatgagatctggagttcaagaccagcctagccaacatggtgaaaccctgtctctactaaaaatacaaaaattatccaggcatggtgtcacacgcctg

SEQ ID NO: 4298 - DNA, 1074 bp, Homo sapiens
aagttaaaaaatacaactcttctctaaatacagcttttttaaaaaaagttatgttcacaaaataggtttttcattgtttttaaattaatgaatattttttaaatttctctgtttttatttctaatgagaactggtagatataaatgacacaaacaaaagatgtttaaggtcctcaataatttataaaaacataaaaatgtctgtgttttatatagatatattttggtcctgagaccaaaaagttttagaattgatggctgtttattgaggagtttatgatataactaagctatgtcaactgtttgcatgctcagccgtatttgagattgtaggttgtagtttttaaaatttctttctcttgatatttctaaatcgggcttttattttcacatattgagtctggcttctgttgattatgttaattaattaggttgaacaaatgtaaaagtaagtaggtttttagttagtaaatatcttttcaaaagccttcaattcttccatcagtagcgaaactaaaggtcacatggattggcaatagttttatgtcactcctttcgtagcactgccttgtcacctcagtatctcttcaaaataattgtttttaacatgaaaaattagacgtgctttctaatccaggtctgtcatccagttgtgattctgatttgggtgtatcataaggtagacattggtttacttaccaaaattaggaagcaacctagatactctttttcaaaaatactgcttttgaaactcttcaagttattttacaggaagatttcctttccttttttattagtattacttgactggcttaagattcaattgcctgtgactcttatgtcatttttctcaacaaaatcattatctttttcattattaaatacttattaagcttttactaatgtgccaaatgttgtgctggatactactggtaataaagtgacaagcaagacagatacagcacccgcctgcatggagcttagggtcttgcagaggagaaaaatgttaaactaattagtatatgaataattgtttaaattactgtacagggtcaataagaggatacaacaaaga

SEQ ID NO: 4299 - DNA, 1030 bp, Homo sapiens
aaacggtattagcactctcttctgcccctggaaacatgaggactctctgactgctctgggggttcccgttcttttggaagccctcagctggtcttcagcagcagtgatgacattaaggaaaattgcattctgctgcagaattcagtcccttcatctttctcctttctctagagcatgaagctaggggcccataaaggatccaatatcaaaaggaagagggtaataccactacatggagaagaaaaaaataataattaccaaatttcctgaatagtaaacagcttttaaaaagaagaaaaagctgaaccctttgatagcttggcccttggtctgcccgtgaatgccttaaggattatatcatcagactgactccagcagcccgcgctattgtttcagaaagaggaaactagaaagaaggaaaagaagaagaaaaggggatgggtgggagcatgtctgccttttggggaggagagcgtttgatttttggaagtgcagttatcaaatgtaaggctagaaagacaaattgaacaaattctcagtgtctgtgggcaggaggtttctggggccattttttccttttggggggattaacatagcctttggattcaataacttttctatcacagatgaaattagctccgaagagaaataagcgacctgagattgcccagaaatgttattcctgaaaaccatcacctgggggcagtcttgggactgttaatttcctctacctcactggtagataattcactactttttttcaacgatgtagtgtttctttatctgtggttgaggagtgagaaaaatgggcaagagaaaaggaggcttaggcactagaactttcactctcctcaaccagccaggaagcgaccccatgtgaatgcgcaggacgttcttgaagtcgcagaagttttcctttggagctctgaagcggagagcctcgaaagctggaggcggaggggtgaggccgtacacactaactggtccaccgacccttaagatctccgcgccggatgagatcgagaagccg

SEQ ID NO: 4300 - DNA, 1033 bp, Homo sapiens
caggcagatcacctgagctcaggagttcaagaccagcctggccaaaatggtgaaaccttgtctctacttaaaatacaaaaaattagccgggcgtggtggtgtgtgcctgtagtcccagctactcgggaggctgaggcacaagaattgcctgaatccgggaggaggaggccgcagtgagctgagagtgcaccactgcactctagcctgggtgacggagtgagactctatctcaaaaaataaaaacaaaaagaagactgaaaacaaaagcaaaaatgatatagaaaaatgagaaaacagaggcctcaagaaactgcaggcagaaaccaaaccaaaccaaaacccagaaagtatagagagtaaaatgattgctcagaaacttcagactggtagagtcagagaagaggtgtcatcataatgtctaagaatcaggctactgccattgaggaccattgaaaataagctttttgagagctttgtattattattatttctctttctttgagactgtcataaaacagcatttgagagctttttctaagaatgctggatttcctatagctgccttggaaacttccagttcttgaagtgcttcattctttgtgaggccggttgagcctggatttttccgagatgcaggaagctactcatttctgtagtctgctcatatccacatattcacccactctacctaagcaataattttttatctttctctttccactttacctctattaggcaaatgcctacaccaaaccagaaccctactgaaaggcagtatgaaaaatgtagtttccaggctgcagcccctgaaaatcaagaggtagcatagaagggagagaatggtgctgagatgtcaacagataatccagtacactctctaaaaagtaacaggaagctatttgtacattttaaggatacagcaaatttgatatgacttatacttttaaaagagaattgattaaaatacagagaatgagttttaggaagagaagaatatctggggccatctatttagaggctatttcactagtct

SEQ ID NO: 4301 - DNA, 1047 bp, Homo sapiens
atcatgtgtctaactattgcgttcctaaggactcagaagaaatggatgatgtgaccaaagagctccaggagaagggctgtggggctcgtaccccctcaccaagtttgtctgagagctctgaagatgaaaaaccaacaaaaaagcgcaaaaaaagacaaaaaggaaaaaaagaaaaagagacaactgactgggaggtacaggcagagcaaccatcctcttcgtcacccagaagcaagacagtaaaggaagaggacaaccctggccctaagaagcacagcagcaagaactaggagagagctcagaagtcagtgcccagggaggggcggaagctccccaaggccaggactgcctactctggttgggcagagaaccgagagagggagctgaagaaggggaaacccaagcacgagcacaggtcctcaagcaggagggaggcaagagaagaaaagaccagggataaggacagagggcggagctcaggcacactttctagcccgtacaacgggcgttctgaagggcgtagtcatagaagtagaggtaggagctgagataaatcccataggcataaaaggacccagcgctgccgggagcaggagtctttgaattccagtgactgtaggcgtcactgaagactgttcagctgctcggtagatttggaaataattatgttttttaaatgcagtcaaattcagttggattgttactatttttgtatctaaaactcctggggctggattcttttaactccttgagtattagagtcattgagagggctgcagtttcaacagctacatatcctagatattcttcgtaccattcattgtccctgaaccagagtacgtgccctgaatgttgattcataaatatggctcttgaacccgtagaaccaattgaagatggaattttcaggaaagggaaaataccagataattccagaattctagttttgtgtttgatgtttagagctcagcatcgtgggacctttccagttactcggtttggacagcttgatgtgaatgaatgggataggatttttaagatcaacca

SEQ ID NO: 4302 - DNA, 1043 bp, Homo sapiens
tttactatagtaacctttttggtatctgtatatatcccataacatcatgctgtataccttaaatatatacaataacatttattttttagaagtttttataaagagcttcaaagaaaatttaaagacatatttacttgtttttttaaagtaaaagaaatagtttactgcttatttaaaaaaaaaacaaacacatatctcaaaaccgtttgggctggggtaattatgccaaaaaacaatctcaagatttcaaagggggaaaaaaaagtccttttggagagcaataattgatcatggaagttgaaatagcgcatgccatccatactgcttcatctggaaaatggtatacaatcaatatttttttttaccaaaggaaataaatatttgctaagtttaaatttacatttttctgagagattacagcataatgaaaatttcagagctactgtttaaatggaagaaataaatggagcaaagtcaactatgtgcagtaattttatggaatcaatgcaaatgtgatcctagaactttgatcccagaacaaagtaacagcaacttcatctatgattatagccccttagttgatggctgtttgtttatttgacatggtctatgtaataatgcttcctgcctctcagcactactacctacatacagttgtggtttggtcagtcaccacaacccgtgcagaatacttttattctactctgcattgccccaggtcttgcacagtcttggaagagaaggccagtgtcctggatgtgaatttctgacagaaatagtaaccagattacagatcctgaacaactgaccttacttaccttatcagtttaagacattagtcaagtgtgctattaatagttttctaaggctgccataaccaagtaccacaaactgggtggcctaaaagaacagaaatgtattctttcacagttctggaggctagcagtctgacactgaggtgttggcagggcatgcttcttaagactctaaggaagaacccttccttgtctcttcctagccgctggtggctcttcgcaatcctt

SEQ ID NO: 4303 - DNA, 1116 bp, Homo sapiens
ggaataaagataagaattacaattgacttctcttcagaatccacgcaagcaaaaagagagtggagtgaaatatttagtgttaagaggaaaaaaaatcaatctggaattctgttccctgtgaaattattatttaaaagtgaagaagaaataaatactttcttagacaaacaaagatttagagaatttgttacaggacacctgccttgcaagaaatgttaaaagaagttcttcagagaaaaggaaattgatataggtctgaaatttggagctacataaagaaagaaaatgcatcagagaaagaataagtgaaagtaaaatggaaactttaatctttcttattcctaatttagctaatagataacaattcattcaaaataattatagcaacaatgtatttgattacatatgcatatatatatgcttatttatgcttatatataagggaaatgaatgacaccaatgatacaaggatgggaggaaggaattaggcatattttgttattactaggtatttgtaccccctgtgaagcagtaggtgttatttcaaagtcacttggattagtggtaaatgtatggtgcaaagtctagggcaatcatgtagaaaaataaaaaaagtgtaatagatatgctaaaaaaggaaagaaaattgaatcatataaaatgcccaattaaaaactacagaaaagtatggaagacaaaaataagaacaaaaaaaaggcagaaaagtgtggaagacaaaaataagaacaaaaggccacaagtagaaaacagtagcaaaaatggtagatgttaatccacctatgtcaataatcattttaaatgtcattggtttaaatataccatttaaaagacagattgttgaagtggatcaaaaaaaccaacaagaatcaacttatgttgtctacaagaaacccactttaaatataaagacacatatggatttaaagtaaagagatggggatataccatgataaaactaaataaaagaaactagctaaaaggggatcaactgtattaatttcagacggaacagactgaatgtcaaggaaagttatcaaggataaagagaaacattacttaatgataaagaggtcaattctctaaaaagacatgata

SEQ ID NO: 4304 - DNA, 1050 bp, Homo sapiens
tgtgatgcctccagatttgttctttttgcctagtcttgctttggctatgtgggctttttttttcttacatatgaattttaggattgttttttctagttctgtgaagagtgttggtggtattttgatgggaattgcattgaatttatagattgcttttggcagtatggtcatttttacaatattgattctacccattcatgaacatgggatgtgtttccatttgtttgtgtcatctatgatttccttcagcagtatttcaacgttttccttgtagagctctttcacctctttggttaggtatattcctaagcattttattttattgcagctgttgtaaaaggggttgagttcttgatttgattctcagcttgattgctattggtgtatagcagtgctactgatttatgtacattgattttgtatctgaaactttacagaattcatttattagatctaggacctttttggatgaatctttgggttttctaggtatgtgatcatatcattgccaaagagcaacagtttgacttcctcgttaccaatttggatgccctttatttctttctcttgtctgattgctctggccagggcttccagtattatgttgaatagaattggtgaaagtgggtatccttgtcttattccagttctcagaggaaatgctttcaacctttccccatgcagtataatgttgcctgtgggtttgtcatagatggcttttattaccataagatatatcccttctatgctaattttcctaagggttttaatcataaaggaatgttagattttgtcaaatgctttttctgcatctgttgagatgatcatatgatttttgttttcatttctgtttgtgtggtatatcattacgtttatttacttgtgtatgttaaaccaaccctgcatccctggtatgaaacccacttgatcatggtcgattatctttttgatattgtgttgaattcagttagctatagaagatttttgcatctatgttcatcagggatattggtctgtagttttctttttttgttatgtcctttcctggtt

SEQ ID NO: 4305 - DNA, 1046 bp, Homo sapiens
tcaaaaacaccctcccctccctgacacacacatatcttatatgtacatggaatgataaggagtatcaactacttttcttcactgattaacatagtctctacttgcaggcagatttaattgggaagccaaattattaagtaagatagcttgatgggtatggaatcagagcaaagggagttcattaaagcacctcattggctagggtaatcaagctatcattacccaaagatccatctccagtatgggacacacgtgttccttgggcaacacattgctggcctgtgccatagtgccaattgacttgggcagttctttaaaacacaaggccagagttttcccagtagagcttcttttttaaagtttccacccttcaagggaacatattctttctttagatatgttaatgtgcctaactttgtttctataagtgtattaagtcttgtcctcagagttcttaacactttttgatgaggaagggtgtggtcactatttcctttgattaaaatgtggatcttctatcttgaaaaatgcgtatatgcattctcaaaactgtatacagtttcacaagttaataaacccaagttaagaactcctacatttttttcctatcctcagagagctgattttttcttctcaatttctcttacttttcttttttttctccatcacccgcctcacacccatttccccaagtccccagagtccattctatcattcttatgccattgtgtcttcgttgcttagttcccacttgtgagaacatactatgtttgattttcccattcataagttacttcacttagaatagtggtctccaacttcatccaggttgctgtgaatgccattatttaattcccttttatggctgagtagtattccatggtatatatgccacactttctttacccacttggttgatgggcatttaggctggttccatatttttgcaattgtgaattgtgctgctataaacatgtgtgtctacatatctttttcatataatgacttattttcctctgggcaaatacccagtagtgggattgctg

SEQ ID NO: 4306 - DNA, 1064 bp, Homo sapiens
ctttctctcttttactcttatcactcttagtaggattctttccattgccatactattcttcccgccccccaccacaccccctagaatcagtctgactttgttaatctcccaaaagcagagctctaattatgttgttcccttgctgagaagcctgtgggggcttctcataaagtccagacttcccacagaacgtttaaaactttgtacagtccgggccggcgctgtggctcacgcctgtaatcccagcactttgggaggccgaggcgggcagatcacgaggtcaggagatcaagaccatcctggctaacacggtgaaacctcatctctactaaaaacaaacaaattagccgggcgtggtggcgggcgcctgcagtcccagctactcgggaggctgaggcaggagaatgatgtgaacccgggaggcggagcttgcagtgagccgagatcgcgccactgcactccagcctgggtgacacgagtgagactacgtctcaaaaaaaaaaaaaacaaaaaacaaaaaactttgcacagtccggatccaaaatacctctctagaccattgctatcttacatagatcctttgccctagagttcacaaaatttccaagtttcctcggagctactcccttttacttccttattaatgccattacctcttcttggaaaggcctttcttcctatccttatctgtctgtactctatcattctttaaaaacaaaacagaaatatgtacagctttttgcaatgtcaattataccacaataaagtgttttaaaacaaacagcaacaaccaaaaaacctcagatatcggttccaaaaactttgttcttaagctggaaatgattgcttccattttgaaattttataggacattgtatctctcttatagaaaaaaatacatcctttatattctgtctctgtttttagacatttgctttaagatagatggaagagcatgctctttttcatttagaccttttgtgaatacctcagcagaaaacagtttagtatgcaccataccacaggtgcagcataagctgctactcaacaggcagacctcacca

SEQ ID NO: 4307 - DNA, 1063 bp, Homo sapiens
tccttctgagatttcgtatgcatctcttcagtttactgtggacattccttttcccatatttctaagcaatggagaacagccttttggtagtatcttgataagattcttgctcatttcccttggaatttttgatgtagcccctgagccagatgcaacttaaaaaattacacacatttgtgtccaggagcacagttatcaccaggtagatgcatacaaagagagcttctactaccttttcttgtaaagtaagctaatgtcgttgtctgtataccaaattgctttaataccatatgctcatgtgatttgttttactcttaccccaaaccaatctctattgactcccacaagtcttcagctggtgatttcagggtcgaagagatgaccttaagctggccactacgcttgcattgaagtgcctgtgataaaggcaactttgggaaattttgcaacttgatcactaaccagcataaaagcatgaaaaaaaattgatttacaagaccgtgattgggtgtttggatcttatgttttctctgatttcaagtcttaccttcaaggatttatttatttatttacttatccacaaggaacaatttagcactaaaatgttcttatctttttctgatgtgaggagaatcatgagactacaattataaacttaacacaaatagaagggggctgagaaaggtggtatctacagaacagttctacgatctggaagtgaaattccagagagtacacttcaagaaagcataccaagtcccactgtccatgaggctgactcttgatggatgacaaggctattagggttggggaacaggccagaggagagcaaagtctgcctagatttggtcatttgctgtgggatgtgcctggtgggacagctgtctcatgagtctgcccactgtctgaggccgtgttcttgaagacccctgagtaagagacaatttcttagacattaatcactgtcattcatttagctctgtagtactttattgagaaagtctccaagtatctactaaaactatccaatatgaccaaaataaagatatctcctttctcattt

SEQ ID NO: 4308 - DNA, 1051 bp, Homo sapiens
gctgtctgttaacaactcacatagctcacataaacccctggtgcagtcttaacctgttttctcttttgtccttcagtgaaatagatgattaaattgcatgtctttctgctgtaggagtgttacacaactaggaccccaatccagataacacacacatgtggctgtgtagatctttaagattaatcttgatttttccctgccatcctctatagcacatataccctgagactctattcaactatctgtatgtagtaatgattttcatgaaaaatgtttaaatgcgtaaatatgatgcaattactgcagactacacctttaagctacagtatgtatgatggttaattttatgtgtcaatttggctgggccacagaatgccaagatttgtggtcaaacattattctgggtgttttgtgagtatgttttttagatgaggataacatataaatcagtggacttcgagtacattgcccaccataatgtgggtgggcctcatccaatcagctgaaacctgaatagaacaaacagactgatcttcagaggaatcttctgcatctgctctcttgggtctccagcctgtcagctgaccctacagattttggacttgccagaccccataatggcatgagccagttctttatgataaatcaatctctctctctctctctctctatacacacacacacacacacacacacacacacacacacatcctattggttctcttaggaggaccctgattaatcagtgtgcaaaaacaaaaagaaaagacaagtatatgtcctcaatttatctggctattttttgaagatgtgttttatattaaagagatgcaaagatcactggagacaccatccgcaaaattgagagtctggccacaactcttctagtaaaacctgactttcagtcactttccctttctagccttagtttcatctctgtaaaagaaggttaaacgaagggatttccaaggtctgtgatttcctgaaatgcaaacatggaacatttgagccagctgctgagaaagtgtctagagataataattctgagggc

SEQ ID NO: 4309 - DNA, 3246 bp, Homo sapiens
aattgacctacgcatctcctcctccttggacattcttttgtcttcatttggtgcttttggttttgcacctctccgtgattgtagccctaccagcatgttatagggcaagacctttgtgcttttgatcattctggcccatgaaagcaactttggtctcctttcccctcctgtcttcccggtatcccttggagtctcacaaggtttactttggtatggttctcagcacaaacctttcaagtatgttgtttctttggaaaatggacatactgtattgtgttctcctgcatatatcattcctggagagagaaggggagaagaatacttttcttcaacaaattttgggggcaggagatcccttcaagaggctgcaccttaatttttcttgtctgtgtgcaggtcttcatataaactttaccaggaagaagggtgtgagtttgttgtttttctgtgtatgggcctggtcagtgtaaagttttatccttgatagtctagttactatgaccctccccacttttttaaaaccagaaaaaggtttggaatgttggaatgaccaagagacaagttaactcgtgcaagagccagttacccacccacaggtccccctacttcctgccaagcattccattgactgcctgtatggaacacatttgtcccagatctgagcattctaggcctgtttcactcactcacccagcatatgaaactagtcttaactgttgagcctttcctttcatatccacagaagacactgtctcaaatgttgtacccttgccatttaggactgaactttccttagcccaagggacccagtgacagttgtcttccgtttgtcagatgatcagtctctactgattatcttgctgcttaaaggcctgctcaccaatctttctttcacaccgtgtggtccgtgttactggtatacccagtatgttctcactgaagacatggactttatatgttcaagtgcaggaattggaaagttggacttgttttctatgatccaaaacagccctataagaaggttggaaaaggaggaactatatagcagcctttgctattttctgctaccatttcttttcctctgaagcggccatgacattccctttggcaactaacgtagaaactcaacagaacattttcctttcctagagtcaccttttagatgataatggacaactatagacttgctcattgttcagactgattgcccctcacctgaatccactctctgtattcatgctcttggcaatttctttgactttcttttaagggcagaagcattttagttaattgtagataaagaatagttttcttcctcttctccttgggccagttaataattggtccatggctacactgcaacttccgtccagtgctgtgatgcccatgacacctgcaaaataagttctgcctgggcattttgtagatattaacaggtgaattcccgactcttttggtttgaatgacagttctcattccttctatggctgcaagtatgcatcagtgcttcccacttacctgatttgtctgtcggtggccccatatggaaaccctgcgtgtctgttggcataatagtttacaaatggttttttcagtcctatccaaatttattgaaccaacaaaaataattacttctgccctgagataagcagattaagtttgttcattctctgctttattctctccatgtggcaacattctgtcagcctctttcatagtgtgcaaacattttatcattctaaatggtgactctctgcccttggacccatttattattcacagatggggagaacctatctgcatggacctctgtggaccacagcgtacctgcccctttctgccctcctgctccagccccacttctgaaagtatcagctactgatccagccactggatattttatatcctcccttttccttaagcacaatgtcagaccaaattgcttgtttctttttcttggactactttaatttggatcctttgggtttggagaaagggaatgtgaaagctgtcattacagacaacaggtttcagtgatgaggaggacaacactgcctttcaaactttttactgatctcttagattttaagaactcttgaattgtgtggtatctaataaaagggaaggtaagatggataatcactttctcatttgggttctgaattggagactcagtttttatgagacacatcttttatgccatgtatagatcctcccctgctatttttggtttatttttattgttataaatgctttctttctttgactcctcttctgcctgcctttggggataggtttttttgtttgtttatttgcttcctctgttttgttttaagcatcattttcttatgtgaggtggggaagggaaaggtatgagggaaagagagtctgagaattaaaatattttagtataagcaattggctgtgatgctcaaatccattgcatcctcttattgaatttgccaatttgtaatttttgcataataaagaaccaaaggtgtaatgttttgttgagaggtggtttagggattttggccctaaccaatacattgaatgtatgatgactatttgggaggacacatttatgtacccagaggcccccactaataagtggtactatggttacttccttgtgtacatttctcttaaaagtgatattatatctgtttgtatgagaaacccagtaaccaataaaatgaccgcatattcctgactaaacgtagtaaggaaaatgcacactttgtttttacttttccgtttcattctaaaggtagttaagatgaaatttatatgaaagcatttttatcacaaaataaaaaaggtttgccaagctcagtggtgttgtattttttattttccaatactgcatccatggcctggcagtgttacctcatgatgtcataatttgctgagagagcaaattttcttttctttctgaatcccacaaagcctagcaccaaacttctttttttcttcctttaattagatcataaataaatgatcctggggaaaaagcatctgtcaaataggaaacatcacaaaactgagcactcttctgtgcactagccatagctggtgacaaacagatggttgctcagggacaaggtgccttccaatggaaatgcgaagtagttgctatagcaagaattgggaactgggatataagtcataatattaattatgctgttatgtaaatgattggtttgtaacattccttaagtgaaatttgtgtagaacttaatatac

SEQ ID NO: 4310 - DNA, 1074 bp, Homo sapiens
ttccagtttttctgcagagattggaattgttactagtctttaagtaatttctgggagttttgtttcatttctttttataatattatgagcatgtttgttctatttgtcttttataaataatctatagtgaataggacttttcaaataaattaaattgacttagagataaaatgaaatgtgatacatgggaaaactacagaaggactgggtaaaacctagaaaacttcattttctgtaggtatctatagtaagctcagtcttttaaatacttctaagcctttgattatagaaaggaagtgggcacctcagagcttctggcacccaatctagcttgtaagaaagtttaagggatatgggttgctcagaggtatttgcctctgtatgatcttagattccagaaatcttactttgtagtagtaagtcacaggcaccagatacatagctgatgttgctctgtttgcttcttagctcctgtttcaatggtggcacatgtgttgatgggattaactccttctcttgcttgtgccctgtgggtttcactggatccttctgcctccatgagatcaatgaatgcagctctcatccatgcctgaatgagggaacgtgtgttgatggcctgggtacctaccgctgcagctgccccctgggctacactgggaaaaactgtcaggtaattgacttccttcccattcactcagctcccctagagcagctgaatattatacctgttcactttctagtctgaataagttccttctaaaagagaaaattgtggatctcagggattccctgagataatctaggtaacttcttaataacttgcagattccaaaatggtgctggcaatatgatatagattcacaaacataagatcttgaaaagaggctaaccaagaactgcagaaaaatacatgtgggaaataaacacagatttttgttttttgttttttgtttttttgttttttacattggaagcacaaaaagaactgaagaaaatagagaataatcaaaataaccttttaaaggtcagatgcaacatctaagtgtttaataatgataattgttgtatcttgca

SEQ ID NO: 4311 - DNA, 1048 bp, Homo sapiens
aaaatgacctatgtagagagcagaggtggagagggtagttagctaccctcattttcttttactgtttccaaatccatttcttcaaatttgtcaaaggctctggtctttacccaaggcttcatacatgccaagtttgaaaacaaagtcctttttgaattgctcaagcatacgaaaaacatcccatgccgtcacagctgaaaatgcctttccctccccacatttagataactcactaaaagggctgaatagatctttgtgaaaacttccaaaagcaatttgcttccgggctgttcctcagacatgagaaattatagtaggaaaagaaatttgagagatttacaagcaattgactggatgtctttagaatcgaggggctttagactttgctatcattcccatcataataaacatactggaaacctgggtgagtggtgggttggcaagcactttgttttctctggcattatatcattataccaggatatatcaggtgttttctggggaggacagagagggtatggtataagtagctgtcactgagaaggtgagaagtcaatatgagtgatctgtaggcagcatggaaaggaaggcccggaatctgtcagaacctgccaaagatgttcctgcagttatttggagaattaaagcaagcaacggtcagacaacattaaaaaaatgttgatctgtaatgggtggagaaagacctggcatgtatcagggacctgggtggaaaatccattaaaagaggcattatgaatagagtctgaagttctagagtaagaattcctgttccacttatatggcctaagttggtagtttggtgtttggataggggagtggatggaagaaatattttacagtttgtcagctaaaattgtggtagtcactcactgggtacttaaagtgagatatactacccagagttaccttcagtgcgttctctcatctgtgcttttatgatagtaaagttttaagtaagtttctttgtgtttcaagtaacagaccaacttgagctagtttaagtcatcatttacaaaaaataaacaac

SEQ ID NO: 4312 - DNA, 1003 bp, Homo sapiens
attctacaattttttaaatgtactgaaattattctttttgaatcctcctatttatttctgtgacttctttggtgacaaagttagaaaaaagtggaggtcagtagggagatatgaagggacgcaggtggaagcagtgagcctgggcgggtgatggagtgggcgatacgtggcacaggggtcagtgagttaatctgggctcattcagagaatggaagttgtgtgccaagaaaactggttggatagggataggtcagggattccctcttgcattctcacacttgggggcatgcgtcattttcttttcttttcttttctttttttttttttttttgagacggagcatcgctctttctcccaggctggagtgcaatggcgctatctcggctcactgcaacctccacctcccgggttcaagctattctcatgtctcagccttccaagtagctgggactacaggtgcctgccaccatgctcagctaatttttgtatttttagtagagatggggtttcaccatgttggtcaggttggcctcgaactcctgatctcaggtgatccacctgcctcggcttctcaaagtgctgggattccaggcatgagccaccatgcctggccgcatgtgtcattttcttgggtgttatactgatcgtatatttgcaggtttgcttttgtgacagacttcttctgggggaaaaaaagtatccttctatctttttacttttgtccagttccaggtatccctgtttttttcttcactcttccttccttgttcatgggagtttttcttgaggacttcaagcccagcttcggagaatcctggttgtgtcatctcatctcctttctgctctcttctctacctaggctttccaccctcacacctcccggggtctgaaaatggaaagataagggtgtttccctgaaagttgctcttctgtgtggggatgacaggttctaaagactcttttctggtccctgccctcattgccatgattaatcagttaagtg

SEQ ID NO: 4313 - DNA, 1046 bp, Homo sapiens
ttttttgagatttttttcattgagttggatattgcaaacttgtactggattgagagaatatgtacatttagtaaagtatatttgcttttttttttttttgaaccaagagagtcccctgaacaccctactgacaaaaactaaagatgaaatatgatgaataaatatttgagagaatcacatggtgttgagttgtctctgccacatgattttgatccttgagggccaggtctgtgctacacacatttcttctctgtactacagaacttgtctggcatgtgccccaaattcagagtcaactgagcagcaggtcttagtcacagcatctatgactcctgctttcccacctttagaacattctataggagaggctgatggtgagttggagtgtgtttctatgttcttttttcctttgaagagataggatcagttgaaagctgaccccacccacagactttttttgctatctcttttaattaattaaggagtggctgaaattttcctctttgttgacttatgcattggcgggaactttaaaattcatctagtctttctgtccatcccatgctggatctgatgtttacaacattctagtcaagaggtaccatattttctctcttcttgaacatctcttgtggtagacagctctccacagcagtttattccatctttggccagctctaattcttagaaagatcttcttatattcagctgtaatccgtctcctcatgacttgtcctcattgacatctactcagaaatttgtctcagagtcctgagacctgtgcaggtgatagggacccaaagagatgcttgtctgtagactttactgagctgacacccagctctccataaaaggagtcaaacccagtgaggagcatgtctgaggtgattgctcaggtaaagcatcttagccctacttgtttcatacctccctgcacaggtgggcactggtgggagaataacatttatcaagcagtgtttccctaacctctcttatgataagaatagctcaggtgttctcatggagattctgattcagtgcatctg

SEQ ID NO: 4314 - DNA, 1032 bp, Homo sapiens
aataatctctgttgtttatgaattactcagtctaaagtattttgttatagtagcctaaagagactaagagagcatcacctgccctgtcacctcatcaccgcattactgaagctatactaacaacagtcacttttagtgggtgcttcatgcatgagaataaagggaaaaaattgcaaggcatactaaaatccaaaaaaagaaaaaactacaatttgtgtcaacagagcaagcttcagaagcagacaaagatatgattttggaattttttttaaacctctggagactatgctaaggacctaacgaatgaagtagacagcattcaagtgtagatgggtaatgtaatcagaaagacagacatcgtaagaaccttcaacataatgtagtgataaaaaatgtggtaaataactgaagaatacctctgatggcttattagtagactggactcagccgagtaaagaatctctgagcttgaggatttatcatcagaaatttcgaaaactaaagaaaagacacactgaaaagaacagaagatgatatccaagactgtgggacaactacaaaaggtgaaacagagtaatgagaataccaggaggagaagaaatagaagaaagttctgcaacaaccatgtctgagaacttccagtgttaatgtcagacaccaaaccaaagatccaggaagctctgagaacaccaggcagaataaatgccaacaacctacacttggacatataattttcaaactatatgaaataaaagataaaggaaaactctgaaagaaaccagaagtggggcagaaaacaccttacctacagagacacaaagataagaactgcattcaacattgcagaaactgtgaaagcaagacagtgaaatgaaaaattcaaaatgttgacagaaaaaaacccaccaacctaagtttctgtacccactgaaaccacccttcaaaagtgaaggagaattaaggccttcctcagaaaaataaaaattcaagaaacttgttgccaggagacctgtcttgcaagaaatgttaaat

SEQ ID NO: 4315 - DNA, 1045 bp, Homo sapiens
atggtcttaatgcttgtccctcacataggattccagaacattcatgttggggtctgagttttagcccttatcataggatttcagaacagtgctcttggggtttgaatgtttgtccttcacataggatttaagaacactcctgctgtggtctgaaagtttgtccttcacataggattccagaacactcctgctgtggtttgaatgtttgtccctcacataggattcctgagcactgctgccgtggtctgaatgttttcccctcacataggattctagaacactgttgctggggtgtgaatgtttgcccctaaaataggattccagaccactgctgctggtttctcaatgtctgtccctcaaaaaggattccagaatactgctacgagggtctgaatgtttgtctctcacttaagactccagaacactgtttcgagggtctaaatgtctgtccttcacataggattccagaacactgttaggagggtctcaatgttttcccttcacatagcattccagaacactgctatgagggtctgaatgtttgcccctcacataggattccagaacactgctgctggggtctgaacgtctgtccctcacataggattctagaacactgctgttggggtttgaatgtctgtccctcacatagaattccagaacactgctgcgagtgtctgaatgtttgtcccgcagatgggattctagaacactgctgcgagggtctaaatgtctgtccctgacataacatttcagcacactgctatgaggttttgaaatgtttgtccctcacataggattacagagcactcctgctgtggtctgaatgtttgtccctcacataggattccagaacactgctgctgggctctgaatgtttgtccctcacataggattccagaacactgctacgaggttctgaatttttgtccctcatataggattccagaacactgttacaagggtttgaaagtttgtccctcacataggattccacaacactactgctggggtctgaatgtttgtccctcacataggattctag

SEQ ID NO: 4316 - DNA, 1036 bp, Homo sapiens
ctaattatgtacttttagtagagacgggggtttctccatgctggtcaggttggtctcaaactcctgaccccaggtgatctgcccatcttggcctcccaaagtgctgggattacatgtgtgagccactgtgcccggcccttaaattctatttcttaaaaagagtccgttcaagattgatattatagatactcctcaacttacaattgtcttatgtcttaatgaactcatcctaaattgaaaatattgtaagtctaaaacgcatttaatatatttaacctactgaatatcatgacttagcctcacctaccttaaacttgctcagaacacttacattatcctacaattgggcaaaatcatctaccacaaggcccattttaaaatattcagtatctcatgaaatttattgaaaactatactgatagtgaaaaactggtcatattgatgctcatcattaatgtacacagatgaaagcaccattatcaagtcagaagagcacaagtcaaaccactgtaagttgaggattctctgtactttcttaaatgtttgatagaattcacctaagaaagcatgtagcctataattatagaaatctttttaaattaaaaaaattcttcaatacatagagaagctattactttttctatttcattttgcatccgttttaggaattagttttacaaataatttcccatgttattttaattgtcaaatgtattggcctaaagttttcataattatattgatgtctgtaggttctgtagttacatcctctatttaattcccattatctacattatgtagcttctctaatttttttcgagataaatcttgctagccattgtttattaaaaaaatttttttcaaagaaccaatttgtgggtatattaattagctccaccttttgttatttgctatgttgttggtttacatttttatctttatcatcttccttcttcttaatttggatatactttgctcattttttagcctcttaaaaaagaacctaaaggtcattgattgaagccttttattttca

SEQ ID NO: 4317 - DNA, 1025 bp, Homo sapiens
cctaataattgctaaattagagacgtaaaagtaaaacaaaggcacattgtgtttgagtaggaaatctatagacatctagctggttttcccatccagccaaaaaattctaaatataatcatggtacctgcactcaaatttatgttaaataccaacctcaataaaatcactctttcttctcattctttttgttatttatatgttgctttccttaagggaagaatacaaatgccttgctaagaaccattctgtttggttgtaggctgcataaggggagtgaacacaaagtacatttgaccacaaaatgactctttaaaagtcagaactacggtagcatgaagccaaacgaggtaatctacaataaaattttctatgcttcttttccttctttgctctctttctactctaataactgcgattcacacaggtaatgaagagtgtaattccttgatagaaacacagctccaagattaatcctttctttaactatgaagttcgcgtgtccaaaatctgtggtagttgctgtctgatttttgatcactgatggtgatacagatatttatcatcaactcacaacttcccaaatctttgaaaagtcttactattgatggttcaactagtagaaacatgatgtaaaatatctgaaaataaagtttttatttattagaatgtaaataataatacaaattgtaataaggtgtaaaagttctttcttcactgaagcagtaccatgttgtcctctaccccacaaatgcactactcccccgtggtctaatgtattttaaaagtcttgtaattgctattaactcagacaagtttacttaacttgttctaagcttctggcatttactacagtttactttcaatcactcaaccatctctgttatatatgttgttttccatgagaaatttgtttattagtaattaagattcttcagggataagaaaatatttgaataactaagtttgtgcataaacacattaaggtcaaatacccatgacattattgtgtgtttctgtgtactag

SEQ ID NO: 4318 - DNA, 1064 bp, Homo sapiens
ggttaaatttttagctaagaaattatgcttcttacatgataaaaatcatacatgccaaaacttaccatactttattaaacaacataatgtaaggtctgattcaacagaaatattggagtggtgattttttaaaatatgtggaagtatatatttgttttcaaaatattagaaataaccatgatggaactataaattcaaacagtttgagctaagcagataaacttgcatgcatgaaaacacattaaacagactcatttggctgggaatattcattgcaactctcaaggctagaagtgtttttgtggctcatctcagtcattgcttccctcccgttgtattcccattctatcattaaataaatgtaattcatctctaaatgactatagtaaaaagaatctagaatctaaaacttatttctttagcaatttctttatgttgatctggttcagaaggtcacatggtatatggctgaattagtttcccagctcatatgccacttggaagactgagagtgagaattaggttgattaatgaacaaacattatgagaacattctccagaaccgttgtttagatagcaggactagtctactttgacacataattacacatttagaaaaccccgctgtaactgtacacatgggattttcttgaatagaaaatttgactaaatcaaataattgataaagagaaaaaagaagcagcaagtgaacctctgtctttttgaagttggactttctctttctccaaagccaggaactctacttgtaacatgcctacctcattctttttactattattatactttaaattctggtacatgtgcacaatgtgcaggtttgttacatatgtatacatgtgctatgttagtgaccttgaaatatcttgctgtaagtttctagctctatttttgatgttctctcactatgtggcaaagaataacccggattttataattcaagattcatggttttgtagttattaacactgggattgtcattcagtggcttctggaataagcattgtgttggctttctgtttttataagtatctgtagcagcagaa

SEQ ID NO: 4319 - DNA, 1035 bp, Homo sapiens
tctctcagttcatcctcattacgttgggcaaacagtcatgctgcagggtatagattatgttattctgttactttcaggtagaattggggtctaggttataattgtttctaagtttagattctgaatgagaatcagcagaggtagaccaccactgctggggcctggggattgctgggaaaaaggcaggaaacaaatacagacctgaccatggagggtttgtgtttcatggctcccatctgggtacccaaggaacctacacgtagctcgtgtgtggagagcctacattgcccactcaaagcaattgaggatggaacagtcttggggctggagctcattatttggaatgataaccacatctgcacagagaggacctgataagatgttgtccttccatgtatatctgggaatcctgtgtagggtctctctgtaaggacaggagcagtgttggctccttggcctctagttagcctcacgagtagtctagtaaaggctttgccaacttgtcaccatctgtggatattctggccagctcttgttttcaccctactgacttcttcagacactaggcttttgcttcagaccattcatggtttttcttcctcttcaaatcagtaatcaataaatcctcttcaaatcaataaatttccactcctttaggaaactctgatcttctggtcatgccaaggtttaattaactggtttaattgtttttctgttttcttggtttctttttccttcttcctgggggtttctagtaattttagtttgatgtctcactttctccattttttatttcttagttttcttctgtgattattttcactgcagctgcagggcctaatcctgggttggcagataactagcacttactctgccctaattggaatccgggagagataggaggtgctctagtgtgaaaatgtgtttgctcctctctgcttctggtagtctctctgtaggagtactttacgtattctgaatgttcacttcttatgagatacatgatgtgcaactataggttgaatgtctctgatc

SEQ ID NO: 4320 - DNA, 1035 bp, Homo sapiens; identical to SEQ ID NO: 4319

SEQ ID NO: 4321 - DNA, 1029 bp, Homo sapiens
ctgcagcatttttaaaaagacatatagctgaaattttgtcagtcctaaaaatattttgtatttctctgcccagatttgcatttgggtagatcgtgctgtagaagatatatcttgctttaagatagctgccactgattagtttattttagtattttaatcaacttattgccttgtaatctttcctttttcattctctaaatttctgaaattctatctttcatgttccccaggaaagactagtaagacgtgtttttattaataagacattatcctcatttcaccatgacataatttgggctttctgttccaagttatcctacttgaatgctggacacttccacctgaatatttgtcattttcacctcaacccagcacatcaaaacaatcccttattacctctttaaaagaagcttctctctccagccttttcctagtcagtatcacatcttttgagccaggcatggggattgcagtttcagatttcacctcaagtcttcctcttctggttcctgaagctccggcaacctctactttgaaacattgttggcctcttcatcccatcccatgtcaatatttagcccatgccctgttggctttgacttaactcaatcaccttaacccagtgtcttaaaattcttgattttgagtttcttatccatccagtttatttacacctgaactctttaagcatgaaattaatcattcttctgttcagaagccttcgaatgtgaccacagctttttccatatagacctaaaacttatattcttggcctttgagagctgccttccctacccactgatatatgtttctcgtgcttcctaacacctacatgcttctgtttgcttagtgaccaccccccacccactcatcagcagtttgtattaatttaatgtaaagctgtgtaaagtttattgattgataacatctgtgtcaagatcatggtttttattataaagagcagttcattgtgttttttccttgtcgacgaatggtatctctgttcattagaatacataatattttatg

SEQ ID NO: 4322 - DNA, 1029 bp, Homo sapiens; identical to SEQ ID NO: 4321

SEQ ID NO: 4323 - DNA, 1072 bp, Homo sapiens
tgtggaatgccagctcttctctggcttgcttcctactatcttgcaaaggtgcagtacccatttccttcactcactgaccttaacacaactctgattacactgagaactccttgaggtcaaggacaatgatgccaagaaaagcacttaggttttggcaatctttaatctccaatactttcttgtcgactttatcaatgaatgtatgctggtatgctgtcaagattttttaaaaactatttatttcttttttgtttttatttatttatttatttttttgagacggaatctcactcttgcccaggctggagtgcagtggcgcaatcttcgctcaccgaaacctccgcctcctgggttcaagcaattctcctgcctcagcctcctgagtagctgaatagctgagtagctgaggagccctgagtagctgggctcccaccaccacgcccggctaatttatgtatttttagtagagatgaggtttcatcatgttggccaggctggtcttgaactcctgacctcaagtgatccaccagcctcagcttcccaaagcgctgggattacaggcgtgagccactgcgcctggcctattattattttttgagtggctgctcttagcccagcagcaaactttgagggatataagcttgcagatgagttgaaatgcatacacatgaatgcacaaatgtgaagttaaatgccaaaacaaaaatgtaagccatcaattcaaaagtgataacaaagtgtttatttcagaaacttatactaagagttactgtgagccaagaacttttataaaacctagaaggggaggcagacattttaaataagcaatgtaaggcagagtcgggtgagtgctatactagaggtaaacatcagatgacctggtatgaatcctggtttactaaggacaatcttgatttttgcctgttgcccagaggtaattatgatagcacctgtttgtactatcagaagagtctcagttattaaattatagtcatataaattataaactaagtacagttgaagtgaaaagaaattattagttctgactgggaggttggggaaaggtttctat

SEQ ID NO: 4324 - DNA, 1073 bp, Homo sapiens
caggtggaactggaaggggctcaggtgttacgcagtcggctagaagaagttcttggaagaagcttggagcgcttaaacaggctggagaccctggccgccattggaggtggggaactggaaagtgtgcgaattcatcacaagcatgcctactgagcactggcgggtcagactgcagcccaggatggaaaaccttgtttgcactaaccagaaagatccttgtctgattttggcagaattaaacggtgacttactaatgatagaactggtacaagtagcatcaactacaaagtgaaactcactttagcctacatggatctcactgtacatacatatcaatccctaaattgaatggtggaggttgcaaagtgtatttgcacattttaaatcattctgttttagtttttccacttttattcattcttatccctagccccttctcgttccctcatcccttctgtgggccaataaagtttattcttccccaactttcacaatccatttcatatgttccatatcatatcataaatgcatgtgtgtgtattatttttgccattcagtcaactcctctttgagtgagagcattttttaaatcaaaagcatgcaagttttaagatgagagagcgggaaagagattgagagtctataagaatgactttgcaaaagtgatataatccttatcagaaggtaatcaaaaccaggagagtagtcttgtaatagtagactgcaagtattgggaaggccaagttaaagaacagaggcaagaactatgaaagtgatcatagtcaacttttatctccaatactgtctcagagttgactgttgtacacaagtgaaattagattaggtacagattaaattctacttaaaatttgttctttattgattcctttaggtttctttaaaccaagctcatgctatttagtcagaacatgacttctagaatggtcttccagagtcagaattctctgtttacaaagataatttcaaatgtagtatccctctttacattcagtgtttcaccaaataactcattatagccagaagagggtattgcttctttcatttgtggcact

SEQ ID NO: 4325 - DNA, 1033 bp, Homo sapiens
agtggctcatgcctgtaatcacagcactttgggaggccgaggtgggcggatcacttgatccgctcgaacaggagttcgagaccagcctggccaatatgacgaaaccctgtctttactaaaaatacaaaaattagccaggtgtagtggcgggcgcctgtaatcccagctactcgggagcctcaggcaggagaatcacttgaacccgggaggcagaggttgcagtgagctgagatcgtgccatcacactccagcctgggcaacaagagcaaaactccgcctccaagataataataataataataataattgtaaagcactggtgaaaaaaggaagcgctgtgtgattgctgcttagagttatgacattagatccgtgaaattagatttagaaacatgaaacgagaaatttgagtataatcagtgtttatcaagtattcatgtgcaatgtactgtgctaggtatttaaattagcactaatgctcacaactctacacaaagtaagtggtgtcggcccaattattatagacgaagaagctgaaacactgatttctcttttaaaatgggagtggagaatagtcatgtaactaataaatgccagagctatgattcaaactcaagccttttgtgacttcacatacttcctaagaagattcatttcctagagcacatttttcccaccttatgctttaactcgctctagcatagagttctcttcaattttttttggaagaggcctttcagccttagagattcccttccccctgcctttcctccacagctagttgcatattcaactatgatgttgaagaaatactaggaccacagctcagagttacagactgaaactaaaagcttgtttgttactatgctggcatctcttttagaagatcactcaatgtcatggcttcctaaattcagtttagctagctagtccaaatagctcttagtttttttctaccttttgccatagctagatctataatataaaacctgtgtttgtatttgtgacagaattatcatattttatcttttga

SEQ ID NO: 4326 - DNA, 1031 bp, Homo sapiens
taatgtaaatagtactgcatgcagtgaggcatatttcctaaaatagcaaacattcctgcgttaccatggagagatctgacttggaggttaaggcaagaatgtgctctaaatgctcaaggcagagactgaaaaccttgcagtgattagtagctcaggcagctccggacaacttcatatgagatttttttttagagtagcttttcagtatccccttcttttgctgatgaatgttgaagctggagactcatttacaaatccccgttcaacattactgtctcccagacaaccttcattaataatgtgtctctgaagcaggccttagcagctaaagcaatcattgctctaatccttttgagcagcaaaggaagtggaaaaataggcagctgctttacaacttaatcaaaaatatttactgagcacttgtaatgcacaaggtactgttaggtgaaggaagaagaacacaaagatgtgcaggatttagtctctaccttctagagattacaataggagaaagtcactgatgaaaaaaatacaaggcagtacagaaaggaaaaatcatcatggactggggtcagaagcaaagattttggtctctgaggaatgagtaggattttaccaagtagatatgaaaaggaaaggcatttctttattcattcattcaatgattattgagatctagaaagatactgttccaaatacttcagaagcagtcttagtccactcaggctgctataacagaataccatagactgagtggcttataaacaatagaaattcatttctcacagttctggaggctgggaagtccaagatcaaggcactggcattttcagtgtctggtgagggcccactttctggtttatggatttcctgctgtgtcttcacatggtagaagggattagctaactctctgaggtctctttttataaggacactaatctctcccaaagcccccacctcctaataccattatgttgggggttaggatttcaacatatgaatttggaggggaatacaaactttcaaaccat

SEQ ID NO: 4327 - DNA, 1035 bp, Homo sapiens
ttgaaaatgaagaaaacaatttttttttttttttttttacatagatccaggttgtcagatcctttagggtcaccaccaggaagattatttacagtgaaggacactttttgaaaaggtatagggggcctgaggtagaagagggaatacccagttgcaagtgaatcccaggctcagaagggtcatacagtctcatgattaaggccctgatgcgtatgcagtatggggtcaaactgttggagttatagtctgtgctcctccgctttctcagtgaacaagtcagttaacctcctgatgtctctctgtcctaggcagtaaaatggggatcatcatgtcttcctacttcaaaggttgtggtaaagataaacgaaataatacacatggaagtactttgtacattgtcaaaaccaatgtagatgattgttgttgtgaagatagtataattgtatctgattaattttgtaatacaggcccaagtcatccaaaacagccaggaattaaacttttatttgtataattcagattttatgagaacagcatagagacgcctagacacagagatgtattataaataaaatatgtgtatgtaaaataaaccagccgtctcttctccctgccccatctcttcttgtctatccccatccccaatccaaaataagctgggctcctggttgtagttccctgggtgctaaaaagcaggaaatactccccagacatttgtgtacccttcccatagggctgttttgaaaatatgacaattagcaaagttataggttaaatcgtctattgggcatcatccttgagtcattgttactgcttttgtcttagaaatatggcgtcctttacatgcacttactgcttctgtagcacaaggcagccggagctctcagtctgaacaggtagactctcattaccttttagggctacaggagagctagtgggcattctgaaattcttcacaaagtgatagttctctcactggcctttggtaggagcgtttctatgagaaaacgtgtttcaagcatagaatttcaggat

SEQ ID NO: 4328 - DNA, 1051 bp, Homo sapiens
ccggttgttcctttccatgtttagtgcttccttcaggagctcttttagggcaggcctggtggtgacaaaatctctccgcatttgcttgtctgtaaagtattttatttctccttcacttatgaagcttcatttggctggatatgaaattctggttgaaaattcttttctttaagaatgttgaatattagcccccactctcttctggcttgtagagtttctgccaagagatccgctgttagtctgatgggcttccctttgagggtaacccgacctttctctctggctgcccttaacattttttccttcatttcaacttcggtgaatctgacaattatttgtcttggagttgctcttctcaaggagtatctttgtggcattctctgtatttcctgaatttgaatgttggcctgccttgctagattggggaggttctcctggttattatcctgccgagtgttttccaacttggttccattctccctgtcactttcaggtacaccaatcagacgtagatttggtcttttcacatagccccatatttcttgaaggctttgttcatttcgttttattcttttttctttaaacttctcttcttgcttcatttcattcatttcatcttccatcactgataccctttcttccagttgatcgaatcggctactgaggcttgtgcatttgtcacgtagttctcgtgccttggttttcagctccatcaggtcctttaaggacttctctgtattggttattctagttagccattggtctaattttttttcaaggtttttaacttctttgccatgggttcgaacttcctcctttagctcggagtagtttgattgtctgaagccttcttccctcaacttgtcaaagtcattctccatccagctttgttccattgctggggaggagctgcgttcctttggaggaggaaaggcactctgatttttagagtttccagtttttctgctctatttttccccatctttgtggttttatctacctttggtctttgatgatggcgatgtacagatggggttttggtgtggatgtc

SEQ ID NO: 4329 - DNA, 1022 bp, Homo sapiens
caggcagatcaccaggctctgcctggattccctctctgtgagctctggggcagttaagtaggacagttgtatggcttactttgcttgtttctctcttctcttggataactttcctatgttgtctgacatccagtgtctgaaaataattattttatatatcttgtcctattttttagtaatttctgtcaggggtgaaggggaatgaataccaaccctattaccgcatgctgtctggaagtagaagtgtctttctagccacgttataaattagtagttttcaaccctgactacatattagaattatttgggggaggtctttaaaaagctgatgtaaggcttcattccagaccaattaaatcagactttttcagattgaggtcttagcatcagtgttctttaaatgcactacaagttttctcatgtataccagggttaaagaacctccatattaaagaaaaggttgcatttataaatcattctgagaaacttttgtattctgtcatttcagctaagacacagaggcggttggcttttatttttgtagacagtgtggaattatagaagcttttaaagaagagtctggcagacatagatctttgttttagagttgtaagtgtggcaatcgtgtgagagatgggcttaagtggattgagtgaagatcactgagaaactgttgcaagtggttcacggccaaaggtaataagggcctgaacacaggcattggtattgggaatggcgaggaagagataggttggagaatttgagttagaactgataggattttttgattaattgagtgtgggaaatgagggagatggtggaaacaaatgttattctccagtttattactctagacaagtaaactctgtctaaacaaattcctaggccagtcagagagtaaatagtaatttcattaactgagatagataatatggtatgagaagcagatgtcagggaaaggagagaattaatttagtttgggatatccaaaaggatatctcatggaactgtctcctgacctc

SEQ ID NO: 4330 - DNA, 1031 bp, Homo sapiens
ttcaatgcttttgggttgcaaaagaagagggattattgcatatatggtaattctatatttaattttttggaacgaccatactgttctctacagcagctgcaccattttacattcccatcaacagtgtacaagggtttcagtttccccatatcttcatgaacactgatattttctgtttttgttttttaaaataattgccatcctaatgggtataaagtgaaatatcattgtggttttgatttgcatttccttactgattagtgatgtaaaagatatttttaaagtttcatatttactgacatatttaccatttccaatattcttcattattttcatctggtatcattttccttctgcctgaaagaatttctttaatccttcttattcttgtgcagatttgctggtgggaaaattctttcagcttttgtatgtgaaaaagtctttatttcaccttcatgtttgaaagatattcttgctggttatcaggactgactacatactttgtggggctcaatgcaaaataaaaatgtagacccctctgttcaaatattattaagaatttcaagtcatcaacaacagagcattaaaccaagccagtccttctgagtgcaaagccctgtgtgactacacgggttgtatgcacaagaaacctactctgctggttgtagaattccaggtgactgctctttttttccttcagctctttaaagatgttgctctgttgtcttttttttttttctgagatggagtttcgctctcgttgcccaggctagagtgcaatgatgccatctcggctcaccgcaacctcgacctcccgggttcaagtgattctcctgcctcagcctcctgagtagctgggattacaggcatacgtcaccatgcccagccaattttgtatttttagtagagatggggtttctccatgttggtcaggctggtctcgaactgctgacctcaggtgatctgccctcctcagcctcccaaagtgctggaattacaggcacgagtcactgtgcctggcttctctgttg

SEQ ID NO: 4331 - DNA, 1146 bp, Homo sapiens
cattcttacatgtatcattctgtgatcaaatctccagcttactataaatgatacctacattctaaagagccaattctagttgtaccagcatggccttagagaaaagtaagggaatacaatttgtatttatcttctatttggtcggagttaagtatttaaaacagtaaggtagatctcagatccaccaccattaaaaataaataaataaataaataaataaataaataaataaataaataaaatagtaaagtagaaagaagagacaaagatccaaacctttcaaaatgaaaaatgaattttaaatataaggttatattttattacctactgctgagaccatcattgcataaatgaataaatagaactaaatagtccagtcacagtggctcacgcctgtaatcccagcacttttggaggccgaggcacgcagatcacgaggtcaggagacagagaccatcctggccaacatggtgaaaccctgtctctgttaaaaatacaaaagttagctgggcgtggtggcatgcgcctgtaatcccagctactcgggaggctgaggcaggagaatcgcttgaaccagggaggcagaggttgcaatgagccaagatcacaccactgcactccagcctggtgacacagcaagactctgtctcaaaaaaaaaaaaaaaaaaagaactaaataaactcttcttcccccacaaatttaccagtttagccattttaagtgtacaggtcagtagttgcattaagtacattcacattattatgcaacaagtaccaccatccatctccaaaattttctctttttccaaaactgaaactctgtatccattaaacagtagctacccattctccctcccctacctcctggtaaccactattctactttctggctctatgaatttgactactctagccaccttttatacgtgggatcatatatttgttgttttgtctccagcctatttcacttggcataatctcttttagggtcatccgtgttgtagcatgtgttgtaattacgtacttttttgtgtgtgagatagtcttactctatcattcaggctggagtgcactggcacaatcatggttcaatgcagctttgacctcctgggctcaatcgatcctcccacattggcctcccaaatg

SEQ ID NO: 4332 - DNA, 1023 bp, Homo sapiens
cctccaccagggattacaattctgctccccaagaggccccctaagaccacagaagataaggaggaaacaatacagaaactagaggtgaggaggaagtgtgcatagagacctcctgagccctggatccattccctctctcttggcccatgtgtgcctcaatttttcccttctgtgaactgaacctgagtttctattcctattcatccccacatgagaccctggagaagaaggaagaagaagtaacttcagaggaggatgaggagaaagaagaagaagaagagaaggaagaggaggaagaagaagagtatgatgaagaagaacatgaagaggtgaaggggactccttccaccttagtccccctccctttaccctctttatactagggttgctctcctcagagggttggcatgccaacagagatagtgccccccagggtaggggcttctctctacttcatctgccccccttctacaaactacagctggaagagatgtctcaggcctggaatggtgtgactgagaggaaaggggtctggtacacaggaaggaaggtgaatgccaaattgacttttacttttttttttttttccatttcaggaaactgattacatcatgtcatattttgacaatggagaggactttggtggtgacagtgatgacaatatggacgaggctatatactgaagaaggactctggaccctcgtgtctttctttaggatacagagagtaactgtacctattatttgtttcttcagacaagcaaatcatttggtcagagttcatataatctgtctgttccctggagatgggaatagaggatgatgacagtttattttctacacttcccctccttccacatttgtatcacctttgctatcttggggaaagtgcaaaggacaaacatctcaattgtatgaagggagaaaggagaattgaaagaagaactggggttgttagagctgagatgactgtacacatacccctgcccaatttatatagctctttgtggagataattaggggt

SEQ ID NO: 4333 - DNA, 1033 bp, Homo sapiens
tcgttttcctgattgcaaatgaagactaccttcccccaggacagaggctctgtattttgtattcttagcagtttgcatggtgtctggcacataaagatgctcggtaaatagcaaaatgatctactggttctcctgctttctttccatccactctcaagggtaaccaagcagttatccatggccacacccaccctaacctctaatcttaaatatgctaatgaacattcagtctaggcaaatgcctttacttttcactcaggttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcattatttgcagtgggataagtcgcagagtcttcaactaaacccccctctctatcccctgcagcccaggatacacctgaaagaatttggcatatttagatccattgctgtagtctcccctcatcaaatcttggcagtgggaagaaccttaaatcaacaaggttaatcatctatcagatgcatctgttcccataaagaagttacccacacctatggttacctatatccctggcaataggaaacttcctaagaagttaattttattttcagatgtctatgcctgttctttattttgttgagataggtgatagatagatagatagatagatagatagatagatagatagatagatagatagatgatagataatttgttgttgttgagacaggatctcactctgtcactcaggctggggtgtaatagcgcaatcacagctccctacagccttgacctcctgagctcaagcagtccttccacctcagcctctggagtagctgggactacaggcatgcaccacacatacccagctattttttatttatttatttttttttttgtagagacagggcctccctgtgttgcccaggctgatgaactgtaatttttaacacacacagtgtaggg

SEQ ID NO: 4334 - DNA, 1067 bp, Homo sapiens
gagatccctagaagcaaaagatccacagagaggataagccctaaaatatgactatagaatttgtccagactaccactaccctacacaagctcaagctcagcagagaatatcagggagttaggctaaaaaggagaagctagaaaccaagaaactgagcagaaacattagctgctgcaggtatgacagatttcacagtttaagtaaattaactgcttactagtaccaaaaaaattaacaattctcagaaaaacaaaacagattccaaagtcactacaacatattaccttcaaccaaaacttgctagacatgtaaagaaacaagacgatgtgaccaatgttcaagataaaaagcagccaatagatactaactccaagtggatccagattacacatttaacaaagacttgaaagtaaccattacaaatatattcaaaaaagtgaaggaaagcatgatacaagtgaaaagagagaatcccaacaaagaaatggaaacttttaaaaaacaacaaaatagaaatccaaagactgaaaactacagtaacagaaataaaaattttactaggtgggcttaacaggagaattgagatgacagaagaatcagatccataaaaattcaggctgggcatggtggctcacgcctgtaatcccagcactttgggaggccgaggtggttggacacctgagatcaggagttagagaccagcctggccaacatagtgaaaccctgtctctaccaaaaatacaaaacttagctggccatgctttcacgtgcctgtagtgccagctacttgggaagctgaggtaggagaatcacttgaacccaggaggcaaggttgtagtgagctgagatcatgccactgcactccagcttgggtgacagagcgagactgtctcaaaacataaaataaaaataaaaattgagatagagtaatagaaattatttaatctgaagaatagataaaagattgaagaaaaatggccaggtaatcccagcactttgggaggccaaggcaggcggatcacttgaggcctggccaacatggcgaaaccccgtctctaccaaaaata

SEQ ID NO: 4335 - DNA, 1050 bp, Homo sapiens
agtctcactctgttgcccaggctggagtgcagtgacgtgatttcagctcactgcagcctccacctcccaggtttaagcaattctcctgcctcagcctcccgagtatctgggattataggtgcgcaccaccacacccagcttatttttgtatttttggtagagacggggtttcaccatgttggaccaggctggtctcaaactcctgacctcaagtgatctgcccaccttggcctcccaaagtgctgggattacaggcgtgagccaccatgcccagccttattgtcctgaatttttttaagtctattttccttaattttttacaatcttttacatatctgacttagatctcaacttccttcgttccaactacttaaaatcatttaagtcctctatatcatctttgttatttaaaaagtacttttaaaatgtgtattttcaaggtgggatttcatagaaatctatatcacagtgtataaaagcataggctctgaaatcagactgtgtatgaatttgaatccttgatctaaaacttaatggtgtgaccttgaactagttactttatgtctttgtgcctcatttgtaaaatagaggtaataataatgagttaagacttagaaaaacaagttagagcccttagaacaatgacccacatatagctaaggacaactactgaaattattaatagtctctacagtacaatcatttgcttttcatgctttgccttcatttattcattcatagattcattcacttaataattttagaaaacctagtttacgccaggcactgtactagatgctagggatagaatgatgaacaagataatcatttcttaccttcatgaagcttattagtctactctctttattaaagttattattacccataagtaaatggtaacaggttttgaattgcatgagtattttcacatttcatatttcctccttcaacacttttctgtagtaagacccatagtcaagttaaagaagccttaatgtaagagataacattagacataaaggccaggagcagtggctcacgcctgtaatc

SEQ ID NO: 4336 - DNA, 1113 bp, Homo sapiens
ttaagtactgaaagaaaaaaaacccctacaacctggaattatttacccagtgaaaatacgtttcaaaaagtgaaggtgaaataagaacttacattaaaaagctgaggccaggcatgatggctcatgcctgtaatcccagcactttgggaagttgagggagggagattgcttgaggccaggactttgagaccagcctgggcaatatagcaagaccccatctccaaaaaaaaaattagccagctgtggtggtacgcacctgtattcttacctactcgggaggctggggcaagggcattgctgttgcttgagctcaggagttggaggttgcagtgagcaatgatgcagtgcactgcagcctgggtgacagagtgagcccttttttctaacaaaaacgaaaaggctggcagagtgactttcatttctgggaagatggaataggcatgcttttccctattcctaccagtaagtagaaataaaaccctggacattttctatacaataaacataaggagactctgaaagatgaagagaaaagggcagaaacttcagacttcaaaaaatgacacagtgagttagttgtctgctctctttagcccatgtggaccaggaaaggggcagcctaacaagggtccactttcattcttttgcatgtagatatccagcttccccagaaccatttgttgaaaaaactgtcttttccccattgaatggtcttggcacccttgtcagaaatcatttgatcatatatacaggatttatttctgggctttttattctattccattgatctatatgtctttgtgttagtaccacactgttttgattacttgagctttgtattaaattttgaagtcaggaaatatgagtcttccaactttgttctttttaaaaaatttttgtagagacaagtttttgctatgttgctcagactggtcttgaactcttgatctcaagcagtcctcctgcctcagccttccaaagtgctgggattacagacatgagccaccatacccagcttgttctttttcaatatcgttttgtctattcagggccccttaagattccatatgaatgtaaggtggatttttctatttttgcaaaaaaaaaagttgt

SEQ ID NO: 4337 - DNA, 1046 bp, Homo sapiens
tggagttaacttgaattgattgtatgtagcacagcacttttgcagtaagattggtgtgaaatactaaacactatggattttgtaggtgtcaggttaaatggtcaagggatacctacattaagtcatatattaggtattgatgatcttacttcttttctgttcccctgtacaaaacacttacctaacccagcttgtggttttaggacagccaaagctcactgttgttggttagtcctaatcactacacgggtctcataaatgagacttgtttgaattttggtacattggagcatgttggttggtattacacggcagcatttcgaatgagtgcagctctgtgtctgtcagaaaggagagataagactactttgaagggaattaaatatgtgagtcctctttttaatggtgctttttgtaacctttaatgctgaggtacagagctgcttttcaatatttcataaaggagtggcagacaagagtggattttaaagctgttcttcaaacgtaatttgtcactggactctgacacacctggaaattatatgatatgatacatacagaaatgttgtgggttttttccataaaactttaataaaagtattatacagcaataatatctgagttattgattgatgactgattatattatcaaggtctgtttgccttggtgtctcagggcctaaagaatgtaaactgcaagaaaacacatttgaaagaagtcatggggtaggggacacaaatgatgtcctactttttctcttctttttgtttcaggctatgccaacattataggaatgcagacttcatgatttgattttcagcattttctctgctggctgcacatttagctatcatcctgtactggattagctgagctcttagaccaatgattctcatccctggctgcacattcataacacctatggagactctataaacattggtggtcaatccatttccaccctagttaaatggaaatctctggtatggggtccaggcatctgtattttttaagttcccccagataatgctaatagacatctagg

SEQ ID NO: 4338 - DNA, 1027 bp, Homo sapiens
gctgaggtccagtcctcctatgctgacttcatattctttcctatattatcattatgccaggtctttccaagtaggtttttctcaggtattcctcatttccacaaaacctgtggaagtgtaaaagtgaattgtttacctgccttgcttctgtcgtatttaggctttgtgtcagcatgactctggagtgttaacccgagaagcattcatggtggataatacagtacgggggaaggtagaaggatacacttgttcttaatcggatttgcttgggttctttgggatctgatggattttgcctcctgtaactgctccttggatgtcatttaatttgcctaggcttgccatctcctcctgtggtacatctgtagtctacaacacagcctgggaaatggtacctcttgctgtcttcttactggttctgactcaggtgaaggtgtttgattattgtggcttagcttggttctgacccattcctgattctctcatattgtttaggcagtttggaattgatccattggattgggtgtctttctgaagaggattttgacatctactttgttcaaggatagagagggattcctaggttccctctaaatcagagagatcttttggaagtcatccctggttttaaatgaaaattagacctgctttgggacttggaaatagtttttcagaaggattgtttctttttttcctcattgtctttaagactttcttctagaaatggatgccagaatattttgttcttttttgtttttcttgctagttttaggcccaacattagaatttaaagtagggaagggagcaaggtaggagactattatttcttcagcccttttatgtgtcagaaactgtgtcagatattctcatgtaatcatcagagcaaccttaatggtaggtgttatcttttgtaatgatgagataaaaagacttggacacactaagtagattacccaaggccacaagtagaatgatgataggagtcagaattggaactaaaacttatttgacctcctgctcttatatc

SEQ ID NO: 4339 - DNA, 1048 bp, Homo sapiens
tcctactatgattgtttttgccttgtaacacaactcttccttgtgtgttgtgggcaagatttttgttttagctctcttaaggaagattagtagatgctgaggcatgagatttctgccctggactgataatttttctaattttctgtaataggattgtattattgatacatactagagtgggtgcattattgaaaagagatagcgcattctagtttaaatttctcaaagagctctgaggaagagtaagctgtttggtttgtctgtgcattaatttcatttagtaatttttttagtaatttttttctctttctcttagtgtgacccagccttactccctgagcccaaccatgttatgctgaaccatctctatgcattgtccattaaggtaagtggtggccctggctcttcacagagctccctggaatgagaggtcaagggtaacatacgttctcagtggttactttctctgctatttcattgaagctgaagctggcagtaatgatcaaattatagaagaactctcttttttttaactactaggttgtttgttttaaaatctcagtctctgtgttctggctggctgaattgccctctgataggacttttttgctgcccagttattttttgggtgactagaatctttacactaactgtttacttaagtttgtgttcatagcataggatttcttctgcagaaaaagcaggtttagcttccagttcaaagaatgcttgaatgtgatattaaggctttcattttttgaaggtggaattgagctactttcaggtgcctcattcatatatactcaggtgcttgcatctctcctatacactagttaaaggagagatgtgaccagatttgccctgtcccgtcaactctagagtcctccttggtttttctgctgctttagagtctgggttggaaatagccattctgttctgtcttgttatgtctttgtggtttggctattggaataaagttatatagctctgcagttatcaaaccaggctgattatcattagagtctcctggagaagattgtaaaaatac

SEQ ID NO: 4340 - DNA, 1055 bp, Homo sapiens
ggaagagatgttgccaggcagaaagttcttaactgctaaatacacaaaccaattttcatcaatatctatctcctctttcttttctattactgaaacaaaaaatagcccactttctcccaaaagtcaatccagccacaggtggactaagcctatcccttccagccttctgagagctctcattttcccctctggccatcccctctgtctgttggatctttccaatcagcattcagacaggctgtagaatctttccgtgctaaaaaaaaaaaaaaaaaaaaaaaagcaaaacaaaacccaggtctagcattctattaccccttagagccaaatttctccacagagttgacgagacacagggttcacttcctcacttgccattcgacctttaatcattttaaaccaacttccacccccagatcatagtgaccactatttttgttaaggtcaccactggccactttgctaatctcatcttactccatctcttagattctgccagttgctcacttcattcttgttaactcttctcctggtttccataacacctcattttcctagctttcctcccacctctccaggccttctttatctgcttcctttgcaggtcccttttttacctgatctctcaactttagagttcctctggactctactctgagtcatcttctcttctcatgctgcaagttctctccatgccaacaactcccaaatttgcaggtccattccagcagatctgtatacacatctacctgcttgacatctccctggatgtctcaaacttaacaggatcaaacatgaattcttcaattctgtgtatagccttcctcctgaaacctttttccttcagttttccatatcttaataaatggctcctttatccacccagttgctcatgccagaaatttggaagtaattcttgatacctctctccctaaacttcaactttcccatatcaagtttgaatagttctgttgaatgaatgaagtcttggcttaagtgtttctttttcagaggagaagaatcccttaatgccatcaatctacataaaattttct

SEQ ID NO: 4341 - DNA, 1081 bp, Homo sapiens
acttaggcaaactgtactggttggtctctatggtcctttcgtttgtgctttggcagggaggtgcggggagaggtcagggaatgatggacaaaagaataacaaaggaaaactctaacataagctttgattacactgtatcctgcttactgttatattactatttactagtctattttctcttcctttcccatttgggtttcatttatttctaattcaacatactgtttcaccaatgagtgttcatggtgtgcctatggcatccccaaggggctgcaggaagaggccccagcccagcccttacctctgtgtgtttcctgatggagagctcctcactttagggttactggaatgcattgattgaaatcctgagcttgcagtcacaaacgggacaggctcaccgagttcctctcgggttgcagcagaaacagctgctgggggcagtggcactggcccactgcttgctgggtgcgtcccttagcgctcgctgcctgtatgcctttttcctctttgtttttctctgctgtggaagtgggtcctttccccttgcagctccagcattctctgggtgcgtgcctcctgctgccagaggaaaatctcgcatctccagggcatactacaggaaaaggccacccaaaaaaagttgggagcaaaaacagagacataaaacaccctcacaacaggatcaaggtgaaagcactagccaactcagcgaagcagctagaccatgcctccacttccatcagggtgaaagggtgatgctcccattgtggacaaaggctcaggggccacaccagctggagggtgactaggacttcctgccaagcatgcaagcctcccccgcaagcagcatggaccaggcaagggtgagcaggtgagaaaggcagttttctctttagctatgtattctcccttacatttctgtagttttgaatacaaaaccctcaaaaacttgtgtctttcttttttcaaaacaatgctttgaaacccctaggtaccgcagatccatagtgactatctggtgtttcagttctgatggcaaacaacagcactgaaatgaaacaacccccccaatttcaaacca

SEQ ID NO: 4342 - DNA, 1074 bp, Homo sapiens
acctatcaatgatgttgaggactgaatgtacctcaggtgtaatgtatttggagatagggccttttaagaggtaaagtaaatgaggtcatatgggtaggctgtaatccaatatgactggaatccttataagaagaggaaatgaggacacagacacagagggaagatgactatctgcaagtcaaggagagaggcctcagaagaaaccaatgctgctgacaccacgatcttggacttctagcctctagcactgtgaggaaataaatttctgttgtttaagccacctagtctgtgatactttgctacggcaggccctagcaaatgaatacacttgtcttgtctttcccccgccctgtgatatttatcagtgccggatattacatatttgtgtatctatatgcttatttccctgactaaaatggaagctccatgaaggcagatttcctcttgttcactgatgtgtccccagcacctggaatagtgcctagtgcatgccagtgctcagacacttggacatttgaatgacatatcccctctgtcacttctctccggggcccaaggccaccctcctaggttaccacagtggcttcctaatgggccataccctcacttgctttccatcaccccctgagacctggcccctgcatacctctccagcttcacccctcacatatctccctagccagacctatagtatgttttaaaaaaaaaggaaatcgcactcctctggcctctttaccttggcacacatttttccatcacctgacccctgacccacactcccttttcctgtgtaatccaattatctctaggcctcccgtgtttctgtttgtccttcaatagaaggttgtttgtcttgtcttttattgtatttctagaaccaagtgcagagactgtacaaagtggacctcagcaaagatttaccgaatgaataaatgagttcagaacgctgacttaactcttctgttggcacccaggtggcttctatgcactctccttccactcaccaccagggggaagcatggagtaaaggaaaacaccaaggctttcgctgggttcaaattctgacagcgtatt

SEQ ID NO: 4343 - DNA, 1162 bp, Homo sapiens
aaactttccatgttagaatcaaacccccctcctcccagacctgcttctcccacacacttccctatctgaatgaaagacacctccactctccacccagttgccaaatcagaaatctgtctttgttttctttgtctcacattttcctatgtctaatcagttaagttttatcaatactacctgtttatttctttaatctattcacatatctttatcctcaatcttcagcatccccttcccatcctcagtctgctggttactgtatttcctattttactaagaatctaaaagagatcagaagaaaacttccacatcccccaacacccaaccaccaaatctgctaacccagttgcattggtgcttttatagccttccttcctccctcttactaagaatgaaccaacactattcctatcaaagcccaaccctctagctttacattgactcctagtgtcttttttctggattgtcaatttttttcctgaccaattattctattagcaatacaaatatgctgtaaaatctcttaaacttttttctctgcatctttgaactgctgttctcttttccttctccccttcatagcagaactcctcaaaagagttgctacctctaattcttcccttccagttctctcatgaaccagctacaattaagtattcacccccaccactccatggaaactgctcttgtcaaaatcatcaatagcctttgtgtggtgaatccaatagccagttttcattcttcttactaagcttctcatcagtattcctagactatttccttcactggcttcgacaaatgctttcttggttttcctccaatttctcgactttgttcctgctgaatctacctttttctaatccgtaagtgttggggtgtcccagggcttactccttggaccttttttccaccttttcccctacactcacccactaggtgatctcaagaatttccagtttgaggccgggcgcggtggctcacgcctgtaatcccagcactttgggaggccaaggcaggcagatcacctgaggccaggagttcgagaccagcctggccaacatggcaaaaccctgtctccactaaacctgcctctactaaaaatacaaaaattattatatttttataaaattattataattttataaaattattatatttatgg

SEQ ID NO: 4344 - DNA, 1055 bp, Homo sapiens
aagagatttgcaaggatgatcgaacagagagctgtggacacatccttgtacatactgcccaaggaagacaggtgaggggctctcactgctggcatgaagtcacgcttggtcagacatccaagtgtatggggaagaggagttcatcaggcccactcacacctgacagctgatgtctcctcgtgtaaggaggctgaaccccattctgcccacctaccagtaggccctaggtcctcgcacttctacagctgggactggtggcctagtgcttctgttccctgttatgcagaaccaggagccaccaccctcatgactttatcacttgccttttccttttgctttaaggtttaaaggatttgggtggggggagctgaagaaagaatattcatttctgtctttagtcatcatgttacaatttgcaaaccattttcacattctcactgtgaggtgagagagatacctttctccctggctttatagataaagaaactgaggctgggagatattgcctacctggtctaggcccagctagcaagtgatggagccagaacttggacccagatccactgactgcctattctgtgttttcgctatattactagcagttagggttctgtttcctgactaccagaatggaaagtttttctctcaccaaatttcagaagacacctttttttctgatttgttgagagcattcaacttgcactaaaaataggtgacttgatagaggaggggaggtaggaagtagccctgggaaagatgagtaggggggaaaggcatctaacagttcaagaatttgcacggttgggtgcccaaggataagagcccctgactgcattccttccactcagggtcagtgtgtccacttctgtgcaagcctagggcatctagaaggttcctgccaagccacacagcttgctgccactccctgggacttgccagcttcccttttctgcttgtgaaggggtgccaccatacctaaattgttacttacttccctctcctttatcaacacacacacacatatttagtaaatattttaagctgtcaggatcatg

SEQ ID NO: 4345 - DNA, 1091 bp, Homo sapiens
gcgactgcactccagcctgggcgacagagcgagacggcgcaaaacaaaaaacaaacaaaaaactacaacagaaacacccgcttctttggggaagaccatgggcggggaagagagggaaaggaggcagaggcagacatcactgcccccgcaggctctggcaccatgttggtcggctgagtggcggagggtggggcagaaaagcagaccgggacgaggaaggcgctgtcggtgacatcacggatagggcgacttctatgtagatgaggcagcgcaggggctgctgcttcgccactggctgtttcaccacgaaggagctcccgtgccgtgggagcgggttcaggaccgctggtcggacctgagggtcccagctgtgtgtcagggctaggaaggctcgggggtgcgcggggcaagtgaccatgtgtgtaaagggtgaggtatatggagctgtgacagggcagaagtgtgtgaagtcatacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgtccgcgctttcccctgaatttttgtaatgaaaaaatagactcccctataagggttattcttaaaactgcagttttgtggcttgggtggcatgttaagtgttctccttacagtcgcaatgatgggaaacagaaagtaacgtgttatcctctccgccgccgtgagctcttttaacactaagtggccgcagggctcttctcttccctttctacttggggctgctttttgcagatcgcttcatagtctccagtcttttgggttctcatgctctgtgaaaaccttcgtgttttttcatagcccccagagtcacccttcacacagcctctgcttctaaccgcagcctccgcaggagtttgtaggatgtctgtgctagcggggaatgtgttctcacctcctagagccagggaagaaactacgcagtcgggtgctgttctttgggatgaaagcagggtccccgttcggttgttaacata

SEQ ID NO: 4346 - DNA, 1021 bp, Homo sapiens
cagagcaatgcgtagcaggcccccgcggaggattaacacagtggctgaacaccgggaaggaactggcacttggagtccggacatctgaaacttggtaagactagtctttggaacttgcccactccatttgagtggaaccacggcgtgcctttattagcagtttggttttggttttgacttggtttgaattgcttgacaggactagtcttgggaacttgcccattccatctgagtagaagcgtggcctgatcacccacagcgtgcctttattggcactttggatttggttttgacttggtttaaattgcttgacaggactggtcttgggaacttgcctactccatttgagtggaagcgtggcctgatcacccacagtgtgcctgtaccggcactttggtttttgtttttgacttgacttagattgcctgatacttcggttttggttttgacctggcttggatttctggatactctgattttggttttgattttggtttggtgtaaactgcagaagtgtgtgtgtgccctttttacctgttttttgttttgtggtgtgtggcgtgtggtgtgagcgtggtgttttgtcttgaagaaacatgggtcaggcacaaataagccccccccactaggaactatgttaaaaaatttcaagaaaggattcaatggagactatggagtcactatgactccagaaaaacttagaactttatgtgaaatagactggccagcattagatgtaggttggccatcagaaggaagcctggacaggtcccttgtttcaaaggtatggcataaggtaacctctaagccaaggcacccagaccagtttccgtacatggacagttacagctggttttagaccccctttccctgcccgcagtagttaagagaacagcagcataagcagctggcagaggcaagtaaagaccatcagagagaaaaagaggccatctataccaattctaagttaatttagactaaacaaggtcttattaatagcaaaggacaattgaaatcccaa

SEQ ID NO: 4347 - DNA, 1023 bp, Homo sapiens
gttctagtctgcgaaataaaagtcattatgtgaagaagagtacccaggctccatctggccaccgaaagtttgcttcacaagataggctaaggaccagcttctttgggcgaaaacagatgccggggcgggagggaaaaagggagaggcagacgtcacttcctcttgctggttcaggcagcgggttggtcggctgactggcagaaaggcagatggggcctgggaaaggcactgtcggtgacatcacggatagggcgacttctatgtagatgaggcagcgcaggagctgctgcttccccacctgctgcttcgcctcgaaggagttcccgagccttgggagcgggctcaggaccgctggtccggccggagagtcccagctgtgtgtcagggctaggagggctggggggtgcgcggggcaagcgaccgtgcgtgtaaagggtgaggcgtacggggcggaggtgcaggagctcatatttacttggcaggggagataacatgatcacgaaggtggttttcccagggcgaggcttatccattgcactccagatgtgttgacccctgcgatttccccaaatgtgggaaactcgattgcataatttgtggtagtggtactgcgttcgcgctttcccctgattttttgtagtttcaagaatacgctgtactctaagggctacttttttctttcattgatttgtgtcttggacgtgttattcttacagtggaaggctgggaaataggaattaagatgtcgcttctcccactgaggagaaatagggagcgtcagccttaacacaaacaaactagcgcgaaggccgtacagctcttccctttctacgcagggctgctttttgcagagattggtccatggtctccagtgtcttgggttctcacgctctgtgaaaatcttcgtggttttctctagcccccagagtcaccttttacacagcccctgcttctaaccgcagccccctcaggagtttgtaggatttctgtgctagcggggaatgtgttctcacctcatagagc

SEQ ID NO: 4348 - DNA, 1095 bp, Homo sapiens
tactttattatcaccacagaatttgaaatgatttctgtagttaacagtcagattttatttttagttaactaagacaaagtgaataattcactgtgagccaaattctttcttgattcctctttttggagcagtccatctttatgggaaaaccagcctagaatggtgatttcagtttcaggtgatttcgatagaattgtatttggctcagaaatgataagactggggccaagaaaaattttaaacttttttttttgtaatcatattactagtttgatttcatatgaacttcctttgttgactttcttttccattaatttaaaagttccagtatcctcaatatttgatgtcttatatgtacagaatcctttccagctgtaagtcatcagcaagtaaaaaatttagtatggcaatagttttcataagaggttttttaaaacagaaaaatgttgacattgccagcctctgggttgcattttgggatatgctacatttcaaaggtatcttttaaatctgaaggcaaagactttttcaacatctgaatattctgatttacagaaattaaaaaaaaaaaccccggaacattacacaggcatataaatttgaatcaggaaaatataaaattagctgattatttttattcagtaaaagtgccttggcacagaactaaaattgataacttatggttttagcatgtagataagtacatgagagtaaatcacatttctatatgaatagaaatatccactttattcatgtatagattataaaactatactaaacaaaaagtaatcatttactattacaaaaattattaagaaccattacaaaaattctctgcctactaattttcaatcaccatagaaatacagtatttaataatgctgctgctgtacttacataaaacatattaagaatagatgttatatttctgtgtttgaatattgagcttaaacataaaacatgtttgaaatgtgtttgtgtgtgtctctcacacacacacataacatgtacatacctgaaactcatactgcaattgcaacacatcttaagtttttccttttaaacataccaagataacattctaaaatgaagaat

SEQ ID NO: 4349 - DNA, 1046 bp, Homo sapiens
agtgtcctattcttatgctggggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaagaaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcttttactaacgtgccataggttgaccatacttcaaaagctgtactctcatggccactgcatcgaattttgagcatattttatggaaaactattgagctcactcttttcatgatcacagtttgctgtgtgtcatgaggacactaactcagagtgtcctttgactcccttaccagtatgtcacctgggcaattcactaggtcactttctctctctctctgtctctgtctctctctctctgtctttctctttcattgttttctacctggccctgttctatcccaacatataggcaataaattttttttttacctcattaatggatctatcctttttcttttctaaccacttccttatgtgacttctgaaatctagtggggctctgtggtttctgattttccctggctgcttctttagttttgtctccttttccaggctcaacggcgtgctgatggaagtggaagagcctgaagtcttacaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacc

SEQ ID NO: 4350 - DNA, 1046 bp, Homo sapiens; identical to SEQ ID NO: 4349

SEQ ID NO: 4351 - DNA, 1045 bp, Homo sapiens
aaaatgtatttctcgaactcctaggtataaaactcaagtatccactatttaaattcttttttgctcacttctagtatgtttccagtctcaatagaaatcgatgccaatccagaaatacaagcattattctaatacttctcacacattactggtatggatgacattttctagatctccttaaatactatcatttttcactacttgtatcttaactgttaagttcaacattttctgtaatattaatatattgtgaaaatttcctttctttcttatttgtcccaggttcaatgttttgcagtctctacctcaccctgtgaagcataaacattgtacatgctgtacaaataatacatcgttcatgtacttagagattgcacaatttttatttggttgacaatagctaatgttttcttcttcattttctatttcctgatttttctttatttagtatatactacactgccataaaaataagaacgttttacaaactaaagcaaaaggaaccctaggaataaaatgcacaaataaaatatataaacatacgtttagatgtaccacgtacacttgtaatttatttagacttttaattttagtacaattttaattaaagtctgtgtattatctgtcatcgtcttagtattttttatataacaaattgtgtaaatcaaaaagtatcaatgtcattgtaaactatcttggcagaggttgatctccaaggaataatttctctcctaaattatgccaatccaaatttcactctaccgtcattcttttcatcagtttcagaggaataataaatttcaaaattgttcaaggtacttcttttagttcaagtaacatttgacaggtgtaaaactgtagacagactgatacaaacgtattctaattgactcaaaattatatgggacctattttaaaatctagattttaaaatgtcgtgtcaacatacacatgttctccttgtgaaataattgttttttattctctggatagaataatttaatctttaaaccttccattcactcttagaaacaatatattacat

SEQ ID NO: 4352 - DNA, 1045 bp, Homo sapiens; identical to SEQ ID NO: 4351

SEQ ID NO: 4353 - DNA, 1059 bp, Homo sapiens
gaccaggggtggggaagggagggaaaggagatagaggtagacttcacttcctccgccggctcccgcagcgggttggtcggctgagtggcggagggtcgggcggaagagcagatggggaccgggaaaggcgctgtcggtgacatcacggatagggcgattcctacgtagatgaggcagcttaggggctgctgcttcccacgaaggatttctcctgctttgggagcaagtccaggaccgctggttggacgtgagagtcccagctgtgtgtcagggctaggagggctccgggtggcatggggcggggtgggggtgggggtgcgggtgcgcggggcaagtgaccgtgtctgtaaaggttgaggcgtatggagctgtcgcagggcggagatgtgtgaactcacacttacctggcaggggagatagtatgatcatgaaagtggtttttccagagcgaggcttatccattgcactccggatgtgttgacctctgcgatttccccaactgtgggaaactcgactgcgtaatttgtggtagtgggggactgcgttcgcgctttcccctgaattttccagtgcaaaaagcagttggtatgcaaaggtctacttctcgcttttttttgctgtataatcttggtggtggtgtgttattcttatagccggatggcagggaaacaggaagtaacatgtcgccgtcgttcctgccggagaaataagcgtcaggcgttgtgttcctgtttaacacaagctaagtagcgcgaaggccgcacagctccttcctttcaacatgaggctgctttttgcagagattggtccatagtctccattctcttggggtctcacgctctgtaaaaatcttcttgtttttccctagcccccaatcaccttttacacagcctctgcttctaagcgcagccccctcaggagtttgtaggatttctgtgctagcggggaatgtgttctcacttggtagagccaggtacaaactacgcagacgggcgctgttctttgggaagaaatcagggcctttggggctcttagtgttcccgttgggttgtagacata

SEQ ID NO: 4354 - DNA, 1089 bp, Homo sapiens
tcattactcttttgccaaaaaaaccagcgacaaaagactaactcagtggaccaacctttgtttcttcattatctctaccttgattctgtccttttatttcctctttcctctaattctaattctgcttctgcttcttatttcctccctggattagaactttacttacctaagctaccagttaggttaccttctcagaaccactaaggcagcagtttgacgttgacaattgaagatttaggattagaaaaaagaaacatgaatgaatttgtgacgttttattataggggtatgtaatgcaggtagaaagacctttttcagagttaagagtttgatccgacaaatgagctattttgatatttataactttgtttagtaaaagtttcctataaaaacatttggtttggatgtctttgttagctttgagtcgacacttgaaaaggccgcttggaagtttctaagtctttctggatactctttccgataattctccaagggttgctggggagaggcactggtggttcagtggtagaattctcgcctcacacgcgggacacccgggttcaattcccggtcaaggcaagaggttcttttgctcttcactatggctctttacccttctgccctgcagaattacactgcataacctaatagtgcatttaagggcttggccaccacaaggtaaactgacaacaacgctgaccaaagtagcagcaaaagacattcaggagactaacccgggacccacgcagttgttggactcaacaaaccgctaagcaaagtggcaagcacgtagtgtttctggtgagtcactgcagttttgatattggtacctgttactttcatctgttctctgggcggattcctgcaaacccaagaaccatcagtttcctgattcgtgtgctggaccttgggcttaccgctgagccactacggagaggaacaagaaatgaagctcccggaaggagagaagctgcgggcggggcaatcacctcggaggtccaagaggcctcagcggcccaaagaaaggggaggtgtgtgcgggagaatctcaatggagatgaggagagcagcggtgactggtccttgcgc

SEQ ID NO: 4355 - DNA, 1031 bp, Homo sapiens
ggggtctctgcgcacctccccaaaggacaatggcaggaggaaaaggagaaagagacagacgtcacttccttcgccagctccggcagcgggttgatcggctgagtcggcggagggtggggcggaagagcagacggggactgggaaaggcgctgtcggtgacatcacggatagggcgatttctatgtagatgaggcagcgcaggggctgctgcttcgccactaaggagttcccgtgcagtgggagtgggttcaggaccgctggtcggacctgagagtcccagctgtgtgtcagggctaggagggctgggggggggggggggggtgcgcggggcaagtgaccgtgcgtgtaaagggtgaagcgtgtgaggctgtggcggggcggaggtgcaaaagctcatacttacctggcaggggagatactattatcaaacgaaggtggtttttctcagggcgaggcttatccattgtgttccggatgtgctgacctctgcgatttccccaaacgtgggaaactcgactgcataatttgtggtagtgggggactgcgttcgcgctttcctctggtgcttttgtggtgcgaatagtaggtgagccgtaagtgtttttgtaattcagtgtgcgggctcgtgttttgtggctgtgttctgtccggtcagttgtttccgttcgcaacggttagttttcgtttgtgaggccatgtttggggacagcttagaactatccacttactctcttgggaggcgaatttcagtctctgttggttggggtgttctcccaggttagctgccgcggtacttgctaggtggagctcagggatcaagggtcgggagctttctggtttgttcagtgctcccagggcttctaacatctcttaaaaactctggtgttttctgtcatcctcggagttacctcttagcctctggtttttttgttgtttttttccccccctccctaagacaagtctcgctgtaccgtccaggctggagaagtggcgcgatcttcccatctcaggctcccgagtaggacaaccac

SEQ ID NO: 4356 - DNA, 1027 bp, Homo sapiens
aacaaaataagattgaaagagaaccaagaggaaagcctttataagctttcctaggggtggggtcaagaacgagtttttcattggtcctaatatggcttcagaaccggccaatcaagtcaagagtcggtgttgttacgtacgcattgctgaaaacgcaaggtccgcacacggaccaatggaaatgaacgactttcggagccctaatttgcataaggtggttataaaagaatcaggcccgcccattctcttacttcttttcttggctaagccgcgtttgtactgtgtcttaccatgcctgaaccggcaaaatccgctccggcccctaaaaagggctccaagaaagccgtcaccaaagcccagaagaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagtgagtccctgccgggacctggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatctagagcgtgtctttactcattgtgctgcttagccttcccaggagtcggttctcaattaggctgttgggaatccgcctctttacccgcccccactcccgccccacacgcgccctggtggctcc

SEQ ID NO: 4357 - DNA, 1049 bp, Homo sapiens
tcagctgcccttgcccttggcagctctctggccctgaagctgcctgagacccgggggcaggtgctgcagtgaaggggtctctagggctttgggattggcaggcacactgtgagaccaacaactccttccttcccctccctgccctgccatcctgacctccagagccctcactccccactccccgtgtttggtgtcttagctgtgtgtgcgtgtgcgtgtgcatgtgtgtaaaccccgtgggcagggactacagggaaggctccttcatcccagttttgagatgaagctgtactccccatttcccactgcccttgactttgcacaagagaaggctgagccccatccttctccccctgttagagaggggcccttgcttccctgttccaggggttccagaataggcttcctgccttccccatcattccctctgcctaggccctggtgaaaccacaggtatgcaattatgctaggggctggggctctggtgtagaccatggaccaaaagaacttcttagagtctgaagagtgggcctcgggtgccctctcacatctcctgttggatgctgggggagaagcaataaacctcagccctctggcctccactttcctctcaatttgggctgcaaatatgaagcctgaattttatgaaattagctttctgattcttatttattaatagattaagttctgaggcagctccgcaggactgtgtgtgaatgtgtatgtatacttacatatgtgtgtgcatgtgccatggggcggggggtatcactatactgtcctcaaatataagccaagggtaatttcagcggatgcacacacaaccctgcctcccacagttcctcccctaatctggtttctgtgttgagcctgggatggaggagccctaggccagcctgggataagagtcccacagtctagggagatctgagggcatccgacaaggcccatctccttccctcctcaagaagcagaggcctcctctggagtgagaggctccacccactacagcacaggcgggaatagcacagctgccctcccatgctccc

SEQ ID NO: 4358 - DNA, 1093 bp, Homo sapiens
aagacattttctcctcactaccattaactcttcctttttccatttcctctataggcatgcctcctcctggctccttcccacccccagtgccacctcctggagccctcccacctgggatacccccagccatgcccccaccacctatgcctcctggggctgcaggacatggccccccatcggcaggaaccccaggggcaggacatcctggtcatggacactcacatcctcacccattcccaccgggtgggatgccccatccaggtaggtgtgctttgttgggaaagggagggaagagcttggtagagcatctctgttaccactcaccctgctgccctttgttcctcaacagtaacagtttcagagttttcctttccttcagacattctattataaaaacatacaaaatgctctctaacatctaccaccctgaatccatttcttaagtttttctgacaagtagactctacttgccagtttttatttctttaatctttagttccattctcttctctgactccacctcaaagtggtgacctaattgccaaatctcggggacgcttctgctccttatctagtttgacctctgatatacttgaaactagttgtgtcctcctgtttgaaattcttgtctctttttgcttttgcttttctagatcctccacccctctctctgacttcttaatctcagctaccgtgatagactcatgtctacttgtgcctagatttttgtgcttgtttctcttttctgcatatatctatagttttaattgggtatatactgatgcctcctaggtctgtatctctagtccgtagctgttgatattccagatccttgatgctgctgcttaatagatagcgtcatttttctatccctctccttcaaatccattcttcttctagtgttcttttttttcaggtgcttaattcatgaatctgagagctatgtttgactgctccctatcaccccactcttaataccaagtcttatttgtatcagtggcatctctccccatggccagtgccctagttcagtctctcattgcctcattattttacacttaatttgttgtagtaatctcttgccactttgact

SEQ ID NO: 4359 - DNA, 1196 bp, Homo sapiens
ctaatttttctattttcagcagagatggggtttcaccatgttggctaggctggtcttgaacttttgaccttaagtgatctgcccgcctcggcctcccaaagtgctgggattacaggtatgagccactgtgcctggcctctgtataggaatttgagtcttaggctttagccattgaaaatccattgaagaatttagaacagtgggatgtaatactataatactggcattttaaattgctcatagtggttgcctgtggaggccaatcaattgacggagagaggtagagggaggagttagggagctatttcctggggtgcaggttatgaaaacctgagatagaataaaagagctgtagcctgtggaaggttttgcagggatttgagagatatttaaggtaaaattagtaaaacttagtgaaagattatttgtgtggataaggcaagagagaagtccagggcggctccctggcttgtgacttggatgattggggactatttgctacaataggcagtactggaagaggaatagtttgaaaggatgggagacagagatgagagaataagctcatgtttttatatactgaattttaagtgcctgtatgattcccaggtgaggtggaaagaatttgggggtgcagatacatttggagtcatgaacatttgggtgcttagggctgtgaatgaagtttcaatgagaagatggaaggcctaaggctagaatggtgggtgcactaagtttggttcagtcacagaaatgggagtccacaaagacgaccaagacacagggccagagaagcaggaagagtggtcagtaagtgtcaaatgctacaaagagagcagaagtaaggatgattgtgttcatcttatatataagccagtgccattctctttctgcagaagcctatttttgtaggttgaggacaaggagatttgcagggaagaggagagtaaccgccaacaaataggagcaggggaggaaacctaaaggaacccctcttgctttgctttgtaattttttttttctgtgaagtaggaggcaaggtcatttgacaggagtaaggggaggtgatgtggcttgggtgggaggctcaaggagcatggtgaaggtatgggatagtagctcagaagattgattgaggtactaaagcaaagatagcagtgtttcaataaaagcaaggtggctgaataacatgttag

SEQ ID NO: 4360 - DNA, 1025 bp, Homo sapiens
aacattttatataacacctcatttatactcatagcaatgccataaaatagatactgttatgcaaccttacagattaattcattcaaagtatgtattagtgtgatttaggcactgtttaaggtcctgaggatgctatagtgaatgtcagatgaagtatctgctaagcaatagagacgttaaataatttacccaaggtcacaaatcaagaaagtaacaggtaggatttagatatagctctaacggattccaaaaggaatgtctgcaaccattgttacattatgccactgtttacatatattggatgttctctgtgaatatataaaggcataaaaataggtggaaccccagtttttttttgttgttgttgttaaaaatggtcttgatgaatccaagaaagaaatgtgtcttggtgctgaaaagcatacttgcacaataatgcttttcctctcttccccttgcctctcccttctccctctccactcacttgtacctgggtataaactggacagtgtgacctgctttggcatttgaatgagtttgtgctttgagaactaggagaatgttgtttgcttgtttctttttggcttcctgaaagttcgtgcctgcttgcaggttctttcttgtagcacaatggtgagtaatgtgttgttaacattgtaatgtggtcatgcgagttggaattttttttgttttccctcagttctctctgatgagtatgcaggtagggactcttgagtcaaacttgcctgctcaattcattcaaatagaaaaagctttctgtattcagaggactagaaaagagttttgaggttggaaacaataccaagatccaatgtcttttgcccagctgaaattcagttttgttagcattctaggtttattctttagcttgtgctatctaagagaggacttgttttagattacggccactattaccgtgtgccatacctgggatgtgtggtctttactctggagttagcatcttcagaacaggtgcaaggatttattttgagcattatctcgta

SEQ ID NO: 4361 - DNA, 1385 bp, Homo sapiens
gttgacttttattttccttatctttttatacgtactacgtaacgctttgcttagaaattcacatgctgctaatttttcagtctttggcctctagtactgtatatttaggagatttttgaggaggctggatccctttgtctttcagaatctatttcaaaggtggaaaaggacagagtagagaaagaggtggcggtaagactggctccaaagagttgctaacccctaaatatttaaaaaagtttctatgctatgtaacttctgaaaacatgtagaaaattttcttcctactaaatgagattgcattcctgatggggagaagacttcagggacggaagctgggtggctagggagaatcagaggtagttaaatatttgctgtgtataacttacaaatacattatgcgcaaacaatgaagaattaattatacgctttgtcttcattgtttttcaagtagttcttttaacgttcagtaaccaacctgctgtgctagtctattgatattttgaaggctgaacaaaactgtaaaataaatgaacttgatgttgctcctctgcaggctgaatacccccgaccgttctaatttccactattgacccagcttgcctcagagcacctccctgacaaagtggccagttactatgtacttagagattgcaaatcaatgcaaatattagctcatactaggaataattaagaaggtaaatatgctgaaaacatatattccaaaaccaaaatagattttttcgattttaccctcatttttgattatcaccacctttctgccaataattatccgttaacatgaataatttagaattgaacagatatctgctttggacattacactttcaagatagaaggaaagatggaaggaagatagtgccaaactaattttttattgtcattgccttatttgacttattccttgcttttaatactgaagactccctcggaaaaaaatgtaaaactttgccaaagcaagagctggctatctactgacttgtataaggcccggtgactggtaatgaatgctaatcattaggtggcctttagtggccttatgttgccaacaacttggaaaatttcccaaagctttatttgtttaatctttcttttgagacccctatttaaaaaacgacttaatttggagacgaaaatctaatttttaaaaaccacatacacctttcccagaatctgttgatgatcaataattgttttgatctgtgtgagttgattggtgccaatattagtgatgatatctgggtaaattctatttatatctgcatctagcaactccctaagttgaactgcatactttattccagggcatggggatcaaaggggttgaagaagcctaggaatgagtggagagctgcctggtagtc

SEQ ID NO: 4362 - DNA, 1050 bp, Homo sapiens
gtgtaaagggaggagtgggaggaaaaaaatatgtatagtgccaacaggtaactaaaaaggtaactatctgcttgtaaggtaaaaagaactcttggggcgggttgcggtggctcaaacctgtaatcccagcacttagggaggctgagcgggggcggatcacctgaggtcaggagctcgagaccagcctggccaacatggtgaaactccatctctactaaaaatacaaaaattagctgggtgtggtggtgggcgcctgtaatctcagctacttgggagattgaggcacgagaattgcttgaacctgggagatggaggttgcagtgagtcgagtccgcgccactgcattccagcctgggcgacagagtgagatgaaggaaggaagggaggaagggagggaggaaggaaggaaggaagggaggaaggaagggagggagggagggagggagggagggagggagggtctgcacctctgcattccagcctgggtgacagagtgagactctgtctcaaaaaaataaataaataaagaaagaattcttgggttaaagggtaaatcaaaatggaaattaaagacaatactgaaaacattacaaagcaaaacctatagtgtacagaaagtggcattcaaaagaagatgtatagctttagaaatgcactcaaagaacataaaagattgaaaatcaatgaaccaaacattaaactcaataagctaggcaaagaacattacaaacaactcttttaaaagttgggggatggaattaaaagagataaagcagaaattaatgaaataaaaaacaaacaataaaaggcacactcaattagtgtactaaaaatctgattatttgataaccaataaaacagaccaatctttggcaagtctgattaaaaaaagaaagatggagaaggagagaaaatataaaaatagcatcagggccaggtgcagtggctcacgcctgttttcctagcactttgggaggccgaggtgggtggatcacttgaggccaggagtttgagaccagcctggccaacattgtgaaaccccatctctac

SEQ ID NO: 4363 - DNA, 1056 bp, Homo sapiens
tggccactgtagtatagtttgaagtcaggtaatgtgatgcctccaggtttgttctttttggctttgctatttgggctcttttttagttccatatgaattttaaaatagtttttcctaattctgtgaagaatgttattggtagtttgataggaataacattttatctgtaaattgctttgggcaatatgaccattttaatgacattggttcttcctatccatgagcatgggatgtttttccatttgtttgtggcttctctgatttctttgcacagtattttgtaattctcattgtagagatctttcacctccctggttagctgtattgctaggtattttatttttttagtgacaattgtgaatgagagtgcctttctgatttggctctcagcttgactgttgttggtgtataggagtgctagtgttttttgtacatttattttacatcctgcgactttgctgaagttatcagctgaaggagcttttgagccaagactatggggttttctaaatatggaatcatgtcgtctgcaaacagaaatagtttgacttcctctcttgctattcagatgccgtttattgctttctcttgccttattgctctggccaggacttccaatactatgttgaataggagtggtgagagagggcatccttgtcctgtgccagttttcaaggggaatgcttccagcttttgcccattcagtatgatattggctgtgggtttgtcatagatgactcattattttgaggtatgttcctttaatgcatagtttattgagagtttttaacatgaagagagcataatatttttatattgaaataatcttttagaaatggctcattcctgatctgtcaagcatttaatcaagatcactgtttttcttaactagaaagactgtttaatattgtaaaagtaaatcataaacttttttatttacatatctttccatttgaagcaaataaaatgtctttaatgtaggacactattatttaagattattctcttaataatagtagtaaataataacaaccacctttcattaagcttttacta

SEQ ID NO: 4364 - DNA, 1035 bp, Homo sapiens
tgattgaggaccagaggtccagtcacaagtaaccagccactagccagctgcttcaggaaaatcaccctcttgcccctgtggctttcagtgaggatgatcagaatggtcttgggagtgatcctggctcacagttttctcatgtgctgactgaagggtttttttccttggctcaacagctttgaaagcacatcttcagtaagataatatgtaggcattttgcaaagtttaaccacctgcgtaccaccgttcttgccaccaccagctggttttgtaatagttgcaggaaacttctccttttgcttttcaaccttggatttcacagctgagtacttcctcttgcacgtggcctttctggaatacatagcagatggagaatatctgccaatccctctgacaatgacaggattttgactgcaatggggcttcctgttcttgggcttcttagccttgaggttaccctttttcaccttgccaccagcatcagccttcttgacttcaggtttcttctctttagtatctggcttctcaacttgttcaccctccatcttgtaagatgggaaagagctgactttttaataatggccattctgactggtgtgagatggtatctcattgtggttttgatttgcatttctctaatgatcggtgatattgagctttttttcatatgtccgttggctgcatatatgccttcttttggaaagtgtctgttcagccgggcgtggtggctcatgcctgtaatccaagcactttgggaggctgaggtgggtgaatcacttgaggtcgggagttcgagaccagcctgaccaacatggagaaacctcgtctctactaaaaatgcaaaattagccaggcatggtggcacatgcctgtaatctcggctacttgggaggctgagacaggagaatcgattgaacccaagaggcagaagttgcggtgagccgagagtgtgccactgcactacagcctgggtgacaagagggaaactcagtctcaaaaaaaaaaaagaaaaaaaaagggaaagaaaagtgttca

SEQ ID NO: 4365 - DNA, 1026 bp, Homo sapiens
ctgcctcagcctccagagtagctgggactacaggcgcgcgccaacacatggtgaaaccccatctctattaaacatacaaaaattatacgttttattggcatcagtcacttttcagagaatatttgcttcactttttcttgtgcaaccaaaagatgtctttgatcctatggaaggagaagagaataattaaatttgaaatcttgtatacacaatttttattaaaatgtcaaaggacagttacatgtttctatagaattagcatatgtatatatatacgctctatctatctatctatctatctatctatctatctatctatctagagagacagggtctgttacccagggtggagtgcagtggctattcacaagcacgatcctgctactgatccgcacgggagttttgacctgctctatttctgaccttggccagtttacccctccccttaggcaacctcgtggtcccctgttcctgggaggtcaccatattggtgccgaacttagtgcggacacgcgatcggtatagcacactacagcccagaactcctgggctcaagccgtctcctgcctcagcctcccaagtagctgggactacaggcacgggacaccgcgcctggcaaagttaacaaatatttaactgcagtaaaactaatgtcagtagtttctcaggcattttcattggcttttacaaagtcacaaaattgggtaaaatgagggccatttactttatttaaaaaaaagaggccgagcgctgtggctcacgcctgtaatcccaacactttgggacgccgaggcaggtggatcacaaggtcaggagttggagagcagcctggccaatatggtgaaacctcgtctctactaaaaaatacaaaaattagccgggcatggtggcacgtgcctgtaatcccagctactcaggaggctgaggcaggagaatcgcttgaacctgggaggtggagcttgcagtgagccaagatcgcgccactgcactctggcctgggcaacagagtgagactctgtctcaaaa

SEQ ID NO: 4366 - DNA, 1114 bp, Homo sapiens
aggttctattcagtaatatggttcatggatttagtggtgactgataagattttatttttgaaggaaaaattgcttatactaagtccagagacatgcaggtgagcccttttgtcaggctgcaaatcatgacatgccgatggttgtttattttgtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgaagaaagaaaagcaggggtgcttttggaagcagtgttagtgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttag

SEQ ID NO: 4367 - DNA, 1030 bp, Homo sapiens
actttgggaggccgaggtgagccgatcatgaggtcaggagattgaggccatcctggccaacatggtaaaagcccgtctctactaaaaatacaaaaattaggccgggcgcggtggctcacgcctgtaatcctagcaccttgggaggccgaggcaggcagatcacctgaggtcaggagttcgagaccagcctgaccaatgtggagaaaccctgtctctaataaaaatacaaaattagctgcgtgtggaggcgcatgcctgtaatcccagcgactcgggaggctgaggcaggagaatcgcttgaacccgggaggcggaggtgtggtgagctgagatcatgccattgcactccagcctgggcaacaagagcaaaaagtccgtctcaacaaaacagaacaaaacaaaaacacaaaaattagcggggcatggtggtgcgcacctgtagtcccagctactcgggaggctgaggcaagagaatcgcttgaacccgggaggcggaggttgcagtgagcagagatcgtggcgctgaattccagctggcaacagagctagactccgtctcaaaaaaaaaaaaaaaaaaaaagaaaaaagaaataacatggtattttaaatcttgaatgtaagttttaactttacttttccagcaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgagggtaatcgttcttaatactcataagtgtgtcataattatagcctctgctgtagctgtgcaaattagattgggcctggaaatttaggtgtgaaaaaaaaaatccacaacaagatattagtaagacaagaaaaaattaaaaacccatagctctagccagtatttcttctttcagatttcccatagtttcagggaatttaatgactattataacatgaagctctgtg

SEQ ID NO: 4368 - DNA, 1028 bp, Homo sapiens
aggggagaggggcaaaggactgcactatgggaagtggggcagcccctgggtgctggtttggaagaggaggcactaagggaggacattagagggaaaggagcatccctgccctccctcatgtttcccctaccccaccccaccccaggaaggcagatgaggggttagcatcgctgagtgaggacggaagatcacccatctccatccgccagatggcctatggtgagccaagggagagggactggaggagggagttggacagccccctcctctagggaagtctctaaatatccacatgttctaagtggcttcttactttccttcatccgtcacttccaaagaaagttggtctggagggagagtagatgtgaaagaattgtaaccgggaatggggaggggtcagtggtgaacaggcaatagtgtgatctctgacattgatgagatcctcccttcccccagtttctggtctctccttcggtatcatcagtggtgtcttctctgttatcaatattttggctgatgcacttgggccaggtgtggttgggatccatggagactcaccctattacttcctgacttcaggtaagatccaccttctatctagcctttaccccccatccatccttgtccctgatctgatttattggccttccctgagagacttctttggctcaacatctcaggagcctgggagaagatcagggatgtatctcctccccatctccctccctgcagcctttctgacagcagccattatcctgctccataccttttggggagttgtgttctttgatgcctgtgagaggagacggtactgggctttgggcctggtggttgggagtcacctactgacatcgggactggtgagttggagacaggggcctgagttagggagaaaagcatttaatggtgagtgggatgtgggggaaagggtatcctcacttcttaacatttttaacttacctgggaggaggaggaaaggtgagtctttcaaggtctctcacctcagcatcatttctatcacctgctct

SEQ ID NO: 4369 - DNA, 1032 bp, Homo sapiens
cccgggcgctgtcctcgtgcccggccgagactagggacttaagcagcccgggctggcccagccggggtcagaggctgcagtcgctcccgggcgctgtcctcgtgcccggctgagactagggacttaagcaacccgggcctccgagccgctcgggtgagcggtgcgaacacggcgcggcgcggcgcggcacaggcggggcagcctccaggggcgcctggagcgaggcggcctgggagagccgctggtccgggagggaagcgccctggacggaggtacccgcggcccccgatccgcgtgggtccaggctctcccctccacgcagcctcccctgcaaactcagtcactcctgcctctcccgtgttgggcagtggtggttcagattgctgggacttctatgagcttcggtttttttcctcagtaaggttttacactcgggactcagcgaaaggacagcgtgctgacttctgagtcagactgatctggatttgaacctcagctccagctcttgccagctatgtggtcttcgacgaatacttccacccctgtgtggtgcagtttgctcatctgcaaaatgggactaatctaatatatatgatgggcttggatatgtctctttatgcatttatacatggaagaatgcaccccaaactcagtagtattggtgacatctggggagggatgcagggttgggggaggactgaaaaaggcttttgctttttactctgcgttatgtttattattattatattattatttatttattttttttgagacggagtctcactctgtcgtccaggctggagtgcagtggtgctatcttggctcactgcaagctccgcctcccaggttcacgccattctcctgccctagcctcctgagtagctgggactacaggcgtctgccaccacgcccggctaattttttgtatttttagtagagacggggtttcatcgtgttagccagaatggtctcgatctcctgacctcgtgatccgtccgcctcggcctcccaaagtgctgggattacaggcgt

SEQ ID NO: 4370 - DNA, 1085 bp, Homo sapiens
aggccaaggtggagggatcatgaggtcaggagtttgaggccagtctggccaatacagtgaaaccccatctctactaaaaataaaaaaaattaactgggcatggtggcgggcgcctgtaatcccagctacttgggaggctgaggcaggagaaccacgtgaacctgggaggaaccccggaggtggaggttgcagtgagccgagatcgtgccactgcacttaagcccaggtgacagtgtgagactctgtctcaaacaaaataaatacctctctagtgaggtggctcacgcctgtaatcccagcactttgggaggccaaggcgggctgatcacttgaggacagaagtttgagaccagcctggccaacacggttaaacgccactactggtggcgggcactagtagtcccagctattcaggaggctgaggcaggagaattgcttgaacccaggaggtggaggttgcagtgagccaagatcatgccactgcactccagtctgggtgacagagcgagacttcctctcaaaaaaaaaaaaaaaaaggccaggggcggtggcttatgcctgtaatcccagcactttgggagcccaaggcgggcagatcacccgaagtcaggaatttgagaccagcttggccaacatggtgaaaccccgtctctactaaaaatacaaaaattagctgggtatggggtcacgcgcctgtagtcccagattgcagtgagccaaaatcacaccactgcactccagcctggcgacagagcgagactccatctcaaaaaaaaacacctccgaaaatttggtgtcctttactaataattcttgggaagtagaaaaaggatatacgtagcaagcttttgttcccacactatacttggtttctaatttgcagttcccttcttgacctgcatagaataatagttattttccattgggaaatgagaaatcttcaacattgaggtaagttaggatttttttttttttaagaggtggggtctcactctattgcccaggctgcagtgcagtgggactatcacggttcactgcaaccttgaactcctgtgctcaagcaatactcccacctcaacctccaa

SEQ ID NO: 4371 - DNA, 1048 bp, Homo sapiens
agagtgaaactccatctcaaaaaaaaaaaaaaaaaaaaaagggcaccggacaagatacagccatttataagaggccccagaagaaacaaccttcgataccttgaccttggacttctagcctccagaagtgtgaggaaataaatttctgttgtttaagccactgagcctttggtactttgttatggcagcccccaaaaactaatacttaaacaattcatctctggttcttctttctcttttcctgcccacctcttaaacattggtattcctcagagttctacatggtcctcctttctcctgttacatagtcttcctggataagaaagggctctacaattagacttgaattcaaatgctagccatcaattaaaagctggctataaattcccaaatctacatttaattttctttttgtataaaaaatggggataagaatatgatatgtttttcttaagagttgttgggaggactaataataataatagggtgggtgaggtggctcatgcctataatcccagcactttgggaggttggtgtgggaagagctcttgaacccaggagtttaagaccagcctgtgcaacatagcaagattctgtctctccaaaaaaaaaaaaaaaaaaaaatttaattacctatgtgtggtagtgtgtgcttttagtcccagctacttgggaggccaaggcaggaggatcacttcagccaaggagttcaaggctgcaataagctatgatcaagccactgccactgccacttgcctgggcaacagagtgagactgcatctcagaaataatatcttttcttggccgggtgcagtggctcacatctgtaatcccagcactttgggaggctgaggcgggcagatcacaaagtcaggagtttgagaccagcctggccaacatagtgaaaccccgtctctattaaaaatacaaaaaattagccgagagtggtggcaggcacctgtaatcccagctactcaggaggctgaggcaggataatggcttgaactcaggaggcagaggttgcagtgagacaagattatgccattgc

SEQ ID NO: 4372 - DNA, 1079 bp, Homo sapiens
acaacaacaaaaaagcggagattgggtttataaaagagctttctttggagagagctactaccatgctgtgagccctattcaatcccaaagagaagaggtggggaagggccaggtgaggtggctgacgcctgtaatcccagcactttgggaagctgaggcgggcaggtcacctgaggttaggagttcgagactagcctggctaacatggtgaaaccccgtctctactaaaaataaaaaaaattagccaggcgcggtgacgggtgcctgtagtcccagctactcaggaggctgaggcaggagaatcgcttgaacctgggaggtggaggttgcagtgagctgagatcgcaccactgcactccagcctgggcagggggagcaaaactccatcccccaccccaaaaaaaagagatgaggtgaggagtaattctatcttctcaatcctagagacagtggcttcaagaccactgaaacattttgtatttgtccttgggtaagggataatcattagactgtgtatgactcacggtagaggaatttcaaggcaaaagctgactaacaacagagcctgatgtaacaaagtagagagtcacatcctggaagtcaccacactggcttctgataaacggtcagatatacatgaatcctgtggaccatgtgtggagccagtttaaatcctactcaagagaactgcctggatgcatagtggggctcttcatgtggaaaagaacactggaaaacaaaaggataatgagagagtggtggctatagaaatagaatacatcacctcacttcaggaagttgccactgcctttggaaagcgcccccagggaagcctctgatggagccatacaaatgctcatgagataattcttaacatcagccaggcctagacagcatgaagccactaataacccttcctcttcattctgccccattcctagaaatatcagtgtagcaaaaggagagaagccaactaccccctctttcacagaggcgagctggctggctctgttgaccctagctgtggggtagagagattcttacctatgatgaaaattgatgtgttaatatatttcgga

SEQ ID NO: 4373 - DNA, 1049 bp, Homo sapiens
agtgatttctttcctcatgatgtgccaatctgcattgctggaaacctgctactgaaagaagttaaaagctgcctgtgaatgtaacgtacaaaagaaaggttaccaaaggagaaaaaactccagcgggtgtacggtggctcacgcctataattccagcactttgggaggccaaggtgggtggatcacttgaggtcaggagtttgagaccagcctagccaacatggtgaaaccccatctctactaaaaatacaaaaattagccgggcgtggcggcacatgcctataatcccacttacttgggaggctgaggtaggagaatcgcttgaacccaggaggcagagtttgcagtgagccgagattgtgccattgcactccagcctgggcgacagagcgagactccatctaaaaaaaataaatgaataaaataaaacaagtacaaatttaaactagagacacaagttaatggtgtttattgtggtggggttagtgagccatcccatgatttcctcctgagtatgttatccctggtttgtgtttgccagctggggaatgaggtgaggtctatgaggctgaatgtgggatcattcaatttctttctttctttctttttttttttttttttagaggcaggatcttgctcagtcacccagaatggagtgcagggtgcaaacactcactgtagcctcaacctcctgggctcaagtaatcttcccatctcagcctcccaagtagctgggactacaagcacacaccaccacacctggctaattattttttgtagagatgaggattcaccatgttgtccaggtgagtctcagaacacaggcttaagcactcttcccatctcagcctcccaaagtgctgggattacaggcataagccactgcgcctggctgagaatatattttcatcctttcttttgtagagaggatctcgttttgttgtgtaggctgctcctgaactcctggcctcaagcagtctttccacctcagcctcccaaagtgcagggattacaggtgtgaaccactacacccagcagttagtgcaatt

SEQ ID NO: 4374 - DNA, 1405 bp, Homo sapiens
ttatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgtccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaatattctgaagcagttggtgtgttttattggggtttgggagggggaagaaaacaatactgaagacattgttaatgtgagatgcggctgagttccccaataccatcacttaggaaagggagcaggaatgttggcataaaccttgcccatccctttgtttctgtaaccaatgtagaaggtgcatcaacctcagtttgtggctcacaaaatgaggcatttaagatatttgatctaaatggtttcttgacacctaagcctagtccaggtttagcagaaaaggaggcccagtctccttttccctctgtcttccattccttttcaagttcccatgtttgtgagggagaaatgtgacaaaccaaaagaaatatattatttctttgtaataagccaaaagaaactcaagtctttctgctgg

SEQ ID NO: 4375 - DNA, 1059 bp, Homo sapiens
actccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaat

SEQ ID NO: 4376 - DNA, 1042 bp, Homo sapiens
atactcctgcagcaaatgtatttttcttgttcagagtggtcctccttaccaagagagagtctactttcatagccatgtagctcctgatcagatttttagttcccaaaggtacctaaagctgactgagggattatattatcgttttttaaaaaaaaaatttggccaggcgcagtggctcacgcctgtaatcccagcactttgggaggccgaggcgggcggagcacgaggtcaggagatcgagaccatagtgaaaccccgtctctattaataatacaaacacttagccgggtgtggtggcgggcgcctgtagtcccagctactcgggaggctgaagcaggagaatggcgtgaacccgggaggcggagcttgcagtgagccgagatcgtgccactgcactccagcctgggcaacatagcgaggctccatctcaaaaaaaaatttttttattttccttactctcctctgcaatgactgtaggattataaatcattacattggagtgtgcttctctgtgcggatgaaatggtgggtgaaacatccctgtggaggatcccagttattgagtcttagtcacagatgataatgtgatgctgatttgcatttaccttgctggaggcaaggcaggcgtgggcaggctgtcacagtcatggaacatgtgtgggagctgtgagagtcagaaggaaaatacattatcctcatgaacaggcccagtttctattcctggtctgggagaataatcattttgaggttgttggcttgtggttgatctcctggtggctaggatagccccatatttatccttctctatatcttattcatttctgtttctccagttccaggctattgccctgtacccagtaaggtcctcagttaccctttatgaataagtgattttggtggaacgatcctctactgagtggagtacaaaggatggcaggggctatcccttgactccaaaactatatactctagctgggaaattgcttatgtacctgaaaaagtcagaacacactggggagaagacataagtacatgtaattaa

SEQ ID NO: 4377 - DNA, 1049 bp, Homo sapiens
tccagattcaaacaaagcaactgtaaaaaaaaatttactaaacaattgatggaatatgaaggcttactggagttcttattgggttgttttaggtatgatattggtattacagttctttttttaaaaaatcctaatctcttggggagaatatgcagtattttttggatgaaattatatagtagctggaatttgtacagaaataatctgggtttgggtggggtgggtggtaaagatgaaagattatattgataactgttgaaactaggtgatggctacatagagctacataatctctctactttgtgtatgtttgaaactgttggctgggcatggtggctcagcctgtaatcccagcactttgagaggccaaggcaggagcatcacctgagctcaggagttggagactagcttgggcaacatcggaaaaccttgtctctgcaaaaaatacaaaaattagccaggcatggtggcatgcgctggtagttccagctacttaggaggctgaggccagacgattgtttgagtctaggaggttggggctacagtgagccatgttcacaccactgcacctctactgcagcctggttgagtgacaaagggagacacaaaaaaaaaaaggaagggagggagggagggaggagttcaatcaaaaatgttaaaaaaaaattggggttgtgttttcttaccacattactcagttttagacaatatcctactgactccctgtagtgaaagatgatgaaatcagtactcttcgcagtttcttctatctctactcctcaatacttttttttttttttttttttttttttttgagacagagtctctcttactctgtcgcccaggctggggtgtagtggcgcgagcttggctcactgcaacctccacctcccagattcaagtagttctcctgcctcagcctcccaagtagctgggactacaggcacatgccaccacacctatctaattttttgtatttttagtagagacggggtttcaacatgctgcccaggctggtaatattttgttgaggtttataacatatatat

SEQ ID NO: 4378 - DNA, 1020 bp, Homo sapiens
tggattttattttttatatttttatttttattttttgagatggactctcattctgttgcccaggctagagtgcagcggtgcgatctcaacccactgcaacctccacctcgtgggttcaagcaattctcttgcctcagcctcctgagtagctgggactataaggtgcatgccaccacgcctggctaattttttatttttagtagagacagggtttcaccatattggccaggctagtctcaaactcctgacctcaagtgatccacctgcttcagcctcccaaagtgctgggattacaggcataagccactgcatctggccagattcatatggattttaatttatgcctcctattaagataaaagattattatgtttcacaataatatttggcatatgagttatttttcaggtcttatccatatctttcttgttcaaatgtttaataccccagcaaagctcactcctggaaaaagattttgggatcctataaaaaacattaactaggcatcaataatgtcagaaaaagggaaaatactactgtaaggaattctgaatgattttattagttttatttttacttcaaattttccattccattgcctcaaatattaaggaggaaataggaaaattctatacattatttttctcttctcctttttgaaacaagatattctagtcataaagggcaacaagtccaagtaagaagtttgaataacccaactggcaaaaggaagatatgtttaacgaataagtaaataatatttaattataattatcatattatcgctgggcatggtggctcacacctgtaatcccagcactttgggaggccgaggcgggtggatcacctgaggtcaggaatttgagaccagcctggccaacatggtgaaaccccatctctactaataatacaaaaattagctgggcgtggtagtgcatgcccgtaatcccagctacttgggaggctgaggcaggagaattgcttaaacccaggaggcggagtttgcagtgagctgagatc

SEQ ID NO: 4379 - DNA, 1083 bp, Homo sapiens
agggatgtagtgacttgaggatcacaataaacttttagcctctgcagatgaaaacagagatgcacttcttaggtcattccctggctaaataaaatctgcctggaaatctgtagaattccttgtatgatttatatatatacatacatgattgttagtaaaagcaaagtatatagggaatcatttccccatccttcaagagtggcctttctgcagtgttttctactttggccaacaaggatcaaaacggttaactccttagtgaggaggaggagagtggtatggggaggtagtagctcagtgcttcctgttcactgagacatctcaaagcccttaacactctagtttttaaatgtcctactggacattttgccagtttgcaaaattacatgtaaatggactataagcaattgtgtaagccatatgtcatgctgcaggctgcaaattgttcttaaaatggaggatttgtaattaagaaagccaatgcaagaaatgagtgaagctaactagagtaaacttatgaaaagctgtgaatttcatcatcatagaacattgcttttcagtctgaacattcttctaacaaaccttggatctgaggcttcttgtcctttgcggcagccacagtgggtttttgttgttaggggaaaaataaaaaaccttgcccgcagcatctggttaagattagggcagtttcctgcctaaggagggaagggagagaaaaaggaagaagaaatgcataaggagaatgaggagatatacaatgtctcagaaaacaggaaacattgtcctattttcccttgtcctcttctgacaagatctgggaaagtaccagaatttaggcacgaaagagaagaacgcctcgaagaaatgatcaggaggcaaaacttagacggaaatctctcctttgtgtattctgaaccccactaccaccttgctatttgtctgtctccaagcctgctagggaccctggaggaaacgcactgagcccattctgattgtccagtttctatcccccatttctggttgtgtacgtgtgtgtgtgtgtgtgtgtgtgtgtgtgtgtgtgtgtgtgtgtgagagagagag

SEQ ID NO: 4380 - DNA, 1033 bp, Homo sapiens
caccacacctggctagttttgtttttgtttttgttttgttttgttttgtttgtttgtaaagatggagtttcgccccattgcctaggctggtcttgaactcctggactcagtgaccctcccactttgacctcccaaagtgctgggattaccggcgggagccgctgtgcctagcccaagcctttttattcttcttgaatcctgagatagagaggaagaggtggatagtgacatagagaaagtgaggaaacatgtattagaaaaaactttcttatcgatgaactacatttagggtggaaacctgtggctgtggatcaggtgtgaaccagcagttgcttacggagagatgcatgtggcctgaagtgtcttacttcttcctgtgaatagaaatacttgttttttcagagtaaaatattaacttctatttctttttcttgcgcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacaggtgagagttatgtgtatgggaaatgaatgagaagtcctttcttgtttttttcctgagacttaagagatgttttagctgttaaattggtttgttgactctggcaaggcttcaagaattttctactttaatgaatatagtcagttctttttatccatatgagattatctactttgtggctcagccttagaaaatatttcattggtgataatattttacatttatcttaatattggtataaatagaacagtaaaagccaaacctacaatacttttttttttccgttctaaaagaattatccatgtttttatctcatttgtatggataattatctggtattttttctacctcctggtgcttggctttgtgctaggttcaatgat

SEQ ID NO: 4381 - DNA, 1047 bp, Homo sapiens
atttacttcagtatcaatcaagtattcccttaatgccaccaatttaatcaaatgattagaaagaaggagagaatatagtttgagaaaatggaataagaattttccaaataggatggtctacttaaaactacatactttgtagctatatacattgaaatagttaatatgttctaacagtacatgtgcaagtattcaacagactccagttatgcaccttttgtgggcaaaccaggtgtgttgtgctgtgagaaatagaaagaatggtgagacaaatggttttctggtggaaacagacatgtaaataaataaattaaacatagaactagttctataatagaagtgctgtaatgaatcctgtaaaatgcagatatggaaaatgagttggggagtagtgttgtggattttgggaagcacttgagcaaaaacctagaagtgtggaataattgggttatgcaaagaaagtcaagtggtttagcatgtttttggtagataataggaaggtaggctgggatctaatgatggaatgtttaggtgttaaagaatttagattttaatttttatgcagtggggagacataaaaaatgtattagatctggtagcattttaaggattgattgaaagcagggcgactacttaattagttttggtaaaagatgactaggacagtgacaaagcattggaaagtagaatcgataaaactgaattatcactggaatgtgagagaatagttagattttgaggcttctagcttaggaggatgctgttaagaatattggaagagcacggcaggtttttttttttaagagggaaataatgattcaggttttgggatgttgatgttgagttgctggtagaatatttataaatattttacagatacttgaaattcaagtctgctgaaagctcaggaaaaaacgttagtcatgtctagggctatagacttggttattatttcgtagtggggaagagtgaatatggtttcccaggaagaaagtatggtattaataaagagggcttaagatgaactttggaaatgtctacatttaa

SEQ ID NO: 4382 - DNA, 1034 bp, Homo sapiens
ttttttgagatggagtcttgcagttgtcgcccaggcttgagtgcaatggtgcgatcttggctcactgaaacctccacctcccgggttccagcaattctcctgcctcagcctcctgagtagctgagattacaggcacccgccaccatgcccagctaatttttgtatttttagtagagatggggtttcagcatgttggccaggctgatctcgaactcctgacctcaggtgatccacccacctcagccttccaaagtgctgggattacaggcgtgagccaccactcctggccccagttttgtacttctttgcctagtttgggactatgaacaagaggaaatgtagctttgtttgacttctgccacttcctctttccattcttccatttgggtgggtgttccggtagcttgtgttgagaaattttaacttcttaatgttttgtattatcagcaggcttaaagtatttattgttggctttcctcaggctggattttgatgatgatggagaagggaacagtaaatttttgaggtaagagactgaaaaactttccttagatgtctgatattaaaaattagtttatgatctttatacttctgacttgtaaatttttgtccttaggtctaaggagagtacttcatcctaaaactataaatattcatatatctcagaaaatttttaagcattccgttaatatctctagagaaaggacctcagtgaggagaggacggcatttacaaaccctctgtatcagttctctgctacttcatagcctaaaaagaacaacagttcgttatttctcaattctgtggattgactgcatgtttattctgcttatctcacctagactcactcataagactgcattctcagctggtcagctgagaactggactcagctgggatggctgggtatttctgtctatgtgtttttttatcctcaaggaggccagactgaattttttcatgtggtgatggctacaatctacagcacaaatcccagtgtgcaagtgcttatcaagcctctgcttatatgacat

SEQ ID NO: 4383 - DNA, 1050 bp, Homo sapiens
cctttaagccttctcagtgatggggcttaatgctcatggaaaacaccacgagcaggattacatcaaccagggacagtttcaccatctgtaatgtggaaagcagcataatcatcaaagagatacttaaaatcaattcttgtttctctactttagtagaaggaaacaatgatgtgaataacttgaaacagcatttaacattaaaaaatcacttataaatctttcattttgtaattaatcagatacttgtccaccctctaccaccaggcaagtggattttaaaataatttttttttttttgagacagagtctcgttctgtcacccaggctggagtgcagtggtgcgatctcggctcactgcacctccaccctccaggttcaagcgattctcctgcctcagcctcccaagtagctggaaatacaggcatgcaccaccacgcccggctaatttttgtattttttagtagagacggggtttcaccatgttggccaggatggtctccaactcctgaacttcaagttatccacctgcctcggcctcccaaagtgttgggattacaggtgtgagccactgtgcccggtcaataatttggttctttaaacaaacactaggaatgtgctagttagggggagagataacgaggtggccacagaaatatccatcaagtagaataatctacatgcaaagactcatggtgagactgcattgttactgcaccaaagttaaagccatagctctcagagtgttctgccactgcttacctctttcttggcctgtttgatgtctccctcatccttgatgcctagtcctgaggtggaggccttctcagcctccattcggcttcccccagcccggccctccccaccttcattagtcttgaaggatgaatggctatcagagtcagcaaaaccaccttcactgacactattgcagctcaaccatgaggccaccttgttcttgggtgtctcttcggaggaaggtggattgcagccacctacagggattgagggaggaacaggaatatgtgggggtccaagatctggggggtggga

SEQ ID NO: 4384 - DNA, 1049 bp, Homo sapiens
gagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggttttttttaaaaattaaaagattaaataaaaaatattaaataaaacatggcaataagtgtcagactattaggaattgagaagggggatcaactaaataaacgaagagagtctttcttatgccttccttgcagttatgtaatattttcttttttaaatttcacatgcatgtaatttgagcactttgaggggccaaggagggtggatcactagaggtcaggagtttgagaccagcctggccaacatggcgaaaccccatctctactaaaaatacatctagctgggtgtggtggcgggcgactgtaatctcagctact

SEQ ID NO: 4385 - DNA, 1044 bp, Homo sapiens
ctacctccctgcccttctcctccttcctgctggaatgaactaaagcagatgtcaagcaggggctggtgggggtgcctactcccttttccactctatctttagatttcaaaccttaggcttacagcccctcaatatctctctgctaacaccagtgtctctttctagttaggcctctaatcttctgtttctgtttaccagcttcccagcaactttccttttttaaaatattaaaaatttaattcaggttctcttaattatcctcatcctgctgttgcctccgcccttaactctatccctattaggaaccttgtttcccaccgaataagagttaaggtaagaggtagctcttcacctgatgacattccatttaagttttggggcatctttcctgccctctgccaacctccctgctggcccaggtgagaggaggaagaggggtctggaaagaaacccagaatgcggcagaactaggagtaagtccatctcaaggtggacttctgatcattgaggatggtgagataaataggttgaaaacaatcatctgtgagtttaggagtcttaagatcctcacagcacgggagcagggagaggctctagaacaaggtttcacaaccgagatgcctttgacattttgggctgaagtgttctttgtaaggaaaacctgtttcctattttgtgcattacaggatatttagcagcaaccctggcccactctagttatgacaaccaaaaatgtctctatacattgccagatttctcctagggggcaaaatcgcctccatttgagaaccacaactctaaagtcaagatatttttctctgaagtgatttctgcttggcacgctaccctcatcatcttactcatcttaagcccgagccatggatcaactaggagcccatataaatgaggctcagtagggctgcacataatctccaaacaattctttattcagtgttttgcttgtgtttgcatgttgctatgatggacaggtccccctcctccattcttgccctctggagaagtggttcctgcagtgtagagata

SEQ ID NO: 4386 - DNA, 1124 bp, Homo sapiens
cttgtcctgtcacccaggctggagtgcaggggtgcaaacatggctcactgtagccgcaactcttgggctcaagtgatcctcctgcctcagcctccccagtagctgggatgacaggcacatgctaccacaccctgctatctcgtttttttgtgtgtgttttttttgaggcggagtttcgctcttgttgcccaggctggagtgcagtggcgatctcggctcactgcaatctccggttcaagcgattctcctgcctcagcctcccaagtagctgggattacaggcatccgccaccacgcccagctaatcttttgtatttttagcagagatggggtttcaccatgttggccaggctggtctggaactcctgacctcaggtgatccgcccaccttggcctcccaaagtgctgggattacaggcgtgagccaccacgcccggcctatctcttgtttttaaatcagtctagggtgccaaagcatcagggttcccggcctgcaagaaagggagattcctgttcatgttaaagtgtcatatttatgaaactgccctttttggaatctttgaggttgtctgtactataggactggggaaatgcaagtgagtctaagaagaaacccagatgtgtcctaccctggctggcagtagtgagaagggaggaagttcttccttggacactagtactattggaaagttccttatgtctggttcactgatgaagcttgaggatagaattggtgaggagggaggggagaacaggtcacagctggaggggagcctgggccctatagggtgtgaggcagagcagagtggcagataggacatgtggacggtggggaaaatattcctcatgggacagaagatacctggcacatgtacccacaacctgtacacagatgatctgtactggacacacgtggagatatggccatgccacgcatgtgcaaacagaggtgtacacacaggagtgcagtgatacaggacacagataaacagaatgtacacagccttcaggaaggatctcaaggtcaggtaataaaggaactgctgctgactggcttctgggagggattggatttcactggagggaaatcaggaggaatagggcagcaaacagagagggaagaaa

SEQ ID NO: 4387 - DNA, 1022 bp, Homo sapiens
cagccagtttgggccagttgcagagggaagggccttgagtgacaatgacagctggctggaactggggcagtgctggagagagggttcttttcccccaccccacagggtcttctggggatacaccaggagaggagcctgctggcttgcttcaggggagagggaacttcgctcctcccccacttttccctgtctcccctttcagggccggcttatgggtgagggggcaccccctggggcctgagctgccccgcacaggatgccccgtgccccccacttcatgcccttgctgctactgctgctgctgctctcacttccccatactcaggccgcctttccccaggaccccctccctctgttgatctctgaccttcaaggtgagtgcccagtacctaccttgccccatctctgtgaacaattagagactgagaccccctgtgtgggaggcaaggtgcaggaaggctcccagcctcaggaagctaacagccagaccagcaaaaagaaggaaacaggtagagtgagctgacacctcctgccagctgcttctcatccctgggcctggtttcttcacttagaggcagcatcgtgtggaggttaagagcatgggctctccaggagattgagaccatcctggctaacacggtgaaaccccatctctactaaaaatacaaaaaaaaatagccggacattgtggcgggcgcctgtagtcccagctactcgggaggctgaggcgggagaatggcatgaacccggaaggcggagcttgcagtgagcggatatcgctgcactccagcctgggcaacagagcgagactccgtctcaaaaaaaaaaaaaaaagaacatggactctcagctagaccaaaccttagcaggtttgaatccctgccaagctgctcactagctgtgtgaccttggttaagttacttaacctttctttgtctcagtctcctcagctgtaaaatgaatataatagtattctgagccagtggtgggtactcaggaggctgaggcaggaagatcacttg

SEQ ID NO: 4388 - DNA, 1043 bp, Homo sapiens
gaaacttcagggggagaggagcctgaggtgaggctcaagaacatggcttatgagcctgcctccctccactccagccatcctccccagcctccttgtctgccaaaaattccttggcctggggcagttttattggcaagattagggaatgggaactggacctttcccagttcttgggctgaatctagagttgagtcctttagactcaaaaggctctttttatatccttgttgcctttcctatcctttttacctttccctggccttagaacagggaagcagagactccccctcagcttcttcctcatctccaactatgtgacataatttatttggtgctaatattgaagtaatatttatttgctatattttatttcttcccactcttagctgaaaaatggaatttctatagccctggggtgaggagaacccgggaacagtgagccagtgactgctggttctccactttccccaccttgttagccaaacatgttattgaggatgaggcaatcggtgatatagcccaccacagagaatggatgactgttggccttttctccaatctcaaagtgacagatttgggctgattctttttttttttttttttggtaccccattcctgttgaatgggctcagtcttgacaaaccaattccctgtaactttttcacaattcttgactctgagaaaaagcagcactgtagggacctgaactctccattctaccagttcacccttctgacctgttctgctcagcctgtggtgaggggaacagatggaagaaggctttccttggggtttgaagaggaagccagttgtgggagtctctttgttacaccccctcccctccagaccctctctctctatgccttcctcctcactgcatatttatttgcgatttgtagcactgatctatggtacagttgttttgtttcttaaacagaagtaggtaagggaacctcagtaataatggaaatctgcctcagtctcctgtttggaaatgatgagaggtgagataagtaatgtttatatacctcctttcttctgtg

SEQ ID NO: 4389 - DNA, 1035 bp, Homo sapiens
ttttttgagacagagtcttactctgtcgcccaggctggagtgcagtggtatgatctcggctcactgcaagctccgcctcctgagctggagattctcttgcctcagcctcccaagtagctgggattacaggtgcccgccaccatgcccagctaatttttttgtatttttagttgagatggggtttcaccatgttggccaggctggtcttgaactcctgacctcaggtgatccacccgcctcaccctcccaaagtgctgggattacaggcttgggccaccccgcggcaattcccaggttttcaacatcagtaactggcttaggagaccctgaaggaggagcaagttcagtggggaaaaaacaaatttatttttgaacatgttgaatttaaggagtttgtgagcaattcatgcagtgatgagaggtcagttaaatatgcaaatctggtgttccaataagagatctgggctgaaaatacaaatttggaagtctttagaatatgggtggtaattgacaatattggagtgcatctgagcatgtagggagaaagctcagagtgagaaaacagaggcctgatagagtcctgcagacactaaaatgtgatagtttcatacaagaggaggagctttgaaaagagcctggaagtgaccaacgagttggagaaacccaggagagtttgtgttaaaaatgccaggaaagagaatgtctcaagagagtaattgctgctgagacgatgattagtagaactgagaagtgcccattggttttggtgagatagaggtcagacattaccttagcactttttggggaccaagtcgaatcaaagtatattggggagcaaaacttttcaagcttggccatgaagggtagaagagggaatggaagctacagaggggtgtgagattaaggtaaagttgtttttattttattcgaagatattagaaattatgtctttcatgagaaagaactgagtttaaagaaagagaagaaaaaacggttattaatagtgtaggtttttggagatgggaggcaaggctg

SEQ ID NO: 4390 - DNA, 1043 bp, Homo sapiens
tacaactttagttacctaatttagatcattcagaaaaaaaccacacataacaaaatgcaaaagggccaaaatattaccaataggtgatggggtaaaagatacatgagtattccttgtactattcttgcaacttcgtaggtttgaaattatttcaggccaggcacggttgctcatgcctgtaatcccagcattttgggaggccgaggcaggcagatcacgaggtcagtagttcaagaccatcctggctaacatgatgaaaccccatctctactaaaaatacaaaaaattagctggatgtggtggcatgcacctgtactcccagctactcgggagtctgaggcaggagaattgtttgaacccaggaagcagaggttggagtgagccgagatcgtgccactgtactccagcctgggcgacagagcgagattccatctcaaaaaaaaaaaaagaaaaaaaaattatttccaagtacaacatttcaaaataaataaataaaatatgtggacatgaattcaaagatttcttcttatctcactctcttccaggtcggaagtctatgcgtcagtctacagctgagcatacacgacaaacgttccttcgggtacaggagaggcagggccagtcaagacggcgaaaggggccccactgtgagcggccactaacccaggaggaactgctccgggaggccaagatcacagaagagcttaatttacggtcactgggtaagtctgtggtttcagaaaaagtgagtagaggggctgaggggcatgagaaaaaccatgagacctggaggaccaaagaactggagagatggaaatttgggatgatggaatcagaaggaagaaatggcggagagtaggtaattaggtgcaagagtctaggcagttatgagcactctgaagaacaagctaaggtactttggtgtaaaataagagttgtatagaactgaggtcaaatcctcgttctgctattcatttgctttaagtctgtaggtaaattacttattcacattttgcttttcttgtttataaaatggggtatat

SEQ ID NO: 4391 - DNA, 1022 bp, Homo sapiens
ttcagaggactattggatgaaggctggagctaggagaaaggacagcaggaagaaccttgctaacagagttgagatttgggggttagtggtggaagtaagttgcaaatactgtctcactcttcccccaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggaggtgagagggcttcagggaggtaatgctgggtcacaggagctttctccaggagctttcactatattggaaacaagacagcatatcccaaggcagggtaaggcaagtatcctaatgagtggtgtaggtagtgaggggtaatatggggaaagctctgaacaactctagcctggaatagattcaggtggagttcattttccaggtgaaggattcagatttaaatgtaaagaggagcttctaggccaaggggagtgagggaaatttaatgaaaatatttattgaacacctacataaagttgtcatagaatagcagaggatgagaagtcatacattaattcattcaagaaatttttattgagggccttctatgtgccagacctgagtgctgtatgctagtgaacaagacttggcccctgcctacaagggatttatgacctaactggaaagagaacaaggccagtaagcaagtagttgtagtgtggtgagagtcaagtcatgggggaaaggataggacattataagagcaccagacttggggcgggcatcacaagagatttcctggaggaagtaatctctcagctgaggctggaagcatgggtaggaattagctggacaaagagtgctggacagagggaacactgcatgcaaaggccagaagacaagagggag

SEQ ID NO: 4392 - DNA, 1048 bp, Homo sapiens
tttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagaggtaagctactcctccttcatgagtcacctttgccctgttgggtgggggggggggtccctctcccaccctgtcccgcacagtcttccccacctgagttcgactacgaaactgccctcttggtgtcagctgcaccccgggttccttctccaccctttcctctcaggcctggggtcctcctccgctttttggcttcctcttctattagctcctccctctgcctcggggattcccccctccctcactcatccctgttgcctacgtctcgaataattcttttttttaagtcatgaaccctttccatatcagacgactcccataatgcccatccttgtccttcctcgtcgtctctgcccctgccccaaaccttttccatggactccacctttatctcttttcctagtttgcacttttcctcctatgtccctgtgcaactccagcactgggttcccatttccctgagctaaagattgcatccctgtcttcctgtgctgcttctgattccattacctcactgtcacccacctacccagccagctcctggcttccaagaattgcctgttcccttctccttaagggatctcgggcccttgtcatcaatccaaaagtaccatttacattcttactttgaacctagtcctcactcttctctgggatgcattatgatccctataactttctttagcttctctttctccctcctcaatcccccaactttctagaggtttctgtctgtaggggagagatttgacagtgcccttcccattcaggatttccaactttgacacctccctcgagttt

SEQ ID NO: 4393 - DNA, 1016 bp, Homo sapiens
ttcttttcttctttttcaaaataaggtttccctatattgcccaggctggtctcaaactcctgggctcaagtgatcatcttgcctcaaccttgcaaagtgctgggattacacaagtgaaccaccatgccctgcctacaattctttttttttttttttttttttttttttttgagacagggtcttactctggtgcccaggctggaatacagtggcacaatcacagctcgctgcagcctcagtgttacaggcataatcatcacacctgactcaattctttatagaaggaatctgatagaaattcctttatagaaggaatctgatagaaatttgatagagatagcagccaaatggtaattattattttattttattttattttggatagcgtcttgctctgtcgcccaggctgaagtgcagtggcatgatcttggctgactgcaacatctgcctcctgggttcaagcaattcttctgtctcagcctcccaagtagctgggattgcaggcgtgcaccaccacacctggataatttttgtatttttagtagagactgggtttcaccatgttggccaggcaggtctcgaacctctgaactcaagatatctgcccacctcggcctcccaaagtgctggaattgcaggcatgagccactgtgcccagcccaaatggtaattctactgactcctttattctctccctagacaatattaaacaacattcaggtattgacctacattcttttcagtcttctgaaaaggtgtctttcttttaaacattggagcagcctaggacccccaggatggtctcaccaccccaggaatacaccatactttccctttgaggcctttaaacatgctccctgaaatgtccacctcaactggagtcctgattccctccttctgcctcacctgccatccaggccagatttccttgtcctctgggaagcctccttccctggctcctccaggccaggggcccattttaacgctcacaaagcctgccacacttaacctcatca

SEQ ID NO: 4394 - DNA, 1083 bp, Homo sapiens
tctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgtttcctgtgttgagactgaatgtgtggaggtttcagattgaaagctcattgtttggctttacaagtttgttgttaacggacaatgcaaatggagggatggttttattttttccttcagttctcactgaatttctgtactttgaatttgctgcctatattttctttctcaagaagtttggagaggatttgtgtcagaatcgcctacagtgttcattttaaaaattcaagctgggcatgatggctcatgccagtaatcccagcacttgggaggctgaggcaggaggttgcttgagctcagaaattcaaggctgtagtaggctatgatcatgccactgcacgccagcctgggcaacagaatgagacttttgtctctaaaatattcaggtttagaaccattccagggatggctgatgccccagctgacttgagggcaacctgatgcagaatagttctactagattatttttaaag

SEQ ID NO: 4395 - DNA, 1930 bp, Homo sapiens
tgatttttttgtatttttagtagagacggggtttcaccttgttggccaggctggtctcaaactcctgagctcaggtgatccacctgcctcggcctccctaaagtgctgggattacagacatgagccactgcgcccggccccagccagattcttgagcactcatttcattttctcccctgcttctaatatgtttcctccttcaactcttagagctatttgttcttctctcctagcagagtgagaggctctgttttttcggttttgatggtctgtgctctaatttcatagggccttgctattcaagtaccagtagtattaggtgggagcttgttagaaatgctgactctcagccccgccctaggcctactgaaccagaatgtgaattttaatagatcctcagtgacttgtatgcatattaaagtttaagaagcatggtgacaggaaaactggcttaggttgagattagggtgcactgaagaagtgtctcttttgttgggggcattgtcactggctggtgatctctagcttagccagcagaactccgtaactcataccacttctttgtctttctcagcaatcatgttccacggaagagccccaagtatttggctttgtttaaaaattctgtgaggtaagaaaaaacttattggcagcatcttaatttttcaggtttttacattaattttcaggtttttcattatttggagaggtggttatgtgaattaatttcagaaaaaggagaaagtgggagggcattccttttctttcttaagcctcaaagcttaatggtctcaagtgtcactgctgtgtttgtcttacatagtctcaattctcttttttagtggaatcaagctggcctgcacttcatgtacctttgttacctctgtgggcgatgctatggccaagcatttggtattcaacccctctcacagatccagcagcatcctgccacggggtaagtaggagagaaggggattagttgagcaaggggaggaaaaaagatacaggttcgtactgtatgcatcaggagcatacctacttggcctcactcattcactgttgagatgtgctggacctaattagaaaccttccgacctgaagtttatataaaactgggaaagctggtcactgcgaacagcgtatttgtatgtagtaagttgaatcccagggcactgtctttggagggcttattttttcactgagctaactatttttgttgtttcattttccataggactcacttggatagctcactcaaggtaacaaaaactcacctcacaatttaatttctggtttgcagtgtgtttactctgttattattattattattatcatattattgtttcaatttcctagttgaactgagatttctcctcttctctttgctcctcacccctttaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgag

SEQ ID NO: 4396 - DNA, 1029 bp, Homo sapiens
gaacagttggatttatgaaacaggaaactttttggctatagagacccacaataagatggaaagggaagattagagcagtatcctttagtgtcatctgtccctgtctccaagtgactatgcctccccttccccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatggtaagtgggattattgggaaataataatcctgggctagaggggtgaaagaataaaaaaggtctcagggacagccctacctgtttagttaggtacagatgtggttctactagttggaaaatgaatttagtaatgattctctgatacggaagtgatttctgtagatggtgctattccttctaagttagtgctgactcggtactggtgtttcaagtgagagagcagtagattcttgctattgataatttcttggagagaaaatgtcaacccaaaattcctgttaagatttttttgtttggttggttggttgtttttgtttctttaatgagaaaaattccattagtttggtaagaattttcccagggcagttctgtattttctctggcagattcatttgtttattggttcctgagtatggaagataggatagggttgttgtctacatgaaagaaatggtgaaagactagtgtttttagtgtattttattttattttttttaatagaaaggctatatagtattggtttctatttaatttctaatgtctatttctacactcctaagatgagttgttgaccagttatgtctcaagattcataactgaagtaggcactttcatagagtcattgcatcgctgcgagggactttattttttaattattttatttcctttaaaactaaaacagctttagtactacaaaaataatatatgcattgtagaaaaactataaagtgaaa

SEQ ID NO: 4397 - DNA, 1022 bp, Homo sapiens
ctcggcctcccaaagtgctgggattacaggcgtgagccactgtgcctggcctgagaggacaaatatttttaaaaagaaatgatagttctttatgtatagaatgtgggatgatttttttttaattgccctcgttttcagaacatgtattcagtttgatcagtgattttcagtcttggcactattgacatttagggtcggataatctccaggctatcctatgcattgtaggatgttctgtagcactcctggccactacccactagataggtcagtaacacctctcctcacccccaccctgattgtgactaccaaaaatgtctctagacattgccaaatgccctctggggggcaaacgtgacctctgataaaattcactgtcacttatgaagattccttaattatttatttatgccttttatgaactagggttcccttgatgtaagctaggtacaggtgttgaatgaatcccttctgcagatgtagtgtatagcttgggcggtgcctgatatatgttggagaacactggaatatgatgaaatattttagcactattgggaatttaattgaaggttcgaaatgagctcttgttttgaaagtaaaggtgtaggctttctgctgtatctaaatctctgttttccacctctgccaccaccccctcatgcatttgcttgaaaaagatccttactagcttaggaatagttgagaatttcgtttgaaatgtttgacatgatctgtctatatcttgtgttcaaggaaagatagttttgtttgtttgcgtgtttgtttgtttgtttgtttttgagaacagggtcttgctctgttgcccaggttggagtgcagtggctcgatcacagctcacttcagcctccacctcctggacttaagagattctcccacctcagcctgttgagtagctgggactacagatgtgcatgccaccaacactctgctaatttttctactttttatagagatgagatttcaccaagttgcccaggctggtctcgaacctctgggctcaa

SEQ ID NO: 4398 - DNA, 1044 bp, Homo sapiens
caggtgatccgcccgccttggcctcccaaagtgctgggattacaggcgtcagccaccgcgcccggccgggttttacttctgtaggcatttacccaactagaggaaagggaaacggagggggcagggagggctgctcgttggcaaacgattaattttgagacactattgctcagggtctgagagcttgaactctgaattcgaactgttagcacaatcgttctcaacttcggggtgcataaaaagtaacttgaaggtggttaaacgtacaatttggggggcctcatcccccaaatttatttgaatggagcagaggggggttgtcatctttacattttcaaatgagcagtcctggggctgagactgattaatgtaaccactacattgagaattactggtctaacataaaagtgttcaagatgttgaaacaagtgacaccttgtgccgttgatttccttcccttttccagagctgtgttggtggtgtatctcaaactaaaggaggtaacagaatggactcttgggacgaacctgatttagttagagtttccactcccatcttgaactagtggtataatgtaggaaagcagttctcaaagtgtggacagatgacccatggggatctcctcttaccctttcagggtagcctcaaggtcataactattttcaaaataatagtaagatgctatttattgttttcactgatacactgatggttcaaaagcaaggctgggtaaaactactggcggtaccttagcacaaagcaagtcaggggcaccaaactacttgagaatgcccttgaagcagtaaaatttattattctatttttatttttttgaggcggagttttgctctgtcgcccagggtggagtgcagtggcactatctcggctcactgcaatctcttcctccctggttgtatttttagtagagacagtgtttcgccatgttggccaggctggtctcgaactccggacctcaggcgatccacctgcctcggcgtcccaaagtgctgggattacaggcatgagccaccgtgcccggcctat

SEQ ID NO: 4399 - DNA, 1027 bp, Homo sapiens
taactgacttttaagaaggcccttgggccaggcaccgtggctcatgcctataatcccagcactttgggagactgaagcgggcggatcacttgaggtcaggggtttaagaccagcctggccaacatggtgaaacctcgtctctactaaaaatacaaaaaaaattagttgggcctcgtggcggggacctgtaattccagctacttgggaggctgaggcagaagaattatttgaatccaggaggcagaggttgcagtgagctgagatcgcgccactgcactccatcctgggcaacagagtgagactgtctccccccctacaaaaaaaaaaagagaaaaagaaggctctcaatattgcccaacaaccatacttcatgtttccctagtttattcactctcctcccttactggatgagtattttctgcctttttctttcttcttatgcctctaatactttcccttctcaccctcagttggtctcgcttcctatctcactaagagaaaataaaagcagtcagaagagaactcccagtctcccattgcctcacatatcctcccccctgcatctgtgcctgatgttctgcttcttcctgctgtgagtgaaccatccacactcttagggagaccaagccttccatttgtgcgctgcattccattttctttggcctactgaaggacatccatctctgctagatgtttcgtatcagcatataaacatgccacaactgcatttctctcttcccagtctctctctctctctctcttttgttttgggtttttttgttttgttgtttttttgttttttttgtttttggttttgagaatgagtctcactgagtcactcaggctggaatgcagtggcgtgacctcggctcactgcaacctcctcctcccgggttcaagtgattctcccacctcaacctctcaagtagctgggattacaggtgcatgccaccacacccagcttatttttatatttttaatagagacagggtttcacaatgttggccgggctggtctcgaactccta

SEQ ID NO: 4400 - DNA, 1098 bp, Homo sapiens
cagacctgagcataatcctggctctgtcaatagctcgctgggtgatgttgagcaaatcattttccctctctcagtctctcattttcccaaggaggttggaccagatgatccctgaaattcccttccattttgaagtgacaagcttatggggagaagaaaagcagcaagataatcttagaaattgggagaatatgttatgaaatagaatgcacctcccattacttacttttctttttcttctgtcttttagaggtcattttcttctgaggaagtcattcttaaggactgttctgtccccaaccccagctggaacaaggacctaagactgctctttgaccagtttatgaagaaatgtgaagacggctcctggaaacgtttgccttcatataaacgtacacctactgaatggattcaagacttcaaaacccattttcttggtagaaacagccactttcccattaatatatctgagcatcaaatataaagctaagaacagattgaagtactagttactacctgaaaaaaagaaagaatataatgcaggattatggttctatagtcaccaattttatagaccagaaatcacaataaattttgcagattggagagcataaagcctattgtcaagaataagactgctcccaccctggcattcttatcaccattagcaagagtgaagaaagggccccagagagcttccaccctcctacaacctcatcacctctccgtcttgaggctgtcatctaatctcatttcaccctttatcccatatctggttatatcaccctaagaagcttagaacactcaggttatacccacatctcccagtatctaaatccccagggcaacccacccaacacccaaaacacacacatagcaattcctatccttctgtgtttttttactaatatacttttttagcattataattttatagaaaaattagcctaaagtacagagagttcccatataccctttatcccctccccacccctaatttctcctattattaacatctcacattactgtggtgtatttgttacaattgatgagccaatattaatatattattcttaattaaggtccatagtttgtttt

SEQ ID NO: 4401 - DNA, 1027 bp, Homo sapiens
acaagacagctccaggcactcagcatcccaatacggtcaggacaccattcgtggacacccggggtcaagcagaggaggaaggcaggggtaccaccacgagcattcggtagatagctctggacactcagggtcccatcacagccacaccacatcccagggaaggtctgatgcctcccgtgggcagtcaggatccagaagtgcaagcagaacaacacgtaatgaggaacaatcaggagacagctccaggcactcagtgtcacgtcaccatgaagcttccactcatgccgacatctctagacactcacaggcagtccagggacaatcagaggggtccaggagaagcaggcgccagggatccagtgtgagccaggacagtgacagtgagggacattcagaagactctgagaggtggtctgggtctgcttccagaaaccatcgtggatctgttcaggagcagtcaaggcacggctccagacaccccaggtcccatcacgaagacagagccggtcacgggcactctgcagaccgctccagacaatcaggcactcgtcacgcagagacttcctctggtggacaggctgcatcatcccatgaacaggcaagatcaagtccaggagagagacacggatcccgccaccagcagtcagcagacagctccagacactcaggcattccgcgtggacaagcttcatctgcagtcagagacagtagacactgggggtccagtggtagtcaggccagtgatagtgagggacattcagaagagtcagacacacagtcagtgtcaggccatggacaggctgggccccatcagcagagccaccaagagtccgcacgtgaccggtcagggggaaggtctggacgttcagggtctttcctctaccaggtgagcactcatgaacagtctgagtctgcccatgggcggaccaggaccagcactggacgaagacaaggatcccaccacgagcaggcacgagacagctccaggcactcagcgtcccaagagggtcaggacaccattcgtgga

SEQ ID NO: 4402 - DNA, 1051 bp, Homo sapiens
ggcaggtgaatcgcttgaacctgggaggcggaggttgcagtgagccgagatcgtgccactgccctccagcctgggtgacagagccagactgtgtctccaaaaaaaaaaaaaaaaaaaaaagattatttcttcctctggttttatagttgagaagctgatgtctcctcgacttccaactggaaccttgaacccccacatttctggaccttgagcattcctcaagtaggaagatgtaatgcaccttgacctctttctaaataagacacttccccaaataaggggagttgagagtgaacagtcttcacgtctccacccacttccagatcccagaggagacagacatcggatggctggtgagagagaagcctttaatgaaagatgagttgcaggcttggaccgctactcttgcgcccttggtgggggtgggggtggggtgggcaagggtggggttatggagagggataagtggggtgaggtggaagcagggggaagaggcaggtctgggagggtggagaggaagggcgctgcccaatgtggctgtctgctcaactgttctcccagaagaaattgttacaggccactgtgagagcagccacaagcaccacatactcctggaagtccacctccccgtctccattctcgtctagctccttcatcaccttgtccacagcatccacatccttctgggcctgtggtgggaggagaggaagagggaggtgtatagggaagggtacagcactgagtcagaggcaagggggtggttgaggagcaggaggcaaagatgagcgagaggaactgcattgaattatgggactcttctaggcctcctcaaaggtcttgagggcttctgttgcctacagcataagctctttcacctggcagaatgaataataatgacaccagttaccgtatgttcagtgcctataataaagcaagcactacactaggagctttacaagcactgtctaatttaattctaatacaaataatgtgaggtatgtttcattatttccattctagagaagaaacaaattggtaatcggtggttaaa

SEQ ID NO: 4403 - DNA, 1441 bp, Homo sapiens
ggaaaatgcttctcagtccacgtgagtccctctctaaccatttggattaagataaactttttaactgcagtgaatagcaggatacccccatacttcctctgacagaactattttgcctgtgacctcgtgtctggatttttatttttaccttaaggaagcaaattaagatttagagaaagcagagaatgtatagttctggaaatagcatagtcagcttcaattctaccttaggcatggaaatacatgatcgtattgattttaatgtttgggtcactattactttcagagttaaagttctcatcagactactgaaggacttgaggattcgttttcctggctttgagcccctcacaccctggatccttgacctactagtaagtaaagatgggcaattggagttcctcatcatccttatttactagtagtagtagtagtagtagtagtagtagtagtagtagtaactctgaaattcaccagagtctgaaatttggtgaagcttaaaagaaattttattggtagacaagtaatccaataaaaattcaacatttacatgactcagagacatttgtttaaaaaaaaagaaaaaattcaaagtttttttttttttttgtatattcaatgaaatgagtagttactgagttatagtgtcccgttttcttctcatgactgctaccatttaatcatggtagtagagagaaatgagtgagcagccatttcagaattgcttctgaacatgaaaattttggctagacttagaccttaatgaccagttttcctcgtgatcatttaaggttttagtttgatgcctgtaatcccagcactttgggaggctgaggccagaggatcacttgaagccaggagtttgagaccagcctgggcaaaatagcgagactctgtctctacaagagaaaaaaaaaaaaattagccagttgtagtggcttgaacttatagtcctagcttctcaggaggctgagtcaggagggttgcttgagcccaggagttcgcggttacagtgaactatgattgcgccactgcactccagcctggatgacaaagtgaggccctgtctctaaaaaataaagttctagttatcagaagtgccattttgatggcacacctactggatttattatttttcagggccattatgctgtgatgaacaaccccaccagacagcctttggccctaaacgttgcatacaggtacagcatgctttgggtttagggttggttgtaaactattttgtgcattcctttaatacctcatacctccctgtgttctaggcgctgcttgcagattctggctgcaggactgttcctgccaggttcagtgggtatcactgacccctgtgagagtggcaactttagagtacacacagtcatgaccctagaacagcaggtattgggacagatatgaactgagttgttttgccccactcttt

SEQ ID NO: 4404 - DNA, 1088 bp, Homo sapiens
gcagtaaaaacaagtgtagaattttctgtttttaacctttttctgtcgtagtaatagaaaaaacaatctctcctgtatattatcttcggcaaatagaatgtagttgtttacttctggtttagtgtgaaatggcctttccccgggtcaagccagcacctgatgaaacttccttcagtgaggccttgctgaagaggaatcaggacctggctcccaattctgctgaacaggtatgttcttttggctgtcttccagaaatgtctctaaagcagttaaaagtattggtaaagagtaactgttggtaaggttaagaatggtgttaacagagcctgaaatccacaaagggtttaattgttctccttatttctcattgtgggtggagatagccaggtggatatataaacaaattacatatgcattcttatttttactggggacaaagagttgttctcttcccatatattcaaggccagaatgaagtgtttttaaagccctatgtcagtattgagtcagcttgtatggaagggattaggagaaaatattcaaattctgagaaattgcttataatttttcattttcaagtattgtttcatactgtttttcaggcatctatcctttctctggtgacaaaaataaacaatgtgattgataatctgattgtggctccagggacatttgaagtggtgagtttttgatgatttagttttaggaaagggcagctttggtagtgtggaaattgccttggctcttgacttttaattttcagttgtctattatccaaagccaagcctaaaatgagaaagtacagtggaatttctttgtagtactgatcttggggacaagacttgtatcattgttatgctagctgtgatgtatcaggctttcatgtggtggttttgggggtgatttcacctctgctacttcttaatttgggtaacaggtagctgtgttgtaacagttctgggaggacctaggcacctttttttcttctaaattgtttttccccgaaatcctttttccaacagcaaattgaagaagttcgacaggtgggatcctataaaaaggggacaatgactacaggacacaatgtg

SEQ ID NO: 4405 - DNA, 1097 bp, Homo sapiens
aaagaacctagtcttatgggcctttgagggtggattgtcaggggatgatagaaaggattttaataagtcatcctgaggaaatttcacctagtgagagccacatccatctgcacagccttaggctgcgtgaaccgaggtgaggctgagctcctgtgaaagccaagacctcctggtccaggactttgtagagtaaaaagaaccaccaacacaaaaggggttgagggggctacaatctggagacctggggtctcctactaacttgctatatgatctttggtagagttaattttctgagtatcaattttcttatctgtgaagtgaagagggggatcatctggccaccaagtttaaaattctatacttctcacctgccaaaaccaaaaaacaacttgaggtgaggaaagtgttgggcccagaaaccagggaggaactgaaagtgactcgcgttgaagtggttatgtgtatgacaatgctcttggagaactgccagtcctctatggttacccttgatttgggagaggcagcagagtcatgtccagggcatcagaccagtgacatctttgcctttatgcctctagtcatctgagggcggggactaggcctcaagccccatctcacagccaaccacagagcccttaagggtggttgacaattgaatgccccaggttggtgctttagttatttactccctttgtgagctacaggatgtgtaacttttcccccatcttggtgataaaataggagagcgcagacacagcccacattttgtctcctttcctcagatttcatctgaaccccgctaaaggcagctgtttcacagtctgtctccttcaggggcccaatttccccacagcctgggctgagtactcctactctcttctttaggttctgggctgataaagcctggagagggtacagggtgatgggtgaagccctggtgaaggtgaaaggatagattggggttggggggtggggagcagggaggtgggatggggaatggccttccctgaatagggtgggtgggaggggaacaagacccttttgcacaactctctttaagtttcctttatttcttttttaactcattctgattttct

SEQ ID NO: 4406 - DNA, 1050 bp, Homo sapiens
cagttacatagaagctgcttcttgactagtatagctcggtgaccctttgttcaaccgctgaggtttgatttcttaccctttcttctccccattttcatactcttcccagggattagtgatggaggtgaggtctccctaatcatggtaaagtgttaaccttccacctcctcccttccctcctccttcctcatccttctgtcttcctcaattctccgtctcttttttttcatcactgattgccttgtgtccctccaagtctacttgttactatccatctccaggctctgggccgtgtagacactaaacctcatgccctaaggacaggaggaaagaccctctgtttggagcattattagtagagtgaggatcccaccagttctgcctggcttcctccatccccagaggcactaaaagcagtattttaaggttggtgtcttactccctggaagcctgaaatgggtggaatagcggtaaggcttgagtaaaactaggggacagaggttcttatttgtcgattttattttataatttgaccacagcatctgaactccctctctccctggaataagtatttttcccacatttttggatatatgtatggtagacaatttttttttaagacacagagataaatgttttcctgctttggttacctttcctttcccctttaaaaggaattagctatagaactgctttgtaaagatgcttcttgatattttacttttgttccttttccctaatcattcccttttctccccactcctccagaaggcataacccttctctccacaccccctacccccacccccgtcctaggctcccatcctttccatcaagaccttcattagcttatgatatttgctgccgagatgttataacaaggactcgttcatgtatataagctatttcttgatccatttaaaaggaattgtacattgtgtagaaaaaaaaaaaaacctgaaaaagagaaaaaaaagccctagccatggatattgtgaaactgtgttatgtcattttgtaatgtgcccgtttgtgtatgatccgtgcaaa

SEQ ID NO: 4407 - DNA, 1052 bp, Homo sapiens
tgccaccacacctggccaatttttgtgtttttcttagagacggggtttcacaatgttggtcaggctggtctcgaactcctgacctcaggtgatccacctgcctcggcttcccaaagtgctgtggttacaggcatgagccactgtgcccggcgcaagcaattcttttgtctcagcttccaaagtagctggaattacagatgtgtgccatcacacctagctaattatttctgtttttagtagagatagggttttgctatgtgggccaggctggtctcaaactcctggcctcaagtgatctgcctgcctcagcctcccaaagtgttgggatcacaggtgtgagccaccatgcctggcctggaacttctgtttttaatgtgagtgtttttgcaacattgtactgaattactgtgtttagtcttctgtgaatgcttacagttgagaaacacacacttacatagataactaagaaagaccttataaaaagctgtaaaccaatactaaaccatactatagagtattaacaacatacagtctagactaactgaagttattaaacttgaatttctaaacaggtagacttctgggaaagcctgccagtaaagtgcccagaggagtcagtattagctataaatagatcacaaagtgaataattcagacactgataactatttaaaactataaatgtatatgacagggataagtacagtctttggtaaggagatattaagaagcaaaagtattggttgagttagagtcctttgactttgaattgacacagtattttcttctcagtgtgatacagtagaaaatcaggaaacatcccagctttatcagttagaagctacctttgttgttgttgttgttgtttgagactgagtcttgttctgttacccaggctggagtgcactggcacaatttcggctcactgcaacctctacttcccaggttcaagcgattctcctgcctcagcctcctgagtagctgggattacaggcgcgtgccaccacgcccgcctaatttttttgtatttttagtaaagacgggttttcact

SEQ ID NO: 4408 - DNA, 1044 bp, Homo sapiens
cagtagaaggatgagtaactttcatgtttccactgtagtttttcttgtctagagaatgcttccagcttctctagagaaggggtagatagttttctatctaaccctataggattagatagtttataccaaaaaaagccaaggacttcccagccactaatcagggtttacaatgatggtagatttatcccatagaccattaaatgaaattaccaagtctggctgtgttcctgtgtttctacttagctatgtattataggcagtgttttcccttttgcattttgtgctgtattatacacagcgtacaacctgtgattagttcttttcctcttcttcccctccagggtcacagtgtcatccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccggtaagagagagctgagccctaatgtggaaacagagaaatccctttgtttgctttgcttgtcgaaagggccataggttttaagtttttatacatagataaactctaggacaaaaatggttattttggtagggatttaattgagagcagtcccaaaagtagaagctttgaggaattatattaaaatagtagtggaggagagaggttatacagcagagcagcagtaagctaaaaatctgcctagaagagagtgatctagggaataagaagcacaaggatgtgtgacagaaagcaaaatcttatttctgtctcttttttgtttgtttgtttgtttgttttttgagctggaatctcactgtgttgcccaggctagagtgcagtggcatgatcttggctcactgcaacctctgcctcctgggttcaaggaatttccagctaattttgtgtatttttcgtagagacagagtttgaccatgttggccaggctggtctcaaactcctcacctcaagtgatctgcctacctcggcctcccaa

SEQ ID NO: 4409 - DNA, 1033 bp, Homo sapiens
acccggccccccttggatttttttaattcagcatagaagttttcttaacttttgttggaaatagcttattttttccctttcttgtctagtgagccagagcgaggaaggctaactccctcaccagacatcattgttttgtctgacaatgaggcttccagtccccgttccagttccagaatggaagaaagactcaaagcagccaacttagagatgtttaaggtaaaaagaaagaaaaatttctttcttcttgttatgctccttctattttatttaattcctcaagagatttagttctgttttttgactatttactctttggatataaatacccattgatgaaaactttatagtaactcttgacttcaagggctttcaaaaggaactattagaagcaagtggagacgacagtttgaaaagcatatatgtaggccattatactcagtgttatttatctttggaaaatgaaaacaaaagttcataattaagtcatataaagtaaactcttggctgtaaggatactttctgcactctaacctaagtaactgaatatgaagggattcctaagtttttatgtatatctagaggaaatgtggctttaagagatttaggaacattattttaaaagaagacaatgtttctctttagtcattcttctttttgccaggaatctggctgattagcatttatacgtggtctgtcctttaattctgtaagcatttctttgagtacctactgaatgccaggcactgtgccagactccagtgatacaaagataatcctattgccacttctgcttcttgtggaagatgaaggtttcagagctaagaagtaaagattgtctcttgcaggaaggaattctgggtaccttgctgccatagctgaaagtcttcttgtttccttaggggaaaggcattgaggagcggcagcagcttatcaagcagctgagggatgagctacgattggaagaagcccgactggtcctgttaaagaaactgagacagagtcagctacagaaagagaatgtggtccagaa

SEQ ID NO: 4410 - DNA, 1085 bp, Homo sapiens
aatacaaaaaattagctgggcgtggtggtgggcgtttgtaatcccagctgcacggaaggctgaggcaggagaatggcatgaacccaggaggtggaggttgcagtgaactgaggttgtgccactgcactccagactgggcaacagagtgagactctgtctcaaaaacaaacaaaaaacaaccaaaaaaaaacataaaaaaaaagagagagagacagggtcttactgtgttgcccaggccagtctcaaactcctgggctcaagtgatcctcccacgttggcctcgaaagcactggaattacttttgtgagccaccatgcttggcctgaaatatattaatatttcttttttcttttttttttttttttttttggagactgagttttgctctcgttgcccaggctggagcgcagtggcatgatcttggctcactgccacctccccctcccaggttcaggctattctcctgcctcaccctcccatgtagctgggattacgggcatgtgctgccaagcctaattttgtatttttagtagagacggggtttcaccatgttggtcagactggtctcgaactcttgaccttaggtgatccacctgcctcggcttcccaaagtgctgggattacaggcgtgagcccccatgcccagcaatatttcttacatagtaagacttgaaagttaaaattactccttgattcatggtctgtagagtggatgtgttagccacatgaaaacaacattaatctccttgttcatctccatcagagctcttggtgactgggtgcattgtcaatgagcagtaatattttgaaagggatcttttttctgagcagtagatctcagccatgagcttaaaatattcagtaaaccatactgtaaacagatgtgctgtcatccagacgtcgttgttccattgagagagtgcaggcagagtagatttagcctaattcttaccttttttctaagtgatggagtcttgctatgttgtccaggctggagtgcagtggctattcacaggtgcaatcatagtgctctacagcctcaaaatcctgagctcaggcaactctgctgccttagcctcccacat

SEQ ID NO: 4411 - DNA, 1029 bp, Homo sapiens
tggatggatagatgtgcagatacatgaatacacagtacttgcttcttaagatgtctggctctgagaagggtgttgtactgtgtaatagattttggaaatgagctagacctgtgttgtaattccagatttactttctaaagctttgcagttgggatacatctcttcccacctgtgaagtagaaacaatactacctacttagtagcttgttgaaaagatttaagtaagtttcttctccaactggaatggagaaaaaaaatatataagtaagaatacgtgataaagtgtccaatagcatgtttggatttaagtgggtggttaagaaatagtatttgttattattaggatcacagaagaaacaaaaaaagattggttaggcattaaaaggcaatatgcaacattcattttacaaaattttcttttttttgcagaggaatatttatgtgataagttttcagtgaatattatttttacagttttataataggggacataatttaactgtagaatttttttttagtatatttacaaagttgtgcaaccatcacaacagtctgttttagaagaacatttccgatcaccctaaaaagatcacgtgtacccttccgtaatcagttatgttggattttgtttttgcaattttgttgtggtaaaatatatgtaacatgaaatttaccatcttaaccatttgtaagtatataattcagtggatttaagtacattcacattgttttgcaaccatcaccactatctacttgcagaactttttcttcatcccagagactctgttcccattaaacaatcacccctcactccccacccctaccttagctggaaacctctattctactgtgtttttttttttgtttgttttgtttttggggttttttgtttgtttttgttgttgttgtttttgagataagggcatcttactctgttgcctaggctagtcttcaactcctgacactcaagcattcctcccacaccagcctcccaagtagctagaattataggcacttgccaccatgctc

SEQ ID NO: 4412 - DNA, 1051 bp, Homo sapiens
gagtgaggctgcagtaagctatgattttaccagtgcgcttcaggctgggtgatagagggagactccatctcaaaaagatgtggtcttttttacttatctacagaagtgtgtctagtttctcagctgtaagcattcagaggtcagggactaaatacaataattaagtacaatgttgcaaaaatactgacattaaaaatagaagttccaggccaggcacagtaggtcagacctgtaatcccagcactttgggaggctgaggcaggcggatcacttgaggccaggagttcaagaccagcctggccaacatggcgaaaccctgtctccactaaaaatacaaaaactagccaggtgtggtggtgcacgtctgtaggctcagttacttgggaggctgaggcacaagaatcacttaaaaccaggaagcagaggttgcagtgagccaggagattgtgccatcgcactccaacctgggtgacagagcaatactccgtcaaaataaaataaaatagctttgactgtatgtaacacactaatcatgactaattcgttggaactaaaaatgagataggactgaaataaaaaataagaatttaatagaaggcataaaagagcaagaagggccaggtgcggtggctcacgcctgtaatcccagcacttggggaggccgcagcaggtggatcacgaggtcagaagttcgagaccagcctggccaacctggtgaaaccccgtctctactaaaaatacaaaaattagccaggagtggtggcggatgcctgtaatcccagctactcgggaggctgaggcagagaattgcttgaacccaggaggcggagattgcagtgagccgagatcgcgcgactgcattccagcctgggcgacagagtgagactccatctcaaaaaaaaaaaaaaaaaaaaaagaacgcaaagaacaagaaggggttggacacggtggctaatgcctgtaatcctagcactttaggaggctgagatgggaggatcacttgaggccaggagttcgagtccagcgtggccaatatggtgaaaccccatct

SEQ ID NO: 4413 - DNA, 1048 bp, Homo sapiens
cataaaagtggccaagtatatgaaaaattgctcaacattgctaatcatcagagaagtacacatcaaaaccacaatgaaatatcatcacttcacacctgtcaatgtcaagatggctattttttttaagtggcaagggagtgaagaaattggaacccttgcacactgttggtgggaatgcaaaatggtacaagcggccactatggaaaacagtatggaggttccttgacatattaaatatagaactaccagatggtctagcaatcatgcttctagatatttatccaaaataaaatcaggatcccaaagagtgacaacatggatgaagcttgaggacattatgctaagggaaataatacagtcacagaaagataaataactatgtgagtctacttatgtgaggtatctagtcagattcataggttgacagagtcaaatggtggttgccaaaggctgagggggaggagaaattggggagttgctaaacaatgtatgtaaaattaatgtcaaacgggaaaaagctctagagatctgccatacaacactgtacctatagtcaacattaatgtattgtacacttgaaaatttgttaagagggtagatcttgtgttaagtgtttttaccacaataaaacaaaaaaaaacttttttttttttgaggtggagtcttgctctgtcacccaggctgtagtgtagtggcgcgttcccggctcactgcaacctccgcctcctaggttcaagcgattctcctgccgcagcctcctgagtagctgagattataggcgcacaccaccacgcctggctaatttttgtttatttagtagagacgaagtttcactatgttggccaggctggtctcaaactccttcacctcaagcaatccgcctgcgtaggcctcccaaagtgctgggattacaggtgtgagccaccgcacctggccaacaaacaattttttaaaaattaagtatgggcttattaggctgagcgcagtggctcacacctgtaatcccagcattttgggaggctgatgtgggcggatcacttgaggtcag

SEQ ID NO: 4414 - DNA, 1033 bp, Homo sapiens
agccaccgtgcctggcctaaaggcttcgttttaatgtccatgagccttaggcctgtatggaacagagttagaaatgcaaatctctatataaagcagggagccttgaaggttcatactcaagagaaaggaagggaccacagaaaattccatctactagtttgaggaaacaaggaaacttctgtgtctcagcttgggctctggctgggggtagatgggaatgtctcctgaaaatttatgtttggactcaagaatatacaataaggaaaggatcaatagggcaaggatagtccctccaacaaatgttgttgggaaaagtggatatccacagcaaaataatgaaattatcttgtactgtacacaaaaatcaacccaaaatggattaaagagttaaacataagacctgaaactataaaactcataagaagaaaacagggaaaaagcattatgacattggtcttggcaatgatttcgtggatatgacatcaaaaacacaggcaacaaaagcaagtggaactgcatcaacctaaaaagcttctgcacagcaaacagcagaatggaaaggcaatctacaaaatgtgaggaaatgtttgtgaaccatatatttgataaggggttaatctccaacatatgtaaggaactcatacaactcagtagcaaaaaatatatgtatattaaaaaataggcgcttcactgccgtccgttgatttatttctccaggaagaaaaatggcatctgttgcagttgatccacaactgagtgtgatgactcgggtggtcaacctgcccttgatgagctccacatatgaccccatgtcctcagcccatgtcagtacaaaggaccagtgtcctacttgaagtctgtgtgtgagatggcagggaagggtgtgaagaccatcacctcggtggccatgaccagtgtgctctgcccatcatccagaagctagagctgcaaattgcagttgccaatatccgtgtctgtaaggggctagacaggattgaggagagactgcctattctgaatcagccatcaactc

SEQ ID NO: 4415 - DNA, 1029 bp, Homo sapiens
agcctgggcaacatggcaaaaacccatctttacaaaaaatacaaaaattagctgggcgtggtgatgcgcacctgtagtcccagctactcccagtcccagaggctgaggtgggagaatcgcttgagctgcaggaggcagaggttgcagtgagccgagatcatgccactgtactccagcccaggtgacagagccagaccctgtgtaaaaaaaaaatatataaaataagtaggagccatactcataccttgaatttagcctaattagacccattttagacttaatgactttctgaatgaaaggtaatacaatttgtattgtgtttaagccactaaatttgtggtaatttattatagcagccatagaaaactaatagtaggctgggctcacgcccgtaatcccagcactttgggagggggaaggtgggtggatcactagaggtcaggagtttgagacctgcctggccaacataggaaaaccctgtctctactaaaaatacaaaaattagccgggcgtggggacacctgtctgtaatcccagctactcgggaggctgaggtgagagaatcacttgagcccaggaggcagaagttacagtgagctgagatcttgcactccagtctgggcaacagagcaagactctgtctcaaaaacaacaacaacaaaaaaaaaaaacaaaaagaaagctaatgctacagttacgtttcaaaaaaatacggacaatctcctattcaaccacaataccattataaccaacaagattaataataattccctaatattatttaatacttagtccatttgaaaatttacccagttccccatagtatcttttgtagctgtgtttaaaccaagattcaatcaaagattatacattatatttgattatgtctgtaagtctctcttaacctagaacagtctgtatcaccacctctttttttttatatcaacttttttgaagagaccgtgctcattgatttgaaatatgttccacattgtagatttgtcagattgtttccatgttaattgtctc

SEQ ID NO: 4416 - DNA, 1046 bp, Homo sapiens
ccctaccctaacaccactctctgaccccttttcatgtctaatttttttaatgatacttacaaatacataacatacatatatacccacatacatatgcaatttgattgtttctcttttcttttttggagatagggtcttgccttgtcacctaggctggagtgtagtgatacagtcatggctcacttcagcctttacatagacccaagtgatcctcacgcctcagcctcctgagtagccggggctttgtttatgagacatggtctcgctctgttccccaggctggaatgcaatggcatgatctcggctcactgcagccttgacctcctgagctcaagcgatcctcccacctcagcctcctgggtagctgggaccgcaggtgcatgccaccatcctgggctaatttttctattttttgtagagatggggctttgccatgttgcctaggctggtcttgaactcgtgttttttgtagacatggggttttgccatgttgcccaggctgatcttgaactcttgcccaccttggcctcccaaagtgctgggattacaggtgtaagccaccatgcccccagcctgatttctggatttttaactcaataaagggaatgatgatgtctttattataaatatggactataagaagagaaataagttagattggaaggaaggatatcccgtcactctcccataactcaccaggcagaagaaagaacaaccttataggaagggggaagaattcagaactatctagtttgagaccttgatcctattcttgaagtcagccacattttaacattcttgttactgggcctcttctctatttgagagcaattgcatctccagatttctccagttactatattatccttgaattcactgtcaaattatttgtatttcttacaatactaggtaggtgcttcaaaactgaatgatttcaaaagaatcttcacttgacctcttcaatgagatggaagttcttattgcttccagccttcagaaagaaggtcttgttggattatctaattcagagttttaaaaaacattac

SEQ ID NO: 4417 - DNA, 1087 bp, Homo sapiens
accaacctgggcctatttttacttttctgacaagttcttgaaggttataatatatatatttttaatggattagaagcaatttggaggcaggcgtccttctcagttaaagttctgagactccttgtatatggatccgtttctgttaatcttagattaccctttcttccgacttactctcagcttgaagtttgctgcctgaagtaactccacacactttctctcctctgcctagctcctctttttagagtatgtttgcaggagacagagacctttaaagccagttcattcaacaagaaatgttttgagtgcctgttatatactggttaggtgaaaaagttaagaaaatgggctgggccccgtggtttatgacttggaggccacgatgggaggatcacttaaggtcaggagttcaagagcagcctcagcaacatagcaagacctgtctctaccaaaaattagccatgtgtggtagcatgcacctgtagtaccagctacttgggaggctgagtccagaggatcacttgagtccaggagttggagattgcagtgaactatgattgtgccacggcactccagcctgggtgacagaaagagaccctgtctctcaaaaataattttttttaagtagataagaaaatgaattttaactaccagtggcagtgagtcgtgcctggaatcttaatgttttgggaggccaaggtgggaggatcacctgaagctgggagtttgagaccagcctgggcaacatagcaagacccaatctctgcaaaaaattttaaagttagctggttgaggtggcacgcacctgtagtcctagctcttcgggaagctaaggtgggaggattgcctaaccctaggagttcaaggttacaggaagttttgattgcaccactgcactccagcctaggtgacagagtgaggccctgtcttttggaagaaaaaggaaagaaaatagtttaactacataccattcatgacttctgggtgctcacagttttctaagggaaatggacaagtaattcagtaataagacacagaaaatgacatgtttccaaaattccttgacaggccgagtgcaagtggctca

SEQ ID NO: 4418 - DNA, 1032 bp, Homo sapiens
agcattgtgaaggatctctgttcaaaactctgctcccctagtgcctattattattacttccatggtataaaggataaaaagaattttttgtttttctttcatataaaaaatattcctaaggaaagcctacatccgttctactttgcatgaagaaaaacaggatttttaggccgggcgtggtggctcataacctgtaatcccagcactttgtgagatcgaggcaggtggatcacaaggtcaagagatcaaggccatcctggccaacatggtgaaaccttgtctctactaaaaatacaaaaaaattacccaggcattgtggcacgtgcctgtagtcccagctactcaggaggctgaggcaggagaattgcttgaacttgggaggcggaggttgcactgagccaagatcgcacagctgcactccagcctgaagacagagcgagactctgtcttggaaaaaaaaaagaaaaacagaatttttatagatgagtactggagaaggttggaaaaatgtagctaactcctattcctttatttaattatgtacttagattgcttactttcctgttgtttttttttttttcttatttctttcttttgagacggaggttcactgtcgtcacccaggctggagtgcattggtgtgatcttggctcactgcaacctccacctcctgggttcaagtgattctcctgcctcagcctcccaattagcttggattacaggcatgcaccaccacgcccagctaatttttgtatttttagaattttgcatttttagtagagacagttcaagaccattttgccaggctggtcttgaactcctgacctcaggtgatccacccgcctcggccccccaaactgttggggtcacaggcgtgagccaccgtgctcggccactttcctgtttttctttgtgaaagtttggagcagtcattcttacagtgcctagtaataaccaggagagagtagtaaaaatgcagattccttagccccacccaaataaatttaatgtcatgaaatagggcctgggaag

SEQ ID NO: 4419 - DNA, 1053 bp, Homo sapiens
ctgagcaatagcaccaaactagtagcaggcattgtgttctttattgtcatgcagtttaaatttgcagtaaaaaaaaaaaagtttcatttaagaatgttcttgatgaagcagtaaaaattaattttatttaatcttgaccttttagtacttggcttttgaatattttgtgtgataaaatgggaagtactcaaaaaacacttctgttatatattgaagtactgtggttgtctaaggaaaagtacttttacagttatttgggtttccagctaactagttgtcttcttcatagaacagcatttttacttgatgaaagaataaccaacaaagtacgttatttagacttgggtatttggcagatgctttcttgaaaattttcaaggaaaacaactatttttgcccagtgataaaattaaagcaaaaatgagaattttggaaagtttatatactccaccatgagacggtccacttcccagttagttttgtggggttttttttttttgatattatgtaatatgtcaaccttcgaaagagctgcatgacttagtgaactagaagttttcacatgaccaatatattatgtgacaaaatcagatttggtgagagatccactcaaagtataaagtagaccaatgtattttaatgtaataatacaaaagttcattgatagggtttcagagttcacatttgctgctaacctttagaaattactgggttgcttttttttttttttttttttggagacagagtcctctgtcacccaggttggagtgcagaggcgggatctcagctcactgcaacctctgcctcccgggttcaagtgattctcctgcctcagcttcccaaatagctgggattacaggcacacgctaccacacccagctactttttcatatgtttagtagagatggggtttcaccatgttgttcaggctggtctcgaactcttggcctcaagtgatccgcctaccgcagcctctcaaagtgctgggattacaggcatgagccaccgcgcctagcctaggttgctttttaaaaattaagttaaatttcacat

SEQ ID NO: 4420 - DNA, 1023 bp, Homo sapiens
ttctgccttagccccccaaagtgctgggattataggcatgggccaatgcaaagaacctttcactctaatactgcctgttcttcttttcttttttgaggcggagtctcgcctttcacccaggctggagtgaagtggcacgatcttggctcactgtaacctccacccgccgccctcccctcaccaggttcgagtgattctcctgcctcagcctcccgagtagctgaaattacaggcgcctgccaccatgcccagctaatttttgtatttttagtagagacggggtttcaccatgttggccaggctggtctcaaactcctgtcctcaggtgatctgcccgccttggcctcccaaagtattgggattataggcatgagccaccgccctgacctctcatatcaccttttctaaatgattgtctggcacatttgctttcgtgtatgtcagaacttctgtgctgatttgtaaggtgacagtaggagaaagctgtttacctcctgttcattacctctaggcagcacactctaacttgtcacatttaagcatagcgacctttacaatccttggtgcatattactgagcagtatgttacccactgcaaggtcatctaggctctttctttcaagaatgtgagccaaaggtttgtgtagtaaactcagtgatacagaaaagacactgtaagagcatgtaaacagtaatagtctttcataagaattactctcttaccagtctggttggatcggaaaccaaaaatgacaatatagatagcatagtacgatggttaaggacattgactcaggtaagacagtcctgtgttttaaccacgcccagccatttaaggactgtgaaatctttttttttttttttttttttttttttttttttgagacgaagtctcactgtgttgcccaggctggagtgtagtggcgcgatctcagctcactgcagtctccgcctcccgggttcaagcgattctcctgcctcagcctactgagtagctgggactacaggcatgcgccaccacac

SEQ ID NO: 4421 - DNA, 1028 bp, Homo sapiens
atattctgcattataaggtagtgtacctagtttttactttagccaaaattttgataaatacatcttcccaaatagtggtagacacttacttcacttgtcaatcaatcagtcattgattggtaactcccaagtgattgaaaactgacttcccttgttagactaaactgcctttttccagagaactcagcagtgcacattaggttgggtgtgattcccaatttgtgtatcagggattgggaaagcaaatggttttctttgtattagtgcttgattgcctggtgtgctatttctaaacatgtggagaggaatcctcatctccaaagaactgatgttttcttttgaccagttgagctattttctgtttaatgaagaaaaaatgtaactttttgaccatatgaatggggtttggctgttctgtgatctgatttgttgttgtaatagtaattttgaagcattgtggtctgatttctccaaatagactggaccgactcaaagcagacaggactataagaagtaggagaggactaacagctagataaacaaattttggcttgtattattggacaccagtgaataattttaagtgtaagttaaccatttagccatgtttcagcataatgttggctttttaaaaaaacagctatttttcggccagacgcagtggctcatgcctgtaatcccagtgctttgggaggctgaggtgggcggatcatgaggtcagaagattgagaccatcctcgctaacacagtgaaaccccgtctctactaaaaatacgaaaaaaaaaaaaattagccgggcgtgttggcaggcacctgtagtcccagctagtcgagaggctgaggtcccagctagtcgggaagctcagacaggagaatggcgtgaacccgggaggcagagcttgcactaagctgagatagcgccactgcactccagcctgggcgacagagcgagactccgtctcaaaaaaaaaaaaaaaaaaaaaaaggaaaactatttttcagcgtttgtaatggttctaatactgatc

SEQ ID NO: 4422 - DNA, 1749 bp, Homo sapiens
aactttcctcttgccagctgtttccttttatgttgtctccatctttctcattagtgtaattatgaggggggttaattgtgtgattgtcttgaaattccgataattggatggctcacaagtctaccaagtttgagtgaagtaaattctgaacttgcctgcccagagtgatttataaatatacatggtacattctttgttttgtgtgtttttttttttttttttttttttggagacggggtttcgctcttgttgcccaggctggagtgcaatggcacgatctcggttcaccagaacgtccgcctcctgggttcaagcaattctcctgcctcagcccaccgagtagctgggattacagggatgtgccaccacgccctgctaattttgtatttttagtagagataggttttttccatgttggtcaggcttgtctcgaactcccgacctcaggtgagccaccacacccggcctgatacattctatttttattcaataattagatctagttctagtatagcctgttgaacatagcaattcagtgaggtgattattaaagtggagggcaaattaaaagatttatggaagtcactgactgtatggctgtgataacttacattttagtcttaggttttctattattactcctcatggtttggggctcttaagtcagagattgagtagaacgtcactatatagagggtagctatatatttttttcttttttgcattgtttatgatttcagaggataaagataagagcaaccttcacaacagaagtgaaagatgagaagcttaatgtagagtaaaatgtctgaagctctaagtgaaactgttgataagctgggatttctactcttggaacgctagagaggaagagacacttagatacttagtaacagcaaaaagccaggccaaaaagtagaactcaagtgcttagaaactctgtggcaaaagagataaacgtgactactaaaactactttctctttcgtctgtggcacttagttgataacagttgttagcacatttagatgttcaagtttaatttttgttgtcagaaaagtatgaacatttgtgacttgcctaaaaagaacttggtccccctgcaaagatagagggaaggtacagatcggagtgaatgaaaataatcagcaatcaagtattaagaaatgaagtatttgcacacctcatcactgggaatcaatagcatgctgctgatacaggatgagaataagttagggatttaggactattctagttaggtactatcttgtagacactactagagatactttgtcttttggaagacagaaattattctgtaggtattaaatactaatataatgctccatatgattttcatggttttttttccaaggataggcagtggaatcccccagttgccttaggaaaatgtataccacccttacagaagagattggcctagacacatcttgtgctgtatgataaatgaaaaagttgatctgtttattttctctgttcctgtatgatgattaagtcattgagtagtgtatggcagtaattttttttttttttttgagatagagcctcactgtgttgcccaggctggagtgcagtggcgcgatctcagctcactgcaacctccgcctcccaggttcaagtgattctcctgccttaacctcctgattagctgggattacaggtgcctgccaccatgcccggctaatttttgtatttttagtagagacagggtttcaccatgttggccacg

SEQ ID NO: 4423 - DNA, 1034 bp, Homo sapiens
cctgcctcagcctcccgagtagctgggactacaggcgtctgccaccgccatgcctggctaatttttgtgtttttagtagatacggggcttcaccatgttggccaggatggtctcgatttcttgacctcatgatccgcccgcctcagcctcccaaagtgctaggattacaggcatgagccactgcacccggccataaactctgtccctaattttcattgtgcttatgtcttttagtaattatgttaaatctagccattccttttatttttaaattttagtcagtttttggataggtgatatatgcacatggtacagaatttacaattggaaaaagtttacagtaaaaaaggacatctctttctttggagacagaacttaatctacttcttttccctcccctcccccccccccatacttacctcctcttacccttcccctctcctttttccttccctttgcctctcccccccacctcttttttttttttttttttttttttaaacgagacagagtttcacttttgttgcccaggctggagtgcagtggcacgatctcagctcactacaaactctgcctcctgggctcaagcagttctcctgcctcaacctcccaagtagctgggatttacaggtgcccgccaccacacctagctaattttttatattttgagtagggatggggtttcaccatgctggccaggctggtcttgaactgctgacctcaagtgacccacccaccttggcctcccaaaatgctgggattactggcatgaaccaccactcccggctgccttcccttttttcttccctttcctttttttttcacctctttctttcctttcccttccctttttcctttcctttcttttccttttttatttgtgtgtttctttgaggcggaatctcgctgtcgcccaggctggagtgcaatggtgcgatctcagctcactgcaaactccgcctcccaggttcaagcagttctccttcctcagcctcctgagtagttgggattacaggtgcccaccaccacacctg

SEQ ID NO: 4424 - DNA, 1051 bp, Homo sapiens
gacctcaagtgatccacccaccttggcctcccaaagttctgggattacaggtgtaaaccaccacgcctggccagtttttatgatttttaaatgattgaaaaaaaatcaagagattattttgtgacatgtgaaaattacatgaaattcagatttcagtgtttataagtaaagttttattggaaataactatgctcattttttttcatattgtctttggttgttttcatgctgctacaatgtcagagttactagtcacaacaaagatgttaaggcctccaaaacctaaaatatttactatctggctaaagaaaaggcttgctgggcctggcttgatggcacacgcctgtagttgcaactacttgggagaggctaaggtggaagggttgattgaacccaagaggttgaggctgcagtgagctgtgatctcaccactgtactctagcctgggtgacagagcaagaccctgtctcaaaaaaataaagaaaaagaaaataagcttgccagtctgtgatgtaggtgaattctggtcccagattaatggtcatattactggatactcaagctattcttttcttttcttttttttttgagacggagtctctattgcccaggctggagtgcaatggcatgatctcggctcactgtaacctccgcctccctggttcaagtgattctcctgcctcaagcctcctgagtagctgggattacaggtgcgtgccaccacgtccagctaatttttgtatttttttaagtagagatggggtttcaccatattggccagatttgtctcgaattcctgacctcgtgatccgcctgcctcggcctcccaaagtgctgggattacaggcatgagccactcactgcgcccagtaaaaaaaaagaaatttttaatagaatatatatatgacatttgcagctcattgttttagtgactgtataatatttcattgtatggatataccttaatttacctaatctgtccacttctgaggaacagttagggtgtttgcaatttgtgtatacgtgtgctatgataaccagccttccagtg

SEQ ID NO: 4425 - DNA, 1823 bp, Homo sapiens
accctctgtcttccagtttcaaatgattttcctgcgtcagccttccaagtagctgggattacagatgcctgccaccacgcccggctaatatttgtatttttagtagagactgaggtttcttcatgttggccagactggtctcgaactcctgacctcgtgatccacccgccttaccttcccgaagtgctgggattacaggcgtgagccaccgggcctggcatatctatttatttttaagacaaggtctcatgctgttgccaacgctggagtgcagtggtgcagtcacggctcactgcagccttcacttcccgaactcaggtgattgtaccactttaacctctcaagtagctgggaccacatgtgcgtgccaccatacctagctaattttttgtattttttgtagagaggggatttgccatattgcccatgctgattttcaactcctaggctcaagctgtctgcccgcctcagcctctcgaagtgctgggattacaggtgtgagccccacacttggccaatgttagaactttattgggaaagaatatttaggcatatggtaaagagtatttaggtatattgtaatatgtcctgttaacagaaattctgtacttttcctgttgcttacaattctgctatttaatgattttcatcgctattattttgttaacattgaacaatttgagtactactagtactcaaaagtactttaaagtatttaaacttagtttaggaatgctgattgcctagttcatgaagtcttattttataatttcatctgtaatcctgaatctcaaactatggcagaaaatccagggctctgagcaatgatatgagtttatttttccaatttctggagtgaagattccagatgcttttctctgtcttaggcctattgtctcgaaaaatgatagttaattgttctgatagagagaaaacttgggtctggtctcttgtcctgcttgtcagagctgcttactttgtaaccacttttttttttttttgagatggagtctcgctctgtcgcccaggctggagtgcagtggagcgatctcggttcactgcaagctccgcctcctggtttcactccattctcctgcctcagcctcccgagtagctgggaccacaggcgcccgccaccacgcccggctaatttttttgtatttttagtagagatcaggtttcaccgtgttagccaggatggtctcaatctcctgaccttgtgatccctctgcctcggcctccccaagtcctgggattataggcgtgagccaccgcggccggctgtaaccacttaaatctgctggttgtgggaaactgcaaaggcctccacataacatttcttgtatgcctactatgtaaagtagtatgtaaaagatataaacataggtacgttagaggatataaagataaattacaagaagatgcagtcagtagactaaagactacatgtattaaaagactgcagctgggcttggtggctcacacatgtaatcctaacactttgggaggctgaggtgggaggactgcttgagcccaggagttcgagaccagagtgggcaacaaagtgagaccccatttacaaaaaatataagaaaacttagcagggtatggtggtatgtgcctgtggtcccagctacacaggaggctgaggtaagagaatcccttgagcccgggaggttgaggctgcattgaggcatgtttgagccacttcactcgagcctgggtgacaagagtgagaccctgtctcaaaaaaaggaatacaataattataatactaggtataatatgtttgtaaattaagtaacttgcatattaggaacaag

SEQ ID NO: 4426 - DNA, 1029 bp, Homo sapiens
actcaacatttccaacatcatttcttccctgtgattcattgagtcatctaaaccagaaatgtgagcatcattgtcacttctgtcttacctattactttctaaatatttctgaatctagcttcttctgtgtctccattgctgttctcattcaacagctcttattttgggatattgccttgatcgcttacacatctgtttatagtcttactctctttttcttttttttttttttttcttgaggtggagtctcactctgtcactggagtgcagtggtgcaatcttagcttactgcaacctccacctcctgggttcaagtgattgttctgcttcagcctcctgagtagctgggattacaggtgtctgccactacacccagataatttttgtatttttagtggagacgaggtttcaccatgttgccccaggctggtctcaaactcctgacctcaagtgatccgcccacctgggcctcccaaagtactgggattacaggcgtgagccaccgcacccggctgtcttattctcttgtaaactctctatcatcgtgccttcaaaatagtctaacacttactgattattctactttcctcatcttaaaagtatttagtagtttccagttattaaaagattaaaatgtaaactttgagtggtattcaaggccctttatgttgttggtgtttgccttcctatccagccctacttctgtaccttatagttaatgtgtgagcaaatacagtggtttttcttttcttttttttttttttttttttatatagacaagttctggctctgttgcccaggctccatggagcacagtggcacgatctcggctcactgcaacctccacctcctgagttcaagtgatcctcttacctcagcctcctcagtagctgggtctataggcctgtgccactttgcccagctaatttttgaaatacagttctttttaattacaggtagcttctgaatctcataaagaatgccacttcttctgggaaaccttccctgacttgcccaaagagagttaga

SEQ ID NO: 4427 - DNA, 1599 bp, Homo sapiens
acaaggtagaaaagtactaatcagcaggaatcagaaggctgaatctataggctgagtgacccagtttgagtagaggtgaggcttacagacttttgtcctgcctattattccttacttgagaacactctccatgaggtgagagtgatttgtagttgacagcagcatccatctttatgacactgtggtttgccttccctgaccgtatgtgatgtgtgttaacttcctgtttagaggcagtcccagtagggtctgaatataggctgcactcaaatacttttctaggaacagtgttaaccaggttccctgatcagcccttcaaatctaaattctggcagtaacttttactgctgtgcttagcatagggccacagggtggtggcagagggaagtgtgaggaatttgttctgagcctcacaaccttaaagtactttcaaaagcttgtatgctgtcccccattttggggttttgcccccttctcccctttttttgccagacgggcaaggctggacctccaggttgaattttggggaccattgtgtcagtgaaggtatcctaatcatgtgttgagacctctgaattcatctcacctttaagcagtgagtcttgtgtgttgcatgtaaagcattcctcctgtttcaatttactgattcttcttcctttcctcccccacccaccaagctggaggtgcatgtggaggaaaacagcagctgtgctgtcctgatttctagactctggagcatattccatgttagccaccccattgggagtcatgctgacaagcagcccctctgcgcttaacttagaaggctcatgttgcttggctcattgagaaaagccaaccagctttggttgattaaaacaactgctagagaaatcgtaagatttgagccataactgggactgagggactttcttttccagacctttgcagtacttaaagccctgcattattacatatcaaggcacaatagccagacattttctgaggtagtttggagggaaagaaaaagtaaagacacacacccagattgactgtaaatctagtcctggcataaagctgtccacctcttgcttggggaaaaaatccagtctatcagacaataccacatagagttgcagttctcctgcttttggctaagcctaggaaaagatatataaggaagttcagtttatgttacaatgactggattttgtggtgtatcttctattagccatattatttggtttatcctcagtagtctctgtgaagctttttctgtaggtcctgtttggggattttggtggctccagaatccttgaagcagcaacctcctttctttgtgtagcagtgatgaaagcttctgaagaataggtctgatttgaaacagacccctcctcatgttccatcttttaccttctcccttgtggatatatgaaatattcctgtatagcttgaattcatccagtaagaagggagtgtcccagggtcattagggcttttaacctgtctgaggtatttagatggtggcttggtaatgtttgctgtctctcacaaaatcccccttacctttgccatttacctaggttgccatcagctggcaagaaactatcaacagttttg

SEQ ID NO: 4428 - DNA, 1044 bp, Homo sapiens
ggcgtgaacccaggaggcgaagcttgcagtgagctgagatcgcgccactgcactccagcctggacgacagagcgagactctgtctcaaaaaaaaaaaaaaaaaaagaaagagcatagactttggagtctgctgcacctggttcggatccttgccgtttcactttaccactctgagcctcaatttggtcatctgtaaaatggcataagcacctatctcactgggctggtgtgtggacaaccttgtgcagagcctggtacctaaacaaatgattcattcatatttgtctattcgttccaccagtattgagtgctttttatgttccaggcacggttttaggcactaggtatgtagcagattacaaaacagtccctgctctcaagagcttacattcttgtgggggataagaattcctttcccacttctctttggctgtgtcctgtaatggccctctgtctctttggcatcacctgtccgtttcttgtcctctgcctcccattcgttgagcctaactgtctccactatcttggctcccccaggccccatctccttggctaacccctgatccagcctctgttcaggtacggctgctgtgggatgtactgacccctgaccccaatagctgcccacctctctatgtgctctggagggtccacagtgagtctggtatttggcctgggtggggagggtgggtcccatacccagagggctcagtgattctggtggccttctttcctttcatccaggccagatcccccagcgggtggtatggccaggccctgtacctgcatcccttagtttggcactgttggagtcagtgctgcgccatgttggactcaatgaagtgcacaaggctgtggggctcctgctggaaactctagggcccccacccactggcctgcacctgcagaggtatggtgctaccatctgggtgatccctggtctgtccggggctccacaccccttttctctcactcatacacttctgcctccactaaaggggaatctaccgtgagatattattcctgacaatggctgctctgggc

SEQ ID NO: 4429 - DNA, 1059 bp, Homo sapiens
gagcagggcctgaaatccagtctaaacttactagttaggtcctggcaaagggctgtgtatgcccagggaggatttcttttctgatctgcacaaattatatgcataatggaggttctgttggctgataacaggtctcaaagtggggttcaggaaggaataaggttcttgagaacaagtgaaagagctgagaaaatgtggagggaggacagggatggacgggggagtatgctctgacctgtttctctgtcccccaggcacatctcccacttcattcacaacgttcccttcccttccccacagagaccccgcatcctagtgcaggtgagagctgaggctggggccgggctgatggaaggaggggagttggcatcattaccctgagccgtggctcttcttcccttccagatgtctccctatgacaacttgctcctctgtcagcctgtatcctcacccctgcccctcaggtatgtgatcagattgtggggaggggagctttaatgaccaaggacatggtaggtgctgggcaggtgggtgcagctgttgaggtttatgcaggctgggtccaggtggtggctgtgcctggcatctggggaagggtccccagggtatcctggtgaccctttccccacctcggcattgcctgcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcggtgagtgccgccccgcctggcccatcttccccagaaccatggttctttctggtgcccctatccctgcctggactcttcccttttccttccttgtggaggatcctcagcccctttccctgggcacagcctgcaggaacacatagcttccatcaggagctcttctctagagcctacttccaacagcctctctcaacaggcaccaactccccaaggccaatgccctctctttctctctcctgtgcctcccactgctgcctcaaccccctgt

SEQ ID NO: 4430 - DNA, 1084 bp, Homo sapiens
tgtgtgtgtgtgtgtccagaggccaggtgatgaagaaagccagcctggctctatgagattccttattccctgttctctgggggaacagcaggaggttagcaggactgcacatcctggaaccattctgagcctcctctgccttgctcaggatcctatagtctgagattccaacttggcgtaatgctgtgctggcaccttcaatggtaaccccaccaccgccaccgccaccacacacacccataggctgacttcctctgagttgcagcttcccctccactgtttcaggaagtaacctcccttcccctctgaagcaccccccacgcttctgggcccctgctgcgagctacccaccaggctttttcccagcttctgcaccctggggcgcctcaggacccttggggctcctactccccggggttgggccatggaggcaggtgagaactaggctgttgtgggcctgtttctgtctctgggctccatggtggagggtgtgggatggccgggacttgtctctcacaactgctttggatctaacgagctacctaaggatcctggaggtgtgagaacactggattttgggccagattggtggagttaagctaggagaaaggacacttgggttcgttgaaaagactcttaaagcttgggttttgtgggctttctcagaaacccatggggtcctcttaaaaacctaggagtgggctctttaagaacattggcaggatcacaaggttcttatggtgtcataactagagtaggaaggtcagaaacccttgaaaagactgtaaggttggtatgatgtcatggccagcatgaatgatgtcatggaaggctattacaaaaaagattgtgatctctgtgatgttataactggtgagcctttaaaagggacacatggacaatgtgaatgtcatagctcaggttagctgtgtgtggtggagtttaggttctttgaggggagtgccaggaccattaagtgggagggatctggtctctttaagaagctgtggtgggcagtgatgtcacagggggaagagttcaggattggccgaccccttatcctgcctttctttggaaggactag

SEQ ID NO: 4431 - DNA, 1043 bp, Homo sapiens
ctcttaaagatacaaaaattagctgggcatgatggcgggcacctgtaatcccagctacttgggaggctgaagcagaaaactgcttaaacccgggaggtggaggttgcagtgagccaaggtcacgccactgcactccagtctgggtgacagagcgagacaccatctcaaaaataataagaaagaagacgggatttggagccaaattacttgaacccaagtcccagctctactcctcagcactatgttattggccatattttctcatcagtaaaattggttaatactagctctgcttatccagagaataaattaaatgatctatttgagagggatttatgtactatacacacaatagaagcctggctctgatttcctcttgagtgtatcctggctaggctgaagtagaagggaaattagagggagaagctgtctggccttccttgggaataactattccttcctgccctcagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggtttccttcccttctgtaacttggagcaggaagtcatgggggcagagagggaaaggaggtggttacttaaggccccaatctaccaagtcttccccaccacttctcccttgttttccccctcttctactacttatttcaaacttctgggatacaatttcagctaaaacgtttatttctcactcaaaacttatttcccctcaaccctatacccaaagaagaaataaaatcacagatacataacagaagtattt

SEQ ID NO: 4432 - DNA, 1050 bp, Homo sapiens
aaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctggtaaggaggaggtaaggggagggaaaaggaggtcactggaggacaggatcgttcccggcctcggggctgggggagatcttatccatggacagcgcaggagggggtgccctattttctgggttttgacttttgtcccttcccccaactccgctacagccaagcagaggctcccgtgcaggaagagaagctgtcaggtgggtgattgtctgggaacccgacacgtcccgtcgtttgtttttggttttagtatcttccccatataccaagagcacaggtgg

SEQ ID NO: 4433 - DNA, 1079 bp, Homo sapiens
aaaacatgtagtgcatgaggatcttcctgtgctctttataatctgagattctgatgtttctattgtttgcaatgttcaaactccggtgagccatttcaagagggtattgttatgtgggcaaaacctagaaaagtggatggctgatggttaaggcttgctctttcattgactgaaagctgaaagtgttggttgggtgtgggagggagaggaaatggctgataagggccctaactccctcacccaggaagtgcagcaacacctacaacttcagtaggcaagccaaaggccctacaaaactgggtgatgtaatagctcacttctgtggctgagaaggcagctgctttatcagtctgcagcttctctgcaacaggagcaagtctcaaagagcgggtagaccttgaaatttacttctagttcttgtaacttctctcctttacccccattagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggagga

SEQ ID NO: 4434 - DNA, 1015 bp, Homo sapiens
ttattgcccaggctggagtgcaatggctcgatctcggctcaccgcaacctccacctactgagttcaagtgattctcctgcctgagcctcccaagtagctggaattacaggcatgtgccactacgcccagctaattttgtatttttagtagagacggggtttctccatgttggtcaggctggtcttgaactcccgacctcaggtgatctgcccgcctcagcctcccaaagtgctggggttataggcgtgagccactgtgcccagccataacaaaaaattttaaatgaaataattaaactaaggtgtgggagtagtaacatggaatttccatttgaggggcagacagagaggagtgggcttttaaaagtacagttctgagacccttggagtggagctgacgacacactcctcagggtgtcagtattgcttttgtcctatttctggcagaggtatgaaggttattgaaaaccgggccttaaaagatgaagaaaagatggaactccaggaaatccaactcaaagaagctaagcacattgcagaagaggcagataggaagtatgaagaggtaagtgaccttctgttagtccctctcgtatcggccttttacaaagcataatgcggtaaatggctcctttgcttcactaagctatactgggatcttttcctgtaggtggctcgtaagttggtgatcattgaaggagacttggaacgcacagaggaacgagctgagctggcagagtcgtgagtatctagctccccaaatcttgtcattaccaatttatcccttcccctttggcttgggcactaatatgaataaattagcattccttcaaccttgttaaacagggcctagggaatgggagtcatctatagtgcttttttaggcccaagaatggttttaggcttccttattctcctgactagtgacaagtgacaaaagaggctttcttattttttgttggtagggtttacaaattgagagcaaataaggactaatacatggtgaacagttaatt

SEQ ID NO: 4435 - DNA, 1635 bp, Homo sapiens
gggtttcaccatgttggccaggctggtctcgaactcctgacctcaaacaatccacctgcctgggcctcccaaagtgctgggattacaggcgtgagccaccgcgctcagcctcttgtatttctaagctactagatggggttttagtaactagtttacaaaataggacagataggacacaaataactatttgtgactattgctgcatttatggcctgggataagccctgatttctttgattagtcctcattctgtcaatgacctcccctctctgttcttcagggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcaggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtcctttatagttgtcttttaataaaacaggcatttgataatgttatctgcacatttctaacagggtatagggcatgaggatttgcctccagagaattggtgggactgtgtgcataccctggacctacgaccatacacatactccttgggaccctagcacaagaaatcctaaaatcaggactgtggcccttgctcatagatgcctgtgtcaccaacagaaggctgcagaacaaggattctctcaaggtttctggggcaacaggccaggtggccaatcaactcctaggcccagggttattgttggaggtgtaaatgttactatgactactgaaaccttggttactgaactaaacagaggagcctgtcagtctcctcagactgtatcaagcaaatctatagacatgtctgtggaaaa

SEQ ID NO: 4436 - DNA, 1050 bp, Homo sapiens
ttggctattcaggggtcccttggtctagttcagagcaatattccttttgcttaaaaattttttctaaattctcaaccattgctagtgaaagtataaattagtaaaaccactttggaaaataactggtcattgtctggtaagattgcacatgtacctaatccatggtccaacagtttctctcctaccatagagaaattaagttttgctcatgtgtaccaagaaacatgtgcaagattatttataggggcattgttcataatatttgaagaagaaacttaattcaaatgtccacttttcaattattatataggctgagtgcagtggctcatacctgtagtcctagcactttgggaggctgaggccagaagatcatgtgagcccaggagttacagactgcagtgagctatgattgcactgatgcactccagcatgggcaagagcaagaccttgtttctaaaaaataggtagtggtatattcatattctggaatagtgtaaaaaatgaaaaactgaagataaatatatgaagacaagtcctcaaaatacttctgaatgaaaaaaattgcaaacatgaatctcaaaaacatgctgagtgggccgggcatggtagctcatgccggtaatcccagcacttagggaggccgagttgggcagataacacttgaggtcaggagttcgagaccagaccagccaacatggtgaaacccaatctctactaaaaatacaagaaaaaaatcctaactactcgggacgctgaggtaggagaatcccttgaacccaggtggcagaggttgtagtaagctgagatcaaaccactgcactccagcctgggtgacagagcgagactctgtctcaccaaaaacaaaaaaaccatgctgagtgaagaaagccaaaatgccgttcacaagagaatatgtaccatgtgcttccaccccatttatatgaaattctagaacaggcagaactgtaaaagagtacatcatgttgcctgggctgggagaggggagatttccaggtgatgaaaatattctttactttgattgacgtggtg

SEQ ID NO: 4437 - DNA, 1081 bp, Homo sapiens
tactaagttgagcaggcactgtgcgctttggaacttggcttacctgctcagtgctgtggcaagcatgtggctcatcctggaacttctgtttttgtatctgcagaatgaagggcttgggtcgaagttcccaactgtttgtagtaaaatatttcccagctcatcttaaactacccagtgttttttgtttgattaggatggggttgagatcattaaggttaacccaagagcaatgagaagggttacctttacataattttagacttaagaggagctccataaatcatctaattccaccattcatgttaccaagaagcccaagaaaaggaggcagtttaccagaagacgtataggaagtgaataacccagtggtcttttatctttgtctgtactttctccttaggtgactgtcttcctttccttggctttagctacagatgaaattttatctctatcctagaactctttcctgagttccttacatatattgccaactgattacctgacatttccacttagatttgtagtagacatctcaaacccaacatttgtgaatcagaattattgctatcccactgccactctcattctgcttctttagtctttcgcttctaagtaaaagacacctgcttcccttaccaacccccttttgtgtggctctccccagatcactgggacccagctccactggctgaattttccaccctttttgctcctgtgatctggaatggtcttcaattggctagctcattcattcttttgatcttagcttaaatgttacttccaaaaaaggaatgcttattacctattttaaagtaggttccccctctctttattttcacatggtaccctgatttttccttcatagcatttaccataatttttatgtttgtccatttgtttaaaacatgcctctctcttccgctagaccgtaagcttcaagaatgcaggcaccatgccagttttgttcacgactataaagccaggacctacacatagtaggtactcagtaatttcttgttgaatgaaaaacaggttagtgccagggcctacacatagcaggtactctgtaatttgttgctga

SEQ ID NO: 4438 - DNA, 1496 bp, Homo sapiens
ggcttgccccctgaggtggcattggctggaagctcttgcagtcagcaacattggtacccatatccagaactccagtctaaaactggagagagaaaaatatcaaaggaataaagacagatttactgacctggaggaatagccagtgtagtagaggagacagggcacccatatccaaccactgaagacaggtgcagcgcggttcaaaccaaatactgggtaagttaatttcaaatggctttggagtccaacaaacctgtgtttgcatcctagctatcctaattgaggaattttatgtaatctcactaagctacagttttcttatctataaagtaggattataatacctactgcatatggttgtcttgagattaaatgaggtgttatatataaaatgcttcagatgatacatgataaatgctaaacaatctatctgatatattctctaaaaacatacagaatataaaatcatggttaggaatttgagctttagagctagacagaacttgactgaatcttagctctgctaagagctgtgactttgggcatgataattgacctcactagactcagcttccgcatctataaaatggataatgatagaataatgagtgatggtggtaagaatgaaatgagctagtatctgcggcacctaggacagaacctggcatgtaataaacactcagtagacattacctgctggtgtggtaattaggtatgtcctgccagaaatggggagatcactctgattacttttatttcctagcattagattaatatcccaggttctataaccgtgtaaggttcttgagactggcaaagggctgacgacatgaaatttactcctcccagatagtggacagccctctgggccacacccccaacatctggctgaggggctcaaccctacataggttctcctccttccctatgctcagtgagctagttgcttgctcacttagagcaggatgaataaggggctaattctgttcttgacctcttccatatatctctctggacatcctttctcatttccatctggcagtgcgtgcctctgcatacctgattcatgccttgcatttgtagcgaggagaggagatgtaatgattcaggtttctcctttaggcttggggccctgagaactcccgggtgcaatagtcacctggtgaaacatgagctttgagtcacagggtcaggcccaagtcatttctgctaggaattagggaagagtttctgctgccaagggagttttaggaacagttggagcagggtcagtccaggaaacaagagggctaagtccctgcctcgatctcagctgcagctctgctcgtttccgaagtccttgctgtagcttgagagctgaagatttagactgtggagggaatggggctggaaattgttctaaaaatggaaagcacgttgcgtttataagactgctagatggactgcttcactttaacttttggctcttcgccaaatgggactgggaaggtgatggt

SEQ ID NO: 4439 - DNA, 2425 bp, Homo sapiens
gacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacccggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaattcttagaaagttttaagtcctggtttcttgggggaggtgaaaatgggaacaaagggacctgtggccctggggtttctgataacagcaccagtggcatctgacatgaacctgtgggggacagggctgtccctcagcctttggaaaggagccatttcaaagaacctccctttgtgggtaaatttgcgtctgggtggggtggggttcatcaggcaccttttgattacgtacccagcagggcccttccccagcagagcccacgattgattgattgattgattgattgattgattgatttagagatggagtatcactctgtctctcaagctggagtgcagtggcgcgatctcggctcactgcaagctccgcctcccgggttcacgccattctcctgcctcagcctcccgagtagctgggactacaggcgcctgtcaccacgcctggctaatttttttgtatttttagtagagatgg

SEQ ID NO: 4440 - DNA, 1961 bp, Homo sapiens
gtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggtaaggggcctgccttgggatctggaactggtctgtccttcttgtgcccagatcccaaactgcatgctttattgccaggtgttttgtctcccttatcaaagtgagcatgattcactcctcagtaattgattgagtgtccagtctgctgtggtaggaagatcctggtagccccagtcagaaggtgcttcctaacaaggcagctgtttctctttcttgacaactatatcttgtacctccaaaatccccacatgcttctgcctcttaacagcatttggtgcaaacacaggtatatatgtttctcttttttgtactcaggttaccttttcagccaagggcatctgacccgtgctatttgctgtcgtgtgacaagagatgggagtgcatttgaggatggactacgacatccctttattgtcaaccaccccaaggtgctataacccccttctattttccctgacattttcctccttttcaagcagtcatgtaaacagaggaaaaatgtacactgtgggcaaggggaacattgcccacagtggtagcccacaagggaacattgcccacagtggcccaccaccaacattggttggtctcccaagaacttaaactttcttccttttggatgccaagggcttttcttctcttagtctggaattaatctgaatcgaggtggagttagtatgtctagagggtgctcagtcttagccaaacagaaccctaaatacaggggaaagatcatgaccccacacttcctctctcctatgagtcttgagtccctgcttcagaatcttattcctgaaaggtttccatctttctcccgttgcttctgggattcctaggttggcagagtcagcatatatgattccaaaaggcaatccgggaagactaaggagacaagcgtcaactggtgtctggctgatggctatgacctggagatcctggacggtaccagaggcactgtggatgggtaaggagacaggagagcgcagtgaggaccaagcctctgccctgacttgcaagggtgcatcatacctctgcagtctcagggcttgagagccgcctcccctcccacggtgtctccactgtgagctccttatcttacaggtcccaggtgaataatgagtgcttttgtttctctaggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctcta

SEQ ID NO: 4441 - DNA, 1015 bp, Homo sapiens
agttaccatggagccggtgctccactcctaggtatatgctgcagagagatggagatctgtgtccacacggaaactaatatgtgaatgttcatggcagcattactcacaagagccaaaaaagtggaaacaacccagacgtccatcagctgatggattcataaataaaacatcaaatatatccataaattgaatattattttggccataaaaagaagtgaagtgctgatacatgcttacaatatggatgcacttgaaaacttgatgccaaatgaaaaaagccagtcacaaaagatcacatattgtatgattccatttatatgaaatgtccagaatagacaaatccatagagacagaaagtagatgagtggttgccagggccaggagtgggagagttggagagatgaggagtgactgcgccaatgggtagaaggtttctttttggagcgatgaaatgttctaaaattgactgtggtgacagttgcagaactctgtgaatatactaaaaatgactgaattgtatgctttaaatgggtgaactgtatggcatatgaactatatctcagtaaagcatttttttttgtttttttttaaacccgatagtggtttcccactgcactgcatatacaagcaaaacctgctgtgatcacccggcctcctctcatgccactttccccatccctcgcatatgctctgtccacactggctctctgtcaggcgcctgaacagccaatccgctggctgccttggggcctttgcttttgtcctgtgtgcctgaaacacttactccagctgtcctcctccatgtctgggctcccctgctgctgctgtcccaggaggtgtcccctgtggtcctccgtcatagctgcctcagagccttcagagcactgtcagcatctggaattcttccgtatgtactggctactggtttagtgtctattctcttccctttcaatctcctcaccaccatagatgttttaagagcacaaagatcttacttggttttgctcaccgttct

SEQ ID NO: 4442 - DNA, 1430 bp, Homo sapiens
tgcccaacatgacccaatttagaacacacatctgcccactgtttaagccatctggaaaaggagaggcccagtctccctccagctgctcttctactaattcatatccttcatctcaataagcacctccttatctttaagcacagtccttcagatgataggttcagtgcatttcctctttctcttctgtgaaatcttctgtgaaatcctttctaggacttcaagtcagccattcattgagaatgtaagaacttactatgaactagatggaagatacaaaaaattgctgcccctgagtgtgtagcagacatatagccatagcagtattgaaatgtgccattggaggtgaatgcagagtgctgtggggacacagaggacactgctgccactgtctgccagggagctgaggaaggttgcatagagaggggaaatgctaattgagtaactacgtttattaactatctcgtacaataatatactttagttgcttcttaatgtgaattatgctgggtctttttttcctttctgtctactgtggctggtgacgttaactaattttatgacttcttttctgtttttttttttttttttttttggagatggagtctcactctgtcacccaggctggagtgcagtggcgcagtctcagctcactgcaacctccgcctcctgggttcaaacaattctcttgcctcagctcctcgagtagctgggattacaggcatctgccaccacatctgactatttttgtatttttagtagagacagagtttcaccatgttggccaggctggtcttcaactcctgacctcagatgatccacccgcctcagcctcccaaagtgctgggattacaggcatgaaccaccgcgacagccatgacctttaatatctaaatgctggagaccactcagagctcccgattcctccatctagttgcttacttgtcacctctgtttggattaacatccctaatatgacatgtccaaagcagaactcttgggttttgcccccttcgcttcatttcccccaagtctttcccagcttagtaagtgataccactgtctacccagtggctcaagtcagaaacctgaggatcatcttttcctctatctcctttacctccttcgtcaactcatccttaagtcctattggttatacttagaatttctatcccaaatcccttcctcttctttccacctccagcgtcagcactctaatccaagccactgtctcatctagactgtcacaatagcctcctaactgatctttatactttatttactcaacacttatttatggagtatcttctattttttttagaacaggaaccaaacattaaccaatagtcacctaaagaaatgtaagatctcatatttgataagtattccaaagggctggagttgcagcgagaatcaattatagcacagtttga

SEQ ID NO: 4443 - DNA, 1031 bp, Homo sapiens
aaagagccagtaggatgggggagaattccactgacctttatgtttacctagcctggtttctaggggtgtagattcctggctagggcccttattccttgtcttgactgtcttcatgacaccaatttggcatttcaggagagcggttaagaaaaggagttgtgtctgtccaaaagctggcaaggccagagctggattgtttggggtagagactggatggccgtcattctcttttgcctccatccctcctccccagagttggaggaaagcagtggattttgtggttagtcattctttggactcacactaaaagaaacattggtgccatgttcaaatatatcagaagacctaggaaataagaaatttgacctacttttctaaatgaaatcccagactgagcaaagagctcaccacatttgaaagcttgaacaaagggggcctaggctaagtccagaggcctagaacaaatgcttttttattttctacataacaaggggaaattccttgttatgtagaaaatagctggagacaaatggtgctatagagtgactcataacaaactacggtgatataggtctagggacaaaagcaggccactgataagtggcagatgcctgatccccctaggtagtggggagtgtgagactgggttataagaagccttcactatcttttaggaccctcccttgaggaggccagtctaccacaattgctttagaatgaaggtcttttggttgctcacaagactataatggtaatttttggctcatcatttttgtgtgtgtgggttttatcttaattcattgttaaagagatagtgggtttcccctgagctagtttcctatcatctgtgcctatgtttgcttcactgagctatggggaaagagtcactggctgctttgtttacaaaaagaaaggacaggctgagccttaaggagtaggaaggagttccttggcctacccttcatctccacaagtgaaaagccccttagcgtagcagaaaattccaggttgaaggtctctttggagaaggc

SEQ ID NO: 4444 - DNA, 1039 bp, Homo sapiens
gctcctgacgcagtcttggctgatttgtgagcagtgctgtttggtggcgcctatcttttcctccttcccttctgccttttagctaaattccccttgattggccctttctccagatattgagcagggaatatagaccttggaccagccagaatcttggctgaacaagggggaggttgactctgttggctgtaatgaagcttctttagaaatgattggttttggccgtacgcggtggctcatgcctgtaatcccagcactttttgaggccgaggcaggcatatcacgaggtcaggagtttgagaccagcctggccaacatggtgaaaccctgtctctactaaaaatacaaaaattagctgggcgtggtggcgtgcacctgtagtcccagctactcaggaagctgagacaggagaatcacttgaacccaggaggcagaggttgcagtgaactgagattgcgccactgcactccagcctgggccacagagcaagactccatctcaaaaaaaaaaaagaaagaaatgattggtcttgggggccggggcggtggcttacgactgtaatcccagcactttgggaggccaaggcaggcagatcatgaggtgaggaattcgagaccagcctggccaacatggtgaaaccccatctctactaaaaatacaaaaattagctgggggtggtggtgcttgcctgtaatcccagctactcgggaggctgaggcaggagaatcacttgaacccaggaggtggaggttgtagtgagccgagattggcgccactgcactccagcctgggcgacagagtgagactccatcttggaaaaagaaagaaaaaagaaaaacatgattgatctccatgcatcaatatcatgcctgcctcctaaggcagaggtaatgaagacttaattcccttctgtaggccttcccctcctccctaagccgttttctgagagaggtgcaggagcaggtgggttggggcaggctgcatacacagtgggggtgggttgtgctgctaagcagcagcaggtccacaatcccccctc

SEQ ID NO: 4445 - DNA, 1658 bp, Homo sapiens
atcctggctaacacagtgaaaccccgtctctaataaaaatacaaaaaaatagccgggtgtggtggcaggcacctgtagtcccagccactcgggaggctgaggcaggagaatggcgtgaacccaggaggcggagcttgcagtgagccaagattgcaccactgcactccagcctgggtgacagagccagactccatctcaaaaaaaaaaaaaaaaaaaaaaaaaaactgagtaatttattactttctttgataatatgttgcaaattgtttagaatacattcacaggcagtacatttctgtcccagtatcactgtatgagcaaatactgaaggagtttgcagacatctgctttacagtagacaggagatagatgttccaattggatatagcccatgtgtgtagtaaagtctggttataggaaattacagattaaaaaagactgttgttgtaaacatgtatccctgcacgcagtaaggttaaacagaagatccacaacaaaccaaattaacaattactaagtcagactaacagttacttatagttaaaaagcaagaatagcagggattggaaaacaaaaccaactcaggagccctgataatagcatgtcctttcctataggtggggaagtctcaccccctgaatgcacctatagagctagagcttggcactgctatgtggaagccagacttctgagaatactgagtttctgagtacttcatttttagacagtaactcttaatcatttaggtggtttttaataagtagacctaggtggtatagatacatctggggtcatttcacaggcccctggggaggtgagccattctttataggaagagctcctcccttgagaggactgaccacccatgtgttggcagtgccgttacgcacggggaagttacgcacagggaaaatgctcgaagggtaggcacggatgaatgatgaattaacaatgggtgatttttattgtgtttgcttgtctgtattttctgaaataaacctattatttttggttaatttttttaaagactttcatccaactcgtcaagttcctacaatagaacagttaaaaaaaaaaagacatcatcacctcacaaccatgggggagttaaaacaattactgagggggaggagatgaaacgtttatgaataagactgtctgcagttacttgagctgctaagattaaatgacaataggagttgttgttctttcaaggcataaactgaccttctgttgaggaaagttcactgctttgccactgtgtcctatgttagattaaaaggggtggggggagcagcggtgcagcttccctcgcacagtagttgtgattaaagcttttctggatcatttctgaagaagggtaaaggctttcagattgtcttgcctgaagacaagaaagcagaggtaagatataactcctgttacttaaacggaggaaaaaaaacatggggaagtggactggaattgcaacagcaagagtttgttgtggttcttgtttgtttttaccttttaaatttgtgaaatacagcatatatatacagaaacatgaataaaacgtaaatgtataatgaaattattggaaagcaaacatatgtagccactacccaagtcaagagctagaacatcaccggtacccaaaagatttcttcccagtcaaa

SEQ ID NO: 4446 - DNA, 1047 bp, Homo sapiens
ccagcgtacagtaggtacttactataatacttgtttaattggattaatgaacttgtcagcagcactgcctgacatgtagtcagcactcagtggtgtatgttcaatgaatgaatgaatccgtgaatagtgagtctagctgctgacatgctcacgatgatgggggggtagagccacaccccacactgccctgggttctgtagtcctcccacctcccctcacttctatcatcctgtcctgttggtcacctgtctgtccctctcctgcagctggtgagtgacacacggagagtgtctgacatccagtggtttcgggaggcctatggggccgtgacgcagacggtccgcgttgtagcgttggagcagagccgacagcagcggggctgggtgttcacgccaggtgagccactctatgtgtagggcacaggaggacacaggctacccaccctgtggtttgtctaccgggcaggcctgggggaagtgaataagggatgataaaggagaatctgaggcctcctgattagggagtagcatggtggacagaatcctgagggtcaaggttcccttggcttaacctaggctatcttctcatggccagtgggctgctttggtggtctggctgggacccacccccatgattcttcacctttgctttccagcccagtaggggctgacagtggtcaggggcaaacctgacaaagctcacttctgtttaacacagtagtggagttagaagttagtagtggagaggaagttctgctgggagcttcagtggtgcaagcccaggacccgctctgtgggcttcagaagcacagctcaggcttccttcctgccctagatcactgtgacttagagcagcagttcagatccaatgggtatgaccactactaatgctgctcatttctggggcactcacatgtccaggcctgtgctaagcattttatatgcactgtctcactttaccatcaaaacagattcagcaggtagatgctgttattagtttacccatggttggatgaggccctggcctgaaaggttaagtctctttccc

SEQ ID NO: 4447 - DNA, 1673 bp, Homo sapiens
agcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccc

SEQ ID NO: 4448 - DNA, 1058 bp, Homo sapiens
ttacagccacagcttcactgtcctgtccctcaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattggtaagttgcttggatggaggcgggctggggctagggtgggagtggttggttagggcttctggtctcaccttatttttatccctgcagcctgtaggacagcctgttgggggagatccagaagtccgcaaacagatgccacctccaccaccctgtccaggtatgaagggagccgagataggcagagctggggagtgttggaggcagggctgggatcactgtagagcctccctttcctcagcaggcagagagctttttgatgatccctcctatgtcaacgtccagaacctagacaaggcccggcaagcagtgggtggtgctgggccccccaatcctgctatcaatggcagtgcaccccgggacctgtttgacatgagtgagtgctcgtctctctcctctctgcatccccacctttctacttggttctggcccttctcctgcctatctgctctttccttcctgacttcccttccctgaagtctgggtcttgggtgtgtgttgtgcctgctacttcccctcaccctccctctatacttccagagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggtgagtgtggcagaggtgtgggtgaggggtggcaaaaaggaaggtacagt

SEQ ID NO: 4449 - DNA, 1081 bp, Homo sapiens
atgtaggcgacttccttcagggtccgctggaagccctcccaccctgtgcccatcttaatgacaggcacccgcagcccagtgtctcgaggggcccctccgaggaagaagggtagggtttgggctaggggctgtgtccggggctgcatgtgggcaacagttccgaggaagggtgtgggagctgcctctagtgccttttatcaacactgtccccacccccttcagcctcatgactacagagacaaaggatccagggtctagcaaagggaaggttctaggcctgggaacaggctgagtcagcccctctagacagggatgggagggtggggttagtgggagggagggcctggccactccatctttcatcctccacagctaggccaaggcagcttcccctcttccagcccaggtggtgccctgcctgattgcccttttcccagtggttggcacaactcctgctttcgccctctggtgggctcctgctgaggctgacattgagaaccatcagtgagagctcctttccagcctgttctgccctgcccctgggccccttagagtgagcacagccagtcagagctggcagcatttgacccacttctgcttctcccatcctctggagcaggaagacacagctagagcaacaggcacagtgagaggcacggtttattgccaggttataccctaggacggtgtccttccctccctcctagggtgggaggtcatgtgcgggagttccgctcctcttcttcgttctccagtagataggctggacggtatgtggggtgtcctcctgggctcaggcacttcagggccgggttccgcacggtattctcccgactccccagtgatgtgtatctggagcagggagggtggagggcaagcatgtggtagggtgggcgatcctattggccctccctatcccagcaccctaaaaactcccttacccattcccttcccctaatacccttaccctcggtcatacaggatacagtatgggacaaacagctgacgcagaaaatcccagatgtctctgtaggtccagtcctgggaggtcagagtaatagaatagtcacaaatgctcacc

SEQ ID NO: 4450 - DNA, 1152 bp, Homo sapiens
acaggttggcacagcccccctgctggcacagctctggggagtgctgccccaggatgggagagaatgcagtacctggctacaaacttctctgtggcagctccacagatgaggtcttgctgggagatgctgggtcagcccaagcatgctgcctctcctgtacctggcttccaagcaagaaactgtttcttgcttttccttcagtcagttcatctgggcatcctggctctctcctggagggggcatctttgacaagctttgcccatccacgtggccccttccagctcagctcccactgtgccttaagggaccatgcctgcacagcttgtttctttggcttaaaggcaggaatggtgggaaaggactgtctccacttctttctccatccctccgaggtgaaggtggggatggcactgtcgggctggttggcctccttccggttgaaaaccttaatactgacccgttttgaggctgctaggtgatagcttatgcctgtggtgggagtggttcccagggctgggggctctgaaagtggccccaagacaggtttggagtgcctgtccctctcttcagcctgtccctctttaaggccaggtgtggcatacaccttcacggggtttgcagcagcagaagtggaaggagcagcacagtccaggcaagtgggaagaggcgtggggcagcactgtgaccgatgctatgtagaacccgcacctctgggtcatctgcaaggtgagagggcaaaggccaccagtgtgagtggctccactatttgtactggctctcagcccaacaggattccctcagcctcagcctggtaaaggagccacctcctgtacccaacctcttcaagcagaccccttcctgtgccccaggcccagtttgctccagctacccacctgctgcaagtctcttctcctgtggattgtcatgggcctgaggactgtgagctgaaagacaagagtggtagtagatcaggtactgtatcaaagaggcagagggctgtaagtatgagtgggctgggctgcaagacttctataccatcctagatcactagaccgcacccagcatagagatggaggaaggaggcccacagggctctgacactcactgattttgccactgacagtcaccttcaacctcaagcagcggtcttca

SEQ ID NO: 4451 - DNA, 1033 bp, Homo sapiens
cactttgccttctctgccctctccacctgggcaggtggggccctgtttgtctttgcttttgtcctctcaccttctctcccatcatattccaggtaacctaaaatcctttcctgcccccatgaagaagtagatccaagcactctgccctccaacctgtgtccagggagcaaggccttcaacttccaccactggtcacccagcttaatgaattgactctcattgtctggcttcttttggaaagggtttaactgggttccccaaatgggaacacaccttgcccttcagactctgttgtccatcacctttcctttttccttttatgggaggaaagccagggtagggaagttatgtgagatatggggcagagctggtaaaaaaaagcatacatctacatccatgttctttttttttttttttttttttggagacggggtctcactctgttgcccaggctggagtgcagtggtgcgatcacagttcactgcaactttgaacttcctggctcaagggttcctccaacttcagcctcctgaatagctgggactacaggcatgtgtaccactgtactacctggctaaattttttttaattcaattttttttttttttaagagatgggtctcactttgttgttcaggctggtctcaaactcctgggctcaagtgatctgcccacctcagcctcccgaagtgctgggattccaggtgcaagccaccacactcaacctcctacctccatgttctgggtatcattaaggtaatcagaatcctcctgctgtagtcacgcttacccttctaagcaggttccccaggattcagagagccccggatttctcctggactccatgtgcagatgcctagtatttccattctgaccgttgccctccttgttcttcttgcctccctagttctcctgtgcctcctgttggctctctttgcatctggcctcatccaccgagtctgtgtcaccacctggtatgttcttgacagctgggtaaggggtgtagcattccgttttttggcattggatcttac

SEQ ID NO: 4452 - DNA, 1044 bp, Homo sapiens
agctgcgggatgatatacgagaccaggtttgggtgggctggcgaagggtggcactgattctggggtagggtggcagatgtcaagtgctgactcctccccatccttctccaggtgaaggaaatgtccctgatccgaaacaccattatggagtgtcaggtgtgcggtgagtgggagagcaggggaggctccacatgaccgtgccacgttccccacccaatggctttggctttcccttctggtggcttaaatagtgaccaccgggtagctctgactgtgtccacccctcaggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgaggtgagggaggtcagagcccagaagggtacagaaaactggggtgaggatgtcaggaggcacccaagagggtgggataaatgctggtccggaggagaggaatctggagtttaggagaggtcagaggcaagagaaatgcaagatgggagagacagaaggcctggggcaaagactgaaggccatacagggaaggagctggggaaactgcaggggaggcttgagatggcgaccagtggcatggggagggagagagggaaccccgagggaagtggggtggggaccaggagcacaaggcagttgtgtggggagagctgcacaaaggggagacctggagcaatggttcctggatcacaggcagggacctgagtttcccagagggcggcctgacctctgccttctcatctggtccccagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtcagactgggtagtgtgtgtggacaagggatcttggccttgtagaggccaggggc

SEQ ID NO: 4453 - DNA, 1030 bp, Homo sapiens
tgagagcaacaagggttgaggtttttttttgttttcgttttgtctttttgagatggagtttcactcttgttgcccaggctggagtgcaatggcgcgatctcggctcactgcaacctccacctctcaggttcaagcgagtctcctgcctcagcctcctgagtagctgggattacaggtgcccgccaccacgcccggctaggtggtttttttttcttttttgttgttgtttttgtatttttagtagacacggggtttcaccgtgttggccaggctggtctcgaactcctgaccttaggcgatccacctgcctcaacctcccaaggtgttgggattacaggtgcgagccaccatgcccagccaagggttgaattttgaggtgactaacgctgcctggtggtgggggtagggggtgatgtgggctcgggggagggcataccttagcatttgatcccattctctaaccttgataacccctgcctgaccagtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaaggtgactggtgggcatctcctttcttgcaatggtgacctccttaagcactctccctcatccctacttcccaagtgcttcctcattctccttggcctccattagggaccaaggtcccatcaggctgtgcccagacatcaggggcacctggtatggggtgcttataaggtgctttaggagcccatgtaccaaacaatagggtgaggcttgagtcctgatatttatagggatgggaggttgtacttggggatgcctggaaggagggtgaggcatgtctctgtgcctcagcggtgatacagaaaggtctttcagatccctggaacaggtcagtggccacaaaa

SEQ ID NO: 4454 - DNA, 1050 bp, Homo sapiens
ccccgagcggggactgcgggggggtcccccgagcagcatgttttccacagcgcgttatgtttggagcgggccctgcgccgcctgtcgccatggaaacaaaacaggggcggtggcggcggccggagcggaggccgggctggggcttgggtgggggaggggaagagaggctcgcaggctgtcgcttaggtgacgggaactcaggcgcccctctgcttcatccgggtcacggcccgtccgctagtacccacagtgttccacagtctggtccttggctcctcgcctgtacccctggtcttctgcgcctgtccctggtgtccctttcctcttttttggtttcttcactctgacctcactgaccactgctttagattctcccttcagttcccgtcagacgcttccagactcccaagctttcctacgaatgagggaaaatggagaaacaggcacttgtcaggggaccccccaccctaataaagagcacttgctccgccagaacagcaaaattcatgccatgtgggcatccctgggcactatagcaagctagttgcggccactcccttggcatcctttcctgccagctgtggaataatgcccactgtctagcactgcccctgccaggggttcttgccttccacaatcgtggcttccagaaaacagtggcattcggtagcgctgtgtgccgagacccccaacaatgatgactgcggagagggaggcacctgggggaggatcattagggagaggtagaaagcagggaggcctccaggattctttcccagtgcccctggttcccagagctgatgatgcctccagggtgattggcagctctttgtttcagccccccctcacccgcctgctggccccccctccaattctgtccctccgccccccggctcctgctctctccgcctagccttttcccctcccagctgcctgcctgccaggggtagtgagccggctgagaggcatggagacgcaggaacttcggggggccctggctcttctcctcctttgctttttcacatctgccagtcaggatctgcagggtaa

SEQ ID NO: 4455 - DNA, 1043 bp, Homo sapiens
gccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttgatcattctctgtcaccagtgaaatttgttctagtgtctctcatatttaagaaaactctttcaggactgggtatggtggctcacacctataatcctagcactttgggaggccgaagcaagaggatcgcctgagcctaggaattcaagaccagcctgggcaacatagtgagaccctgtctctacaaaaaacaaaaaattagccaggcatggtgggacacgcctgtagtcccaactactcaggtggctaaggtgagaggatcacttgagcttgggaagtccaggctgcagtaagctgtgattgagccactgcactacagcctgggcaacagagcaagaccatgtctcaaaaaaaaaaaaaaaagaaaaaagaaactttcaagacactctttccaaccactaattgtaactctgctcctccttttcacagcaataggttttctttttcttccct

SEQ ID NO: 4456 - DNA, 1028 bp, Homo sapiens
agcgagattccatctcaaaaaaaaaaaaagaaaaaaaaaaattagctgggcgtggtggcgggcgcctgtagtcccagctactctggaggctgaggcaggagaatggcgtgaaccggggaggcggagcttgcagtaagctgagattgcgccactgcactccagcctgcgcgacagagccagactccgtctcaaaaaaaaaaatgtctttgcaaggggatcacacattattgacatttgctttctccatctcccctgttgaggattccatgaaggcagcagctgccttcatttccttactctgccatgtttggtgaatattataggatgagcatagatgggaaggagccttcattgcagtccagaagggctcctcatcctgtccctctgccccttaggcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggtaagtgtgttagtggtgggagagtgatggagacctgggatgggccccacgtctgcccatccttcagctctaattcttctcccaccctccccatttttttcctctttgtaggagtgacagttcattcaatttcttcgttttcttcttcattttcttcgtccaggatgtgctctttgtcctccaggccattggtatcccaggttggggattcaggtttgtgaggctgttatccaccctcacctttccctctagatccagccagcactgggtgctgggataggagttgttcagaaaaaggaaatgtggttttaatccttgggaggtactagtttaatgagatacaagacatacttccaggatagagcgcagacagcactcttgacacatatagattgaagggaagaatgctgcatttggccaatctaaggtggcttcctggaggaggcatagaaccatggttgaaaggaggaaga

SEQ ID NO: 4457 - DNA, 1051 bp, Homo sapiens
acatggcagatgtgcttgttacctcacttctctggtcccttggtcctctcagtgactcaacaagtgtctgagaacagttttctagcattactctttgtcctcactaaggcaggaccttgtcacagggtatggtagggaatgtgatctgaacagatacacctcattggtatttgttatccaacagcagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcggtgagtgccagcccaggcccttcctctccccactcttctgcaggccctctaggactctggtaagtgagcagtatccttgttctcagctgaacattggggcatgaacactgaggtgggcactgagtttgcctactttcttggaagctctccgactcttgaagggccctggatctgctttggagatggatgggcacggagcatttgtgacccccagtgctctccctggcatgttgggcttattgtgttgggagcagcttctccgccccagcggcctccactctttaatggggaccttgcttgtgaactgcctttttcccccaagccctgggctctgtagcccccttggcaggcgggcttgggtgggggcaaggggagatctgtgtctgcccggaagggcattgtgtagagcatggggttgtgggtgacattggcaacaacaccacttctctgctctgcccatgcctctccctgttcctgttttgggtttggggacttgggattatgcgccgctctctcttctcacaccgatccaccttactgcatctgacgtgttcccttccactgtcccccatcatcgtctgtcccccctggctgggcgcctgtgaccggtgacccctctaccacccaccccgcctccc

SEQ ID NO: 4458 - DNA, 1026 bp, Homo sapiens
agtggagagggagaggaaagggttctgtccaagacagttcaggttaattaattttcttctccattgcttcaccttaagggttaataatgtagagaggagggaggaccacattgatgaccagaacctactggtactttatagcatttgccccaccccacagcttaggtttttctgtcatcctcagatcccacaggcattgcgaagaagctgcttcctatacccaggtataactcaaaatccaaagggatagggccaggatccctattcctaccccatctattctctgttggctccaagagctaccccagagaccttaaacagaaacagtagctgaggcttcttcctagatacctgactagggaagtttgtctctcctttcttgcccaaccaggtcaaagtaaaatgtgagttgacagctcaaagcacttgtaactgctgccccctccctacctctactccccaaaatggaatcatgggatagggaaggcccccatggggtcagaagggcacggtagttcttgcaattatttttgttttacccttcataacctgtcaaacatatttttttctaatgagaaagccaggcccccgccagcacacatgctgtttttaatgcgctgtagttcttgtgtgtctgctgtgctgtgcaaatggagattcagttcaaaataaaatcatttaaaaacctacataaaaagaactctaaacccacccctgcaacaaaagtcactacataaactgttcagcagtattcacctatcagagtatttgttgtgagtatagattatcaattgaaaacactactcttgttttcttaattgtacagttttcaatgtccctttcttaaagagacagtatatttctcttcacccctagcccatcttccctcaccctcctgaatgacatcaggaggtatatccagggtgtctccttccttcctactctcttgaccagaagttaacagactatactgtctctttaaaaataaaatttaaaaagctttgttgtcttttcagacatacatat

SEQ ID NO: 4459 - DNA, 1153 bp, Homo sapiens
gaatgattccgttttgtctaatcaactttcacacctctctcaaacttacaccagcaaacacccactggggagtgtttgcttaagcaaaagttccttaagctgataaacaactttagcaaagtctcaggatacaaaatcaatgtacaaaaatcactagcattcctatacaccaataacagttaagccaagagccaaatcatgattgaactctcattcacaattgccacaaaaagaataaaatacctaggaatacagctaactagggaagcgaaggatctctataaggagaactacaaaccactgctcaaagaaatcagcgaagacacaaatggaaaaatattccatgcttatggattggaagaataaataccgttaaaatggccatattgcccaaagcaatttatagattcaatgctattcccattaaactaccattgaaattcttcatagagctagaaaaaaactattttaacattcatatggaaccaaaaaagaacctaaatagccaaggcaatcctacacacaaaaaaagaacaaagctgaaggcatcatgctacctgacttcaaactatactacagggctacagtaatcaaaacagcatggtactgatacaagagcagacacatagaccagtgaaacagaatagagaacccagaaataagactgcacacctacaactgcgtgatctttaacaaacctgacaaaaacaagcaattgggtaaggattccctattcagtaaatggtgctgggataactggttagccatatgcagaaggttgaaactggaccccttccttacagcatatacaaaaacaaaatatggattaaaaacttcaatgtaggccaggcgtggtggctcacgcctgtaatcccagcactttgggaggctgaggcacgtggatcacttgaggccagcagttcgagaccagcctgatcaacatggcaaaatcccatctctaacaaaaatgcaaaaattagctgggtgtggtggcacatgcctataatcccagctacttgagaggctgaggcatgagaatcacttgaaccctggaggtggaggttgcattgagctgagatcgctgcactccagcctgggcaacacagcaaaactctgtctcaaaaaaaaaaaaagacttaattgtaaaacccaa

SEQ ID NO: 4460 - DNA, 1029 bp, Homo sapiens
agtacttcgggaggccaaggtaggaggattgcttgaggccaggagtttgagaccagcctagacatcatggtgaggaccccatctctacaaaaagtttttaaataattatccaggcatagtggcacacagacctgtagtcctagttactcagtagactgggatggtgggattgcttgagccttaggagttcaaggctgcattgaattatgattgcaccactgtacaacctgggtggcagaacaaggccctgtctttaaaaacaaaacaaagcagtaaaacatggataacttgtctggaccatttgattaattccttttttttatttaaaagattagctctagaataacatgtccattttttacattctgtactttttagcataaagtttatatagtaatctgaaatataattttacctttttatctaaaagtgccgtattccttgaggattttaagttgtgcagtaaaatggtctggattggagcaaggttagggaaaggtgacattatgaaaaaatgatgcctcccccttcttcaaattcatatccccagggcaaaagttgccatattgtttatgaaagaacattaagggagtctgttttcctgttgtctgtagatgatgttcagaagtattttaaccctgatatgatgtttgtttgtttgtttgtttgtttgtttgagacggagtctggcagtggcacaatcaccatgcccagctagtatgattttttttttttagacagtcttgctctgtcacccaggctggtgtgcagtggtgcaaccttggctcactgcaacctccacctcctgggttcaagcagttttcctgcttcagcctctcaagtagctgagataacaggcgcctgccaccacgcccagctaattttttgtatctttagtagaggcggggtttcaccatgttggccaggctggtctcaaactcctgacctcaggtgatccacctgccttggcctcccaaagtgctgggattacaggcatgagccactgttcccggaagccagtatgctctt

SEQ ID NO: 4461 - DNA, 1050 bp, Homo sapiens
gtaattgttgtaattggaattggattttttatttttatttttttatttttattctattattattatttttttttagatggagtctcactctgtcaccaggctggcgtgcagtggtgcggtctcagcttactgcaacctctgtttcccaggttcaagcgattctcctgcctcagcctcccgagtagctgggaccacaggcacgcaccaccacactcagctgatttttgtgtttttagtagagaaagagtttcaccgtgttggccaggacggtctcgatctcttgacctcgtgatccgcctgcctcagcctcccaaagtgctgggatgacaggcatgccaccacgcccagccctccaattggatattttaaattaaatttttggattgtttattgctatgtatagaaatacaattgatttttttttcccaccagtttaccctgacagatgtgtttcatgtattgagtttgtctcctgtaacctaggtgttagtcctaagagtcttttagtggattccgtcatgtgtgtcttgactttgcttaagatcattcacatcgtcaccacatctagctaatttttttattttttgtagagacaatgaggtcttgccatgttgcctgagctggtcttgagctcctggcctcaagtgatcctcctgccttgtccttccaaagtgttgggattacaggggttagccactatatctggcctttatttttaaattgcttctggatttttttcttttttaaagacagagtctacctctcatccagactagagtacagtggcataataccagctcactacagtctccacctcctagactcaagcgttcatcttacctcagcctcctccagtagctgggactacaggtacatgccaccacactggactaatttttttattttttcagagacagggtctctctatgttgcccaggctggtcttgaactcttgagtcaagtccctctttggcctcccaaagtgctaggattgtaggtgtgagccaccgtgcccaggttgcttcctttttttttttttttttgagacgg

SEQ ID NO: 4462 - DNA, 1060 bp, Homo sapiens
gagttttgttttttgtggttttgtttgtttttttgagatggggtttcgctcttgtcaaccaggctggagtgcaatggtatgatcttggctcactgcaggctctgcctcctaggttcaagtgattctcctgcctcagcctccagagtagctgggattacaggcacctgtcaccacacccagctaaatttttttttttttttttgagacggagtcgtgctctgttgcccaagctggggtgcagtggcaagatcttggctcactgcaacctccacctcctgggttcaagcagttctcctacctcagcctcctgagtagctgggactacaggcacacaccgccatgcccagccaattttttgtattttagtagagacggggtttcaccatgttgcccagtctggttgcgaaatcctgagctcaggcagtccgcccacctcagcctcccaaagtgctgggattacaggagtgagccacagcgcccggcctctttttgagtttttatggaagcttcataggcgtcaatgacagccatgtagaaatgtgattgaacaaaatgtagaggatgtaaacccagcatgtcctgtctagacttcttggcctctctgtgtcacattcctttctctagggtatggggcaggaccctctctggagtgagggttttcttggcccagaatcagattagagtcctgccttaggtaggtgaaaggaagacaggagaaggtcaaagagagattctatctcctgaggcccactcctgagacttaaagtgccccaacattataacagggactatgggagttaagagccaggaaccatggatgaaaacatatatatatatatatatatatatatatatatttatttatttatttatattcatatttatatttatatatatcataagaccacacttctgttttttacttttgtgctttttcttgattaaagatttaaaaatggaagattctgatcttttgatgtaatttgatttcacatcaaattatacaaccgtatcagtgatttgtaagtgtctctggtcatacaaaagatttgacctgaaa

SEQ ID NO: 4463 - DNA, 1066 bp, Homo sapiens
tatcaggggccgggtgcagtggcttgtgcctgtaatcccagcaatttgggaggccgaggtgggtggatcacctgaggtcaggagtttaagaccagcctggccaacatagtgaacacccatctctactaaaaatagaaaaattagccgggcgcagtcgctcttgcctgtaatcccagcattttgggaggccgaggtgggcggatcacctgaggtcaggaatttgagaccagcctggccaacacggcgaaaccctgtctctactaaaaagtacaaaaattagccaggtggtgggcgcctatagtcccagctactcaggagcctgaggcaggacaatcgcttggacccgggaggcggaggttgcagtgagccgggatctggccactgcactccagcctgggcaacaagagcgggactccatctcaaaaaaaaaaagaaaaattaaaattagccaggtgtggtgctgcatgcctgtaatcccagctactcatgaggctgaggcagcagaattgctagaaccttggaggtgaaggttgcagtgagctgagatcagaccacttcactccagcctgggtgacagagcgagactctgtctcaaaaaaaaaaaaaaaaaaaattatatcagagtatatacctggaaaggtaattactgaataaaataaaggatttgtcccaagacttaatttcaagctatggagtattaaggtggtgtggaattgaatagataaaagaaacagacctacacatatatggaagcttgctgggtaacagaggcatataaagaactgttcaacaaattgtgcccagtaagttgaaatccctggggatcagaaggaaattggattctgtcttatcctctatacaaaaaatcaactcccagttgattaaatacagttgacccttgaacaacacagatttgagatttgcgatacttaaactcacagatgaactgtgtagcctagaaaaaaattttttagtttttaatttttattttttgtggatacatagtaggtgtagcctagaaatagtcaaaaaaattaaaaagtatgtcatgaacggataaaatatt

SEQ ID NO: 4464 - DNA, 1018 bp, Homo sapiens
tcttgatggctgtagtagaagaaaggaaagtggacaggttcaagagtttaaactaacagaagacagaattttatgatttgtggggagggtgaaggagccagaataaatgatgtggcctgagcttagataaccaacgtcctgccacacgatggatggtcagtatacataatgttagctttatggtatcattcactgatgtagggaatctggatggaggagctagtttgaagggagcgaaaatgaaatgagatgtgaatatgagtttgagaaatctgtgaaacatgcaaaagtagacaattagaagaaaggtctattcagaaaatagaaattcagtagtcatcagaatatagatgatagttaaaagaattgctaaagagagaatagagagtcagacaggaaaaaagctcaggctagaaagtttttaaaaactatagcatttaaaggttggagaaaaggaaggggtcatttttcgttttggtaattttcagataaaactgaagattggtatgaatatttagaagtcacttacatactgatgataattgagactatgagaataaacatgttcccagtgggaaagtaagtataaaaggtaaataacaagtactctgtattgaggacctccgcagttaaatttaatggagttgcaagtaattgaaagttaatcaaaggatattatagaaatagtgtaggcaggattttaaagaattatgaaatcaaatatagctgagagtttgaaattttttcctttttttaaattttattatttttctagagacagggtcttgctctgtcatccaggctggaatgcagtggcgtgatcatagctcactgcagcctcaaactccatggctcaaacaatccacccgcctcagcctcctgagtagataggactacgggtacaggaaaccacactgggctaatttttattttttgttgagacagggtctcagtacgttgcccaggctagtctcgaactcctggcatcaagtgatccttccacctcggcctcccaaaa

SEQ ID NO: 4465 - DNA, 1034 bp, Homo sapiens
aatgatgtctttaaatgtggaaaggaaaaataacatctgtcaacttaaaattttttaaccagcaaaaatatctttcaaaaatggaggcaagataaacattatcagaaaaagaaaagtttaaagaatttgttgccagtagacctacagtagcagaaacactaaaggacgttcttcagatagaaagaaaacatagtaggtagaaacatggatctaccaaaggagtaaagagtgccagaaattgtcaaccaatgggaaaatataaaacacatttttctcggctgggcgcagtggctcacgcctgtaatcccagcactttgggaagctgagacgggcagatcatgaggtcaggagatcgagatcatcctggctaacatggtgaaaccccatctctaccaaaaatacaaaaaagtagccaggcatggtggcgggcgcctgtagtcccagctactcaggaggctgaggtaggagaatggcgtgaacctgggaggcagagctggcagtgagccgagatcgtgccactgcactgcagcctgggtgatagagcgagactctgtctcaaaaaaaaaaaaaaacaaccacatttttctcatattcttttgaagtgcgtgtggaattataccaagataccatcctattctgggtaatcaaatgtcttgatacgttttaaaagattaaactcatgcagaatatattttcagaccacaacagaattaaattagaattcagtaacacaagttatgaaattctctaaatatgtggaaattaaataacacacttctaaataattcataagtaaaagatgaatccccaaaaatgaaatcagaaaatactttgaaatgaataaaaatgaaagacacatagggccgggcgtggtggctcacgcctgtaatcccagcactttgggaggccaaggcgagtggatcatgaggtcaagagatcgagaccatcctggccaacatggtgaaaccctatctctgctaaaaatacaaaaaaattagctgggcgtggtggcacatgcctgtagtcccggctgc

SEQ ID NO: 4466 - DNA, 1035 bp, Homo sapiens
gacagagtagataagggcttcagatttggatatattaaatttggactgtctttggcctatttaggtagagatattgaatagaccgttagaagcagtggtttatacttttagagacatctgtggtagagatctaccagtatatatatgaacttgaatttggcagtgaaagagatcatccagggagaatgtgttaagtgaggtgatggggacggagacctaagaaactcgagcattttggagggaagtggaagaaaagatgtttagtgaaggacacttaaataagaaacatcaaactgtatatgtcacagaagcctaaacaagacttcagaatggaatagattagtcaacattagatgtcacaaagagatcaagaagagttcgatcagaaagtgtcaaatgattgagaaaataagaaaaaatagtctgagaatgtgaaagtttggagcttgaaagagggaaaggagacttaaaattcaggtggcattgaaataaattagagctctttatttccagcaatgtggtagattaggtgtgcagagcaagcaaacaccttgttatctaaaacctgaaaatacatggacaacatttcttacagtatgactgaactttgaagtaactaaataggaaaccagaaacttcagaaagttcaattcaacagagataaagagcattagagctgcttgacatctgcttgatccctggtggctgggagtctggtaattggaacacatccagctggaagagacaaaagacagagcctaggactctagtagaacaaaaaaccacatatgcataaagttggaacccccaaaaggtgacacttaacaatgtacgggaaaatagaaataaacctatcatagaaaaggacagtttcttgttttagttttggctttggaaggaggaagaaaaaggagttcctgaccacaagctcttactaattctctgcctctcctacagatttatattgtttgtcagacccagaaaaaagttaaaataaaatttgtcataggtttgtaatgttcccagttgcattgc

SEQ ID NO: 4467 - DNA, 1048 bp, Homo sapiens
gttgaagctgctcaactgtaggcacagaaggatgtcattggtagataaatgtagcaatgccagacatagctggttctagtgtattgtacctgtttgtttcttttgtacaaacattgagagaagccacacaataaaaacacttgcagaaaagtctgttgccagtaggagccaagaggaagaatgtggatgaatgtacattttgaacagaactacattgcttatggctttcttcatttagtttgtgttggtgtactccttcgttcagctgctagttttgtcctgcaaaatatttatgtgctttaaaagtcatgtattaaccaatacaacttccatattctggtatcattcttgtatttatcaatgatacaagagctatttaactatatagaaacacatacaataacaaaacatactgtatacctttgtgaatttttatatgtataatcatgagagtaatgatattttccttgggagagaatagggagtgaaaaacaaacagccttgggtagctctgaggaactgcagtatttaaagtagtgcttaaaaaactgtcagcttttggcccacatgtgattctttgtgatgatctctacactttttaaaaaattgctcatattaaaaaatgtagcaattttacataaaaatgtggaattctgcttctcagaaaaatcagaacatctggcaacaattagtccacatttcgtggataatagggatggctggggctcagtattggcaggccctttttcattgctgcttgtattcttttgttcgccacagtcctcactgttttctgttgtgtgttgtatctggccctcttcagctatttaaagagggaacttttggatttgagatccctaatttcagagtcatgagaaggagattataaaggatgagtaaattgaggtgaaggtgatatgagatgacaggttaggatgttgaatgtatcatctacatggacattgaaattacccaagaggacagttacagaagttggggtgaaaatggtggatgtgaacctggtttcagggtccttggggaatgagaa

SEQ ID NO: 4468 - DNA, 1029 bp, Homo sapiens
tgcaaagaagattgtagcaagttcagcaatgggattggttaataaggacattggaaagaaactaatgagttgtcctttggcaggtctgatcagtaaagatgccataaaccttaaagccgaagcactgctccccactcaggaaccgcttaaggcttcttgtagtacaaacatcaataatcaggaaagtcaggaactttctgaatccctgaaagatagtgccaccagcaaaacttttgaaaagaatgttgtacggcagaataaagaaagcatattggaaaagttctcagtacgaaaagaaatcattaatttggagaaagaaatgtttaatgaaggaacatgcattcagcaagacagtttctcatccagtgaaaagggatcttatgaaacctcaaagcatgaaaagcagcctcctgtatattgcacttctccggactttaaaatgggaggtgcttctgatgtatctaccgctaaatccccattcagtgcagtaggagaaagcaatctcccttccccatcacctactgtatctgttaatcctttaaccagaagtccccctgaaacttcttcacagttggctcctaatccattacttttaagttctactacagaactaatcgaagaaatttctgaatctgttggaaagaaccagtttacttctgaaagtacccacttgaacgttggtcataggtcagttggtcatagtataagtattgaatgtaaagggattgataaagaggtaaatgattcaaaaactacccatatagatattccaagaataagctcttcccttggaaaaaagccaagtttgacttctgaatccagcattcatactattactccttcagttgttaacttcactagtttatttagtaataagccttttttaaaactgggtgcagtatctgcatcagacaaacactgccaagttgctgaaagcctaagtactagtttgcagtccaaaccattaaaaaaaagaaaaggaagaaaacctcggtggactaaagtggtggcaagaagcacatgccggtc

SEQ ID NO: 4469 - DNA, 1068 bp, Homo sapiens
aagaccagcctggccaacatggtgaaaccctgtctctactaaaaatacaaaaattagccgggtgagtatggtggcttgtgcctgtaatgccagctactcgggaagctgaggcaggagaatctcttgaacccaggagacgcaggttgcagtgagctgagatcgcgccactgcactccagcctgggcgacagagcgagactccatctcaaaaaaaaaaaaaaaaaattcactaatctccctaatgattatatggtaatctggtttcctgaggatctttatatttaaaatgggagtgctttgtggagattctgagattaggtgtatcacctattgtaaaataataaattagcacgctagttttaaaacattttgtgtatttggggaattgacacatgcctactatttgctattaggaaaacttgtaaaaataaattgctgatttttaaggttcttataacaacagtgattatttgtataaatatttgcttaatgtttgcccttctcactagagtataaaccttaaaatttaggaactgggttcattttgttgaatactgtattttcagagtgtagcatgatgcctggcatatgatagatgtttggaaatattttttgaatggacaagtgaatgattcagagttgaattgtatcctaacaacaaagataatatctgcataagttcctgcatcagagagtcctaacctcaaaaagcctgataatctcttctaaaagtttggaatactgaaaccagcctaagagataatttaaaaagaatttttataggtacatagcgtgtttaaatatttatggggtgaacgtgatatgttgatgcaggcatacaatgtgtaataatcacatagtcaatggagtatcaaaaaaagatgattttttaccttcaataaaactgtaggaaataaaagtgtacttcagcagaagagtggggaatatattcttttaaaactgatgagtgcgaaaatatatgaaagttattttgattttaggcaatgtttgcttgactgtaagtttcagaagcttcttggtgattcttaaatttgcatttgcaccatac

SEQ ID NO: 4470 - DNA, 1024 bp, Homo sapiens
aaacaggaaaaaagacatttgctacatgccaatcattgtattagaagttacaggaaccttaaaattcactcattcatttattcagctatttattgggtactaaaatttgtgctattcattgtttcagctgctggggttacagtggtgagcaagccagaagaggttcctatcctcatgaagcttatattttaattatacagttggccttccctatctgtgattccgcacctgtggattcaaccaactgcggatgaaaaatattagaaaaaattaaaaataacaatacaataataaaaaattatacaaaattttaaagtacagtttaataactatttatatatcatttacattatgttaggtattataagtaatccagagatgatttcaagtatacaggagcatgtgtataggctgtatgcaaataccataccattttatataagtgacttgagcatcgtcagattttggtatctgagggggtgggatgggaggtgggaggacttaatctgttgaggggtatagctgacaaatacagaacaagaaaaaagttaattgccctaattgtgatcttatatggatcataaatattcagggatggatcaggtcagtgcaagcttaaatataggtctgagaacataggtctagaatccattacccaaatgttggtgccgtaagtttttttctttttaaaaaaattccctgcaagtgttacacgtttttcttttttcttatttttcttcttcttctttttttttttttggcttttagaaatgtagattgggtgaactggcacagtggtgtttgggagtagtagcatcctttactaacttaatcaagcccattaatacttctgcattgtaatttatcattattcatggaaattagggtaattaagactaaaatgggtccgtgtcaagttttatcactaggttttgaaaaaacttggatttcagagttttttggacttcaggattgtgagcccatcatggagaagataggactttgtactttttattttttgttt

SEQ ID NO: 4471 - DNA, 1050 bp, Homo sapiens
acttcttttttttttattttttttatttttttttgagacagagtcttgctctgttacctaggctggagtgcagtggcgcaatctcggctcactgcaatctccaccagaagggaaacttttgtacctccttcttggaactaagtgaggagactggtaggcgatggaagagaggtagagaggactttaggacaaattaaattggatctttagaccatttaaaaaattttggcttctgctttgagggagataggaagcctacgaaagggttttgagcagaggagtgacatgatctgaatcaggctttgaaaggatcaccctgcaactgaattgagaagactggaagagatatgagggttgaagcaaggaaccagttagaagcatgttgcattttgcaagctatgcatctgacaaaggtctaatgtcagcatctgtaaggaacttaagcaaatctatgagaaaaaaaatgattaaaaagtgggtaaaggacatgaacagacacttctcaaaagaagacatacatgcagccaacaatcatgaggaaaagctcaacatcactgatcattcaagaaatgcaaatcaaaaccacagtgagaccatctcacatcattcagaatggctattaaaaagtcaaaaaaaaaaaaaaaaagatgctggcaaggttgcagagagaaaggagtgcttatacactattggtgggagtgtaaattagttaagccattgtggaagactgtggtcatccctcaaagacctaaaaacagaaataacatttgactcagcagtcccgttactgggtatatacccaaaggaatataaatcataaagacagatgcatgcgtatcttcattgcagcactattcacaatagcaaagacatgggattaacctaaatgcccaccaatggtagactggataaagaaaatgtagtacatatacatcatgaaatgctatggagccacaaaaaaaaaatgagatcatgtacttggcaggatcatggatggagtggaggccattatctttggcaaactagtgcaggaacagaaaatcaaatact

SEQ ID NO: 4472 - DNA, 1072 bp, Homo sapiens
tgtaattttgagcaaaatacttacaatctttggtttccttgactgtaaaatatggtgatatagtaatgataatatttatagcatagagttggcggattctacgagatgatatgtataatgtgtttagcataatgtgtgccatgcagcaagcaaataatgtgtatttgttattattttagttatttattttcttcatttccaaaaaagaatatagcaaagcagattacttccctcataggtaagaatatgtaaaatacacttttgaagtgtatataagcaatgtccttatttgtatacatattttttccattttcaatttttagcatactatttatcttttctcacatgtgaattccaatttcgtattttccctcttcattttagcctaggttttcgtgtttggctttttctttttgagtcagggtctcgctctgttgtccatgctggagtgcagtggtgcgatctcggctcactgcaagctctgcctcccgggttcacgccgttctcctgtttcagtctcctgagtagctgggactaccagtgcatgacaccaccctgttgtagtttctatcaaaacttctttttgttttttttgagacagagtctcactcttgtcggctaggctggagtgcagtggcgcgatctcggctcactgcaaactccgtctcctgggctcaagcaattctcctgcctcagcctcccgagtagctggaattacaggcatgcgccaccacgctcggctaatttttgtatttttagtagagacggggtttcaccatgttggccaggctggtcttgaactcctacctcaggtaatcctcctgctttggcctcccaaagtgctgggattacaggcgtgagccactgtgcccggccttcatatatttatttagtgcttactatgtgccaggcactattctaggtactgggatacagtgatggacaaaacaagatccctgctttgctgtcttaggacttaataatttgggcattttcttttttcgatatagatcttttagtactgatataacatactgttagccagtatattacgtgttgttcaagcaagatt

SEQ ID NO: 4473 - DNA, 1532 bp, Homo sapiens
gtatgagtttaagatgaaagagtctatggtatttgaacatgttgacaggagaactttagggtccatgttttttattctttttatcatctgcaaacttatttctgcagtattagtaaaggactctgaatttggtgataagggaatataatatagcacaagtatctatggctttgttctttgtcagtatctttttgttcctaaactctgagaagtgggtttgtcttttttcagttttggattgggcctgaggtgatttgaagctcctgtcttggagtttagcttagttataacaaacactgagttaatcctatgcaggagacacaaaaatcaataatatatggtctctgtgcttgaagagatgctaattcagttgagtctgaattgtttgatggtggcagctctcaaaaggacaaggaagagggaaacattcctagaagttgaaattttgttacccaattgcaaagagatttttgccactacttactctttgaataagcataaagtgtttatactctgtatgcagctttgtactttaaaaaaatatgttttgtatcatcttgtgctttttttttttttttttgagactgagtttcactcttgttaacaggctggagtgcagtggcgctatctcaattcactgcaacctctgcctcctgggttcaagtgactctcctgcctcagcctcccgagtagctgggattacaggcatgtgccaccatgccctgctaattttgtatttttagtagagacagcgtttctccatgttggtcaggctggtctggaactcctgacagatgatccacccgcctcggcctcccaaagtgctgagattacaggggtgagccaccgcgcccggcctcatctggtgtttttgtataaaggaactattggtttgagaagaaggcaaacatttatatttcttaccttcttttgggatatatttctacagtgcgtttatgtaaaaaggttttgatgtcgctgggcatggtggctctcacttgtaatcactttgggatgctgaagagggtggctcaccagaggtcaggagtttgagaccagcctggccaacgtggcaaaaccccgtctctactaaaagtacaaaaattagccaggcatggtgtgtgtgccggtagtcccagccagttgggatgctgaggcaggaggatctcttgaatccctgaagtggaggttgcagtgagccgagatccaccactgtacgccagcctggacgacagagtgactctctcaaaaaaaaaaaaaaaagaaaagaaaaaggggcctagggcctggcatagtgggttatccctatgatcccagtgctttgggaggctgagccaggaggatcacttgtgcccaggagtttgataccagcctggccaacataggaagaccccatttctacagaaagttaaaaaattagaatgaacacctgcagtcctagctactctggaggctgagacaggggaattacttgacccaggagttggaagctgctgtgagctatggtggtgctactgcactccagcctgggc

SEQ ID NO: 4474 - DNA, 1035 bp, Homo sapiens
tatagagagagaagaacaccggctcccattctggttaaaggtacagccctcttcctcgaagtctgtaggaggcagaaggtcactgaaagttctgagagaatatcaaggacttccttaatcgtctaatgctttagttgtagaactaggacttcaggaatcttcctgattcacctttcttcccttacttttctgcccttctccgggtgattctacaacattttcaaaataatgggtaaaatggtaatttgctaaaggaaattcagagaagagtttctaaagtgtataattggactgtggtctttgtagaaatttcatatgcagagtcccttggaaagatgccttgagcttgtctcaggtccctaaacttagaaagtcctattctttttcccaaattctgacatgtgctggatcagagtgttctcatttccaataggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaag

SEQ ID NO: 4475 - DNA, 1042 bp, Homo sapiens
attaaagtgagtgtttcctgcatgcactatccaggcacctcaccaacacatatctgttcttttctcttgttattctcaaagaaaagaagaaccttcttttatctaaagctaatttctcctacttatatactagattaattcccctgttgccttttcagggacattgattcattcattacgttcctctggagtatcttcatcctcttaaaagattccacaaatccatgtttccctgtaataattctctttcttgaactttctagaaatgatatgcagtattccacttacatgctttgggtttttgttttgttttgtttttttggtcagacataatcttgcactgtcacccaggctggagtgcaggagtatagtggcatgatcttggctcactgcagcttccgcctcccgggttcaagtgattctcctgcctcagcctcccaaatagctgagattacaggcgtgcccaccacgctcagctaattttttgtatttttagtagatacgggtttcaccatgttggccaggctggtcttgaacttctgacctcaagtgatccaccagttttggcttcccagaggctaggattgcaggcataagccaccgtgcccagcctatatactttttctcaattttgtgtttgtatgtatgcatgtatgtgtgtgtgtgtgtgtgtgtgtgtttgtgtgtgtctgtgtctgtatgtatgtatgtatgtatgtatgtatgtattgagatggagtttcgctcttgtcgcccaggcccagcctatatactttttctcaactctttttacttattgattgattgattgagatggagtctcgctcttgacccccaggctggagtgcaatggtgcgatcttggctgactgcaacctctgcctcctgggttcaagtgattctcctgcctcagcctcccttgtagctgggattacaggcccctgccaccatgcccagctgatttttgtatttagtagagtcggggtttcaccatgttggccaggctggtctcgaactcctgacctcaggtgatccatctgcct

SEQ ID NO: 4476 - DNA, 1756 bp, Homo sapiens
ttaaaacacaataaggaagagagaggagaaaaagacagtcaaaacaaaaactctggggcttcccttatcaattacctaaataatccttgttaaaactaagtgcaggctatgtttccattttctacttttttatgcttcttctcttctgttccttcagtggtggtagcgcggatgttcaaattttcagttctcagtaaagattgtatagacagtcccacggtcttcaggtttttactctgtgctacccaaacctacagtaaatactataaaagaaaacttattcaaacgtaatctttatctgcaaaaactattgaaaaacgttaccatttaactattgctgtaatatagggggttccttgaaatatgataacctgcttgttatagctacttcagcagatcttatcctgttgcatagggtatcagcatatgcttaatcatttaggtatattattctccctttatttctttctatgtaaacatagaaaaggtatagtaatcatacatagaactgacatgctaggtattggaatttttgcttcagccctgcaaacaatctttcaggagggtatggatgggaagttagggttaggaaccttggaagaggaatttaaagggctaaaagaagatagccttcatggataatattttaactaacttctccgttctgttcatttgaactaccatgtacttcagttattttggtatatccttttcctgcttcatgctagaaagtctttgacttgttaagaaagcagggcagtgcagcctgagtagataggataatgggacaagctggacctgggatgggagtaacatcccagggagtaacaagtaatgagagaagaaatgagaatgatgagttcccaccagctccttggctgctttcttacccatatatttctctgtccctagttttttgtttaattttttcttcatttgtatattatttggaagaggaattgtagaggaatgggatggggtgtaatacagaatcatttgatgcatgctaactactttgggaaaagatttgtgtaaggctgggagtttgactgttggctaaagtgaaaaggggggattagtagggaatgaaaattgttcaggctctttgctcatcattgcaaagaattggatgtgttgtggacctaggaaaacactcaaattcagtcatccccgtttgggataggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcaggtaacactttccttggtcatattaatattgaattataccaaggcctaactctgaggctttggtataatctaaaattagcagctttgtaaatgtcagagatagttaccttactacgtattaaaaccgtagtatcttcacatcagttaggagcttgagaagtcatcatgttcatgtcctgtggctcagggaagacagcacataaggaccctaatggtattcggaattacagatttcaaagagtcctcagtaatctattctgaaatttaaccttcactgtgacaagtagttttttttcccttttcccttttcttttttcttttttttttgagacgtagtctcgctctgtcacccaggctggagtgcagtggctcaat

SEQ ID NO: 4477 - DNA, 1048 bp, Homo sapiens
aagctttttttttttttttttgaggcaaagtcttgctctgtcacccaggctctggagaatacagtggtgaaatctcagctcacagcagcctcgacctccagggctcaaaacaattctctcatctaagcctcctgagtagctgggactacaggcacacacctacaggcccggctaattattttatttttttgtagagacagggtcttgccatgttctggaactcataggctcaagtaatcttcctgcctcaacctcccaaagtgctggaattacaggtgtgagccagcacatcttgccccttgaaaacttttgatggcttcccctactgtcatttggtgtgtccttaaagattgccaactagttttaaagtattttgcacacaaataattaccttttccataaatttgtctaaaaagatatttctgtttaagaaattgatcattttgagttatcctagctctgtgcttactgatacaagttgactggttgagcaacttctttcctggcataatagtcattccatatgtgggtttgtaggagtcctgaagtgagaaaggttctgatgtaggctctttctgggtgccagcattattaaagtattgtttatagttttcacttttccttcccaacactggagcaacattcaaaagcccattccccaggaaaaccctccctttcctttgcccacagttccaagatgagatgggattctccaacatggaagatgatggcccagaagaggaggagcgtgtggctgagcctcaagctaactttaacacccctcaagctctacggtaggctagttgaagaccttgagatttggaatagaggaagagtttatttctgaaaaggttttcagaagttgcagttaacaatttttcatccccagccagcttctgttactgatgtaaggatgcagagtcctgtcaggagttaggtgtcaagtgaagtctccttgttatggggcagtgcagctgtaggccaagctgtatctgtttgggaagggagaaaaaacagtagctggcatccatatccacttctccgggtg

SEQ ID NO: 4478 - DNA, 1022 bp, Homo sapiens
gcagggcgcggtggctcacacctgtaatcccagcactttgggaggccgaggtgggcggatcacgaggtcaggagatcgaatcacgaggtcaggagatcgagactatcctggctaacaggatgaaaccccgtctctactaaaaatacaaaaaattagccgggcgtggtggcgggcgcctgtagtcccagctactcggggaggctgaggcaggagaatggcgtgaacccgggaggcagagcttgcagtgagctgagattgcgccactgcactccagcctgggccacagaggagactccatctccaaaaaaaaaaaaaaaaaaaaaaaaaagactgatttcatgtagtaaggatcccgtctatgaactctatgaatatgaggtaagaatgcatgaactaagccaacttagctgtattcttctggaaaatgggatgtttcttgataggctagattagtggttcttaaaagttttttggggtcacttatccttcagagaatcggatgaaagacactgggccctcaagttagaagatgagcataagcgcaatcacatgatttatatatatgattttaggaacttaaactgtaatgaaatagagccaatttatatttagatctcatttgaaaacctttcattttcattgttcgggtgtgtggatgttagtatgagtttaaggtgaaggagtctatgttagtatttgaacatgttgacaggatccatatttttaatttattctttttatcgtctgcaaacatttctgcagtattagtaaatgactctgtatttggtaaaaagggaagctaatgtcgcacaagtatctatggctttgttctttgtcagtatctttttgttctcaaactctgagaagcgtctttttttcagttttggattgggcctgaggtgatttgaagctcctgtcttggagtttaacttagttataacaaacactgagttaatcctatgcaggagacacaaagataattaatatatggtctctgtgcttgaagagacgctaattttctg

SEQ ID NO: 4479 - DNA, 1034 bp, Homo sapiens
tcaaaaacctcaagattgctaagtcagtatttgacccattattttaagttacagctcatacaacaaaattctgttatagcagaatggaaccattcatcctgggaacatataatgggatttgatctataaacgtgttttggttctgctgattgactctttgtaacttcttaaaatttgggaagtgtaggctgggcgcagtggctcatgcctgtaatccctgcactttgggaggcggaggcagggggatcacctcaggttaggagtcgagaccagcctggccaacatggtgaaaccccatctctactaaaaatacaaaaattagccaggcatggtggcgggtgtgtgtaatcccagctactcaggaggctgaggcaggatactcacttgaacccggaaagcggaggttgcagtgagctgagatgacagcctgcttgacagagagagactctgtctcaaaaaaataaaataaaataaaataaataaaatttgtaaagtatagaaataatttaaaactcttgttagaattcagttaccttctggtattcagtagaatacagtcatatatcatctcatggtgatacattctgtgaaatgttatcattaaacgatttcatcattgtgtagaaagcacttggataaacctagatggtttagcctactgcatacctaggctatacggtataacatattgctcccaggccacaaacctgtatagcatgttattctgctgaatattgtaggcagttgtaacacaatggtaagtacatatgtatgtaaacatagaaaaggtacagtaatcttatggagccatctctgaatatgtggttcattattgactgaaacattatgtggcacatgactgtacttgggcagctgctgcttctctttcagttgcaaatgcaaacctgttataatctttgactaaataaagcatcctggattctgtaagtccatagatagtaaaaacttcttaaaacacaataaagaagagagaggaaaaaaaagaacaaaacaaaaaccctgggaaagtgagt

SEQ ID NO: 4480 - DNA, 1032 bp, Homo sapiens
actgtcatttggtgtgtccttaaagattgtcaactagttttaaactactttgtgtacaaataattacctttttcataaatttgtttcaaaagatttttcattttaagagattgatcattttgaggctgggtgcagtggctcacgcttgtaatcccagcactttgggaggccacggcaggtggatcatctgaggtcaggagtttgagaccagcctggccaacatgatgaaaccctgtctctattaaaaatacaaaaattaggcatggtggcgggcacctgtagtcacggttactgcagaggctgaggcaggaaaattgcttgaacctgggaggcggaggttgcagtaagcccagattgtgccactgcactccagcctgggcaatagagcaagactgcaagactctgtctcaaaaaaaaaaaaaaaaaaaaaaaaaaaaaaaaaaaaaggagagagagattgataattttgagttatccacgctctgtccttactgttacaagttgactggttgaatgacttctttcttggcataatagccatcccaagtgtgggtttgtgggaatcctgaagtgagaaagttctgacattggctctttctgggtgccagcattattatagtcttgtaatctatagttttcactcttccttcccaatactggagcaacattcagaggcccattccccaggaaaaccctccctttcctttgcccacagttccaagatgagatgggattctccaacatggaagatgatggcccagaagaggaggagtgtgtagctgagcctcgtcctaactttaacacccctcaagctctacggtaggctagttgaagaccttgagatttggaatagaggaaaagtttatttctgaaaaggttttcagaagttgcaattgataatttttcatcccaaaccagcttctgttactgatgtaaggatgcagagccctgtcaggagttaggtgtcaagtgaagtctccttgttatggggcagtgcagctgtaggccaagctatatccgtttgggaaggga

SEQ ID NO: 4481 - DNA, 1063 bp, Homo sapiens
tcatttatagaaagaagtgaggcttaccaggtgtaaggcagaaatgctaatgacagtaatagattctttcctggtttcttctttctaactctgacaaataattgagagtataccctcagggataatcaacacctctagatcactgcagttacttgttaagtatatggctgttagtgatggtacagaggaagtaaacatgaaaaacaattatttcagttaagataacttaattatttatattctttgttggtaggtaattccaacatggaatatttcaccaattaagaaggccaatgaaattaaggtaaacttggaagaaataattgttattcttttccagaaagacttcatcggttttgaaacttaagtacttcctctttaacttttcttgatcaatctttgttttaattccagctttgtttttttccattctattactcttaggtttgtatctcatggaattcactttaacctctgcctcgtgttatttgctttagctgtacattatgctcttaggattttttttttttctgccctgcttcttccccttattttccaaatacgtatgatttgtgtttcccattacttcatttctttctaattgtactaatgtagcctcctcagtttgtggatatccaccttgaagaagatgattcctcagatgaagaataccagccggatgatgaagaagaagatgaaactgctgaagaggtcagtgaatgttagttggtaatatttgtcttaatagagcagggtatactttgcttccttagtaatgtcacttgtagagaggattgagacatggttcttttttcagctcatttctgtgctttaagctgtttttctgccctttatactcccttaattttagaatttgttgtattatgaaatacagcatagaaacgtgcatagaataaaaatgtatagctttggttattataatgcaaatcctcatgaaactcatagcaaagtcaagaaatatatcattactaggacaacccctgtataccctccccagtcacaatcacctccctccccctaaaaataaccactaccctgcctt

SEQ ID NO: 4482 - DNA, 1005 bp, Homo sapiens
tttggtgttagatcctggcaagagttggtgccttctctagatgagctgtctgtacccaggagtcaaagccctgtaactcaaaagcacattgattagttaatagcacccgataaggaactttttaaagggctggcagtggtaatgctggagtccacaacctgtcaggaggctgtaaaaatatatcacaaccttgcagtgattagtttttatagctttgataaagcccagcaacaagccagacaatcaagctaggattcgattctgggggcatttgtaaaagatgttaaaaagcccaaaatactgtattgacacagaaccacaggttactgtaagtaatagttacttatttacccaaagtggtaatctctctgcagtgtaattgtctctccttatgggaagcccacttaactaatcttgaagttaaatttgatgaagagaaaaataatacttgaatttaatcggacaaagtatgttcaaggttttgaatatagcaggtgaacatgaaaagttttctggttactctgaaaatttagacatgtcaagaaaaaccaagagtatagaatcaagttatactggaggaaaacattgcttttatagacctctaagctaaaatatttcagcatctgactgtaaaaacagaactggaagagaaaaagttacagcaactgatgaaaaggttgaaggagagactaatgtctcaggctttctcaaggggagaaaaagctgaaagcagtgagatagaacaattgaacttatgagatatgaatctgagaaattttcaaaagaaacaagttatagaattgaaaagcaaattttcttgtaatttcattaagagcaaatcaataccttgaaacccttactttaacataggagaccattctttagaaagattccacttttaattatagctaacttaatcacataaacaattctttttataaattctcctttataaatcttatgacctgcacagaccatgtatgatatggttgaatgaactttctg

SEQ ID NO: 4483 - DNA, 1027 bp, Homo sapiens
ataggctaatgactggcagcagcttgaagacctgcagctgatagatgaattggtggttggtggacagtttgcctgtggcaactttttccaggtagcttctggtacccagaagcttggagttcagtcccttcaaatccaggacctggtttgtgatacactgggaaagagtgcccactgtagtgtctttgatgtcttgtaacaagtgtttaactccaatttccttagcttcctctgctgcagtttcactggtcacatgctcaaatgttttcaaggctgaagttccatcttcatagacttctactgaaatatatgcttctgtaggcagccctaagtcctttggcttcatgtcactagtgaccaatactgagttacggcagtatcttttcatgatttcattgaaggcagtgtcattcttgtgtagtttagggcctatgtggtaccactcaactattctttccctggcattcaccctcttaaacattctgtatgtgtttttcaaataatcgtgggctaaaaaacaattatctttgtcatcttcattaaaagggactgtaaaactgctggatacatcaagtactttcatttgccatgaccgcaaaagcacatgaagaatgcatttctggtttccaaccttgctgattctgttgaaatgatccaccacattgagcagtacctgggggtggactaccaccttctgcaccaccaggtccagcctcatgatacactctggccaccaggcctggctccctgtgacccactggagtttcttttagcatgcaaattcattataattagtgtataataagcagtgagagcaaccgaatgtcacttttgttgccatcttggttgtaactggttttggctgctttctttgctgcatcctgttttgatcagggttttgttcttgttttgttcagcaggctctctggccagtgcttggaaaacaaatcctgcttctctcctacctcactccccccacagagattatatactccccttcaatcttacagggttttagaagggtgga

SEQ ID NO: 4484 - DNA, 1031 bp, Homo sapiens
tgcaacctccacctcccagttcaagcgattctcctgcctcagcctcccaagtagctgggattacaggcgcctgtgaccacatccagataatttttgtatttttagtagagatggggtttcaccacattagccaggctggtcttgaactcctgacctcaggtgatccacccgcctcagcctcccaaagtgctgggattacaggcatgaaccactgtgcctggcctggtattttctatttttatttaggtttctgcttgtttattttaatgctggtcccggcccattaagtagatttcacaactcactaatcctaatgaataattgagaagcattgatttaatgagctcttcatctttgaggaagagacagaagcaggaattcaagaaaaaatgttaaaaggaaatacattgagatgtaagcagcagttgttaagtgaatgaaatattgcgtggctttttttttctttttagttttctatattttccaaggttactatagtaatatgcataaagaaatttgctttcagaaaagagaaattacgaaactgtggattatttagaaaatagtcagttagaccgggtgcagtggctcacgcctgtaatcccaacactttgggaggctgaggcaggtggatcatttgaggtcaggcgttcaagaccagcctggccaacatggtgaaaccctgtctatactaaaaatacaaaaattagccgggcaatagtggcatgtgcctgtaatcccagctactcaggaggctgaggcaggagaatcccttgagcctgggaggcagaagttgtggtgagccgagatcatgccactgcactccagtctgggtgatagagtgagagcctgtctcaaaaaaaaaaaaaatagtgaattatatatttttttccttttttgtagtattgaggaggaagtataacacatggttaataatgcttttcagttcagcaatcttggattttaatcctcattctgtcactaattaactaatttagagaagacattaatattttcaagttgaattttct

SEQ ID NO: 4485 - DNA, 2737 bp, Homo sapiens
gcctgtaatcccagcactttgggaggccaaggtgggcggataacctgaggtcaggagtttgagaccagcgtggctaacatggtgaaaccccgtctctactaaaaatagaaaaattaagctgggcatggtggtgcatgcctgtaattccagcggcttggaaggctgaggcaggagaatcacttgaacttgggaggtggaggttgcagtgagccaagatcacaccactgcattccagcctgggcactagagtgagactctgtctcaaaaaaaaagaaagagaaagagaaaatagtttctaaaaaattgtatacagacaaccttttatttccaacaaacgtgtgccgagagagagagagagaaaatagttttaaaaaaattgtatacagacaaccttttgtttccaaccaacgtgtatctagaaaagagttagtcgacttattttatacatagcatcagtgaatagtaatgagtggtaggtcatttcaaaatcctgttgcctatattatgtgaataccaggaggtcatctgatacggacttaataaaggttgattttgctttatattgggagctgagccacacctccccttataactctattggtcagtaatggtcagtttgtggctgttaggaaaatgttgccttttagcattccagaactctaaatcctgtagaggtacatgggatattttattctttgcctgtactcataaaaatgaacagaagaaaatacgtttttttcttttcttaacttcttttcttttaactctttaaaaggtgaaatatcagccctcaagagactcacttgctaactttcctttttttctttttttttctttttttgtgtttcttttttctttctctgttttcttacatggttctggtggattcacatttgctgatgctggtgctgtttttcgtgtgatcttcaacgtttttgggtgaccattgaccctgtgacctcaaaatggtgtccaactaaccacttaaaattaacatcttttttttaattaacgaatttatggtatttttttttttcccttggcggggatggggttggggttgttttttctctattctagattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattctgcttgtggtttctctgttttcttccacaacccatccatacactgaaattcataaacttttttactcatagcacaatgcaactataacattaccagaaaaatacatatacagaccccaaggtttgcatatagttcccagagttatgtaactgcaaaatgtacccttaaagttcaaatgaaaaggttaaggattattatgctggatattttccattttcatattttagccctcctttatttaacagcgtattaaaaggacttcatgaatgaagcgggttttaaaggaaatatgttattcttggaaagacattttatttttttttgagatggagtctcgctctgtcacccaggctggagtggaatggtgcaatcctggctcac

SEQ ID NO: 4486 - DNA, 1761 bp, Homo sapiens
tcttgcacaccaaatagctgtttaaagtggggatggtgggcacacttgctataaagggtcagatggcaaatattttaggctttaagggccatacattctctgtcacaactatcacactcggtggttgtagtgcagaagcagcccgtggataatacctcaatgaataagcatagctgttgtactccagtagaactttatttacaaaacaggtggcaggccacagtcatagtttgccatacccttggccattgtttgcctaaccttacctttgcagtgttaacaaagtcctcaaggagaatggggctaccttcaccacacctctcagtaattggaactgagttagcatttcaaatcttagaaggaaacataatctcagcatctggggaggccgaggcaggattgctttagcacagtttgagaccagcctaggcaacatagtgagactccatctctacaaaaaaaattaactggacatggtggcacatacctgtatttcagctacttaagaggctgagatggaagggtcccttgagcctaggaggtcatggatgcagtgaaccaagatggtgccagtgcactccagcctcagtgacagagtgagactgtctcaaaaaaaattttaaaaagcaacattatgtaagagatatataaacttttcaaatgtaaggattataaatgctggtatgtttcttttataacttaagaaatgtatacttaaaaaaattttttttttgagacagagtctcgctctgttgcccaggctggagtgcagtggcgcatctcagctcactgcaagctccgcctcccaggttcacgccattctcctgcctcagcctcccaagtagctgggactacaggcacccaccaccacgcctggctaatttttttgtatttttagtagagacggggtttcactgttagccaggatgatctcgatctcctgacctcatgatccaactgcctctgcctccccaagtcctgggattacaggtgtgagccaccgcacctggccacaatttcttaaatcatgaaagtagaattttaggaaaagagtagatgtctggataataatctggatggattatatatactggtcttggaggcaggggagagacttaatgagagcatggtaatggatttatggtgggtccttctctgtgggcctctcatagtgtacccatgccatagcaaatggcagcctcgaaccattgcccagtccccttacctgtgggctgtgagcactgaagggggttgcacagtgtgtaacaaaaaagctatgaactaaattttatttgtggtctctagtcaaatttattttattttatttatttattttatttttgtttattattattttttgagacagaatctcattctgtcacccaggctagagtgcagtggcaccatcttggctcactgcaagctccgcctcccaggttcacgcgattctcctgcctcagcctcccgagtagctgggactacaagcgcctgccaccatgcctggctaattgttttgtatttttagtggagatggggtttcaccttgttagccaggatggtcttgatctcctaacctcgtgatccgcccacctcagactcccaaagtactgggattacaggcgtgagccaccgcgcccggcctaatgtttgtatttttaatagagatggggtttcaccattttggccaggctggtcacaaactcctgacctcaggtgatccgcagcctcggacttccaaaatgctaggattatggtgcaagg

SEQ ID NO: 4487 - DNA, 1699 bp, Homo sapiens
ggatcgtccattatatcttcatgttcagggccagacacgggaattagtggacagtaagtaatgtttttggctcacgtagcactttttgtgaagagcaaagtacagggctctgtatagcaagttggcaaagtgtccctgatggctgttctaacccttgttcatgaactatacacgaatttgtatgggagtttagagggatggagagccacatatttgggtaacgtataaagcagatttacggtgaataattgaacactggcctgcctgggcactagtcagttcattccattcagttttactgtctgtgtttttctaaggagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcaggggtatgttttggggagggatcgttaatagcattatcatttctataaaaatgatatgtgctggccaggcacagtggctcattcctgtaatcccagcactttgggaggccaaggtgggtggatcatttgaggtcaggaatttggaccagcctgaccaacgtggtgaaaccccgtcacgaacattacccgggcatggtggcaggcacctgtaaccccagctacttgggaggctgaggcaggagaattgcttgaagccgggaggtggaggttgcagggagctgagaccatgccactgcactccagcctgggccacagagcaagactccatctcaaaaaaaaaaaaaaaaaaaaaagtgccaagtaatacatacaaagaaaaaaaaatcgtgaaattccaaattccaatcccgaaagttacctgccataggtattctgtttgtgtgttatccagctctccacggtataatgaacacctgatcacacatttcttcatattgatatattctagaaaggagattgatagagcagaaggtatacatgttgtacattttgaagttagtggttttaatttgtatttgtaaacttgatgacaactggaggactaagaaggctgagtctgatgaagtaagactttgctgatacattcctcctagaaaaaagggttggagagagcagccttcactgaagagtatcacagggctgactgtactacccaacactctaccccagttttacaggagactgtctttgctataatttcttattgacttatttcaaagattgaggatttaattatatattctgtttaatctgaagtattctgttcttcctacagatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcaggtatggatggatagggcaggggacatgtgaattcttgtcaacttgttggtacagtcaggagtgattcagaaggagcaagagaaaactgggtgtaattaatagtaatgagggatttagataaatgctaggagtaattactttataattagttaaagaaattgtagaattggggca

SEQ ID NO: 4488 - DNA, 1025 bp, Homo sapiens
acagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactccataaggtactgtcttccataatgtctgccaattctgaggaggatggtagtagagagccgggcagtgacctaagttcctctgaaaggggccttttcctctcaccgcaaggacagcctctgcctcactgaagagagggggcactaacaaaagtaaccactgcaaatcttttttttgtttttttaattcacaaatacaaggataaaaacaaaggggcacacaggttccaatgttgggaattccggtatcaggaaaagtgtgttcatcgtatttgtatgccatgctcagcaatcacctccacctattgcccccatccccagtgtcattcattgtcagatccatcccccactaggcccttgttgatctccatgatgtcgggccctggggttacccgt

SEQ ID NO: 4489 - DNA, 1071 bp, Homo sapiens
tgccaaaataacaaaattaagtctgccacactgccccaccctacccctctcccctagggctgtcctctactggcgctcttgcatacccctacgtcctctcatgtcctcacttgttccttatctgcagtggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgagggtgagggagctcccagggaagagtccaggctcaagcactcaccgtcacagaatgtggacatgtgactagacatggacaaacacagacaagtgggatgccaaccctataaaccataaacggccctgagtgcctcttctgggccagttcctgggaaaggcaggggaggaggtgtggtccttgctgctgctccatatcgtccatgctgcatggactctgctgcctcgtaggcatttactgccctttacctcatcagtggttgtgtgagtgaaaccccactgccagtgcagggggcattcccccagatgcccaagtgtcccacatgtgggggtgaatggcattcccctcagggtcctgtgtcattcctgttctcacctcttcctctttccccacagtggagggtctgaaagacctgctggtggggccaggagtggaactgctcttgacaccccgagagccagccctgcccttggaaccagacagcggtggtaacacgagtcctggggtcactgccagtgagtaccagggcaggggaccaaggtagtaggtgggaggggccaaagttagtagagtggtaccagggatcaagtggtatcagggccccagggaagtgagctcagccatccttttctccttctcaacagatggtgaggccagaaccttcaatggctccattgaactctgcagagctgactcagactctagccagagggtaggtcctcaagaggttctgggacttggcaaga

SEQ ID NO: 4490 - DNA, 1047 bp, Homo sapiens
tatccgcccacctcagcctccaaaagagctgagattacaggcattagccaccatgcccagccaagatttttataatttttctttagctttcagggaatcagttctcaactttataatttgtaaacctttttttttttttaacttctgcaccatggaattttgaaaaggtttttagaaatgcatataaaagtatgaaattgcaggccaggcacagtggctcacgcctgtaatcccggcactttgagaggctgaggcgggtagatcacttgaggtcaggagttcaagaccagcccggccaatatggtgaaacctcgtctctactaaaaatacaaaaattagccgggcgtggtggcataagcttgtaatcccagttacgcgggaagctgaggcaggagaatcgcttgaacccgggggtggaggttgcagtgagtcaggattgtgccactgcactccagcctaggtgacagagtgagactccatctccaaaaaaaaattatgaaattgcctattccaagaaagcagttcaaaataacctgtcctgttgacagatctgtagtggcttctttattaatagtattaatatttataattgtggccaggcgctgtggctcacacctggaatcccagcactttgggaggctgagacaggcggaccactggagttcgagaccagcctggccaacatggcgaaaccctgtctctactaaaaatataaaacttagccaggcatggtggtgcgtgcctgtagtcccagctgcttgggagactgaggcaggagaatcacctgaacctgggaggcagaggttgcagtgagccaagatcctgtcactggactccagcctgggcgaaagtgcaagactctctctcaaaaaaaaaattataattgtggaaattaataatattaattgtaattgatttgttgagcttctgttatgttcaaagcactttaacatttcatttaatcctaatgaaaaacctatgaggaagatattaccttcatttttcaaatgaggaaatagagaggttaccacctggtaaacagtggag

SEQ ID NO: 4491 - DNA, 1048 bp, Homo sapiens
agagtggaagaatggggggtcctcctggtggctgaggcttctggggacatagacaaaaattctaggggtcgtggaggttagggagagagttgagggggaggggagaagtgaggataggggaagggagtctaaagcttagggaagtcactgagtgacttgcaggaggttagatggggcctagagaaggacctactgaggccgaccagaggagttacagtggggtctgatcttagccactctggctgtggaatttgaccttggaatcaaggaggggacagatgtgaatgtgtgcatcccctgtgtgcatgttactggtgtgctggtgtgtcagtgtgtctgtctgcctgcctgccctcctattctgtacccagatgctctgggctactgttttgaacagtggtcagcaaagtagggggttcgtgctctctggccacgaggaagtagcttcatccttagcttcagtttctggttggaaatatcatctaggagctgagtgagcggattggttaggatttctgaagctggtaagagaaaaggctgagaggagctggctggacccttccgggtttgtttatgtctctttgggagagggtgggggtggggttgcaggcagcagctgcccccctcccaacccagccggcctgccttgtgccaggagggcagggagtcctggcacagctattgttcacttgcacaaatgcctgtctgtttgcatcgcttaccccccctctctttctgcttgtctctctctcctggcctgacaggtgtggccgcgtagggggcaggctgggttccaggatgcttgggtctcagggtccctaacctgatttattccttgtggcccttagcaatcctcttccgtttcacccgtacccactcccattgccagtgtctcatcttcattcactaagcaagcatttattaagtgcctttgtgtgtgcagtgatgtctttctgtgttgtttctggctttggcattagtgtttccacttggctgccttcccctctgcctcctgtcttcatcttgtccctggaagctcataaaggag

SEQ ID NO: 4492 - DNA, 1023 bp, Homo sapiens
agtaccctttatccctgcctttgtacccagccccattcccaagtgccctgacctttccacacccagaccccaggaaatgatgaagctgacttgcaggtgaataagtcagagctgaaaggaaggtggtgcctgcagacagcacctcccagctcctttggggcccccgcactgtacccattatcagaaaggacaggtcccagcccagagttggtttaatctctggcttctctccaacctgagtgccctactaccctggtgccagcctatgctgatcaccaacttcagccaagggagcagtaccccttaggagtccttaagggtgatggaaagccctcccctccacctccctggtagttcctagccaggctacctgtcttgatgctaaactgggagagacagaggttccatcctgggttgggggtggagggccagggaaagcagctttaaaaggactttccttagggggttgggattagattttgctatctggaaagcaactggggattcgagtagggcctaagacaaacagagggccggggtgaggtggctgaagtgtggtggaacagtggggtggcagacaggctcttcacagcctgcgccagcccaggccccagctccaaaagtctgtttattttttcaaccgtttgagctgagaccctggagtagagccaaggggggcgggggaggttttttgaaaccgcagaaatttggttccaccctaaaaaggaaagccatgggggagctggttgggggaagacctggctagggggtatagagagcggttctgtgggggcaggtagctactgggatcccttttccattattgtggggagctgggacgtcagacatctgggtgttcatgctctgtttttgtttttgtttttggtggtggggggactggctcttctttctactatgggggctggctgtgtggggcaggtaatttgggaatctggctggcagcagggagtcgggggctgagtgggtggatctgagagggcaaagaggccaccggagaagggt

SEQ ID NO: 4493 - DNA, 1021 bp, Homo sapiens
acaggattttttgtattttagagacggagtttcaccatgttggccaggctggtcttgaactcctgacctcaagagatcagccagcctcagcctcccaaagtgctaggattataggtgtgaaccactgcgcccggactattgctttaatttttttgtttgtttgagacagagtctcgctctgtcccaggctggagtatagtggtgcgatcttggctcactgcaacctccgcctcccagggttcaagcagttctcctgcctcagcctcccgagtagctgggattacaggcgctcaccaccgcgcccagctaatttttgtatttttagtagagacagggtttcaccatgttggccaggctggtctcgaactcctgacctcaggtgatctgcccacctcggcctcccaaaagtgctgggattacaggcgtgagccacggcgcccggcctgctttaattttatatccattacttactaaccctttttgtttcatccattttctagtgctgcattagacgtggaactatctgatgattccttccctccagaagactttggcattgtgtctggaatgctcaatgtcaaatgggaccggattgccccgtatcctcttggcacttggtgatgaagggtcggggggcagggagagccttgcctgcaaagcagcaggggtacttcaaataggctggatatgtgtggctgtcctcctgtcatctctctggataagatggagcaagagaggttggtgtaaattgtgtgagcatgatttagagtagacatgaagaaggaggatactgaagttcagattataagaccctgaaacaagctgggcacggtggctcatgcctgtaatcccagcatttttgggaggccgaggtgggtggatcataaggtcaagagattgagaccatcctggccaacatggtgaaaccctgtctctattaaaaatacaaaaattagctgggcatgatggcgcgcacctatagtctagctacttgggaggctgaggcaggagaatcacttga

SEQ ID NO: 4494 - DNA, 1036 bp, Homo sapiens
ctgtgggcactcctgtgtgagggaaagctacaggctcctgcaggtccgagatcggccgaaatcaggcaccccaaggaagccctgctctggccacatggtgtcccctcagaagactccaccagccggtgggcatcccggggcttctgacaggaagagggcagtagatatattggtgcttgtaccggtttttcgagggctgcagggtgaagatggtaggagagtctggagaacgggtctgctctggtggcttatggactactctgtggaaggggctgctgttctggtagcatcgaaggagctttctacgggagcgctgtcaagaggattttggtgaatttgacgtacttggtttgataactcactttgcttttttctctaaagatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaaggtaactcgaggccctagagttacagattaagcctatttctggattcttagttttcagatgggaatagggagcatattggtgggtagtggtttctctttgggacacttccagcatcagatatattgagtgaatgaatacacttcgggatctacttttggaaaggaggacattcttacctaagctacaagaaaccatctttcacgtttcgggttggaagaattttagagtagggaagtggcaagaattgtggaaaaactaggagggaaagataaagacacagaaaatacacaatcccttgttacctcaggggtttaaagtgtcatcttccagcctggcatggtagctcacgcctgtaatctcagcactttgggaggctgaggcgggcggattgctggaggtcaggagatcgagaccagcctggccaacatggcaaaaccctgtcactactaaaaatacaaaaattagccaggcgtggtggcggacgcctgtagtcccagcta

SEQ ID NO: 4495 - DNA, 1051 bp, Homo sapiens
caaaaactggggcctgcggggctggatcactatttgaggcagcctcccggctgggaggaccccgccactctttgctgggctgaggccgccaagcccctcagtgtggggactgaatgccccaaggagaacaggggttggagttaagtggtgcaagggctggggaaggtggaccagcttccccaggcctgaaggaagcagctccaggagggagggtgccatctgcctcccacacgcacagcccatcctgcggctgaacccaggtgaaaggggcctgtggatgggggcagttatctgatcccctacctcccactctgtctctaggtcaacgtggaggtaccaggccaccatgctcagtctcaagctgccccaacttcttcaagtccaccaggtcccccgggtgaggggctccacccactgacccaccaacccccattccctagaggactgactaggggctgacgttcttctcttttagctattggggcagcccctcctgcaggcgaactcttaccctcccattccagtgtgagactcttcctctgttctctgaggaacaagcttgtggccctccatctggagtccccttccccagagcgccctgtgtgctgcgctccacccccatcccaccccaatctggctcttcggtttcctatttgttttgtgggttgtgggtactgggacctgtggtaacatcagatcagatttagtttggcttgggggccacgttgatctccagcccagcctctttgaccctgcttccagagatctcagatggagggaaagggtccgggcacagtgacgcccttcctctcccaccactaccctaggtgttctgggaagatggcatcatgtctggctaccgccgccccaccagctcggctttggactgtgtcctcagctccttccagatgaccaacgagacggtcaacatctggactcacttcctgcccacctggtgaggggaggctccgccccaggccgcggccttgagctcagagggggtacccaggcgggcagggaccgtccaggcccacgggctgcagcggcagtc

SEQ ID NO: 4496 - DNA, 2051 bp, Homo sapiens
tgggctgtgctaatgctgggtcttggcccatcttcccctctgccccccatccccaggactctctataagatcctagacagctgcaaacagctgactctggcccagggggcaggtgaggaggatccgagtggcatggtgaccatcatcacaggccttccactggacaaccccagcgtgctttcaggccccatgcaggtgggtcatgggtgaggtggggggatggtgtggaatagggacgaggtaccagagcagactccatccccagaccctccacatagctacctttttttctcttccatcactccttccccagcgcctcaacaatttgctcttcagttcaggaggtcagaccctctccatctttccttctcccattccacaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggaatgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaatccctgtctcctggtgcctgtctgtacagaagtttcattggggggtggggcactgaagatggcatcctgaaatgcattttggaaaggcttctttgaagtggatggaacagaacaagaagcaggcaatttgagtgaaggccctggagatggtttgataggcactgtcaagttccttgactgtaaactgaggcggtgcctttgcaggggtgatagtgaaaatct

SEQ ID NO: 4497 - DNA, 1089 bp, Homo sapiens
ttctgccttacaagacagttgggagaaacagaaaatgtaagtgaatataatgagaaagcacttggtaaattgccaagtatattgctggcagaaggtcatgttttcagagaactttgggagccctctagggagccagggtcccttctctgcctgaagagtgtactgaggtgagctcagatacttcctccagagccccttgtcacagcagtctgagcttatctgttttgtctttccctaccttgcccaccagtgatcgatggcctggatttgctgaagaaggaacacccaggggcccgggatgggattcggtacctggaggcagagtttaaaaaaggaaacaggtgagtgtggcctggctggacctgtgctgagccctgggtctgtcttttggataacacatgcttatgaaagccccttgctccctatgggtaagacacatacatacccgtctctactcacagttagctcacctcactgcctggggagtgataccagagataattagaagtcaaggttgtagctgctgaaatagagggtgaccaaagggatcaggagccctgtggggagcactgagctgctgtccttcctctggggcaagcctgtgatcagcacccactggggagaagggagcagacctccctcccccaactttagactgtgaactcctttataggaatttctcctgctttggggttgggacaggtgatcaggtttctcagagtgtgagggcctcatccaggctgcccaggggcttcccacctccctgctgagctgagggagtggtaagaccgaagccagccagggaggggcagctggcagcatgtgcagatgctcagccggtacaggcctgcccttctggcctttggggctggaggagaactaggcagagggtgtagggaataaggagaaagcttccctctccctgctagctggcccaccccctcctctgcatctgctctggctggccaggaagctgcacaaggtctgattgttcggaccttgtctccagaagccctgacttgaaaagcatctgctgcttctcccctcccagctcctcccctgagaggaaccaaataattgatgttatca

SEQ ID NO: 4498 - DNA, 1030 bp, Homo sapiens
gcctcctctgcttgagtcacaggcttccaccccgaagggcttatccccagcccagaggagtgttgtcgttatcacatttatcaagagttttctctgtgcacagcctggtttgcatgtgacatctcaattaacccttgcagcagcccagtgaggtaggtgcttgcatcctccattttatagataagaaacagtaggctgggctctgtggctcacgcctataatctcagcactttgggaggccaaggcgggcggatcacttgaagtcaggagttcgagaccagcctggccaacatggtgaaacctcgtctctactaaaaatacaaaaaatagccgggcatggtggcaggtgcctgtagtcccagctacttgggaggctaaggcagaataatcacttgaacctgggaggcagatgttgcagtgagtcaagatcgtgccactgcactccagcctcagcgacagagcgagactctgtctggaaaaaaaaaaaaaaaaggaaaagaaaagaaaatgtagaaagacaaaggaacattcccaagatcagaaagtatagtcggtggtagagccagggctctggagttggacacactatggatttcttatcctggctcttttctgctgctttagagacttagcttctctgtaggccaagtgggcactaggagttgcggggggtgtagtacctgctgatgggacttctgaaggtaggctttccctctgaggaacgcgtaggcctacatctgtttgaaatgctgggttggtaatgtcagagcctcatattagcacagctccatcttcttgggtccaggcggatctcactcacctacactagttctctgggggagcttttacacaagtgcccccatccccctctcttgaatatggagtttcacaattaccattttagtctaaaagcaactcattggcttgatttctgcagtgggaagagggaaagtttgtctatggtgcctcccttgcttaccagtttgcccacagggcctgtgagaaaatggctgttaggttgaggctgcag

SEQ ID NO: 4499 - DNA, 1047 bp, Homo sapiens
cagatggtcttatgtgtccttcttctgcccaggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggaggtaaggatagcatttcttatgccacagctctgtttgtcagtcacaaacagcagcaaatgggttcagatctggggagggagggggcaggatgccctcttccactcagacagggacagtgtccttggggctacaggctgtgcttccttcttcattcagtgagccattttagcttttttcctgccttggcagtccttctaaaggtctgccattggtagtttctactattgtagaacaaccacccccttcctttctctgccttctgtaaagggcagaacaaatagttattagggcttcgaaatctttatcagtctcttttctaactctgggcccagcctgctccgagctgaacatcaaacaatcatagaaagttagagctggaagggaatgtgctgcccgcttagtccagcagctttcacccttaaatctccatcaccacatgggccatctgggggcagcagagggaagtcaagcagacaggccacccagtcctgacatacataaaccacctggctgctccctccaaccagagctgcttggctctgttttatattttagagttctagataagatttttatttgagagggaagaagggttttactgaccacaaaaataagttggggccaggtgcaatggctcacctttgtaatcccagcacttggttgggggccaaggcaggtggatcgcttgagctcaggagtttaagaacagcctgggcaatatggcaggaccccatttctatcaaaaaatacaaaaattagctgggcatggtggtgcgcacctgtagtcccagctacttgggggccgaggcaggaggatgacttcagcccaggaggtagag

SEQ ID NO: 4500 - DNA, 1052 bp, Homo sapiens
gttgagaacagatgagatgtggttggaattgatggtgcctactcctcatcagggccctaggcccctaatgcctggctttcctgacttcaggatccaagcagtacagtgcagccattgccttcaccctggccctcttttcccacctcgtcaatcatgtcaacatacggctgcaggctgagctggaagagggcgagaatcccgtcccggcattccagagtgatggcacaggtgggagaatcggggaggtcatcactatggaaaggttggtgtggggcatggggatgaaggaaaggaacacagactcgggggaagtggtgttggagagcacattccagcttccaggctccacctgttcctcgggctccacctgaccttcctctttccgcagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccaggtatttggaccacttcatcatcctgttctggtccgcacctccatgccatagacactcaccagag

SEQ ID NO: 4501 - DNA, 1781 bp, Homo sapiens
tgcagtgagccatgatttcatcgctggaactccagccggggcaatacagcaagaccttctctccaaaaaaaaaaaaaaaccaccacattatctaaaagacaagattattctgggaccatgtccataggttaccagatagctagaggggtccacagctttaaaaaaaagatcacttcaaagggttagtgccccaaaccactttagtttttatgttcactgatgttttctccattcagccaactgagaagtgtctataaaacattaggactggcttttccaaatggaagcaacccatctgagtgaggcagtaaggtggaatggataagaggacagtctctggagccttttgtatcctaactctgctgcttagcagctgtgtgactaatttcctcaactgtaaaatgggagtaataagagtaacctcatagggttgctgtgagaattaagttaatactgtagaatgcttagacaagtttctggcacatgagaaaactgccttccaaagatctcaagctctctgaagttaccaggcagtttcttgggaagggagaggtgagtgctcaggcatatttgactttggccatcagcagcctcaggcagggcaagcccacttttctccttcatgggcagactctccagtaggctgccttctctgtggacctccactaggagcatctgccttagcctcattcacatgtctttctttttttcttttttaaattttgttgttgtcgttgtttttgctttttttttttttttttttaattggcgtcattcacatttcattcttgggcaaattagtttcccatatttacctcaaacctttcacctttatgtgtgtaacttctacccaagacattcatgaccctattcatacttgaagctcatcccttcctcctttttggaagccttcctgtgatgaccttcccgcaaggtgccatcctaggttgagggccctagccctccttttccagttccttcctgtcctatgaatgaatctgcctataagtctctgagtccctgcgtatggccacctgtgatcctctgtgtctctccctgtgtcctggatgagtgtgtctctgccctgaaagacaatgttccaagactggccctggattcttagtctctacatctcggaggggtatttcttcataggtgcgggaaggcagaagaatgggcctacaaatctctttctctttgtctcataggatgcaagaagccagtgtctgcctcagggaaggagatggattgggcacagatggcatgtcaccgatgtctggtgtatctgggggatttgtgtaagaatttgcacctttcattttctctgttttgggttacaggacgagcccaggctgcttcagttgttggtaacacccattacatggttggagagcaggagggatagtttggcttctgataactttttccctcccatctgtttcagtgatcccttcttttcactgcccttccatgagtcagagaggatcagtgaatacaggaaaaagggaaatttctttgagctttgagcaaatgaagataataattctctttcagtagtgggttgggaagattttaatttgatatttttcttctttgagtgtttcttttatctttatggactgctagatgaatagaaacttcagcacagggattgaaattagacatcaaggaggacttaccttcctaacagatgtttctaaggatggaaaagtactcttttgctttatagcccctggggcctctcgtcctgatagacagtggtttctcattaggctgctggt

SEQ ID NO: 4502 - DNA, 1108 bp, Homo sapiens
catgaggaaaccccatctctactaaaaatacaaaattagccaggcatggtggtgcaggcctgtaatcccagctgcttgggaggctgaggtagtagaatcgcttgaacccgggaggcggaggttgcagtgaaccgacatcatgctactgcactctagcctgggtgataagagggaaactgcgtctcaaaaaaaaataaaagactgaaaagatagatttcagacaaaatggcagttccatagtagcatctaggtgatagatctaaaggaaagaaaagtgtcctttccttctctgctgacctctttgcatctgtggtttttctcctagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgagaaagttgttatgtgtttttcaaccttgggccatctctcttatctcctggcaaataggtggaggcagaaaaccttactggggagggaaaggagacctggaatgagggcatttagactcttttgccttcttgagggagtattcttcagacttctcagtaaattttggttggaaagacccttttggagttcaaaggataatactgtaaagcttacaaagcaccattttgcattcactgcccaaagaacaagaggaacctgtctaaagcatgggtgttccccatatgtggttgtatgtagaggaacacccagtacatcctagggctctggcatgtgtcctaaaggacatataactttttttttttttttggtgtagttttcagaattctccctttaccatgagttatttttctctgccctcttccaatgtttttacaattccagtcttca

SEQ ID NO: 4503 - DNA, 1032 bp, Homo sapiens
tttgttgttgttttttggggtttttgtgtttgtttttttttagatagggtcccactctgttatctaggctggagtgcagtggcatggtcacagctcactgcatccttgatatcatggtttcaagggatccctcacctcaccctcctgagtagctggagctacaggtatgcatcactgtgcccagctagttttttattttttgtagagacagagtcttgttatgttgcccgggctggtctcaaacttctgggctcaagcaatccttttgcctggcctcccaaagtactgggattacaagtgtgagccactgtgcctggccccctgaaaatctttttcaccggacaggcaagacctcttaagtgatgtttccaacaatccacttttgcccttatccctagctacagaccctagagactagggaaatgggtacaagtatctgaaatcatctgattctccccacctcttccgtccattagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggtgagtcagccttggatgtatgaccagatgaagtagatcactgaacttcttgagagtttcccaaagggcctaaaataattctgtggtccatttatagctatttaatttggacctatagccacaaattccttttctgcttcctttttttaattaaataatttaaaattttaaaaattgtagtaagcataaaatttaccatcttaatcattttaattgtacagttcagtaatgttaagtatattcatgttattgtgcaagagatcttcagaactttttcatcttgcagaactgagactctgtacccatcaaacaagatatctcatctcctactccctagcaacaactgttttcttattttttacgttgaagttataa

SEQ ID NO: 4504 - DNA, 1030 bp, Homo sapiens
gcctcctgggttcaaacgattctcctgtctcagcctcccgagtagctgggattacaggcgtgagccaccaagcccagctaattttgtatttttagtagagacggggtttctccatgttggtcaggctggtcttgaactcccgacctcaggtgatccacccacctcagcctcccaaagtgctgggattacaggcgtgagccactgcacctggcctgtcatcttgtgttaattcctctgatgtaatgtctgttagctcttgagtttctccaagattcatatcttgaaacccttcaccaccgctatgccagtttttttagccacatccacagtctctttcatgatttccttgattggctctgtcataaatcctacgaagtcatgtacaacatctggacacagtttgctcctgcagaaatctattgttttgggcttgatggctttcataagctttatctataacaactgtggcatcttcagtaatgtaatcctttcatattttcatcatgttctctttgttggggttctctttcataatgttgacttttttttttttttttttggagacagagtctcgctctgttgccaggctggagtgcagtggtgtgatcttggctcactgcaccctccgcctcctggttcaagcgattctcctgcctcagcctcccgagtagctgggactacaggtgcgcaccaccatgcccagctaatttttgtatttttaggaaagacgggttttcaccatgttggccaggatggtctcaatctcttgacctcgtgatccgcccgccttggcctcccaaagtgctgggattacaggcatgagccaccgtgcccagccgacggttctttacatgaagtaccatgtgtaataagccttacaggtccttctctgactgtgtggtctagagtatttgaatgtcttcagtgttgaactcatggggctctgggtagccaggggcattgtccaatatcagaagcactttaaaaggcagtccctttctggaaaagtacttcctgacttcaaggacaa

SEQ ID NO: 4505 - DNA, 1034 bp, Homo sapiens
gggagaggtgggtggaaggagtataatatgacccttagagcttcaccagtccagggattttaaaatcagtgtcttttctttaccacacagactgacattgagattacacgagaggaggacttcacccgaattctccagatggaggaagagtacatccagcagctctgtgaggacattatccaactgaagcccgatgtggtcatcactgaaaagggcatctcaggtgggactttgttactttttccagcctacctttgaggtagacgagggtgggtgatttgttttctcccctcatgtttggcaggggcgtaatagtgtcatggttaagagtactttgattataaaaccagttcagaacccagcttgacatctctactcttggatttgtagatttagctcagcactaccttatgcgggccaatatcacagccatccgcagagtccggaagacagacaataatcgcattgctaggtgagtaggccaggtaaaaacaagacttttcttcccgtgtgtttcctttttgtagttgcgtaacagtcatcattacctgaaaaggtttaataaaggatatagtaacaggtagaaataaccttggcttagctgcctgccctcttcagaagtcctctagtccaacagttatttactgcgtgagtctcatctgtactgcccctaaccattagtgagcagcttgtgcttagacatttgtaattgctaccttggtgggtgtccgttacatttctaaataactgcctatctaagaggttttctttaatgtcattatgatgatttttgaatgaacatttccagagtatcctaagtggcctggattatagcagaaccatcagtttcctcagctacatccttagctgcgatttatgcgattctagattgcattcactacttctgcactgatgtctgtgctcatagaccattctttttaatagacaaggtcttgctgtgttacctaggcctgtctcaaactcctgggctcaagcagtcatcctgttgtcagcctttccagtacctgaaacta

SEQ ID NO: 4506 - DNA, 1229 bp, Homo sapiens
tactttagaaacctgaaacactgggccgggcgtggtggctcatgcctgtaatcccagcactttgggaggccgaggcgggcggatcacgaggtcaggagatcgagaccatcctggctaacatggtgaaaccccatctctagtaaaatacaaaaaaaaaaattagccgggtgtggtggcgggcgcctgtagtcccagctacttgggagtctgaggcaggagaatggcgtgaacccgggaggcggagcttgcagtgagccgagattgcaccactgcactccagcctgagcgacagagcgagactccatctcaaaaaaaaaaaaaaacctgaaacactagctgtttgggaaagatgaacatctgggaaggaaattaagaaattgtctcttgattgtggattaaagtgcagttgtcttttgttcagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccaggtaaggttcttggccttgttccttaaagtagatgcaagaatctgactgcaaatatgaacaacagaaataaaacgtatgtttattgcatgccttctgggtgcatagtgtacactgactcttagaacaatcctttagaatagttggtattgatttcattttacagatgagggatctgaagctcaaacaagttaggttaattgcttgaggaatacagctagtattggccaaaatcaagatttgaacctggttgtgtttggcttgttttatacgatcatgctgcctttcctaatgcaccaggggaacataaggtaggagttaattcagctttgaagtactaaaggagaatttcagcttaatgcagtggctcacacctataattctagcactttgggaggctaaggcaggtggatggctcgagcccaggagttcaagaccagcctaggcaacatgtcgaatactgtctttatttaaaaaaaattaattgggcgtggtggcatgtgcctgtagtccccactacttgggaggctgaggtgagaggattgcttgaacccagaaggtcaagggtgcaaggagctgtgatcacgccactgaactccagcctgagcaacagtgagaccctgtctcaaaaaaaaaaaaaaaaaaattctagagggcagga

SEQ ID NO: 4507 - DNA, 1050 bp, Homo sapiens
taccgaaatcatcaagaaaaatgtgaaaaacataaccttaaatatactgcataaaggacacttttttttacagtgtgagagctaaaggccttgtttaacctcacctaggaatgtcattgggtgactcaaattttttgccattctgtgaatttccatgaatgactatgaaagtgtcatgaatgttgattttggggttacaaataataagaaatgaaatctttaggataatgaccctgggctatgtaagtttaaagactaatctttctacttcctataggatcataaagaattatttttcaaatcttggcctattgcctttattgtgtaaatgtcaagatgatagtaaaatttttatactagaaacactggttttaaaaaatctgattgcaaccaagtgtggtggctgacacctgtaatcccagcactttgggaggccaaggtgggcagatcacgaggtcaggagttcgagaccagcctgggcaacatggagagaccgcgtcactgtaaaaaataaaaatcggctggatgtggtggcacacacctgtagtcccagctactggggaggctgaggtcggtgaggcaggaggttgaggctgcagtgagccgtgtttgtgccactgcactccaacctgggcaacaaagcaagaccatgtctctttttttttttgagatggagtctcactcttgttgcccaggctggagtgcaatggcacaatctcggctcgccgcaacctccccctctcgggttcgagcgattctcctgccttagccttccaagtagctgggattacaggcatgggccaccatgcctggctaatttgtatttttagtagagacggcgtttcttcatgttggtcaggctggtgtcgaactcccgacctcaggtgatctgcccgcctctgcctcccaaagtgctgggataataggtgtaagccaccacgcctggcctgagagggactattttaaaataagggatgctaattttatttatttatttatttatttatttatgtttttgagacagagtcttgctctgtcgcccaggctgca

SEQ ID NO: 4508 - DNA, 3992 bp, Homo sapiens
ttcgccctcttctgtccatacttttcagtgttgccccagctccgtcccccactgaccgggccactgagccttccaatcatcgtcttcattttggaagcccagtgtcccgctttcctctcttctcttaacctgttcgcttctctgcacaaactcaaactggccttattctcgccgagcctctttccttgacgtgtgctcgtcttgggaagctctttcccactccgcgttctgtccctcagcccccacgcttcccccgcccctgcgccctttctagcctgattgtcgctatgtagctgcacgaataacgtttttttttgtttttttttcagttaggtctagctttatattcttggcccatcccttagtagcggtaatttaaatgtttcaatctgtattacggagttaacagtatttcctagtagaattgtgagaattaaatgaggtaagtcggtagactgcttaaagagggtctggtaaataggtaatatccttggtcactttacgttacatttattttcagtaacagtctcttgaacagcaatcccttttcccgaagtaaccgtacttgcctcactgatcttagatgtaatcgttccctccgtgtccccggcgttgtactctttcccactaaccagttgggttttcccagatttctcgactggtcaccttttccttttggaagatcccttattttttttctttttatattttgagacaaagtctcgctctgtcacccaggctgggttgcagtggcgcgatctctgttcactgcaacctctgcctcccaggttcaagcgatcctcctgccttagcctcccgagtagctgggagtacaggcgcgcgccaccacgcacggctaatttttgtatttttggtagagacggagtttcaccatgttgaccaggctggtctccaactgctgatgagctcaggtgatccgcccacctcggcctcccaaagtgctgagattacaggcgtgagccaccgcgcccggtcccttatttttttctgatgagcaccacctccattgtcttcctttggtatgtttccattctgtgtgtaacttctgtacctcatctgcagagcctggctagccatctcccctcccttaccgtcttctgtatactgactgcctttcagagttattattcattatctctgtacctgggaaataacttttaaggaaaaaaataaaataaaaacgctattttgaaaaaaaaaagccgccttctttctgatggattgtaggtccatgcaggtttttggttacagctccctgagatagatgtaaatcctaagcattgtgggtgttttggtttgatgggactggattgaaagatttacagacttaaattgtaaaggaaggtaatttagagagaggaaggaaataaacattatgttggtttggttataaccactggcttgtctccactgacatggcctgggggtgagtggtgtatttgcaaagctcctttcaggtctgcattaatctctggcattagttggctgtgaccgattagcctcccagttaaagtatgtagtcagttcttagtgatggtaaatgggttactgaggccttcttattacatccaattatgaggtgactatataatttatcttgcaaactgttgagtgtgttctaaacagtatgctgtgggggcgctatcactaattatgctggacctgttagagtatgatccccctatccaagcagaaaaatgtgaatccccaaactctttccctgcttacgcaaagcaatgaatggtcatttcttagggtcaccagccctttgagaatctgataatagttgtggatcctctttccggaaaaaaaaaaaattgcagtatctctcattttctcacataatctcagggagttcgctatcccactaaggcccattcatagatctcaggttatgaatccctgctgtaaatataggaatatttggttagaagaaaagtattaaccaagattccaaagttatttcttaatataccaaggattgaaatacagaaggaagttaacagccataaggacatatgtttacagttttttgagatatggttgacatataataaactgcacttatttaaagtgtagagtttgataagctttgctctgtggatataccatgaaacctgcattcttatttttcaaagacggggaaataaatagcttgtgtacgatggggcagtcctgggctgttgacttgtgtttttgtctattttaggccagaacacaaagcgtgaatccggaagaaaagttcaatctggaaacatcaatgctgccaaggtcacaaatcttttaagtgtttatggtagtttgcctccagctatctttcctggtatttggtcatagccatgtgtcctgtgcatctagactttatagagtaggcaaataggcagaggaaaagttgacctctttcagaacattttcctgatgatgttaggggaaaggaagccctccccttctgagttaggactgataatcttctcgtattaacttgtgcattattctgttgctgtgtattgttttatagtattctatttgtgtttgtctcccatactaaactgagttacttgaacataagtactttattcccttttgtattcctagtgcccaccgtagatcttggatagatattcggtaaatgtcttttgaatgaaatagtgaaatagccttatatctgatttaggatggtgtagaggccaccgtcatggaaagaaatactaagacatggacttctagtaattaggactgctgggaaacaagctctgggagccatttcccccttattcttgtgaaaagtcatttctgtatccattctgaaagcattcccaaggggagaaaaacaacagagctagccacatcctatatctaaagtggcatgctatgtctaaagtgatggctaaccatgctttaggggtgtcattaaaaacactgactctggctgggcggaatggctcacgcctctaatcccaacactttgggaggctgaggcaggtggatcacttgggcccaggggtttgagaccagcccgagcaacatggtgagaccccatatctaaaaataaaataaaattaaaataaaataaaacactgactctgtgggttgttcatgccccttttccctattactccaacatttctcacactgtcctctgatttgtgcttgcgtattttatgttccctttccattagactattgcagatatcatccgaacatgtttgggacccaagtccatgatgaaggtaggcttatctcttcctaaaactcttaggctacaatttttttcttcctgttatctaggacactttaaatataacttttgctttcatcttagatgcttttggacccaatgggaggcattgtgatgaccaatgatggcaatgccattcttcgagaggtgtgttttgtttttggttttgtttttttgctttctgacagttctgtaaacataaaggacctgttaagatacaggctctgattagttttttagggctgctataacagattaccagaaactggttggcttcaacaacagaaatttattatcttatagaatgaagctagaagtctgaaataaaggcgtcagtagggccatgctccttctgaagtctctagggaagaactccgcttctcccttctgatggttgctggctttctttggcatgaacttggtctctgccttggtcttcatgttattccccttgtgtgtctcttacacaaggacaccggtgattggtcttcgagcccaccctaattcagaatgaccttatctaacttggttacatctgcaaaaaccctattttaaaataaagtaaaattcacaggttctgggagttatgacttcaacatatcttttttttttttttttttgagacggagtctcgctcttgtcacccaggctggagtacagtgatgtgatctcggctcactgcagcctccgcctcatgggttcaagcaattcttctgcctcagcctcctgatta

SEQ ID NO: 4509 - DNA, 1081 bp, Homo sapiens
gcactccagtctgggcaacagagcgagactctgtctcaaaaaagaaaagaaaagaaatagttgatcctagggcccgtttctgcccttgctctgcttttttaataagcatttcaaaactcctgaccaacgttaggagactagagccaagcacagatccccctctagagagatttaaaggtaatagagtcctggggtcctgtcttagctctgccgctggctttctccatgacttggagcctgttcctcaaacttgaggctgcagttgcctcatttgtaaagtaataatagataaatcttttgattattttctatgaaccagatactgttctacatgctttttgtgtattaacttgctcagtcctcacaacagctgtgtgatgtaggtaggattattacctccagtttataggcagagtaagtaacttacccaaggtcacatggcctaagtggaggtagcctggaagtttgacctcatagctcatgcctttaaccttattgctatattgcagagataatactgtcttccctgcataaaaacaaagggctggagcaaatgactccctgagtaatagcatactggtggggtattgggatgattgaggggtgcgttccctatcacagcactcccactaccacagtacagcctcagggaggacattttctttctttctttctttcttttttttttttttgaaacagagtctcgctctgttgcccaggctggagtgcagtggtgcgatctccactcattgcagcctccacctcccaggttcaagcaattctcctgcctcaacctccctagtagctgggattacaggtgcgcgccaccgcctggctaattttttgtatttttaatagagatggggtttcaccatgttggccaggctaatcttgaactagggaggacattttctaaactgtcccaaacaggatacagcatgaaacaatagtgctgtgtaaatcatgaaacattcagtgattctatttattctgtgacagtgcaaccatcagtttcttctttaaggtagacattttatgacgtaatgaacaccccctcatggggagatctgctggaaccttg

SEQ ID NO: 4510 - DNA, 1074 bp, Homo sapiens
aaaggcacatgtcagtgttcacagatgtccacccgcttgtggccacggggtcacacccgccccaggacttagtctggctgtcccagctcccacggccctgcctgggaatgaatttccttcctgtggtttcccagtgtgttgggcaggagatgggggtggggtaggactattgtgggagtggctgaggacctctttatacggggtgattgggggacactggagcttatatggagctccttccccacttgccccagcataggcatttggacctttgggtctcagtgattatattctctttgttgtaactcccctgcccccgccaacacaccctgtatgtttgcatatgtgtgtatatgtatgtgtgtgcatgtacatttgtaaagggagaggtctctggtctctctggggggaagggggggaggggggaagggaggaagggaggagcttttactcacccctgtagggacccaaaaggttgagttttttacctgagatcacacagcaaatctgtgtcagagctttcgtctttccactcttttaggcacaacttcatagtagggagggattctgggaagggagacatacagtccgtgttcatggaagccccagtccaagggaagaagcaggacccagagagcctcatgatccttgtgttgggggatgggcatggggaattggctagagcttctgtctgctgtactcaatgcctgaaagattggtggaggacttggaggggtggcaggtgctgtccgtgtccaccccactctgtgcttggtgcccctgggctggagggcctgggcatcctggctctgcccccttggctcctggttcttctcataggctgggagatatgatagtctttctggctgctgttatataatctctctgtagcagggttttttttttttttttttttttttttaatctttcctgggagatgtgatagggaagagaagccagagggagactcttcaggttggggggagctaaaggagcagtagtaaggaagcttggagtgggaggtgccttggcccccgaggaggccttggggataggccctcattgattatggcc

SEQ ID NO: 4511 - DNA, 1029 bp, Homo sapiens
gctgggaggagcttgcctgcctggccacagacagtgtatcttctaattggctaaagtgggccttgcccagagtccagctgtgtggcttttatcatgcatgacaaacccctggctttcctgccagatggtaggacatggaccttgacctgggaaagccattactcttgtgtctgctactgccctcccacagtcaccccaatattacaagcactgccccagcggcttgatttcccctctgccttccttctctctgcactcccacaaagccagggccaggctccccatccctacctcccactgcatcagcagtgggtgttcctgcccttcctgagtctaggcagctctgctgctgtgatctgcacaccctccaacctgggcagggactggggggatgcagtgtgtgttagtgcccatgtggcattgtggcactgttgccccccatggcggcatgggcaagatgaccttccattagcttcaagtcttgttctcttgtctgtggtctgtttaatatgtgggtcactagggtatttattctttctcccatccttacactctggatcattgtgcagacttaatcagggttttaacgctttcatttttttttttttttttttttttttgagctcaaagagagttctcattttccctattcaaactaatacccatgccgtgttttttaccttggatttaaagtcaccttaggttggggcaacagattctcactcatgtttaagatcttgttatttcagcttcataagatcaaagaggagtctttcccttttctcttttaccctcaggattctcatcccttacagctgactcttccaggcaatttccatagatctgcagtcctgcctctgccacagtctctctgttgtccccacatctacccaacttcctgtactgttgcccttctgatgttaataaaagcagctgttactcccacatctgttgttaacccttatttcattttctgtagagccggcctttaagttctggaacacagctccctgagagaactggggaatc

SEQ ID NO: 4512 - DNA, 1122 bp, Homo sapiens
actaagaccaccttctatgaggagcagggtgactactacagccagtacatccgggcctgcctggaccacctggcccccgactccaagtaggtgctgctttcccgtacttggaaggttacgagtgacttctcacccctgcccatgtcacctttgccctgctatctcccagctttgaaaggggaatctcacccagcacagcacagtcccttcctaagtctggtctttgagcctcatttacaaagtcttgggctcaagtgcagcccccctcctctgtcttccatcagtgagaagtcttcctcggggtctcatttcctttccagccacagaaaacaagtttctttggtggtaaagtgtttattggatgaattctctggggccttcttttaatcaggagttctgggaaggggaagaagcagccttctcttcattacactgctgctcagctcctggaaaagggtgtcttggtggaaattgaagatcttcccgcctctcagtatgtgtctttggagggcaggatgtcagccccttcctgtcctctaacctgggggtggagctctgggctgggcaccgggtggaagagaagaagcatggtcccgatcttgaaggagctgctagaatgatggtggagacagagcatgcccagacagaaagtgaagggctgtggacatggtctagcacagttctagatgccctgaggcagagggtactgggaaagctttccagaggtgagaacagctgcgtagggcggggcagataaagagatggtgtggggagcagaagtaaaatggagaagacagcgagctgggccctctgggagtgacagagggaaaactggttctggatgacaccgctgcccaggatgaggagcagtgggtgcaagaatgtggctgtagccctggaaagaggcagtgggttcctgttttgaatcctgttcctgacagcttcagaaacgtcatctttgacatcacgccgggagatgaggcaggaaagtttgaagtaaatgccaagttcctgggtgtggacatggagcgatttcagcttcactatcaggtgaggggacagtcccatgagcctgcaggacatctgctgggctttaggtgctggcctgaagagagcagctgg

SEQ ID NO: 4513 - DNA, 1035 bp, Homo sapiens
tctttattttttattattattatttttaagacagggtctcactccattgcccaggctggaatgcccagggcaagatgaggatgttgaaagggggaacccacagagtttataaccctgctccccaaacctggagaaccggattaagagtttacaattaggagtaagaaaagattgttctaggcttaagaaagtaaagtacacaatgagctgtaaacttctgtctctggtaccctaggagtggaaattgcttttaaatgaatttaattacatttgtaggtggcacatccataataggaataataatgataatacagtctagcacatttgaatagtactctaccattatacgttactctcgcagacataatttcacttgatcctcaaaaagccctgtgagaagagaaggcaagaatgatcattcccattttctagaccaggggacagacttacaaaggagaaggaaatagtctaagataatatctctggttggtggtggagtccaaactggagcttctcctcccggctcactgatctccttggggccctacctctagcccagactaggccactcacagatgctctgtgacagctgacaaggttgactacctcggagccacctaggctgtcctaggacagggttttggctgtgagtgtcagatacccaagctttaggttaatggtgcctctgggggatgggggatggctatggtgagctggggtgctctgcaggggacccagagagtctcaaagaagaggttctcgagccaggttggaggctgtgtgagagatttagtagatgatagggccctggtcctgactactgacataaggcaggaggaagggacaaggcccagagacgtttggaggaaggcagcagggagctggctatggctagtggagggacagtgcttgagctctactctggagtggctgagcctgggggagaagagacagccaggcactcaagctcttatctctggcagagagagatgggcagaggcacagccacgcgcacctgtttctttgtccccaggt

SEQ ID NO: 4514 - DNA, 1118 bp, Homo sapiens
tcccagctctaccacctcttagctgtgtgaccctggcaagttacttaccctctctccctcagtttcctcactggtccctcagtcttttcatctgaaaatggggataacgatagcacctaccttatagagttgttatgaggattaagttaggtaatatctcaagtgtttataaattgtgcctgggaggtaggtaagaacatgttagaagttaccatgctatttatatcattatcgtcactatccagagagtgagagctgcttcttagcttccccaagggaagagtgaaataagatttagctgggcgcagtggctcatgcctgtgattccagccactcagaaggctgaggtgggaggattgcatgacagggtctcactctgtcacccaggctagagggcagtgtactggctgaaatgagctataatgacaccactgcactccagcatgggcaacagagcgagaccctgtctctaaaaatgtgtgtgtgtctgtgtgtgtgtgtgtgtgtgtgtgtgtgtgtgtgtgtctgtgtgtctgtgtctgtgtgtctgtgtgtttagtaagacatcaaggctaggacactaggagggctcgaagaagtggtggtggttaaacagaaaaggggtggaatatcctttaggaagagaatagccttctacctttcctctcctaccagcccttcccatttttattcttccaacccgtggatggtccagtgtggcctctgagactgacccataagtaattgagacatgaggctggtagggaagatagccagagacactgtgcaagcaagccaggaatgatggcaattgagcagataccttcccaggcagatgtgatctggagggcctcgtggaggtgctggcaatgtaagatgctttcacaaacttctttgaatgccaagagcatgccacttggcactaagcaagggtgggagatgggtgcaaggcccacgggtgagtaatcacttctctcccctcacagaaattggagtacacttgatgtcagacattgtgataggagggacatgaagacaacaccagaggacaccaagggagacagatgtgcagatcaggactggcaaatggcccttgattatgactgagggtgttgggg

SEQ ID NO: 4515 - DNA, 1029 bp, Homo sapiens
attggcctgagaaggtgtgcaatgaggcataggggagtggggcgtgggggcaggtagttggagcctccagcgtaggctatccctggacatggctgaggcataagagcagggaattgagctgttgagaaggtggtggatgctgagggtttgaggagctatgcagagcctctgtggttctggaggtgctgtggccaagccgagtagacctgaaagcccaataggataagagagccttctgagcctggccgcgtcccagggaaccacatgccacacatgcccacacacagggcagagagctgagtggagatcactgtccctgtggctcccaatgcctgcctgcagtttggttcccttgggcatcttggcctgggaacctagagagactagcttggggtcacatcttttttttctccctcaatctgccaggtgacaggggatcctggagctgtgctgtggcttgaggagatccgccagggagtggtcagagccaaccaggacactaatacagctcagagaagtaaatggactggttgggggaccctgggaggggagggatggtgatgtgggctcagcagcagcccagataatcaggcagcctccctggtcaccaccctctcccttcaacctctgtggggaggcaggccagagtcagagcaggagggctgctgttcagactgcaggatggatttcctggcagtcagcagggcaggacattctcaggaggtgagaatccatagttcacctgctgcctccctctatgccttcctgtgaacactttccctgtaatgtgggcatgtgagatcatgcggtagtcagaaatcccatttctgctggtagcttgagtttgggttccaacagtcaatcagctctggctagaaaatgtttagacttggaatgagagaagaggaattggcaggagtttgaggaaaacaggcagactcagtgcaaatagacaggggtgtgctgatgtttggtgctggtggtgttagttctcagtggctggggtctccctgtccatctgtctgtctg

SEQ ID NO: 4516 - DNA, 1044 bp, Homo sapiens
cctggctaattttttaattttttgtagagataggatctctgtacgttgcccaggctggtcttgaactcctgggctcaaactgtcctcccatcttggcctcccaaagtgttggaattacaggcatgagccaccgtgcccagcgatctgatctacttaatgggatctttctggctgctgtgctgagaactgactgcaggagtacaaggggaaagcagggagacctgttagacagctattggagtaatccaggcaagagatgatgggggcttggccttgggcggtagcggagatgggaaaaaggagtcagattttggatacattttgaaagcaaactgacaggatttggtcatataatagatatggggtagaagagagaacagaattaggtatgactccaagatttggggcaagatgggagagacggtgggacatgcaggttaagcaggggaaccagttcagatgtgagctgttgggtttgaggtgcttgttagacattcacttggaaatcacaaggagctggctgggataaatgaatgggctggaggtgtgctttcgggagcatatggtgttaaagtcatgagattgggtgagatcatctacaatgtaagtatggagagagaagaggtctgaagactgaagattgggatgctcccatgtttagatgtcagggaggaaccagcagaggtgtctcagaaagaatagcctgtgaggcaagaagagaactaaaagagtgtggtgtcctggaggtcaagtgaagaaaatcgttcaactgtttcccctgacttctggctgatgattcacatgctactcacctctctgcccttcaccccactgccagttacttcgatgccctgctgaaattgcgacaggagcgtgggatgggtgaggacttcctgagctggaatgacctgcaggccaccgtgagccaggtcaatgcacagacccaggaagagactgaccgtaagtatagtctggagctgggtggagatggcccaacttaggcagtcctgtcccttagccattaagtctaggggccccctgccc

SEQ ID NO: 4517 - DNA, 1083 bp, Homo sapiens
ctttcaatggagtttttgcaggatgacagagaaagccaggacatctatgaccactacctaactcaggctgaaatccagggcaatatcaaccatgtcaacggtaagagacctcgagcaggagtggtttgggggtgacctcagggtaagcccctgcactgggaggtttggggatagcttttctcaagccagaaagccctatggtctcatttgggccaactcttgcctcggagaaagatcagagtccaaggagtatgtgcactgctttctggccatcggtgtctagagaagtagtccatgtccgggaagcttctgtctgactggagaaccatagagaggagcagctcttgatgccgggggggcagttggactggggtccttcgagaggggcaatgtggagaatacatgaggatggggggatctgggtaggagccgtgtgaaggctcaggatgggtgggcatttgcctatttgggtgaggatatccttggggtctggggcggcgaagtgagaaggctgtgaagaccaagctgaagaatttgggctgaaccaaatgggcccaggaaccaagggggaaagggtgggggtaattccgggcaggcaagaagagggtagattcctagggctggactaggggattatgagaggtggctttctcacactgtccattatggagtcattttttttcagtccatggggctctagaagttgttgatgatgccctggaaagacagagccctgaagccttgctcaaggcccttcaagaccctgccctggccctgcgaggggtgaggagagactttgctgactggtacctggagcagctgaactcagacagagagcagaaggcacaggttagcctctgtctattacctgccaccccctgtatgtgactataggataggagagggcctcttactcaaagatcaccactgttggtcctttgtattctgtaagtgctgactacgtgtttaaatggttaaatcaccccaaggcctagtagaccagattgatcagcttctgtccctgagagtcccccaggctgaccaagaggaacccaaggacagtcccataggcagtaatgtgct

SEQ ID NO: 4518 - DNA, 1065 bp, Homo sapiens
ctgttttagagagagagactggagctggaaggatgggtggggcagaaaggttctatctgattttctgaatgaaaggaaaacctgctccttccaccactcccttcctttctattaggattcaaagagcaaagtccatgtccagtcttctgttaaaggaaaactagttccagacctgagaaggacaggaaaactgtttttcggttttttatttttttgagacagcatgtgtatgtacaaaatccctcccatcgcccacagtcctcagttcataactctgagatgatgtcattcacttactggtttattttccatgcttaacaaccaacacttgttccttgtacacccccttggaggaactgatggctttcctgtggttggccagtgttttcaaatctgtatttggaggggtgtgtgtgtgtgtgcacgcatgtgttttaatttacttaactgctcattcatataagctctgcccttccctgaatcattgcagaatatgcaatataaggaaataggataacaaccgggaatgacattaagtgctgagtcaaagacagattggctaagctctgccttttttcaagctctctgagtttattttcttactgtgtgtgtagctttctcttactctttctgtttgattttgtattgtgtttctaaggagaatagagagaggggagagaagggagaaggattaagggagactgtaactaaggcaaattatgattgctgtctcacttgagggattctctattcttgagttttggaatcagtactctgtattttatttagcttgaagattcttttcctcctcgggtgacctataccaaaaaggatagtgaagatacctttgtgatcttttaaaattttctttgtccttccacttaatcccaagtgagtggcatgtttccctctgttggactgcctttccctgtgttccgcctatttattccttaagatctagttcatagctagaatcctttgcttcctctgctgctcccatagattttatgcatgggctataatcatacttatcatgttagattaatttattcagatgtttttctc

SEQ ID NO: 4519 - DNA, 1044 bp, Homo sapiens
ggttggaggataaactggaagtggggaaggagagaagtgggtgtggactgctctttcttggttctggagggagcaggtgacggtcgctataggagcagaggcctgaagatactgagggatagagccagtggatcataatgtggctgggcaaggggcaggtgaatgaatgctacagtagatcgtgaaagtgcagacaggagggatcccaagcttagccttggccagcagtaaggacaccttatcttctgggaaagaaaggaaagaggaaagggtaagggcagataaatatgtttctgagtggtggtggaataaagtgattatcacctagagaccttgacctcattcagttggaggcagagtggtctgctgagtgaggggaaagccaatgggtcatgaacttgaaaagaataaagacagcttggagagggcttcaagaagaacaggagagtgagctgaccaagaacttaaggaagggctgccgaacaatgttgagttcctgatttgtcagaaactgaatttgcaggggcactgcaagctggttgtgattttttttttcttttaaaaaaaggatcacttagcagcccaaatgtagaaagggagagtttacatggttgggctgtgtaggctacaatggaaggacgggatgtgggtccagaggccagtgtcaaacaggatggagacaaagtagttggcatccatgttgagtaagcattgaaggtgcattggtggctgcaggattagaagcagagaaagattgggagctgagctagacatgcagtgacctgagctgcgcagatgcagcaaaggaggagaagacacaatgagcacatggcatgagccttaaagaatttgggggaggccgggcgtggtggctcacacctgtaatcccagcactttgggaggctgaggcgggcggatcatgaggtcaggagttcgagaccagcctgaccaacatggtgaaacccccgtctctactaaaaatacaaaaattagccaggtgtggtggcgtgcgcctgtaatcccagccactcgggaggctgaggc

SEQ ID NO: 4520 - DNA, 1048 bp, Homo sapiens
aactccgcctcccaggttcacgccactgtcctgcctcagcctcccgagtagctgggactacaggtgcccaccaccacgcccggctaattttttgtatttttagtagagacggggttccaccgtattagccaggatggtcttgatcttctgacctcgtgatccgcctgcctcggcctcccaaagcgctgggattacaggcatgagccaccacgcccagcctagaaaccccatctctactgaaaatacaaaattagtcgggcatgatggcacacgcctgtaatctcagctacccaggaggctgaggcaggataatcgcttgaatccgggaggcggaggatgcagtgagttgagatcacatcattgcactccagcctgggcaacaagagcacaactccgtttcaaaaaaaaaaaaaaaaaaaaaaaaaaaaaggttgacttgatatttctgaatgaggttgagtagacagtagtggtgccactcaccaacatagagaatatgctggagagaactgcaggttttgaagatgtgttggatattctattgggttgactttgagctgtctgaagatatccagttagcagccggataactagactggagcttagcatagcaaagagatctggggctagaaactaaggctcaaagacaacagggtagcagggggatggaagacttggattgggaggaggccttccaggaaaggtatataaagaagaccagcaggttggcctggtgcagtagcttacacctgtaatcccagcactttgggaggatgaggcgggcagatcacttgaagtcaagagttgaagaccagcctggctaacatggtgaagctctgtctccactaaaaacacaaataagctgggcatggtggtgcacacctgtaatcccagctattcaggaggctgaggcagaaggatcatttgaacccggggggcagaggttgcagtgagctgagatggcaccactgaactccagcctgggtgacagaatgagactccatccatctcaaaaaagaagaagaagaaggagaaggagaagagaaga

SEQ ID NO: 4521 - DNA, 1076 bp, Homo sapiens
ttataaagtgttttaataatttggttgtcttttttaccttgctaaaccaagcctctaaaaactcaaattattcccttgataaatttttataatggaaaagcaattatgtacagtttcttctttatgttaaatagctctatcacaaagtattgtggagctgtagttttcttaggggatttccaggttcactggatgacactaactggggcccttcctggaagtcatagaactgaccaagcctttgtgcgtaacccacgtgacacatatggttccttgtcctcatccctaccacacatcagagctgagcatggcagctcacgcctgtaatcccagctacccgggaggctaaggcatgatgattccttgagcccaggaatttaaatccagcccaggcaaaatagaccccatctcaattttaaaaaaaaggaatgagcacacctaaaatgacaccccaagccatgcaactccccctgacacacacagggtatgtgaccaggagagtgagatagagagagtgggcatgaaggaggggcagagcaggggagaaagggtgcttggtgatgacagcctggtcctgctgccagcttttggtggtacacaccccatcttgggaaagagtcaccagtctgaccttgtgtccaggatcattatctgcactttcttgagagaatgcagactccatgtctacacaaggacttttgcattcttgagtggctggtctggttccaggggccagagtcacggtcacagctgcctatagaagtgaatttcgtgcagccagaccagacccagacatggtcttgttgaggcctgcactgtggggtctgttgcacaggcagccattgtgctctgagcaaattggttcctgtggggcccaacatatttaatgtccatgacttcacaaaggggtgccaggtatccttgcacagcaagaactaagaatagtgcaaggaggccgcaacagaaactggtaagaatacacacatgcaagcgattcttaactacattgtaatcagtaaatgaagataacgacaatattctcattagggtacttactggctgaaacaaaactaact

SEQ ID NO: 4522 - DNA, 1100 bp, Homo sapiens
tgtcaggagaaagggcttgatttggaaaaaccttgcgagttggagcctaagcttgagagaggaaaggtggagagctcgtcccaagcaaaaagtagcctggggcaagtgcggaaagtggtggtggtaagagagggcagaaagttgacaggaggagctggggtatatattgtccaactggaacaggtaaccagtgaacggcataaacggcacagggccggcacttcgggttgtcatctcactcctagccctgtgctggccatggagcgcaaggcatgaacggaaaggagagtgagctgggaggggtgaaagaggaagtgaagggagagcaagagacctgctggtctcaggaggccgccagagggcgcccttggtccacgtctttgcagtttcaggtccacactctgccctctctggacacgctgttcccataatgccttatatgcggtcagttggaggaggttcgttagaggtgaggtgactgactattttagaaaagacggaaagaagagttaaacatcttgtgcacaaaggggcgcagccaagcaaaggcataggagaggcagaagatgggacgggtctgagacagcaaatctgcccagctttgatgagggctatatgtcgaggttaataagaagtgaaggtggtggtggacagtaagtaggtgaagtcaggagtaacgaaatatctagttcacgggactacgtctggttttcatcataaagcacttccccagtgccaagctggggttatgagactaaggtatgtccagatgagcctagccccttcagagggggtccctttgggaggctatgcaggactgtcacttttgttgaaaacctgtttggaacctcatttgggaatggccttcagagcctgtggtgtgttcttcggttgtcctcattggtagcatgtcctcctacttcaagagcctgaaatggctaggtgtggtgacatgtgtctgtaatcccagctactcaggagtttgaggtgagagcattgcttgagcccaggagtttgaggccagccaacctgggaaaaatagcaagacctcatctcttttaaaaaataagttacctgaaggccaggtgtggtggctcaca

SEQ ID NO: 4523 - DNA, 1070 bp, Homo sapiens
tttacaaatgagactcaaacctagagcgcggtaatgaccttactaagaccaaatggctggtgaattgggcttcactagaatccaggcttgctggctaacaccaatgctccctccatcatttcatgttatgttttcatttcccctctgtctgagagattgctctgatgtctttccttccataagtcctacggagatcgagcttacctcatttttctcccaggcctaggagctcaattaccaggatcactttcttccccagggtgtactacagacctccacatgttggacagtaggattcagcagagaatgagtcccacatcctcttttcatccataagccactcttcccaactactcttccgccttccattgtccctatgtctactttactgctcaatctggattttggggaacctcctcccaaaaaggcattagaaggaaatgccaagcaccgaaattttgtcaagaagcggaggctcttagaacggagaggctttctgagtaaaaagaaccaaccccctagcaaggcgcctaagttgcactctgaaccttcaaagaaaggggaaactcctacggtcgatggcacttggaagaccccttccttcccaaaaaagaagacagctgcttccagcaatgggtcaggacagcccctggacaagaaagctgcagtgtcttggttgacccctgccccttcaaaaaaggctgattctgttgctgctaaagtagatttgctgggggagttccagagtgcccttccaaagatcaatagccacccaacccgctctcagaagaagagctcccagaagaaatcctctaaaaagaaccatcctcagaagaatgccccacagaactccacccaagctcattcagagaataaatgctccggagcatcccagaagttgccacggaagatggtggcaattgactgtgagatggtgggcacaggaccaaaggggcatgttagttccttggctcgatgtagcattgtcaactacaacggagatgtgctttatgacgagtacattcttcccccctgccacattgtggactaccgaaccaggtggagtggta

SEQ ID NO: 4524 - DNA, 1065 bp, Homo sapiens
ggaagatgctgaggccccaggcatcagagatcatgagaggtgagtgagccccctgaccccttggcagctggactaggggggaccggccactctcggagaagaggatgaaaagggcctgcagtggtcagcctctcgggaggcagggtgggctctcctaggagaccggcactggctggggcaaggccaggccaaggccacaccattaacccttctcccctccaaccctccctcacagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacag

SEQ ID NO: 4525 - DNA, 1030 bp, Homo sapiens
taatggcggagctgaggctataaggatgatcaggagtgagtgagtattagagactgcaagaaccatggtcagagcagaaaagacagtgtactgggagaggctgatgaaagcaaagacgtgtaggatgtaccacatgccaagttatggtcatttcatcctcacagccctatagctttagtactatgactgtctcccttttacagatgaggaaactgaggcagagagatgttcagtaagttgcacaaagtcatacaagtgggggcagagttgggattcagatcttgccattgtgcagaaggggtgaacaggtgggttctagagtccttaaaaggtattgaagggttttgaagcaaggggacgaaatccttggaccaacattcccaaaggcccactctggctgcattgtggagaatagattgtggagaatggagaaggtgatggcaaagtcagggggctttgtggccagacatgttgggaggcagaatgggtgctgtctggctggtgacggagagggaaggattcctgggtttctgttgggctttcatgtctgacttcatttgaataaagtgtcactgctaaaaatggcccaaaagccatcttgctgactatcctgggtccctctcagtctgattttatataaatgtgccttggaggtcagcacccctgcctcaggctcaaaacctcaggactctagctaacctcaccccctcatctcaccccagattgacgagatgcctgaggctgccgtgaaatcaacagccaacaaataccaagtcttttttttcgggacccacgagacgtgagtggaggccaaaggggtataggtcgggagggccccgggaggactactctggggaaggtgaggtggtgttggtgcccctttcatgccgggctgtgcagctcaggggcagtgaggggcttgagagcacagtctcccatctctcaccagggcattcctgggccccaaagacctcttcccttacgaggaatccaaggagaagtttggcaagcccaacaagaggaaagggtt

SEQ ID NO: 4526 - DNA, 1060 bp, Homo sapiens
gtgtgtgcttagccttccctgctgccttcctaagtgctgggtctgtttttagtctgaggctgggggagaggtgttcagttctctttccccactctacctgaaaacttcggattactctttggacctcagagggtgtctgtggcttgggaggctggtgtttcatgtgctcaggcctgtctgatggaatcgggcaaatgcaaggcctaagaataagtaacttgcctggatctggaatggttaagaggtagccgagttcccctattgctggctagtggagggggtaccgtggggtccccagcactatttggccccaccctgacccagttagccttgactcacttgttttgagtcacagcctggatacaaaggcaccacctggaagacagatgtctgtattggggtacagggctgccctgagacctcataacctctacatctaggaagaactgccctccacttccaaatgtaagaaaggacattttctttgtagcttgagggatagaggtgtcactgtagaagggatttctcctcttttgggtgaagggttagaaattccatcaagtgagaagagcacacctcccctggcccttccccacaagtgcctatactctaggtgagggagccaggtgggatgatgctttggggggagatgcctatctgctcaggcccctgtcttcctctctcttccctctagacccatcctttatgtagctagaagtcagcagggctggcatatctggtgtgcctcatgctatttttaatcccattcgttcttttgtttctcccccactgctggggctgggcagctggtggcctcctgggtcccctgccacaccattcagctatctgcctctgagtgtgctttccatgggaagctggggtggcacgagacggtggccaggtagccactttgcagtctgtgcttctgcaaagaacctcatttctccttatttctgaactttcacccacacacaccctcttatgaagcctcagtttctcctcttccatcacgcatttactgtgggcatcttaatgccctggctcaggtgtgggcactgaa

SEQ ID NO: 4527 - DNA, 1029 bp, Homo sapiens
tagccccggcagaaactcatggctacggctgatttccaccgaacaaggcgtacctcttcacttaagctcctagtcccgggcaactacacacagctaatggccgccgagtcactccgcctcctccttgcctcaccaatacaggaactacaacttccagagaacactttggacacagcccggttctttgccgcagggatctcagcgcaaggcacggcgggagttggagtccgaggaaggatttaggggcgagcaaagggagacaggagagaaacccgcctctgacgcagggacacctggggtgagtagtttttttcgtcgcctaacaattccgaggtgactacaagccccaccggtcaccacggcagtcactgagacggacaggagagcatttcggtacttgaagttccctagggtagccccttggccactaagatttctgggagatatgatgctcttagaaactgcaagtgatgtcgggaacgaaagggagtctgggaagctggcggattgaggaaaattgcttaaaggcaaagtgatctgtaaatgaactggtgaagcttcccagtcggctgggactgggaattagaataaaacatcccaaaaagagcaagggcccaagggacccgtacgaaattgggctgcaagccagaaagaagcgaggctgcaggtctaataataagcatctaagagttgaaataaatgtgacgtaaaagggaggaggtgatctccctcaccaggatcggggtgcacatccaggaacacaccttaccctggagcctggggcctggcctccctctgcagcaaccagtgagacaaagatgggcaaggctctgacaatccgggccaggtacttgaggttaatcccttctcagctcagtggggtaaagggcgaccgttctgaggaatcacttgagtccgtcctacctggctgtgcctcccacctatccatttgcagatgtcctttacattcctttacgtctgtgagtgctgcttcttatggctttgtatgtgactttcttacatctgtct

SEQ ID NO: 4528 - DNA, 1052 bp, Homo sapiens
aggcaagctcagagcactgtgggagcacggaaaaggccaggccaggaagggcctcctgtgaacgcacatgatattgtcagatgaagacgggaaaggtgttctaggcaaagaaagcaggtgcaaaggctctggaagcgtgaaacagtatgtcgcattcagattttactaagtgtttcccaacacctagagcaatgaggagaatggattggagggaagtaacaatgacggcatgatgaaaagaaattgcagtagtcctagtacaatcagcagcctgatcaagacagaggcagagatgaaaaatggaaactgaaaggcaaccccaatctcttcctccctctgaacgtcctcttttgtaagattttgtcttgagtgccagagaagactcctgaaaggagaggggcccttccctgcctagggtgtgcagggagtcttccaatggaagagaaaaataaagagaggcggatgctcaggcagctgacagaacggagggatgagggaccataagagcactgaaggcagcccaggaagatttccaatgcaagcagcaagttggtccaggttgtaagggggcagagaagatccaggggcaaaagagagagggtctgaagaaggacccatgcacagggtagcgtggggcagtgccatgaccataaaaatgccctgccttcctcagggagctgctgagaggggcaaaaaagaagacgcattgttcctatgcaacagtccaagcaagtgatggaggtggtgatgaggaactgagggcctctgtgcctctgggcctctggggaagtagcctggctgagttgagacagcagatccaaagtgtgggctactaatagacaaggaaaaatagaaggggtctgctcttgttattcccacagaagcccaaggtgagatgggagggggtttcaggtgaggttgggacaggagtggaggacaaatttgaaggcaaatggctgctgccacagcatggggctggagaccacattccaggaggggctggggtgagacgtctcaggcaagcctggaatcccaggggtgtgccccctgcc

SEQ ID NO: 4529 - DNA, 1047 bp, Homo sapiens
tctgtgtctcctgctgtctaggaggctgagagccaccctcagtgtcggcggctgcagctgagagacctcatcatctctgagatgcagcggctcaccaagtacccgctgctgctggagagcatcatcaagcacacagagggtagcacctggggaggggctggcatcacaggcagtgggcctcgtgccagaccctcattctgacactgctttgtgaccttagcaagtcactgtgccttgtggtctttggtgtcttcgtcctttttctgttgtggggtgtttcagagaagaaaatgattgtaaatgtcctttggaaaatataaggtgtttaatagtgggaggagtaggggccaccatcgaaggccacctgtgtgggcctttgtgcaaatccaaggaaagcatccggtgcccaacacaggctggcactcaagggcacctgggtccctctggttgcatggggctggattttatccccattcatgccccctgcagtgcacaaaagacacagcctatgtggttacactagaggggcaggggaccagactgaacaagagggtctagcctcaggttatcactctccctgggatcctgggcatctttcactacccccaaatttcagacattggagtcaggacagagaggtgttaggaaccccaatctgatttgaacaggctttctagaggcataattgtggccatttaccacagtctctgtcccttgcatctgtagagctggttgtagtagaggcagggattcccaggagctatcagcgtcttcaaagcagtgatctgtctgagacctgaagatgctcagtaaaagttacccttaccacttggggtcctcatgtgaggcaagggtggctcccctccacccacgcctgctggtttgaagcaagccagctgccatggatgaataggcagataacagctggcgccatgttggacttctcaggcaggagccccaaccatctcttctgtccattttggtaggtggcacctctgagcatgagaagctgtgccgggcccgggaccagtgccgggagattctcaa

SEQ ID NO: 4530 - DNA, 1053 bp, Homo sapiens
tgaaaagaaactaactttcttacaatatgagccagtattatttaatgccatgtccagatagcacctaaaatcattttgaccctcaacaaaaatcatctcacttaaaatccttatagttccacttcccatgctggaaaacactggtgtcaggagttaaacaggtggtattttcaaactgtgggttgtcatcttttggggagtcatagtttcagtattgaaggtcatgagcagcatctgttttaatgaagtagaatctaatagcatggaaaagaaaataacagaattcatcacatgtaataaaagtattttgtgaaacttctgttttaattacatatgtgtgtgctgagttgcagtgaaagcatatttattagaagtcatggtcaacagaaagtttgaaagctactttctggagttcttttgactctgggagcctgttaatcactgagtccaggaggaggtcttcagaagatggggtctctaaagtaatttggataatgagggagaaatggtacaaggaagaaaacagagcaaacgataatcctactcactgagctctctttggtggtgttgtgattttagtaaacttgtcctctcaccttggagttcagggttccaagcagcatcttttttctcttagagcatttatccctctgctgttacttccctatgtggcttacctcaactttatatgctttatctctgtaggcacctggcacatagtagccaccttcataatgtgtagtgaatgaatgactgaatgggagtaatcaaaattgtcttctgagtggcatcttaggggaggacttatccaggacacagagctcttaagtttcttgaagctgaagtttcacagtgtgatctgtagaagagaggatcatggcctaagtgaacatacttttttataaatctagagttatgcaggcatcaaaagaaaattctaatcaagagctactgtgcaaaagaagaatacatgtgaccaagcctctctgaacctattctggttgggctgccaaattcacaaaaaatagaatttaaaaaagatgacaacatatg

SEQ ID NO: 4531 - DNA, 1049 bp, Homo sapiens
gagataccagtgtgaactcaaaaatttataataaatttttctaactctgtccattaaaagggcctggaacgagggacagctcagcagcaatgagtacctagcagtcagatcttgtttgtaaatgcatttcctgctaaaaggaacagggctccttggagaaatgtttaattccaggtctggcataggggaagtacaaggtgagcatggagtatctttttgtgccagaaagcaaggacatgatcaaagacagatggtgacatgttaaaaggacacaggagctggctttcagaagctcccactggtcaaattggaacattttaaactttttttttaaagggtaatagactataatatattattactttgcgggggaaacaggatctgtgagttcatagcactactccagaaaagggatgagatgacattctttataaaagcttactggctaatatatgttgaaggaatgatagaattagcaaattgccattttgcaggcaccagtgcaataagcgctttaggcaagaatcatctatggatagtaaaactattggatgagagattgttggaaaacagagtatctatgcagtctcaaaatatcatcccacagatttctcattaattcaaatgagaaaatagatttttaccattgaaaaaatctcaggaataccactttacctgagtaatcaaacctaccgtcaccaaaatggggcaagctatccaacatcacttatataatagtctcttaaaaatgtttaacatgaatctaactgtgaggaggcatcagatgaatccagattgtaggacattcaacaagattactggcctagactctgcaaaatgtcagtgttatgagagacaagaccaagaaaagtagggagagttctagatcaaattaatctgagagacaggacgtaagtataattcgagatctttgattggctcctgaactgaggcaattggggaatagctacaaagaacttaataagacagttggggaaatttgaatgtgtactgtatattagataatattgtatcagactcattgggtg

SEQ ID NO: 4532 - DNA, 1045 bp, Homo sapiens
agttacctcagctgaagaacaggttgcctacagcctgcccaaggaaggggattgcaaagacaagcagacctcataccatcaactcccattacttccacaagttacccatttgatggtttaacctcagtggttttaaagtagaacactaactttcctctgccacccagtactttcctatcgatgttggtatgaactcagggaaagggagctaatttaaaatccaccttaagaaagtaaattagaaaggtgaatcttctgggccaaatgacacacttttaaaaagcaaaatgaagacttcttggattggccattatcctgggtacctgtttcatggttggtcctttatttgtgccaataatcaaaagtcgactcaagtaacaactccgtttatacaaggtataaagtatgccttctttgaagaaaatccagtcttttgagaatttatatttaaggtattatcactttcatgatgatttacttcagaacatatttacttatcttttcaggaaaacattaggtaaaacaagatatgcctgtagggccgggcacggtggatcatacctataatccaagcactttgggaggccgaggcaggtggctcacttgaggtcaggagtttgagaccagcctggcccacatggcaaaacgccatctttactaaaactacaaaaattagcctggcatgttgacacacgctctaattccagctgctcaggagactgaggtacaagaatcacttgaacctgggaggcgaaggttgcagtgagctgagatcgcaccactgcactccagcctgtgtgatagagtgtgactgtctcaaaaaaattttaaaaagatactcttgtagagtggttttaggatgacaagtaatttaattatcacagtgccctgcaaaaagtacaaggcttggtcttcccatcttactgttaagaaagctgagactgagaagtggtgtggcttgcccagtgccacacagtggctacgatgtggtgaggaggaaacctcattccacagatggaggcctttcccttcggccctggcaagt

SEQ ID NO: 4533 - DNA, 1032 bp, Homo sapiens
ttccaatctgtatgttttatgagttttggagaatatcaggattttagaacttcttggtagacctttggagcagatgttagattctctcttaccagaaattctttaaaaatcaaaacaaaagaaattattaaatcctcttctccgtttctttttttttttttttttttttttttgagacggagtctcactctgttgcccaggctggagcacagtggcgcggtcttggctcactgcaacctccacctcctgggttcaagtgattctcctgcctgagcctcccaagtagctgggattacaggtgcgtgccaccacgtccggctaattttttgtatttttagtagagacaaggtttcaccatgttagccaggatgatctcgatctcctgacctcgtgatccacctgcctcgacctcccaaagggctgggtttgcaggcatgagccactgcgcccggccttctccatttctttattaattcagtgaacatttagtacccactgtatcagacactagtgattcatggaagagacggacatacaaacaaataattataatttaacaagtaagtgtaataagtgccatggtagttatgatacagagtgtgctgggaatttagaggcaggaccattcagaatctgggcagtgagatgatctctgcagaccctgctgttctggaagggtatgactgcctgaggaatacttggaggtcattgataagaaagtatttaaactgagctatctggggaagttccacctcttcgccatcctgattgtccatatttgctttattattatggggagcctgaaaggaatacatctttatcaatagttcttctccttcctattttcttttttaaatcttaatggtatggcagcagccttagcttctagccttaaatctcactagtctggatgtcgtggggtgtgcctgtagtcccagctacttgggggctgaggtgggaggatcgcttgagcccaggaggtggagactgcagtgagctgagattgtgctactgcactccagcctggatgac

SEQ ID NO: 4534 - DNA, 1067 bp, Homo sapiens
tttatccattttcagtgtcttttaaaacttgtttaaatttgcatacagtaaaatgctttgtcttttgaggaacaaaagttcttaattttgatgaaatccaatatataaggtttttcttttatagtttgtactctttgtatttaatgaataaatctttgccaatttcatagccactaagattttcctcctctgttttcttctagacattttatggttttagctcttacatttaaatctgtgatttattcttcgttactttttgtgtagtgtgtgagagaagagttgaggttaatttattactgttttttgcatatgaggtccagttgttctggcaccattacttgaaaatcatattctttcctcattgaattgtgttggcatctttgctgaaaatccattgatcgtatatgtgtggtccagactctactgtgttccactgatctatatcaaaaacacactgatttgattattgtagctttacaatatgttttaaaatcagttaatcaagtcttccaatgttgttcttctgtttccagaattgttttagtattctaggtctttttcatttcttttttttttttttctttttgagacagagtcttgctctgtcagcaggctggagtgcagtggcacgatctcggctcactgcaacctccgcctcccaggttcacgccattctcctgcctcagcctcccaagtaactgggactacaggcgcccgacaccacgcccagctaattttttttgtatttttagtagagacggggtttcaccatgttagccaggatggtctcaatctcctgaccgcatgatccgcccaccttgacctcccaaagtgctgggattacaggcatgagccaccgcgcccggctggtctttttcatttctatatagattttggaatcaatttgtcagtttctgtaaaagtgccttctgagattatgattgggattgtgcagaaaccatagatcagttcagagagaattggcattttaacaacattcagtttgtcagtctataaataccatgtatttcttcttttatttaggtcattaagttctctcagca

SEQ ID NO: 4535 - DNA, 1044 bp, Homo sapiens
gctggacagtgggcataaagtagtatctcatggttttgatttgcatttccttaatgactaatgatgttgagcatctttttatgtgcttattggtcatttgtatatcttggttagagaaatatctgttcacgtcctttgcccattttttatttaagttattcgtccctttattgttgagttttaagagttctttatagattctgtatactagacccttgtcagagacatatgattggcaaataatttctcccatctcatggattgtctttccacttttattgatagtgtcttttgacacacaagacgttttaattttaattatgtctaatttcttttgttgctatgcttttggtgtcatgtctgataaaccattgcctacctcaaaagtcacgaagatttactctcatgtttcttctaagagtttcatagtttaactcatatagtctatggtccattttgagttaatttttatgtatggtatgaggtaggggtccaacttcgtacttttgcttatggatttctgattgtcccagccccatttgttgaaaaaactattctttctccatttaattgtcttggcacctttgttaaaaatcagtggacccataaatgtgatggcctatttctggtttctcagttccattccattgatctctgtcattatgccagtactacactgaagcttggtaataggttttgaaatcagaaagtgtgagttctccaactttgagtttttttcaagactattatggccgttctgggtcacttatatttccatatgaattttaggatcagcttgtcaatttctattaaaaaatcaacagagattttgatagggattgcatcaaatctgtagataactttgtggagtagtatcatcttaacaattttaaaccttccaacccataaacatggatgtctttctatttatttaggtctttacttttttaaatgatggtttttagttttcagtgtacaagtcttgcacttcttttctcaaatttattcctaggtattgtattctctttaatgctattgtgaatg

SEQ ID NO: 4536 - DNA, 1007 bp, Homo sapiens
tactgcatagtactattcaataaaaaaaaaggaactctggaggaagaacataagatggttgagggagagaggaggagaggagtcagcatccctttggacatgttgtgtttgaagtgcctgtgggagatccaaggaaagatgttcagcagacaactggagcttgggctggaggtcaggaggggatagagaatcacattagcaggtcatcaacacctagacggagcagcagaagcataagactgtccaggggcagggtgtagagagagcaaagggctgtgcacagaaccctgagaggcatacatttaaaagggaggtgaaggaagatgagaggcatacatttaaaagggaggtgcagaagagactggcagggagtgacagaagcaaccagggcagtgaggaacctccaaagtaaagagagggagtgattaacaatgtcaagttctcctaagaggtcatggacgaaaaggacagagaaatgcctggacttagtaactgggaggatgttcatggcctccgtgcgtggtttctgggcagtagcaagggaaggagccagtttctagtgggtccaagtgagaataggaggtgaagaaatggtgatggacatagtctagtcaattctttcatgaagtttcatcagaaaggaaaaaaaaaatgtcgctcctggtcctgtcaggtaggactttaattttttcaaggtagggatgtattgccctaggtcagaggttctcaatctttagaatcctttagaatcagctggagagcttgttaaaatacaggtctgtgggccccacccaaaacgttctgactcagtgtgtttgagctgagtttggggcctgaggatctgcattgttacaacttcccagatgatgccaatactggcattctgtgcttccagagccactgccttatgacatctgtgctcttaacgaactctttttatgttctcagaacagaacttttgttcactgtctatttcaaaacttgtcagtggctctactctgctggga

SEQ ID NO: 4537 - DNA, 1047 bp, Homo sapiens
tattaatgtatttgtttagcttttttaatagacaagaaataagaaaaattaaatgacaatacgagttcatcaaaaataaaaagattttgtgaacagcacatagctaatctcctagttagtataaaggtaaaggagttctggaagctcacagcctctgtggaatggagtttagaaactctagtttgtatagtgtttcttgctgctttaatgttctgataatctgatgtttgtgaaaaggctttgttaactgttgagttctataaacgtaagaggagttattttaatctatattgactgaatctgtttcacctcttcatagtagcattgcctttaaaaattcatttttattggtttattattttttaagcttaactcaaagatatatcacgtggcttggaaactctttttgctgtggattgtggtgttccttcttttgtcaatcactatattgataaaagacccaagcatacacctgctagtggcatgcaagatcactcctttgccccatggggtaaaccgtactgaagaagttgctgatcctggtctcaaaaagaaaaaagtataacttcataaaaagtcatgttagatcttttgtgaaaggaggtttggagttctgaggaaagaacacaacatctgagttagtagacgtggatgatggagccagctttgttagcagctgggtgaatgaccttgcaaaggtgcttacctgccctcgacctcagtttgcttatttggaaaaatgagggaattaggctagccagcctctaagatttgattccttttagctattacgttctttcagcctctgaaaccagaatgctttgtgtcctttcagtgggccaaatggtttttcagaaatcattgtctggctttcctgaaaatcagtgaaaatgaaagcttgaaaagaacagagaacaaagctgcctgatcaaatgggagagaagatggaagtacagggacatggaaacatggggaggaactgagaaatccatggcccctaatagaattggaataggatttggaaggtggttttgttttttgtttttt

SEQ ID NO: 4538 - DNA, 1024 bp, Homo sapiens
ggacagcattgagagttttgtggctgacattaacagtggccattgggatactgtgttgcaggctatacagtctctgaaattgccagacaaaaccctcattgacctctatgaacagattgttctggaattgatagagctccgtgaattgggtgctgccaagtcactattgagacagactgatcccatgatcatgttaaaacaaacatagccagagcaatatattcatctggagaaccttttggccaggtcttactttgatcctcgtgaggcatacccagatggaagtagcaaagaaaagagaagagcagcaattgcccaggccttagctggtgaagtcagcgtggtgcctccatctcgtctcatggcactgctgggacaggcactgaagtggcagcagcatcagggattgcttcctcctggtatgaccatagatttgttttgaggcaaagcagctgtcaaagatgtggaagaagaaaagtttcctacacaactgagcaggcatattaagtttggtcagaaatcacaagtggagtgtgctcgattttctccagatggtcactatttggtcactgggtctgttgatggactcactgaagtatggaactttactactggaaaaatcagaaaggatcttaagtaccaggcccaggataactttatgatgatggatgatgctgtcctctgcatgtgtttcagcagagatacagaaatgttagcaactggggcccaagatggaaaaatcaaggtatggaagattcagagtagacaatatttaaggagatatgagagggcacacagtaagggtgtcacgtgtctaagcttttctaaggatagcagtcagatccttagtgcttcttttgaccagacaattagaattcatggtttaaaatctgggaaaaccctgaaggaattttgtagccattcctcctttgttaacaaagcaacatttacacaagatggacattatattattagtgcatcctctgatggcactgtaaagatctggaatatgaagaccacagaa

SEQ ID NO: 4539 - DNA, 1048 bp, Homo sapiens
aacatttgaaggttgtcttttaatggtggggggtgttttttcctttttaaactacagtgcttgcacaagagagggagggactcagaaaaggttagggcaggtgagggagacagtagatggcctgggatgacttgagtccatcatactattgcttggcaggtgtcctcccccatgtttgattcaaattccatgagtgacctacctttccccaggaatgggactgagagggtagtctccagcaactcagtctgcacagggctccccgttcaggctgcctttggtggttgtgcttttgtaagtttctttctctgcacttcgacttacctctgaatcagaaagcaagcccagcaggtgaatgagggatgtctgcttggcattgcccaatctaaccagggaggctggctggccacccactgtccgctagaggggagagctagcaggtgttggtatgaactcaggaatagaaacacgaggcctttttaaatacgagggagaagaatccatgatgcatacctgtaaccccctagaacccaagtgccagaattcctagatgctgcttctgtttgaacaaaatgtcactgcttttacacttgaaaaaaacacactcgaaaaatgttcaactccatgaaaaatattttttggctttaagaaattgtttggtgtttaactgtttcctttgattgccattccaccagtaaattgttggttgatttgcactgcactctggggttggggttgggaggggagggtccttatacagagccgaacctggggttgctcaggaagtgggccagggaatgtggaagtcgttgacattgcctgggccaaaagagtgggagatagtttttctcccctcagcccactcctggtagcacctgtcgccagcctggtacaaagccaggcctttttcttctgtgagcatctcatcactgtccagcagcaggtggaaaaagggggacaacaaccagacctattttttctcccccattttttccaaattttgctgtgccaaatgtttaaaattttataaatatgaatctattgaaat

SEQ ID NO: 4540 - DNA, 1065 bp, Homo sapiens
aacacgcccacagtgtttagctaactttctaggcagaaagtttcctactggggcacaagtctacgggctctcggtggaggctgaggtactcacgggtggagaccactgcagccgcctttgtagattcagactccccgaacctttaacccttgctctggtctactgtccctctgtctcaagcagtcctccctccttctgcgctgcggcgcctttaaaccttcttggcccttgccccgccccgggtccgccccgtctgaggcgggaccctcctgaaaatccccggctgggcagggcgcaccacttgcagctgcagcccttgccttgagtcagtgcgccgctctccagcccgcttgaacggtgagcaggtcgggggtacgggggtcggggacatgtgcgtgctgtgtagaaagcaagaagccagcgctttgaacttgctccagcgagctcggggatcaagggctggtaccaggcaagggtccggtgactactttaccccgccccgtgctgtcaggtcctgtccccaagccctgacccgacattgttggacgatgaggtcaggcgaggttagcccatgcatagacagggcgtccgtctggagcagggactcagggactgagccccacccgcgggctccatcgctgagtcctcactggggcgaggggaaaaaagggcgtcggactttagctggctggccccgagtgaccccgggtcgtggcgccggccctgggccagctcgtgctcctgggctttcccgcgcgacccttcacttcctggttccaggagcacgtgtgagcactgcgtgccctctgagtccccgaggccgcccttttcattcctgttcctgctagcttgctattctggggacttgaggtcacgggctggggctagggggctctgcatgggtcgcacggtgaccttctgtgaagctccagtcatctctatgacggtcccctgacctcgggggtctgggtgctgcagccctgactgcgccccggggtgccctgtgtgaggttgtgggggtggtggtggctgcttttaccctgcccgagcgccgctgcccccacc

SEQ ID NO: 4541 - DNA, 1076 bp, Homo sapiens
ccactgcgctccagcctgggcgacagagcaagactccatatcaaaaaaaaaaaaaaaaaaagataatccaaagaatttaaattgtaatcatgtttcatgtatttgttttattacttacttttatagcacttagtcccagtggtattagactgctatttggtttcatacaaaaaggattaaatttaaattcattcatgtttagacttgagttattacatttttaaaactatcatcttgcctttaatgtttgtggtcctacacaaactattagtacatttcagtatcctcttacccctttgtttttaagtttttgattgctaaagcaagacttttttcttctagaatttaagtcaaccaagtgttatctatgttgtaaaaatggataatagtagattttaggtgataaaacaacttgttagtaagacatttcctagcttaaaaaaaaaaatcaaaaattccatgatagaaatgcagacctgtgagggaaactcctgaaaagcataagaagcatcccagagagccatgggttttctagaccagagaatttagagggagattgtggaactgaggcttaggtggtcagatcgtttcccttatcactgtaatatttctgggggaaaaatgctttctgagttgtttaaacaagcatccttacatttttttttttaattaaacagcctgtctaggcttgggattccctaatactacagtagcagtatatgaatatgattttgtgattgtgttttttaaaagataagtaatttgatgaactgttcttttgcagtcagaaaacactcacaaaaagacaaaaaaagttccacagtattatatttcatgtcagttcaggcctaaaatcctttgcaaataagatgtttataggctggtcacaattaacaatgttattattggcagcacttcttggatggataccttttgggacctttcattagaaagagggaaagaatggggtggttttgtatgggctcctgtttggggtaaaaatagcagagtcagttgctgaggacaatgaccttccttataacatttagtttcatacccatattaggtcttgtctt

SEQ ID NO: 4542 - DNA, 1292 bp, Homo sapiens
atatcatgcaaattgtaaatgtagagtagaatgtaattgtaacgtagaatgttagaaccaaagatcttagaagttattttctgccttgcccagatctcctgactgatttgaggatcttttctttgttcccattcagcttcacagggacaagggttgggggtggtatcagaggacagccccttagtctcccaagagcactttgatgcttgatcccattctctacattcccccagcccagtcatctaaggccagagctcttttctctgctcaggcattattgacaggataagtcctggcattcagacaggtctggtgaagtgaccaggtactctggcccagaagttctctgtcggctccccccgcaggctccaattcaggtactgtatgttattctcttgttcctcttgccactggctttttccttagtcttaagttccaaggaattgttcccctgtgtttttttattttcctgacttattcaagcagagctagctcagagtacaggtctgtaacaagggcttattaggagatagatgaaaaagtgcaggtttgtatatgtaagttgtccattactatagatagatactattccaggcattggactttaactgcactgcctaaaagagcccaaagataaacttcacaataggctgatatgtggaatgggaggaggagataaagaacggggtttctgttttattcataagctcagtcttagcttcagtcttttctgagcatttgtttatttgtaagatggaagtcaaagtaagtgggaagtctgtaggtcagctctattttccatgcctgcccttgacttctcctcagctgttctctgcctgtgcaggtgaggcagcggaggtggttggtccagagagaactaaaagaagttgttttcttggactataggtccagctgcaaggcagggtgcctttcctatgtgttcctcttttcactaaaagactcaaaatgctttagcagctagatctggaactaactcttctggatggggtaggaacttccctgcccttcccttagggaagctcatgtttccaagtcagacagcagggggcattgggtgcctttcggacagaaggaagctgcctaagctagaaggcctgcctgctggagtttatttcttttgccttgttcagtgaatttacccagagggtggctgagattgaggctttgggagccccaagaagctgcttggttttaatgtgctgccttatagctgagcctgttgtgctcagggcaagtagtaggatgttccccctgggatgtgcaaggttctc

SEQ ID NO: 4543 - DNA, 1043 bp, Homo sapiens
caggctggtctcaaattcctggcctcaagtgacccacccgcctcagtctcccaaagtgtagggattacaggcatgagccaccatacctggccataagttacattttaatggaatctgagcaatagtctctgaccttaaggtcttttttagcctactgtttctgggattcttcttccacgtctctccttgttcccaggtgatagggaagatatatttataaataaagggtaggaaggtatctgtagtattgtctgattaataactggctgttactgtgttggactgcagctaaactgaggcttcctaaagaatggtacattcatatacctttagtttatacttcttaaggaacactagaaagtgacttcactacatatttttttccccaatccccaaagtcccatataataaatgtatgtgcttttttcctgttgttacgtacaaaacaaacagagaaaacacaacaattctttctttccaaatgagaatctctttggtttcttattagccatgtgactctcttggctctcctttgccatgaccatttggatcttttggagtatataactttctgtgcttttctactcttaaaggaaactggtggtgacaaaagagaaagagaagaaagtggggctgtatacgatctatgtgaatcctgccaatacccaccagtttgcagtgggtggacgagatcagtttgtaaggtgagtttgtggctcttttgtgtctttgacagtttgtaagactgatgcattgtatactaccaggtgctcctttatggagagttacgaattttataggaatccattaactattatcttgaattttttaccgttttccaaaaatcttacacgcctttggagatgttctgttctctaatgtaacagtctctgaggggtgactttacatattttagagattatcaagttttaaagaagttagatgatggtcaggtgtagtggctcacacctgtaatctcgacactttgggaggtgaggcgggtggatcacctaaggacaggagtttgggaccagcctggccaa

SEQ ID NO: 4544 - DNA, 1046 bp, Homo sapiens
gaggctttagtgagccatgatcatgccactgcacttcagcctgggtggtaaagtgagaccctgactggaaaaaaaagaaaatgaactctaatggctgatgtttttctttgctatctgttcatatctcttgaggacttagttgaaatagcaaatcaactgtcctttgactagttatagaataaacaaaactataaataattcgcatagaacaagagtaagtgggcttagattatgtcctttcctgggattttatgacaaaaaggtagacatttctctttttggaacattttaagtgcagcccttcccaaagttataggaatgaactagatgacctctaattctaatatttagaaacctcatgtttttcctttttcttcttcagttggcactggaaccagactctccctgtacgttcttatctgcaggtgaagatgcagttgttttcaccattgacctgagacaagaccgcccagcgtcgtaagtgtagcagtaatatcattacagaactgtatctcttagccttgaacatattccatatgtcttggtaatgcctaactctggttcatccgaatagtacctttgtgcctatggttaagaggtagtttaaggttaaggggaattccttacttcctctctttctcagtagtgaaatactattcagtctaccttcatttctcaaacagtttacttgttatatgtggcctttaataatttgatgatcttttgctctttattcacttggatatcattcatcttacccacagaaagcacattcttccacagactcatgtagaggtacagtcctgtaaattttaaatttaaatacatttttaatttagttatttatagaaacatacaaacataaaatttgaacaaaaatactggtagctgtagttgagttctgttttatcacagttcatttgtatgtgaatctgagactcataggtaaattttattcctttttaactgtgtggtatcatagaaaaaacacaacatcttgtttggatccaggcagacctaggtcaaatctcaaatcaggcactact

SEQ ID NO: 4545 - DNA, 1034 bp, Homo sapiens
aaaaaaaaaaaggtgattacataagggatgaagttacaacccaactaggagtgggacatctttcccctccttatttcctttccttacttcccctcccttctttccatttatttccttccttccttcctttccctcctccttcttttcaggaccagtgctgccaagtgtcaaatcactggctttagggcagatttgaaggcagaatataaaaattctaatagagtataactaccacctgggttatttaaccagctcttcacctctgagccaacttttaaattagagaagccgcctttaaatggatatagttgggcagcacagagtccagcattccttagcaccttgaaggtcaggataacaggctaaattctagttgatgtgattggaggaaggataagtgagattttcaacatgcttttttattgctccatatgttcttatcactgccattcattcatcttttgtaaaggaaagtggttcatatttttcactgggtttagttgaaaggcacagggttctagaggagttaaagtatactattgatttggagcttgaccattagctaggtcaaggattggcaaactataaattgcaggccaaatccagcctgccacttgtttttgtaaagttttattggaatacagtcatgcctgttcgtttatgtagtgtctatgagttgcttttgttctacatactggagttgagtagttgtggtggagctccgtatggtctgcaaagcctaaggtttttactatctggccctttacagaaaaaatttgcaaacccctactctagatcttggtgatttactgttggggacttcttgatgagcttgtgataccctctggcccttatgttaatgtggtaaggcctccaaaattgtctatatttgttactcataattttaacaataaacactagatgttttggtgttttattttttcttttctacagacctgttaggttggtgtttcagtccctgctcaccactcccaagctcaagcccagctgcatttcaaaaaactgtaactgct

SEQ ID NO: 4546 - DNA, 1038 bp, Homo sapiens
cttggctcactgcaacctccacctcctgggttccagcgattctcttgtctcagcttccccagtagcagggactacgggcatgtgccaccacgcccggctaatttttgtatttttagtagagacgggggtttcaccatgttggccaggctgatctcgaactcctgacctcaggtgatccacccgccttggcctcccaaagtgctgggattacaggcctgaaccaccgctcagatttatcagaatttattaattttgataaatccaactgattaatttttttgtatgtgctttttgtgtcctatcctaagaaattgttgcctaacccaaggtcacaaaggttattttctttgttttcttctggaacttgtgttgttttaagttatatttaggtctgtgattcattttgacttagcttttgtatattgtacaatgtatggattgaggttctttagtttttttcttttggcagttgaatgttcagttattctggtacaagttgagcatcccaaattaaaaaatctgaaatctaaaatgctttgaaatctgaaacttttcgaatgccaacttgatgctcaaaggaaatactcgttggagcattttggattttgaattttctgatttgagatgctccactggtatattgcaaatatttaaaaatttgaaacacttctggccccaagcattttgggtaagaggatacaccggacaagggatacgtagtctcttatgcagatctttcatcatattagaggaaaagagcagccccagtagttttaaacaagagacacttggtatctcttttacagagtactcttatccagcgtagtaaagtctttctgcctggtttttagttaatattttgtcatgtaattggttaaaaatttaaggctttattcttattaagacaagaaaaatctaggtcactggaatttcttagtgaaattaaaatggcacctgggtcttttttcctcaccctccagtgggttactctttaaccttcagtttggcaggagttatggttatttttagagtaggaac

SEQ ID NO: 4547 - DNA, 1080 bp, Homo sapiens
ttttgagacagtttcgctcttgttgcccaggctggagtgcaatggtgcgatcttggctcaccgcaacctccgccttccaggttcaggcaattctcctgcctcagcctcccgagtagctgggattacaggcatgcactaccacgcccggctaatatttttgtacttttaatagggatggggtttctccatgttggtcaggctggtctcgaactcctgacctcaggtgatctgcccgccttggcctcccaaagtgttgggattacaggcatgagccactgcgccggcctgcattcgctctttttaggccacgtttattaaggtataatttatatacagtaaaatttatccttttttgagttggcctattcttttaattctgacaaaggcatagttatgtaacaccactgtgattggcgcatggaacatttccatcattccaaaaggttttctcatgccctttcgtagtcagtttcattcccctacctccaagccctggcaatccctgatccctctattcctatagttttatcttttccagaaagtactataagtggaatcatatattgtatagctgtttgagtctgaattattgcacttaccataacatacttgagatctatccatgttgttgcttgtatcagtagttcattcctttttattactcagtagtatcccattgtgtggacctaccacaatttgtttatctatgacccagctgaagaaaatttgtttccagttttttgatgaatttaagtaaaactattaaaacattcacctacagggtatttttaattttgtggacatacattttccttcttgtttatcttatttatttatttttaaagatggagtattgctgtgttactcaggctggtctttaattcctgggctcaagcagtcctcctgcctcagcctcccaaattgctgggataacaggtctgagcctcttttttcttgtataaattcctgaagctgaagtgggattcctgagttgtatgataagtgtatatttaacttcataagaaactgccaaattgcttttttcaaagtaactgtactgttttgcatttctagtaacag

SEQ ID NO: 4548 - DNA, 1042 bp, Homo sapiens
cccccctcccttgacctacccggtctgtgtctcgttccggctcggcctgcgccccccctcgcttcccagccggtttcccctaaggatgggcctgacccgtatcccaagctcttagcgctcaggtcttttccttccgccgacccgaagtcatcgctgggagtactggttgccctttcctcaggtcagccctggtgttgcccccaagagccagccgcacagttcacagggacgccttgcttcgttgggtgacccatgtgtgcgctcctatttctccccttagattgagggacacggctcgccctgcgtctccccgtcacctcagggccaccgcgcaatgtgtccccctcccccatcccaagttcccaggcccagcaccttgtacggaaggcggaggtccaagaattccggagtcggttgttgtcttgtggtcttgtaccctttgtaatataattatcttagtttacctcctctaactcccaaatcttttaggatatcttagaacggtcccatttggtccctgttagttggaaagcatctggtggcttgaatttctgactcatgattgttactggagtctctgtaaacaaaccggcactagcgctatcacattctctccgggatttccccccctgctctgtggcttcttgttgagaggttgtttggttatggtttagcgttgaaaagattcaggttatccttttaaatgactttacgttttagtggagctgggagattacttgcctggcttctaatcttcatgttggttcattttatttccatatgtgtgtgggttatttgttcagtaattagaattagataaagtattctgcttttaagtagttttgagaaggcctaaaaatactaaagtgtattcataaatatttttattatgttcagtagaagacacacctttgccatgtaaattttaacttttctcagtccttcagtgaatctacagacctattttctcaggagctcagcctggccttacttcagtgataaaaggaggaaaggtgagtgggagttggaggcattaaaattc

SEQ ID NO: 4549 - DNA, 1029 bp, Homo sapiens
tctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttcttgacttggccatttatttcttggacactctcatgttcttgttcacccatgcaggcaccccaccaaagtacatatcttccttccagtaataatttttaattacaaaataaacatccactattggaaaaaaaaaaaaaaagctagccgggcatggtggtgggtgcctgtaatcccagctactctggaggctgaggcagaggat

SEQ ID NO: 4550 - DNA, 1998 bp, Homo sapiens
gtcactctcccacctggttaccaggagaggcagagaaacaaatgagatcaaaggaggctccataactttccttacgtgacttccaagtgctatttgtttttagcctcttttcttctactattcagatcccagacattgaccctaatgccaagctgctccagccacctgcacctatcatgccattggataccaattggcctttattgactgtatccaaaggattttttgaaggcaccattgccagcaaaggtaagtacctatttctcccatagcacttttgttgtttgttttgtgaagaactgtcctagagaataccattagcatttagtttaacttgtcctttttttctgcatggagcctaatggaatattgaaatgccagtcatttatggtgcagtcttaaaaacttaagatagcattttcaggtcattaaagaaaatttggaaaatagggagaaaaaaagggatccctctactaccatcaataacttcggttaatattttggtgtattttcttaggttttactatatatgtagtcatgttctttgttcagtattttatcattcatgacatacaatcttaaaggtactaattcaactacctgtaattccggtatgtgggtataggcagatgtgtgctatcaccctccaccacttccacccttaacctcctcctgttttctgggtctcctagttcatttcccgtgagtaagagcctaaacagactcttgagcattttgtgccaaaccccactcttttctccacctcctctatctaccctatgcctgatgccctgtacacattgtagtggtggtagcttagcaaagcgctcaggaagaaattcaagagttggtagccaaaggctggtaagtacaaattatttaagagccagtttttggtagcaggaaggccagttccttccatctgtcttctattccctccctctgtgaaagctactgcaagttagcataacatatataccacaaaaataaataatacacaaaaataaatagtaagtaggcagaagcttggcacctgtttttgaaaggatttaacctgcctacagaaaaggccgtatctcagacttgctggactataaccagttccgttctgttccttccctctgtagggaagggaggagcactggctgctgacattgacattgacactgttggtacagagggctggggagaggatgcagagctgcagttggatgaaggtaaaagtgctgttttaagactgttctggggtgatggacaccttggattgggactgggttgtgggtagctctgcagacttccaggccatgaaacgaactaggattgattttacttcctttggctaagattatgccactgcccaaatctgttttgagcttgaattttccttacagatgggtttgtggaggctacagaaggtttgggggatgatgctcttggcaagggacaggaagaaggaggtggctgggatgtagaagaagatctggagctccctcctgagctggtatgtggaatttgtacccttagaaggttctctccgtatctccctgtggaagccagaggccttattgtcccctaccactatcctcaggtctcctatcctatcccctaccactatcctaaggtcagcccttctgggaaggggactagaccctcctagtctgatgcttatctcccatttgaaagaaggaagatggctgggcacggtgactcatgcctgtaatcccagcactttgggaggctaaggcaggacaattgcttgagcccaggagttcaagaccagcctgggcaccatagcaagaccctgtctctattttaaaaagtaaaagaagcaggaagaacgagagagtcaaagttagtggccttgtcacttccatctatcctgatatgctccaagaggagaggatgtaggacttatctctaatctgatgcttaactcccatttgaaagaaagaagaatgaggtaatcagcgttctgccagcagcagcttatgagaaggt

SEQ ID NO: 4551 - DNA, 1438 bp, Homo sapiens
cttagcatgtcaccatcacatgctaaggaacaccaaagaggccagttggagcacagtgagtaagggactgagtaacaggtgaggtctggccagatcgtgtattgccttctatgccatggttagaacttaagattttattctgaatacatggaaagccattggaaggttttgggcaggaaagtgacatgatctggtttatatttggagagcagacagtaggagaacaagagtggaagggttttctaagggatgatggtgctagtagggaaagagcaaaacattttaaaaaacagaatcacaaagggtttttaacatccattttttcagtaaatacttcttatactctttttatatgctagagactggggaaggatggaaattataatttctgccttcagggaattcatgttacaatgtgggtgatagacctaaatgattacagtgcaggatgataagtactgtaatggaggtttgtacaaagcattaggggaacacagaaaagggcagtgtggatagtgacactaagtgtggcagtgtgaatagtattaggaaaggattcacagagaattatttaaataaagattccaagaattgtgagaatttaggcaaataagggatgcattcaggtgtcttgtcttacagatataatcttcatccttacgtatctccaatttccaggtttttttcttgcctacagcttaattttttctcctcctctccctgtcccccaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggaggtaaatcggacttgtttctttcctccaaaccctctcatctgtcaccctgatacaactcccacaaacaagactcttcttttctttctttcatttatttattttatttatttaatttttttttgagacggagtctcgctttgtcgcccaggctggagtgcagtggcgcgatctcggctcactgcaagctccgcctcccgggttcacaccattctcctgcctcagcctcccaagtactgggactacaggcgcccgccaccacgcctggctaattttttgtattttttagtagagacggtttcaccatgttagccaggatggtctcaatctcctgacctcatgatctgcctggcttggcctcccaaagtgctgggattacaggcgtgagccaccgcgcccagcctatttatttatttttaaattttttttttttgagatggagtctcactctgtcacccaggctggagcgcagtgatgcaacctcagctcactgcaacctccacctcctgggttcaagcaattctcctgcctcagtctcccaagtagctgggattacagg

SEQ ID NO: 4552 - DNA, 1049 bp, Homo sapiens
gccactctgatttggcatctcctttggccaagtaacagagcagagtttctggggctgggtgtgatagtcttgcctccccgctttctctctgcctgtcctcagggatatttcccctttcaggcagtcgtgatgcttcccatgggttaagtcaaggttagatctcctgccagggcacccaggaagatggggaaggtagttgacctcctcagtctcactttttccagtgtagaaaccatgagttgggggagggccattgcagatgtggaaatcagatgctcttaccatctgctcagagttttttcatctctctgtggccccaggaactgtctcattgtcatatttgagttctgggttgttgctgatgaaaatctcagcactgtatatttgttttgggttttctgtggaggggagtgaagccagcttgcttctataccactgttttgaaactgaaagtattccttctttcccttttttcctgtggtggtacccttattttgaggagtatgaacatagaattcatccattcatttgacaaatatttattgagtacctcctttgtactagactttgtttaaggctctggagatacagcggtgactaaaacagataaggcccctgtctgaaggagctcatatttgttctaaaatggcaactcctaaagtggcaggtccctgaaaaaaagaaaaaataacaaaaattgaaaggccaactaggacagttgttatcaggacagataaaacaggataaagggatggagaatgatgaaaaagaggtgtttgtttttttgagacagggtcttgctctgttgcccagcctggagtttggtggtgcattcacggctcactgccgtcttgaccttttgggcttgggcgatcctccccctcagcctcctgagtagctgggactacaaacgtgcgccacaacacccagttaatttttgtattttttgtagagatggggttttttaccatgttgcccaggctgatctcgaactcctaggctcaagtgatccccctaccttagcctcccaaagttctgggattacaggt

SEQ ID NO: 4553 - DNA, 1050 bp, Homo sapiens
ggtgggtgcctgtaatcccagctacttgggaggctgaggcagagaattacttgaacccgggaggcagaggttgcagtgagctgagatcgtgccactgcactccagcctgggtgacagagcgagactccgtctaaaaacaataaaaaataaaaaataaaatttgtctggagatattaataattatttgtagaaataagataaaaataggcaagtaaaaaacaaagcagaatatcctaaatgcaaatgaggctgagtttaggggttagaaatatgtatttggaaattcacatgagaatttggggtaatattggaggacagacatggtaattctgatgctcaaaattttagagcagcgtagtctcttgaatctgttcacatgaagaataaatcagagacattttttacaacgagtagcttgattcattggtttgctttgagtaatgactataaagatgttttagaagaaccactcttttctacagggtcacgatcgtggagtaaactgggctgccttccaccccactatgccccttattgtatctggggcagatgatcgtcaagtgaagatctggcgcatgaatggtgagtgaaccggttacattatcgccatatctaagaaactgccagccagcaaggtaaagtagccaggtcttctggactctgacctatttttctaccttaggtgattaattaatgctaatcccaggagcatagaaattattttacaaataaaatatatcatctttacaatttttatgtgtacagttaagtggtaataaatatatttatattctgttttcctccatttcctccttcaccctccttcccattctactctcgatcttaataatatccactttttagcttccacatgtgagtgagaacatgccatatttgtctctttgttcttcccttaacataatggcctccagttccatccattttgctgcaaataacaggatttcattcttttttatagctgaataatattccattgtgtgtgtgtgtgtgtgtgtgtgtgtgcacgtgcgcgtatgtaattttctttat

SEQ ID NO: 4554 - DNA, 1045 bp, Homo sapiens
cccacagtggagcgtcgccgccgagacaagatcaacaactggatcgtgcagctctccaagataatcccagactgctctatggagagcaccaagtctggccaggtcatggaaagaccctggtagtgggcaggatgcctgaattctgcctcctggtattgtttccagaaatggtagagagaggggcacacatgacagtagtcttatctctccctgaggttcctgtatccctgggagatattataccaccttccttagatgaaaatgaggtccaaagtgtgaacctacttttggaaagcaagctgggtatctgaaatcctagttctcattttgttgaccttatcttgcagagtaaaggtgggattctatccaaagcttgtgattatatccaggagcttcggcagagtaaccaccgcttgtctgaagaactgcagggacttgaccaactgcagctggacaatgacgtgcttcgacaacaggtcagactcctacccccagtgcagcccttctcagttctgctagccactgacccagtttgacaccctctactttgttctccatggagaaggcttcatcttttccccctcaccagtggatgtctgaatacattcaggggcttggaagtgccagctttactacccattccctttactgcctccttcccatgtcaggtggaagatcttaaaaacaagaatctgctgcttcgagctcagttgcggcaccacggattagaggtcgtcatcaagaatgacagcaactaactatggggattcaggggctttgggcccaagaactgcagatagcccaggagcaacagcctaatcccgtgcccctttccttcactgccccacttctggcatgggacagggggaagttcagaaggtgtgtccttgaactgaggccctgtgatatggcggcctgcagtggtgtgaaacacacaatgtggacgtgcactgacagccttgcccacccccaccatgcagcccctgggcccttgtgctcctctcgcacaatgcatgtgctgtctccatgctggatactggacaca

SEQ ID NO: 4555 - DNA, 1050 bp, Homo sapiens
ctggtgtgtcctgagagctggagttgaggctgtgatttgggatggggcagagctggccatggtgggtggaggggcagtgtggagcaggggttaggatctcaggagtttgggagaagctgaatcctggttctcccacccacagtgtggctgttgtggtgactcagccaggctcagactctggctccggggggtttaggggacttatctgtgctgggagctgtgtctgggccagagtggggctgcctcaaggcctgtcctccccattgttctcatctccctttgtgattgtgtggcccccctccccagacactaatctgtgggtgggcgttttgcccaggctgggaagctctcactaagctggggggcttagtacaatggggggtaagtgagggaggtggatgaaggcggagagggaatcttctggtttttaaagttccttagcactccaaggccaaggttatggggcaaagagtggatggaaaggggtttgctgggttgtttgtgtcacctgtcctggatggtgagcttcggtgcgtccctcctaggtcctttctcaccccagactcacccacatactccagctctcggtggagattgttgctgtcaggtaaggggaggcaggagttaacaaaggagcatgagaccctagacagcctggacccctccccctagccccaggcaggattcccctcacccccccaaacccacaccagacaacccttacccaggcctggagccagagctggtttttctggtggtggcagcagcagagccctgacagagattcccagggagaggcctccttggggggccagagctgctgaggggcccaggggagtggctgggggtagtggtgagaaggttggcagtccttttagtaggaacctgaggagcaaggggagagggaacatttgttttgttctgctggggagtccttaatggcaagttcccatcacctggagggacagtgacctcatctctgggtacttccaccttgagcctgagattaatatgtcttcaagtcttggggtaaggtggggaaggatgctg

SEQ ID NO: 4556 - DNA, 1050 bp, Homo sapiens
tcagtgggccctcaaatatctcaaaaatagtaagccctccgtgtttggtgaatggaattccagaaaaattttaggtagaaatcgcaaacttgtggttctactccttttccaaggtaggtgcccactactgcacctttgtaaagcctgccaccctatgtgctatctggaccctctgccatttccactatcccctctttcatctcttctctcaccttgttaggtgattgctggcttcaaccgccttcggcaggaacagcgaggcctggcatccaaagcagctgagttggagatggagttgaatgagcacaggtgagaaagtcagggagaggcaaacagtaggacagttgtgtgggctactccgtgagggggatttgtagtagagtggggctgaatcctcaggtcctgccttgttctcctatcccagcctagtgatcgatacactgaaggaggtagatgaaactcgtaagtgctaccgcatggttggaggagtgctggtggagcgaactgtcaaagaggtgctgcccgctttggagaacaacaaggagcaggtgagcaagaatcattgaataggatcgggtacagtggctgtaaacccagcactttgggaggccaaggcaggtggactctttgagtccgggagttcgagaccagcctgggcaacatggtgaaaccatatcactacaaaaaatacaaaagattagctgggtatggtggtatgtgcctgtagtcccagctactcacctgagcctaaaatgtcgaggcttcagtgagctgtgatcacctcactgcactccagcctgggtgacagagtgagaccctgtctcagataaaaggagggcagcataaaatagcctatgctcattatgctatgctaagtgcaactcttagacaagaggaattgctgactgctgtgggctctgtgacttggctgaattggggtgggaggattggggttagagtaatgtttctcatagtgtgtgtttcacgaatacatgaatcaaaatcacctgaaggactaatttataaatgcagcttcccagacccactgga

SEQ ID NO: 4557 - DNA, 1051 bp, Homo sapiens
cccaggctagagtgcaatggcgtgatctcggctcactgcaacctccacctcccaggttcaagtgattctcctgcctcagcctgccaagtagctgggattacaggtatgcaccaccatgcccagctaattttttgtatttttagtatagagacggggttttccatgttgcccaggctggtcttgaactcccgggctcaagtgatctgcctgcctcggcctcccaaagtgctgggattacaggtgtgagccagggtgcctggccaacacattctgttgataatatagatgcaaataagtagtagggagcggaaaatgtaagaattttcacctgaaaatggatctgaagagtaaaagatattaattgacctaatcgtgcattgagaattgactgtttatcccatttatttgttcaataaataagccaatgggttgtaaacattgtaaacattccacagcatgtggaaaggacatggatttttggagtcaaattgaatctaagccttgctacttacttacctgtaatgatgcaaccttaattacttgatctctgtaaacctcagtttccttacctacaaaacgtttgtactattacctgccttatagagaggtccagacttaagaatatgatgatgtaaatgtttggcactgtgtctggcttttagtaagtggtcaataaaggccagttctcctttccttatatctcttcctttgtctgctccctgacttctaacccctgcattcacgtgagaaaacagttatatcaaggaactgtctaggtcagatctaagggccattttgtaaatttgtgcaaaaagttctggcttacattgaagggatgataaaaggaaagacatggtcctaatcctcagagttcacaatctggtggctgagacagtcaagtaggacaaaaatttcagacttctgtgataggtgccatgatcaaggaggggcacctagcacagaatatgaggccacagaagtgtttctggaggaggtgcctgtctctccttctagaagtgagcagtaaggctgggcacagtgacccatacct

SEQ ID NO: 4558 - DNA, 1067 bp, Homo sapiens
aaggttcgggcagatcggggcatgagccgcgaggctgggcggctacgccaggccagcccgcctctgactcaggctgctgaaagaaatgcggggaaggttctagctcctccgggctggctctgaggacgcgcggttgtggcagaggctgcaaaagcagcaactttagaggcaaggtctccccggggctgtgggaggtcggatccctgaggcacacaggggcctgcgggctgccttggagggccgctgagagcccagcggctcaggaaggccgaagatatgttaccatgcgaatacagatatataagatatatacacgtatatcttaaaacagttttatcttgaacaaaatattttccaaaccgcgatttaagacggtgcctggttccttagtgaatggccagagatagtgagctttaagagacaatactgcaggtctttagctgacagtagcattggtggttcagtggtagaattctcgcctgccacgcgggaggcccgggttcgattcccggccaatgcactttcatttttttccgatccatttcaattctttttctcatctaggattaatcactcttgaataaattaaaccaggtggctgaagactttacattcctccagttttgttctctctcctttaccagtcactttccacaaaggagatgtgacattgcactgtggccctgggactcgggagagacctcgccactcagcccaagagagaacgcaacacctgggaaaggaggacgcagagtacggtcgggatgtccctcatgttctccccactgtttgtatccccgaggagcctcgtctccagaggcccggtggagaggcacagtgtgcgtttttctttatggcctaagtgggttcccagctggagaccaggactcaggtggagagtaaactactgcaggctccagtccaacctacctcctaaaggctggaggacgagatgggttcactgggcagtaaagtcacactggtttttatcaggttgtgactttgtgaattgaggccatttcccactttcttcaatccagaacattccattcagatctgctggcgtt

SEQ ID NO: 4559 - DNA, 1034 bp, Homo sapiens
aattaaagtcaaaatttcagaaaacaatactttttacatccgatgcacttggatatttgtctattctatttattacattaaaaacatcaggtcataatgcactgcattgactttacaagccagtaacaggggttgatcaaccattgcctaaaaagggtatataaagagggagtcatttaaaacaactaatttcagataacagagaaaattatgagagtactgttcaattccaaattcagagcttttcttacggattattcagtgccactttttttaaagcttggactcatgcctaccttttaggcatttatttacagattaacttatcagcaccttgggccccgacaagataagacacaattcaggtaaattttggtaaatattccttgagtgataggaagcaggaaaagtttgaaggagaaggaaagacaagcctaggcaaggatggctatggtggggaggtacaaagaattacaaagcattagtcatccaagcaaagtataatcagaagaccactgacagaattaacagagttcagagataatatcattatactcaatccctactaagattttggtgtttggtctcctagatcacttttttagtaccttcacagacatatggattcataaagaatatatagtaattattcatatttgttttgatttatataaacagtaatcttgtctctcagctccagaaaaccttgcctggtgcttcctgaaggctcacaacatcccagcccggcctccatcacttacttataatgtgttttggggtcttgagggcagggagctttctctttcttctctgaattcctagcatccagctgagtgcctggcacttggtaagtattcacatacacattccttgaattccctagatttcagtttccttcactgtgaaacaaagtgggctaaacgatctccaggagcccttacagtcctaagaatctatgactttgaccgatctgaagtggtccaagacactttgcttcacaggaagctcacatcttccttgtgattggcctgaga

SEQ ID NO: 4560 - DNA, 1023 bp, Homo sapiens
taaaggaaggagagatataggggtttagttagagaaggttgcaaagttcaaaaagaagatttattagtattattactactattattatttatagcctacttgaaaggagtttaaaaagaaaagaatagtaaatgcaggttagaagaggatgataaaggtacaagttgccttacaagactaggagagcagatgtaggaagtatggaaataaattagcattgaagtaaaaagagaaacctcttcctttgatatagaaatgaaaatagtggggatgaatatatatttaagtaaatgttaagattgtaggctcaaagttaagatggtaaggaagttcttgtctactggccttttttccccctatgaacttaagggatatgatcgtcattgaagttgcagcagagatggaataggtatccatctttacactgaagagtttacaaagtgtaaggaaactatggactaacctttgtgagacacagaaaagacactgaagcagtgatggtgaaaggattgtcaaacagtacaggacatactactgagttggagtccacaaatttctaggggcagtaatatacacaagtatgtaatatgcttttgcaatgctcagcattccaagtgcacaagtggagaaggcatgtggctgggtttactatggaggtaaattcacaaggtggattcagaggggtaagggtctatggattttgaagtgctagtgagagtaggagattcatcatggatcaagattggctagaaaaagaagtcatcaggagagtgatgaactgggagaaaataggaggatttaaagaactaagtctcaatgaggttaaagagcaggttgacatagggaaatataatgactctaaggataggagatcataatcagatattgaaatattggaatttaccatttcagagatgagggtactccaaggtccagattcagcaatgtgtttaaattattaaagtggaagaaggactttgaggtcaaaaagtttaagataagtttgttggatagtcatgcatg

SEQ ID NO: 4561 - DNA, 1132 bp, Homo sapiens
ataaagaaaaataattggtgatttatactaccaaattccaaaacttatcataaagctgtagtaataaaaatagtgtggtactagcataaagataggtatatagatcaatgaaaaagagttgagatcagtggaacagaagtgagagcccagaaataaacccatatatctatggttagttaattttcagcaacagtgccaagacaattcaaaggggaaaggataacttcttttttaacaaatgatgaaggaataattaaatataaaccacaacaaaaaaaacttaggcccctaccttatgttctattcaaaaattaactaaaatgagtcatagagctaaatataaaagttaaatctataaaattcaagagtaaatcataggaggacatctttgtgactttgggttagccaaaaagttcgtacataagatgaccaaagcagaagccatacaagaaaaaaattagtgaattttatttcattaaaattgagaacttttgtgcctcaaaggataccatgaagaaaaggaaaagataaacttcacactagcagaagatatttgcaaagtacaaaactgaaaaggacttgtatccagcatacatatctttataactcaatataaagaaggtaaacaatctaaaacataggcaaaaggtaggcatagacattttaccaaaaaagatatatgaaagaaaatgtaatcctcattattagtcattagggaaaataaaattaaaaccacaccaagataccaccatacacccacaagaatgtctataataataaacacagacacctcagcctgggtgacagagtgagacttcacctaagaaaaaaagaaaaagagagagagagggagacagagagagaggaaggaaggaacaaagggaaggaagggaaggaaggtaggaaaataaaaaaataaataagacaatacaaagcattgttgaggaaatggagcagatggaactctcattcattgctgatgaaaatataaaatgctgcagtcactttggaaaacagttgggcagtgtcttaaaaacattaaacataaatttaccatatgacccagcaattctactcccaggaatctaagcaagagaaacgaaaacatatgcccacaaagggacttaaatgc

SEQ ID NO: 4562 - DNA, 1024 bp, Homo sapiens
ctttggctaaacattaagctatgcaggcacaatggtgaccttagtaagccaggcttaactataaaaacaagaaaaaacccaaagacattatcaaccatacattccagagaatcagatttcccaaatttagtccaggcaagttactaaacaagcaaaacattaactacaaatctcagaggagaaaataaagatcccaagatactgatatacaatatattatctgaaatgtcttatattcaataaacaagacagatagaaagaaacaagaaagtgtgatacatactctgggaaaaataacagttcatataaactgtctctgagtggtcctatatgttagatttagaagaaaaagtcttcaaagaaactattcacagaactaatgaaaatgatgtttaaataattaaaggaaagtatgatagcaatgaccccaatgatcgaatgaatagaaaatttcagcagagataaaaatcatataaaagaaccaactggaagttctgaagttaaaatatactagaatatttcataaaaataaaagatcaaataatcaggaagatataataattttaagtgtatttcacctaaaaacagtgtcccagaatatgtgaagcaaaaaaactaagaattgaaagtatagacaacaataatagctggagatttcaatacccactcttaataattgatagaatgcctagaccgtaaattggctagggtaaagaaaatttgagcaatgctatcaaccaacttaatataactgacatttatagaacgctccacccaaagagttcagaatacacattcttttcaagtttatttggaaaattctgcagatagatgatgtactgggccactaaatacgtctcaatgcattttttttgaagaaaattaatcatatgaagtatgttctctgaccacaacaaaattaaattggagatcataatagaaacaaatctgggaaaatgtcaagtatatggaaatcaaatgacatacttatgaaaaaaacccctcatgattcaaaaaagaaatc

SEQ ID NO: 4563 - DNA, 2224 bp, Homo sapiens
ttctctaaagctctattcattatgagaacatagtagcagtccataaagggtctgagagaaagaaaccaagacttaagaattttatatgcattcatgaattttatatgctggtaatctcagtggaaaagatatgctcaaagtaagaaaaaaaagatatttaaatagtgtctgcactgtgaaactgaaacaacaaacatttaaaatgcacatctaaataagtgagcagtatcttaagacttagagtaggtgactctgtagccatgagcatgaatagatagctatgaaaaagaatcaaatagggactttatgaatgaggcctatagttgctgaatgataacaagagatgggctaacaaatctaatgggcacagttggtgaataaaccggtaagtgaaatgttgggccaaggatttcacttattatgtaacaacaaaagagttataggtcagattctcttaaaacaggaattcaagctactatttaatcataaagaaaaagatccaaaatacatcgtgacattttttaagcccattgcggaatgctgtgttaattttttattgctacataacaagtgaccataaacagcaacttaaataacacgtttatgatctcatagtttgtgttggtcaggagtctggatatggcttagctgaattttctgtttagggtctcaaagactgcgctcaagatgttggccaggctgctttctcatctgaaagcttgcctggaaaaagaatacctccaaatacactcattattgacagagtttcatctccttgcagttatggaaaatagggctttggcttcttattagctcttagctggaggctgccctcagctcctaaaggctgtcttcagttccttgcaatgttgagctttcacaacatggcagcttaattcatcaagcctctagatgaattaggagagtctctagagtgagcctgctggaagatcaagtcttaaataatgtaattatgagagtgacatcccatcaccattgccatatcttattgtttagaagcaagtcactggattctacatacactcacggagtggaaatttcatggaggtatgaaatcaggatacaggaatgataggggagataccttagagcctgcacatcacagaatctgtactattatcataatcataagtaaagagataattattattccattttaggtgacacataattgtacatagtcatgggctgcagagtgatattttgatacacgtttacaatgtgtaatgatcaaatcaggataattagtatatttatcaccttgaacatttatcatttctttgtgttgtgaacattcaaacattcaaatcctgtcttctaggattttgaacacatacactaaagtatagttaatcatattctccctgcagtgttacagaacactaaaacttattcctcccatttagctataacttgttagccattaaccaacctccccctttcctttctccccattttccttcccaggatctaataaccacatttctattctctagttctatgagctcatttttttaattgccacaaatgagtgacaatatgtggcatttgtctttctgtgcctggcttatttcacttaacataatgtactccagtctcatccatgttgccatgaatgacaggaggtcatttttttatggctggatagtattccattatgtatatataccgcattttcttattcaattcatctgtagatggtcatttaggttggttccatatcttgtctattgtgaatagtgctgcaataaacatgggggtgcaggtatctctttgatatactaatttcctttcctttggatatgtacccagtcatctagtagtaggattcttggaaaatataatatttcaatttttatttatttatctgtttatttagagacaggagggtcacattctctcccccaggctagagtgcagtggcaccatcataactcactgcagctttgaactcctgggctcaagtgattttcccacctcggactcctaagtagctgagactgcaggcaagtgcaaacatgcctggctaatttttaaaaaatgttttcatagagacaggatctcacttagcctatgcttgttttgaacttctggcttcaagcaatcctcctgcctcagcctcccaaagtgctgggattacagtcatgaaccaccacatctggcatatttttgttttttgatgatagttatcctaactgggggg

SEQ ID NO: 4564 - DNA, 1031 bp, Homo sapiens
tatcttattttattgtagcaggtgaagatgctcccaagagatttaaaaaaatgtttttcaaaatatttttctttatatgaaaaaaactttttcttaaaataaaaaacagcatatctatctgaactaaaaaaaaaaaaacaggaaaaattaagaagccaatatttggaaaatttggtccaaatactcactttaaattgatttcttcaatactagagaaagttagattttcttcctaattgaaatatcacatggttaaaccaggaaccctgggaaaagctggggtatcttttgataattatgaagtgaaagcaagaatttctatttaattatttacaccctgaccaaatagtatagaatttagctcagcaggtgaaccagggagtctcacggatcctgtgtacttaaaggaataacaaagcacgggggcttatggcctgtgaaagccagagtgaaggggagaattgagcagtaataggctcattttttttctttataaagactcattctgggcctggcgtggtgtctcacgcctttaataccagcacttttggaggccaaggcgggaggatcggttgagctcaggaatttgagaccagcctggacaacatggtaaaaccctatcactgcaaaaaatacaaaacttaactgggtgtggtggcacacacccgtagttccagatactcaggaagctgaagtgggatgaccacttgaacccaagaggcctgggctgcagtgagctaagatggtgccactgcactccagcctcagtgactgagtgagaccctgtctcaaaaaaaaaagactcattctggataattgcccgtttctgatttttttcctctagaattctgattttttcctctatctcagtttgtgtctttgtccattaaaataggccacaatgattgatgataaatttgttctctgagatagcacctagaggaacagttatccaaagtgtcctgtgccctgtcaaaggctgaaataaccaccattgctgaaattatgtgtttatagataatgcctcccta

SEQ ID NO: 4565 - DNA, 1067 bp, Homo sapiens
gagtgcagtggcactaccatagttcactgtaacctctatctccccagctcaagtgatcctcctgcctcagcctcccaaagtgctgggattacaggcatgaaccactacacccagcctatcagtcatcaccctgatcagtcagtagtcatcaataccaaggcaagaccctctataagcaaaaagatgatgactcactaaagactcatatgagcattagcattttttagcaataaagtatttttaacttaggatttgtgtatttttagacataatatttttgtacatttaacagactatagtgtaaacataactctttatatgcactgagaaaccaaaaaatttgtgtcattccctttattgtgatactcactttattgcagtggtgtggaactgaacctgcaatatctctgaggtatgcctgtacataattatgtactattttatattggttttgagtcatttcatgcaggtaaatttgattatctcaattaaattgcaatacctttaaagtcaaagactgagtcttatttggactttttattctcatgacagtgaactattggcatggctcaatccattgacctgttttggttcctgatgaagttttgttaatttaaatgagaaaaataaggacagtgaagtaagttttttataaaactaaatttatttggcttataaaacagtttaatattatgcctttcctatattttttgtgttatctctttttctagatgattataatagatgataatttttaaatgtttctatttgtcaaagtacaacattgtccatcctgtgtcagtgtctaacttttccttgtacttattcaaataatctcatagttggaacttattacttattgtgtcacacaatatgctggtaaacactgaaatggggaggggttattttcattctattttagaatggcacagtttctatggtatagtgactaatctgaactaatatgtaaaagattaagattcacttgagaatcattttcaaagaataacttttttaaatgtagcacactgctgacttgtgtaaaaattaaatgtgatactgaactt

SEQ ID NO: 4566 - DNA, 1045 bp, Homo sapiens
tgggcctcgtgctttctatttttgaagtttattaattatttgttcaatttgtttactggtatgcacctattcagattctctatttcttcacatgtcagtttcagcaaaggatgatgtttagatgatggattttacatctttcctaatacatgcattcaattctataaatttttctctgaacattgctttgattacatcccactcattttcgtaagttatgtttttattttcacttaattcaaaatattttaaatttctcttaagacttcttctttgaccaatgtattacttaaaagtgtgttacttaatctccatgtattttagaatttttcacctatttttccgttattagtttttagtttaattccattgtggtctgaaagcagatattgtatgatttctgttcatttaaatttgttaaagtatgttttatgagccagaatgtggtctctcttagtgaatgtttgatatgagtttgagaagaatgtatattctgctcttgttggatgaagtagtctataggtgtccgttacacctaattgattgatggtgttgttgagttcaactatgtacttactcattttctgcctgctgcgtttttctatttctgatagaatagcagtgaagtctccaattataatagtggttcatctatttctacttgcatttctatcagtttttgcctcatgcattttgatgcctattaggtgcatacattttaaggattgttatgtcttcttggataattcaccactttttcattgtgtgatgcccttcttgatttctgataactttccttgatctgaagcttgttctgtctgaaattaatattggtactactactttcttttgattagtgttaatatagtatattttgcccaccaattcacttttaatctatatgtatatttatatttaaagtgggtttcttgtagagaacatgcagttgagttttgtttcttgatccattctcacaatctccatcttttaataggtgcatttagaccattgacattcaaagtgattattgatatagtttgattaa

SEQ ID NO: 4567 - DNA, 1028 bp, Homo sapiens
attctcctgcttcagcctcccaaggtgctggaactacaggcgtgagccaccacacctggcctttttgaaccatttttaagtgtagagttcagtgacatttaatacattcacgttgtgtacaactatcatcattattcatctctagaactttttcatcaccccacattgaaaactgtgtaccccattaaataataactctgtttctctctcccctcagcctctggtaaccactagtctaattcccgtctctatgaatttgactattctacgtaccttttataaatgcaatcatacaatatttattattttatgtctggctcgtttcacttagtataatatcttcaggttcatccatgttgtagcatgtgtcaaaatttctttcctttttaaggctaaataatattccattgtatgtatgtatacacacacagcacacatacacacacacacagcacacacataccacattttgtttatccatttttttatttgtgaacacttaggtggtttccacttttggctgttgtgaataatgttgctatgaacattgatgtacagatatctatagtagaagtatctgctttcagttcttttgggtatatatccagaagtggaataagtggatcatatgataattcagtgtttaattttttgaggaaccactgtactgtgccctacaatggcagcaccattttacatttctacaagcaatgcacaaagtttccaatttctctacatccttgccaacacatgttattttcttattttcttgctttctctgtttttgataatagtcatcctattgggtatgaagtggtatctcattgtggttttgatttgcatttccctgattattagtgatattgactgcatatgtaattttataagatattgccaaatccctctctaaaaggaaatgttgcattcttttttttttgtttgttagttaagcaattattttattgctcaagtacatagacaaatttatgcaaccagggcagaggctgtatatgattcatatttccagt

SEQ ID NO: 4568 - DNA, 1043 bp, Homo sapiens
ggagaggaattctaaaagaacggggcggggttgtggggaagataatcatttgtgctgggaatgaaggaacgctcacagatagtttctaatgactacgaatgaggactttgtctccacattctaatattaaaatatttctgcacattaatcagaattgggaaaggaaaaaaccccacctttattcagtactttcttccccagctttattgaagtataattaacaaataaaaattgtatatacttaaggtgtaaaacgtgttgtaatgtatgtataccttgcaaaatggttaccacggtcaatctaattatccattgcttctgcatagttaatggctttttttggatagtgaaatatttaagatctattcttttagcaaatttcaagtatatgatgcagtattggtaaccatagtcaccatggtctacgtgagctctccacaatttattcatcttgctgaaataaaactttttaatccagtgcttaatgtgtgctaagcactgtgctaggcactggatttactctgggaactctgaaggtcacagagataaggaagaaggggctttttgttttggttttgtgttgtgtttattttgctgggttttatggaatatatgtggggagaaaaatgtaaatattttgtgtaaaatgtagccagagcaataaaactgatttgcaggggactggagaatttagtatttgaccatccacactaaaccacagagcagtgacttggcagagccagaaggcattatcacatctcttctttatataggaggaaacagcttctctaccccgacttaatcctgatacaaaagaaagaaaaattgctctttgctttaattgcctacagtgtgtgtgatcctcagccaccgcctttaccagctggctattcaagtttgtaacagaaattgcagatttgtgaaatctccctggaaagagtcccaggagttcttgtgaagaggatttgctgagttggcaaacttaaagaattcttgttggtagaggcagtacagtccttgggctatgggcctagaaaaactga

SEQ ID NO: 4569 - DNA, 1053 bp, Homo sapiens
gcctgctttttagggagatgaagtgttttgtatccactgtttaggggaagggagacaggtagagtagattacacactgaggaaactttagaatgggtcccctgggctaagtgcggtagctcacacctataatcctagaactttgggaggctgaggtgggcagattgcttgagcccaggagtttgagaccagcctgggcaatatggtgaaaccccgtctctataaaaaaatacaacaattagccgggtatggtggtaggtgcctatagttccacctactcaggaggctgaggtgggaggatcacctgagcccagggaggtcgaggctgcagtgagccaagaccacgccactacactccagcctggtagacagaatgagaacctgtctcaaaaataaataaataagaatgggtcctctaatggggccaacgagaggctccctgtggttgaacatgaagacatagacctggtaaatgcacagcaagtattattacatttttttattcctggactctcctgccactcctcaagcttctcaataaacttccatgtaaaaacaaaacaacaaaaaacaataaaaggctttgtttccccctcgacaaggtgagaaatcttaaaaataggagagaaagagagcaggtagatctgggagggtctctctggcatgccttttgacccccttgtccctcttctcctgggaccattgtctttcttatcgcatgtctccagtctgccgaggccttcctccatcctggctcacctttgctctgtatttaattttcaatgtgtcctctgcagcccctgttctttgctgagactttgctagattctcaattttatcatagaatactcctaccacttgaactaaaaacctaactttcttatgagggaaatgtcaatgtaattacacaaatatatctgataatccatgataattcacaacccttttgagcagacgctgctgtttctcttctcttgtctgaggaccaagaggcagggtcgatgtgctcctagctacccactgcctcatcctctttttcaaaaagccttttttt

SEQ ID NO: 4570 - DNA, 1040 bp, Homo sapiens
cgccactgcactccagcctgggcaacagagcaagactctgtctcaaaaaaataaataaataagtaaaacataaaaacacacgatgtatatatttcactttaagcaacaaagagcaattctgagtttgttgttgttgttgttgttattattttgagacagaatctcactccatcacccaggctggagtgcaatagctcgatctcggctcactgcaacctccgcctccctggttcaagtgattctcctgcctcagcctcccaagaagctgggattataggcacccaccaccatgcctggctaaccctttatatttttagtagagacagggtttcgccatgttggccaggctggtctcgaattcctgacctcaggtgatccacccacctgggcctcccaaatttctgggattacaggcgtgagccactgtgcccggccccattctgttttaatttcaggcagattttgttactttacttgtgatggatcaatagtaatcttagatgcaccaaaaagtcaccatctaaaactgtagagttttcaaaatgaaataaatgttgttaagaattatcatttagagccaggcacagtggctcacacctgtaatcccagcactttgggaggccaaggcgagcaggtagcttgagcccaggagttcaagaccagcctgggaaacatggtgagaccccatctctacaaaaaatgcaaaaatttaactgggtatagtggtgcatgcctctactcccagctacttgggagtctgaggtgggaagattgcttgagcccgggaggtggaggttgcagtgagccgagattgcatcactgcactccagcctgggcaacagagccagaccctgtctcaaaaaaaaattatttaggaagttcaactcaagctggtctttacactccttttaattatttctaaaaatgtgatgagttgtgtgtcagttattttatcaggaatgcaaagctcattttcagtgcggatcggcaaactgtttctgtaaaggtctagatagcaaatattttaggctttgtggaga

SEQ ID NO: 4571 - DNA, 1105 bp, Homo sapiens
tgttcaacttcatataattaaataacttatatataaagatataaaagattttatatcgcttgaacccgggaggcgaaggttgcaatgagccgagattgtgccactgcactccagcctgaccgacacggcaagactccgtctcaaaaaaaataaatattaaacatttctcatttttaatttctaatacagtaaatattaataactataagctacagaaacacaaagtttttagggtcctaaataatttgtcagtatataaaggggtcttgataccaaaagaattgagaatgactaatttaggaaaagattgatgagaataatctaggctcttctttacatcaccgtacatcaggttcatgtgtatttttagcatgtcaccctctctttgtttttcagagatcagagacttaaagctctatttctgtcccagattcttctttggaagtaagaaagttgtcagtcttccaaagataacaattctttttttttttttttcttttagatttgatggtagagtggtggcaaagcttccttttacccctctttcttacatccaaggactgtctcatcgaaatctgctgggagatgacaccacagactgttccttcattttcctgtatattctctgtactatgtcgattcgacaggtgagtgatcacatctaccatttaatatgtatatttttccttgctgtcataccaattagcttttacttttataatactagaaatgtttacccattgttcctgagttctttcagttgctcattttagaatttcagtgtatcttccaaaagccattttaaatggctgtaggtctagatgactgatccttagggatgagaagtagtgataaaaccaaacatggattccacatcccattcttagagctctcaggctccttctttattacaactgcctaaagctgcaaaagtagagagtgggtttggtcttcccagtaccatttcttcattatataccagcaccatttagcggctcaggagcacaagtaagtttaacaatgtggtaattttaggttattcacagttgagataaagtttaggttatagaatttacatttggccaacttggtgatttgacattcg

SEQ ID NO: 4572 - DNA, 1050 bp, Homo sapiens
cacctacacccagtcgttcagtacctttgcggaagtcagtcttcttacttcacggcaaacccaagctaaactaatattacgaccacagaagttgggctgaggtagaagtcaagactatcccaataactggattctggccgagaaaaaggcgcgcgccagcaccccagtcagtaaaatctaccgggcaaagttcgccgccgccactatcctcctctggctctgaaatagttccaattctcgcgagattcggcctgactaccagcccttcagctccagtgagttgcgggttggtttcctctagactctcgtggccacaccgttctccgatacgagcctttccggtgctatgccccggaagcggaagtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggtgagagcgggtatttctcagacgtttgatcagtccccgggaggaagggccccggggtcccctgtgccaccaggggaaagatcgcgagccttacttgcttgagaggctcatctactccacttcagggaatctctgggcaactcgtgaacaggagcaggaggggagtatggagtcgattgccgagttttctttggtctcaggtagatttcacttgggtatttgtggagacaccttcacatcatgttactgttgttttggctgaagagtcagttgtattagcctttgaaaaaagttaactatgggtaaatacaaagcgaaaagttggaattcctccttctccaacagtaaccactttgtttgttgtgatcattccagtcatttctctattaacatgttgcttttaatgttttaggcataacctgggtcctggtttacaggacagacaagtacaagagactgaaggcagaagtggaaaaacaga

SEQ ID NO: 4573 - DNA, 1024 bp, Homo sapiens
agagagatctaagagggcagaagccctgccctgccagtattttttgcctccagccacctgctctgttctgagacatgcctgagaccagctgcctacagggggaccagggtctgtttctgctgttaaccttggttccctcctgcattcctgcatgtggggatgtagacaggaagcctgcaggtatggagcaattgaagcagagtctagatagagcccagactccttacttcccatagtactattctgcattttgtagtgctgcttatgcttttcagtgtttccacatctatttactaataacatcatagtacaacagcaagaacatggcctcagaactcaaagttctggaattctaatattttatttgattgtcagtatttctgtgagatagataaaataggaattatttcctctgatctgcaggtgaggaaactcagtcacagggagcacatttatccatacttgtggagctatagtataactagtattaggacaaggatagccaacatagttaaaaaaaaaaaaagtactggacttacagtcaagaatcctgggttcacatatcagctactgtcctgctatgtaacttagaatacatctgttttctgatgcttaattttattatctataaaataaataggttggactagaaaaagaaaatatggcggatggtggacatctttagtcctttcagtcctttgcatgcctgtggcagacatggctaattgatcatagctcactgtcctgctgagccagatgcagcccagagtcctcagtacagggctcctgggagccagcaaccactgctgaaaatcagggttagcacataaaaggaaattgcttgccattcctcaactagctctccaagtttttttccagtctagcattctgggcatagaaaactggtctcctcccttccaacctcatgctctctacatcacgtcatcctggaacactccttttctatagatctgtaggaaaagtaaaggactaaaataagatctaggttcaggccccttctctt

SEQ ID NO: 4574 - DNA, 1113 bp, Homo sapiens
gtaactgcagttatccccaggtacctgggagctactccatgcagccagtcaccgcacctccatcctaccctcctaccagctattcctctacacagccaactagttatgatcagagcagttactctcagcagaacacctatgggaaaccgagcagctatggacagcagagtagctatggtcaacaaagcagctatgggcagctgcctcccactagttacccaccccaaacttgatcctacagccaagctccaagtcagtatagctaacagagcagcagctacgggcagcagagttcattctgacaggaccaccccagtagcatgggtgtttatgggcaggagtctggaggattttccggactaggagagaaccggagcatgagtggccctgataactggggcaggggaagagggggatttgatcgtggaggcatgagcagaggtgggcggggaggaggatgcggtggaatgggcagcgctggagagcaagttggcttcaataagcctggtggacccatggatgaaggaccagatcttgatctaggcccacctgtagatccagatgaagactctgacaacagtgcaatttatgtacaaggattaaatgacaatgtgactctagatgatctggtagacttctttaagcagtgtggggttgttaagatgaacaagagaactgagcaacccatgatccacacctacctggacaaggaaacaagaaagcccaaaggtgatgccacagtgtcctgtgaagactcacctactgccaaagctgccgtggaatggtttgatgggaaagattttcaagggagcaaacttaaagtctctcttgctcggaagaggcctccagtgaacagtatgcagggtggtatgccaccccatgagggcagagggatgccaccaccactctgcggaggtccaggaggcccaggaagtcctgggggacccatgggtcacatgggaggccgtggaggagatagaggaggcctccctccaagaggaccccagggttcccgagggaacacctctggaggaggaaacgtccagcaccaagctggagacaggcagtgtcccaatccgggttgtggaaaccagaacttcgcctggagaacag

SEQ ID NO: 4575 - DNA, 1036 bp, Homo sapiens
cgccccgactttcttaggtgcagtggagtagtgcataggtggtgcatcctgagggctcccgaggggcatcacctgcccagtggggaagtgagcctgctttcagttagaggcagggcctgtgattgttgggtcacagctgggtgtcttggtggtgggaggaggaggaggagtggtagatgtttctccaggccctcatctggctcttgtaggcatagctcaagatagtggtctgtgcctggtgtcatcacttgcttttggcctcctgctgtgcagacatggtctctcagctcacctctgggattcctgtgtcgtcttcccattgagggcttcaggatgtctctatgtcctgagtcacccctttatgaaacaacctagattactttcatccctgtgttgtctttcttatccttccatctccttttgtcctccacttcccccaaagggaatttagtctgaattttaagcctttgggaaaggaaaaaaaaagtagtaatgtaattttctttatggttactgaagtgacttgaatttcttgtgatttgctggactttgcgtatctggttagtttgggagaagagaggtaaagagataactgggacttgcaagttcagagaaaaaagtatgtatgactgggaagggtggcagggtgattggtgaagtaacaggaagggaaggcaggaggtgtaggtgggaaagctaagagagttggatagagggagtgttgatagcacatgtgggagtttgtgccagtgcccatttcatgactctgaagacctttacaggggtcatgggcctattttaacccatcttaaattgggtttactgtttagattgccatatgtggtgatttattgtctgaatcccattcaggcgtatctgtttgggatcattcttctctagaaaaaaacaaatccccaaaagtggctccttgtagcgggtgatgttgggagcagcttctggccctggcgggactcccaagccctctctgccctgctggccagtctctgagggcttttgcctctctattggccacttg

SEQ ID NO: 4576 - DNA, 1027 bp, Homo sapiens
tactacgcaaactaccattattccccttaatccatgtcttcattattaccttgtattggatgtgaatctgtgattatttgtgcatgaattaactcttttttcccttaacccctgtggtatagttttggtggcattaatttggaggatctcaacttcagtacaggagtttactttgtgtcttgtttgctactgtaatgagtaattttaaaaagtttttcttactcatagcatagattccagcctcaaaatcctctctcaggagcccagcaatttgtggcaaaggatccccaagatgatgacgacttgaaactttgttcccacacaatgatgcttcccactcgaggccagcttgaagggagaatgatagtgactgcttatgagcatgggctggacaatgtcaccgaggaggctgtttcagctgttgtctatgctgtggaggttggtttgctgttggcagaaataatcttacaggttgaatgtgataggcttgtgtgttgtttaaagtcggtattgcaagaaaagaatccaaatgtcactctgatttcacagaattgtcattgttgaagttgttttctgttttttttgagacagcatcactttgtctcccaggctggagtgcagtggcacgatcatggctcactgcaacctggaaatcctgggctcaagcgatcctcctgcctcagcctctcaagagctgggagtatagacgtgcgccaccatactcagctaatttaaaaaaaaaaaattttttagggatgggggtctctctctcttgcctaactggtctcgaattcatgggctcaagtgatcttcccgccttggcctcccaaggtgctgggatttacatgtgtgagccatagcacctggctaaaagttgttttcttttaagaggagaaactcattataatccaaatagttgtcttcagttaatagactaagcttttcagaaaggttatttatggcataactcttctggttgatctgatgttttgtcaacaggggaatggtttttaaggaaagaaatgaa

SEQ ID NO: 4577 - DNA, 1036 bp, Homo sapiens
tctgtcacatgctggtttgtttgcttgcttgtttacttgcttgtttaccaatagagttgacctgttattggatttcctggaagatgtggtagctacttttttcctattttgaagccattttcgtagagaaatatccttcactataatcaaataagttttgtcccatcaattccaaagatgtttccagtggtgctcttgaagaggaatgagtaccagttttaaattgcccattggcatttgaaggtagttgagtatgtgttctttattcctagaagccactgtgcttggtagagtgcatcactcaccacagctgcctcctgagctgcctgagcctggtgcaaaaggattggcccccattatggtgcttctgaataaatcttgccaagatagacaaacaatgatgaaactcagatggagcttcctactcacgttgatttatgtctcacaatcctgggtattgttaattcaacatagggtgaaactatttctgataaagaacttttgaaaaactttttatactctaaagtgatactcagaacaaaagaaagtcataaaactcctgaatttaatttccccacctaagtcgaaacagtattatcaaaacacatgtgcacacagattattttttggctccaaaactggattgcaaaagaaagaggagaagaatattttgtgtgttcctggtattcttttataagtaaagtttacccaggcatggaccagcttcagccagggacaaaatcccctcccaaaccactctccacagctttttaaaaatacttctactcttaacaattacctaaggcttcctcaactgccccaaatctcttaatagcttctagtgctgctacaatctaagtcaggtcaccagagggaagagaacatggcattaaaagaatcacatcttcagaagagaagacactaatattattacccatatacatgatttcagaagatgacataagattcctcttaaagaggaaatgtcaggaatcaagccactgaatccttaaagagaaaagttgaatatgagtca

SEQ ID NO: 4578 - DNA, 1040 bp, Homo sapiens
gtgataagaacagtaacaataacagctagtgtccattgtttattactggctgggtgctatactggctacttttcatgtattaactcattcagttctcaccacatccctttcttgcgcaaccttccaccgcaacaggtaggtgctgtttttccacatgtgtgaaatggaaagctgatgcacagagaacaaactggcctaaactgtttgttcttgcagccaggaagtggtggtgctgggactcaaacccaggcattcttgctccagagccatcacctgacttctatccatgatgctgtacttctcctctggctgcctcactggtagctggccaggctcctagctcagtgtaatttataatgcactttctgcttgtaatgattgactgctgtttcaggagattacggtgatgataactaaggtagacttgtaggttgtaggtcatttgagggcttaaattcttagcatttatttaatctctgtctttttcaattgtagaacaattccgtgttgaactattgactccctaccatgattggaaatctcagttttgttttgtttctaattttttttaattccaagcagggcctaggacagtgtgtgtcatagagcaggtgtttaggaatgattgtctggctcattacttgagacaaacactctcacactctgttggaataaagaatcccacagtcctggcgcttgttttgctgctgtgcatgcaggagaggcacgggccactggtcgtcttctgggctggcaaagccatctgacttcataggaatatagaggtagcaattacaactttattccctggcaacaaattatcaggatgactgttaagaagggcctgctcttcgaagttaaagtttactttcacaggacataatctctaaagcgcagttatctttatataaataacatgcccaaaggcagtgcctggtttaataacaaaataaaactgttttcccataagtctccacactgaataagtgagtaaaacagatacttttgaggttcccactttattatgctgacaaaggagc

SEQ ID NO: 4579 - DNA, 1044 bp, Homo sapiens
gtgaatcacctgagggcaggagttcgagaccagcctggccaacatggtaaaaccccgtctctactaataatacaaaaattagctgggtgtggtggcgcacgcctgtaatcccagctactccagaggctgaggcaggagaatcacttcaacccaggaggcggaggttgcagtgagctgagatcgcgcctttgcactccagcctgggcgacaagagcaaaactcccatctcaaaaagtaacaatatgtatcctgtcaaaaactctcattgccacttggaacacatagcctagttatcagtttcacaactattctcaaagacttagtaagaatatattagaagtccttactatcaatgcagttactgaactccgtaaaaataatttccacagtggtgcaaatcgattagtatagttgagttgaattctttatcacagctttttgacaggtctttattgatagcttcactatgtaagttttctttctcaatgccaagtctgacagccctgggtttcaactcaactctgccacacattaactgtgagactttgttaacctctgtctctgacctttaatattttcaagagcaaaatgaggataatcatagtactgacttcataggattgttctaaagattgagataaggttttaacacagtgcctggtccacagtaaatattgaagatatggaaagttcaggaaacgggccaggcgcggtggtgcatgcctgaaatcccagcactttgagaggccgaggcaggtggatcacctgaggtcaggagttcgcgacaagactgactaacatggtgaaaccgcatctctactaaatacaaaaaaattagctgggtatggtggcacatgcctgtaatccgagctacttgggaggctgagacaggagaatcacttgaaccagggaggtggaggttgcagtgagctgagatcacgccattgcactccagcctgggcaacaagaagaaagttcagaaaatggtaatcttattaattgaaggtagacccagaaagtacttttctttaagtactttaaagg

SEQ ID NO: 4580 - DNA, 1060 bp, Homo sapiens
ccgggaggcagagcttgcagcgagccgagatcacaccactacactccagcctgggcgacagagtgagactccatctcaaaaaaaaaaaaaaaaagtttttggcagttgtgctcttattatctgaaacaaaatccagatgcaaatgaactctttgaatcctttcctttctgcctgtttctacctgtaagccctccgggaagattctgtttacaactgtatagctacttgaccaccaagaaagaagaaatggagtatgcttcccattctctccttaccataaatttgtctattattattgatgattatttttctttctgttttctttatagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaatagaaaaatgcagcaaacttttaataacagtctctctacatgacttaaggaacttatctatggatattagtaacatttttctaccatttgtccgtaataaaccatacttgctcgtatataccccctgcctccttctgttccagtcagccaacatatgtacataaaagaacacacaaattcaagaagttggaagattaaattatctgcttatttagtgtaggatggtcaggtagctagctataagtgaaaggaaattttgctgaagagactgagaaatgggtagtggaatgactatcaagatgacctcaaactatttaaaaacattttaacttgccatgaagaatcttgatgatttttgtataaatgttgtataaaattcttttacagctacagatttttaaataggatcattgtaaagattaatgagataatgttttaacatagtgcctggtccatgataagtgttaaatttttcaattaccctcagtaactgataatgtagcagaaaatactctatattcagacagacctgaatttgaatcccagctctatgacttat

SEQ ID NO: 4581 - DNA, 1072 bp, Homo sapiens
ggatgagaaaagcaaggagctagtcttataggtcaaggaagatgaggtatagttaagagtcatcagtatcacagaacaggccagcagggctttattaggtatgtagaactattataaaccaaggatcttgggagatattaatatctgctggccagacctaaaaaaaactgaaggcccaaggaaagtgactggactcactggaaagtatctaacaaatactttggattccaaagtatttccaataccttgaagattcctttgaaaacatcaaagcacaaactcaaatctgcacaagattacaaaagcacaattttggtgttatttttagaatgcaatacacaaagctatgttcatttctctcagcaagcattttcctgggtagtagtaatagcttaggaatcaaatgccacttttgtttttccttttttcactagtttgaaataccacaaatcacaggtgagtcagtcctcccagaggaaaagacagtcctagggagaatcacaggcctggcagacaagaccacactgagagcagtagaaggaacctgcatgcttaagggacagaggactgtgttgtgttctcataatagaccgctggatgaagaagtggttaaaaaccaaccctcgaaaaacaaaaatccctggctaatcctgaaatatatttaacttgaagtctttggatgatttttttaaggttaaaaaaaagtttaggattattataaatcaatatttataaataagcaacaatgtatttggaatttttgtttacctgattaaatatgtttttggtatgtgtatactgtggaaatggtgaatttgtacttggacttgtggtctgtggactttgttgggtgcctctgcctttctcccattttctgcagccatatccctattgtcaacctcccttcccatgggctaaagcgagggagactgagcagaaaggggtggattactgcagaattggtgggggagtgcccataccagagtcacctgcaaatactcatccatgcattttcataaattcctccaaggcaattaaattcagataactgtttaaatgacctacttctcac

SEQ ID NO: 4582 - DNA, 1011 bp, Homo sapiens
tggggcatgggaggaccagagacgaagggcttggaaggagacccccacatgcatcatttcctcctcttcacagtgtgctgggagtccagccgtgcactgtgccagatgcctcaggaggagaaccctccccagtgtactgtgaaggatgacacagcacttcttcctaatgacacgcgaccgtcctggtgcctctacatggttgatgcgggcagtgtgggaccctcagttctaggactggtccgcagagaaagcacccaggagcagagcgcttcggagcggtcctcagtggcgccacctgctggtgctaatagggacagccacaggcctcttgcagactggcccaccctgcctacttccctactgacaagttctttggtatttcaaaagggagaaaccactataaaagacaagaggaagggcaggtactaggtgtttcatttccagaattaaaaaaaaaatccatttaagacgtaccactgttttaccggactgaatgggactgtagtgccaagcacagccaggaaatagagaaactgttattatggaagggaatttgttcacatgggaaagcctcattaaatagattctatgtgtgatgtttgagtgaccaatgaaaatagctggcctcagttctgcatggcacactcccaagagcaacagttactattatcacaagcctggtataaataagatagaagcagccctggacccacagccagcaacctgggttattggcccagctctgtctttgtgtgcacatgtcatttggacatcttgtcacctttctaggtcctctgtaaagtgggaaaacagagtggagttggattgaatggtctccaagatcatttccagctctgacctttggtgttctcaggatttgtaaagcagagataggtaaaacacaaaagcagacccacggaccgacctttgtataactttggagtgtggttgctcatgcacatgtgaagtgcaggcagatcaaggttctgtggctttgtctgccctgtccat

SEQ ID NO: 4583 - DNA, 1035 bp, Homo sapiens
aaaataagaaaatctttgtgtaaaaattgagcaaggtctatacatgtgatttttaacagctttattgaggtgtaattcacataccaatatgattcacttgtttaaaaacatatagctcagtggtttccatcaccacaattttagaatattttcatcacttcaaaaacaagccctataccttttggctatcatttgcctacttcccacctcaccctcagccctaggcaatcactaatctactttctatctctatagattttcctgttctggacatttcatatgaatgagatcatataatatgtggtctttcatgactggcctttttcatgtagcataatatttttaaggttcatccacattgtatcatgcattcagtactttattcctttttatggctaaatcataatccattgtatggatataccagattttgtttattctttcatcaaatgatagacgtttgggttgtttctatcttttggctattatgactgatgctgctgtaaacactgtgtacaagtttttgtgggaatatatgttttcagttatcttgagtatattcttaatagtagtattgctgagttatatggtaactgtgtttaatcatttgaaaaactagtagagttttttccaaaatggctgcaccatttaccattttacattaccactagcagtatttgagggttctcacttctccatattctcaccagtatatgttagtatgactttttaattctagccatctcagtgggtgtgaagtgatgtctgattgtggttttaatttgcatttccctattgactagtgatatcgagtatctttttatgtgcttattggccatttgtatatcttccatggagaaatacctattcagttctttgcctatttttaaattaagtcatttttattattgacttgtaagagttatatgttatcaataaaagtcccttatcagagatataatttgcaaatattttctcccattctgtgggctgtctgttacttttcttgttggtgtcctttgaagcaggaagttt

SEQ ID NO: 4584 - DNA, 1029 bp, Homo sapiens
tggaagcacaaggaaatacattttcttagatagaggaaatatggtagagaattctggtagagatgggtgtgattttagccttagaagccaggataaaaattgtaattctatttaatttgaatcccatatcataggaaattggaattccttgtatgcagcttaattttgactatactgaattgttactttgatgcaactaggtcaaactaaattggaagagattaaagtcagaggctctagaaatagaaagagacagacctgatgacatcaatagagaaagtcggcaggacctcctttatatcttttcagggagaaagaatagatacttaaataacacatgtggttgtgatagagtaatgattacaaggtgactctgttgcaaaggccattgagagaaattggtaatgatgctgtttattgaaaattaattataataaattaggaagggattgctttttggctagatgagtaaaggtaacagtttttgccatttttaacattttaaatttctgatttctgtttgatgggcaagaggggtttttgtactttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccactgcgcccggctaattttttgtatttttagtagagacggggtttcaccttgttagccaggatggtctcgatctcctgacctcatgatccacccgcctcggcctcccaaagtgctgggattacaggcgtgagccaccgtgcccggcctgtacttttttttaaggtaagtaaaactgtgagtgatcagcttgacctaacaaacagaagtaaattaaagagataaaaactaaaacaaaaaaggaaagaaataagatgattcattcttttgttctctcatttattcaataaatatttattgagcccatgtcagtatttgtga

SEQ ID NO: 4585 - DNA, 1073 bp, Homo sapiens
gaattatcttgtacaacagcctggtcgcttctttaaatttcagttttgtaagttgttttgctcaccaaagtgtccttttcatgggctctcatgctcgtgagtagggttttgttgtcatctgtatcttgctgttacatccagtaagtttaacattcatggtaacgatatttttcaagtgtttctacagtgtaaggggctcattggctgcaagattgctgtgaggtatattatagatgatagatactatgattttctgtttatttgttttatttttgttgttgttgttctgagacagaatcttgttctgtcacccaggctggaggacagtggcataatcttggctcactgtaagctctgcctcctgggttcaagcgattcttgtgcctcagcctcccaggtagctgggattacaggcatgtggcactatgtctggctaatttttgtatttttagtagagatagggtttctccatgttggccaggctgggcttgaactcaggacctcaagtgatccacccaccttgtcctcccaaagtgctaggattacaggcatgagccaccgcacccaggtggtagatattgtgatatcaagggaaaatattgatgccaggaaagaccttaacatcagaataagttattttcacaagaaatatttttgatatagatacatgtggcaaaataaaactattagattattaactatgaaaaccaattttgttagaattttgaagaatactatgcatctactttttaacaacttaattttttttttttttttttttgagatggagtctcagtctgtggtccaggctggagtgcagtggtgcaatctcggctcactgaaagctccgcctcccaggttcacgccatcctccttcctcagcctcccgagtagctgggactactggcacccaccaccatgcccagctaattttttgtattttgtttagtagagatgaggtttcaccgtgttagccaggatggtctcgatctcctgatctcatcatcctcccacctttggcctcccaaagtgctgggattacaggcgtgagccaccgcacctggccaacaact

SEQ ID NO: 4586 - DNA, 1191 bp, Homo sapiens
atatatttaaccaaggaggtaaaagatctctacaaggagaactacaaaacactgctgatagaaatcatagatgacacaaacaaatggaaacacatcccatgctcatggattggaataatcaatatcatgaaaatgaccatactacccaaagcaatccactgattcagtgcaattcctatcaaaataccaacatcatttttcacagaattagaaaaaacaattctaaaattcatatgaaaccagaaaaagaacctgaatagccaaagcaatcctatgcaaaaaaacaaacaaacaagaaaacagacgtagaggcatcacattatcagatgtttgccacaaggctgtagttacaaaaatagtgctggtataaaagtaggcacatagagcagtggaacagaatagagaacccagaaataaagccaaatacttacaaccaactgatcttcaacaaagcatagagaaacacaggctgaggaaaggacaccttatttaataaataatgctgggaaaactggataaccacatgtagaagaatgaaactggatgcttatcccttaccttatacaaaaatcatctcaagatggttcaaagatgtaaatctaagacatgaaactataaaaattatagaagataacctaggaaaaactattctggacattggcttaggcaaataattcgtgagtaggaccccaaaagcaaatgcaactaaaataaaaataaataaataggacctaattaaataaaagaaacttcagtacattaaaagaaataactatcagaataaatagacaacccacagagtgggagaaaatatctgcaaactatacatctagcaaaggactaatatctagaatctacaatgaactcaagtacatcaacaagaaaaaaaaatcccatcaaaatgtgggcaaataacatgaatagacatttctcaaaagaggatataagaatggtaaagaacatatgaaaaatgctaaacatcactgatcatcaggaatatgcaaattaaaaatacaatgagatactgccttactcctgcaaaaatagccattattaaaaagtcaaaaaataatagatgttggcatagatgtggtgaaaagggaacacctatacactgctggtaggaatgtaaattagtacaaactgtataaaaaacaatatggagatttcttaaagaactaaaagtagatc

SEQ ID NO: 4587 - DNA, 1062 bp, Homo sapiens
tctgtaggaatgatcctagctcttctttgtacatctggtagaatatggctatgaatccgtctggtcctgggccttttgtttgattggtaggcttttactgattcagtttcagaggtcactattggtctgcttgaggattcaatttcttcttggttcagtgttgggaggatgtacatgtccaggaattactcatttattttagattttctagcttatgtgcataacggtgttcatagtagtctctgatggttctttgtatttctgtggggtcagtggtaatgtctcctttgtcatttctgattgtgtttatttgtatcttttttctttatttgtctagctgtcaatttatcttactttaaaaaaaaaaacaactcctggattcattaaccttttgtatgattttttgtctctatctcctccattttagctcttgattttggttatttcttgtcttctgctagctttggggttggtttgttcttggttctcaagttctactagttgtgatgtttgattgttaacttgagatctttccaactttttgatgtgggtgtttagtgctataatttccctcttaacactgccttagctgtgtcccagaaatactgatttgttgtgtctttgttctcattcatttcaaagaacttcttgatttctgccttaatttcattatttacctaagagtcattcaggagcaggttgtttaatttccatgcaattgtatggctttgagcaattttcatggccttgatttctgttttaattgcacagaagagtatggttggttatgatttcagttttcttgagtttgctgagggttgtcttatgtctgattccgtggttgattttagagtatgtatcatgtggtgatatggtttggcgtgtccccaaccaaatctcatcttgaattgtggttcctataattctgacatgtcatgggagggacctggtaggagatatttgaatcttggtagcagttacccccacactgctgttctcatgataattagtgagttctcacgagatctgatggttttataaggggcttttccctcttttact

SEQ ID NO: 4588 - DNA, 1033 bp, Homo sapiens
gatgctcctcgagaagagcaaccccaagacacataatcattagattcaccaaggttgaaatgaacaaaaaaatgttaagggcagccagagagaaaggttgggttacccacaaagagaagcccattcagactaacagcagatatctttgcagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgagggaatttgtcaccaccagacctgccttacgagagctcttgaaagaagcactaaatatgaaaaggaacaaccagtaccagccactgcaaaaacataccaaattgtaaagaacatcgacactatgaagaaactgcattaactaatgggcaaaacaaccagctaacatcataatgacaggatcaaattcacaactaacagtattaaccttaaatgtaaacaagctaaatgccccagttaaaagacatagactggcaaattgggtaaagagtcaagacccatcagtgtgctgtattcaggagacccatctcacttgcaaagacacatataggctcaaagtaaagggatggaggaatatttaccaagcaaatggaaagcaaaaaaagcaggagttgtaatccgaatctctgataaaacagactttaaaccaacaaagataaaaagagacaaagaagggcattacattaatggtaaagggaacaatgcacaagaagtactgactatcctaaatatgtatgcacccaatacaagcgcacccagattcataaagtacatgcttagaggcctacaaagtgacttagactcccacacaataaaagtgggagaatttaacaccccagtgtcaatattagacagatcaacgagatagaaaaataacaaggatattcaggacttgaactcagctctaaaccaagcagacctaatagacctccacagaactctccacctcaaatcaacaga

SEQ ID NO: 4589 - DNA, 1069 bp, Homo sapiens
atctccaaatttctcttaattctgaatcttcagagggggagagtggagaatgcattgttctgatgtatcctcctggagaaaaacatgattttaaaagttagcatgttgttacgtattcatatacattgttgtataagaagacatttgattcttcatgcagtcacccatgttatgaataaagagtcaatagaagaatttataattatttccaaatcaatgttgaactgactatatagcatacatatgttgaagtctaagagaccaaaaaccaagctcataatatatttaatgcaatgttttagagattagtcctttgtataaaatgtattctaagaaatggagattctaaatgcctgtgttttctcatttggatatattaaaaataattaaattttagtgctttttttcctaagcttctccctcccccaagtttagtatctaattttgatgttcatgggaaaaatactaagcttactttgtgtaagtttttaagggatgtctttaatacacttttctatacaattaatttcaaattttgatgatctaggatgattgttgagaatactgctgcttgggaattataaataaaaactgttgaactatttttatttgcaaacttattttttgtttccttatagaacgctagccctaattaaaccagatgcaatatcaaaggctggagaaataattgaaataataaacaaagctggatttactataaccaaactcaaaatgatgatgctttcaaggtaatttttttatcattttcagttatgtaatgtctgattcctttttaaaaaatcattttctgtctttcttgtcattgtttaaaattaaaaaacctcgtattgaatgacaaagaatagaatagtaacttaaccaaaatgggaactgacaggagttcatctagaatgttactgacaaagccggccccctaaaagatttgatcttttcctattcagtgtcatgaagcccatatacaaaaccgaaagtgagtatcaagcagtgcaggctttattcagtgtctgtggaattgagaaacaggagtgtggctcacaaatcaacttct

SEQ ID NO: 4590 - DNA, 1052 bp, Homo sapiens
ccttcactggcaaccaaggtatccaggttctctcatcaaacttgactagaaggctggcgtgacccatggacagaaggaagagcagtgtagtgcgtggcccacctgagagctacatgggaaaggagaaccccctacccccagcaaagggaggcagtgaatgagcacgctacccagaaggggaaactgtgctttttccacagaactgtgcaacccatggatcagaagatcccactagaaaatctaggccactggggcctagcgtcccaaccctagaacacgattcttacagcttctcagctggaatctacttaagcctactgaaaactcctcgtgggaggggtgaccaatttaagttgttgagtttcaggtatgcacaaaatatccagatgaagatattgaagattagttggagaaatttatccggttttcaggagaaaagttgggactggagataggaaattagcgatttcagaggtggagtagtttgtgtgatgaggatatggccatagaaatacgtggcaagtgtaatggagaaagacgtagaagatgagagaatcaaaggtctttgggggtggatgttcaatggctcttctatgtagttaaaaatataccttgggactggcatggagaggaatattgagtcaggagtgatcagaggtggttacataactatttttaatagagccaaatgatacaaatgtcaaaggaggatgggttttctcaggaaaacagaaatacaattcagaagacgtatgggggaatgaagagaatattaatttatttgtctgaccaccgaagtacttgaagtatggtagaaaatgcagcctctgtttcagagaagatgtggcttgggggagaatcagaatttgcataagataggaaatttagggccagatccctttcagtgacttgggaggatggatgttgtttgggagtttttatatcattgagtaggaattacagagaactaacaagggttatgaaggacaggaggaatttgggattgggtgaagaagcagcacagcatattgctgtagtgattacaggtatag

SEQ ID NO: 4591 - DNA, 1036 bp, Homo sapiens
tggggtattaacttttttagaatgacacagctgaacagtgttaataatagtgtgtcaagattgcaaagtcgacatactcatttggtttaagcaggaatcctagaagcaaatggatggggataagaataggtcattttctattcaccatcctttactattaagggaaaggaaaagaacactagctaaggaagggaaagggaagtgatatcataaaagtagcaaccttcattttacattctgtctgtttttctttttttgctttgttttgtttgtgctaatttgggaattgtgtactccgaaacaagtagaaaagtgctgtttgagggattttattaaatctttttttaatggaatgtggtacaaattgttcatgttaccaaagcaatatttccctggaatttaattcaaagtttgtggcatacaacctgagccttttcttatataagacaagaatatgttcacatcttggtatgtggccatatttatagaatgctgaactcaatgtgcaagttgtactgtatgcagttttgtaaataagtgaaaataatttgttgtactttttattcaattctgtatagattataaaattatttttattaaataaatattttacagtatattttctctttttaatcaaaattgttttaaatttatcttctatttcagtaggagctttagattatatctttaaatattttaataatttatcctaggacaaatttcatattaagtcttcccctggtctaacttgcctagttaaccttttgttatctttttaattattccattgctttgtgatttttacctttgactcttcccccttatttcagatgttttcccccttttttttggcaccccgttgcactgtttttttttttttttttggttttcatgttggcactgctcttatctctttttaaagcattcttccttaaaaaaaaaaaaagacactctctttgatgttaactgaatttttacaataaaggaaattaaagcaagagcagaaaataccaccttgttctgaaacttcatagcc

SEQ ID NO: 4592 - DNA, 1039 bp, Homo sapiens
agtaccaccgtgctgtgatgctgctttgtgtcttcagggtctggcacgtggtgtaagtatgcaatattttttgaggctttatggacaaattctgaatatactttattatagagtaatcctcttgtcattgataattcaataaactgcttttcccccttctagtttttgatctatgccagttattttgcactcatcgctgtggttttcctggccagtggtgcagtcagtgttatgaagaaatgtagaaagctggaagatccacaatcaagttctcaagtaaccacttcataatatactgctgaagggcttcttcttatagcaagaactctgcacagcaactgcctggatgtgtttgattttttaaagcgtagacatatatttatgaatgtgcatttcttgacttcacagcagccacttgactaataccttgtgttccgggaataacatgatactattcagaggagccagaagtaaagtttatttcatggattatttatgagagctaatttaaggatgactttttttctgattcaaaagtgaacttgattttaaaaaccagtcaagagcaatcaaagcagcacatggtgttgtatacttcattagcaagtgagtttggtgttttataggtcacatatgtctgtatctacttagccagatgcttggcctggtgggaccagggctccacagaggccacaaaatgttgcaagtcatgatggatggaaatatgttctaacagcatctgcctctattcaatttaattcttatttctgtgttactcatgtacattggtctttctacatagttattctatcactggcaatatttgttctggtttagtgttctgtattttaaggtgtacgtatcatttctaattttaagttattttaaaaaaattcatcatatgaatgttcttggttcccattgtgacgattatttatttctgtaaaatttgtttagaagtacgtttttgcattattcatatgcttcccagagaagctcatttagttagaaaataaggcaagttttgaagcctgctaaa

SEQ ID NO: 4593 - DNA, 1028 bp, Homo sapiens
tggctctcattttgcctttccatgttagccacaaaagtaaaattttctgtgggttttttttttttttggtagagataggatctcactttcttgcccaggctggtcttgaactcctgggctcaagcaatccttctgtcttggcctcccaaagtgctgagattatagacatgagtcactacacccggccttcccatgttctgagcaaggcccagggattacagtaacctttggtagattagtcctttcatacagttgaaatcagagatatctcacagagtgtctgacatctcatattgacttcttgggatagtgcgtagctcagtaatgtcttgcttcactcaattataagcccagtagctttatttattactttattataatactatttctcattgtttaaatattaagtaatataaaaagtttaaggaagaaaatttaaatcactaagaacccaccacctagagagaactgctaatattttggtctacttctttccaatatttctatcttaactgttggatcagtctgtcaattataacgataggaggccttaactgaatagtgatttattagggttgctagtctgttgcttattattattcttgttatgttgtttgccagtttatgggagatgtagattacagactcccattggctgaagcctgcggtctcttttcatcatcttcattttgtaaacagtacatcttttgctgggttgattacatacagctgtgttaatgctatagtgcatttaaagcaaaaatcctatgagaacatatttttcgccagaggggataaatgtatttgttaataagtttatgaagtaagcagttagttttcacaaggaaaaaagtctgttaggtaagtaattgggcctgtaaattgctttctatataattgccttcatcagagtttgagcattgttcccttttgctatgtaggaacccaagccagaccgtctccttgtattgaaagtactatggaatgatttcctgatgtgctactcctctcgccctcttctctgctgg

SEQ ID NO: 4594 - DNA, 1528 bp, Homo sapiens
ataattttacatacttgagcctgttattcatcccacatgaaactcttaaagctccatggaacacagtgaaggccacttattaaattagagcatgcatgattaactatgagcagctcagagttttgatgtaatagaaataaacctttgtttgtagatgtaatttaacaagaaacataaaaggtaatatgtcaaatgctactttataaagtgtgattcatataagcttaacatttgaagcctagaaaacagcatagaaggaagcctgcagattatagcacgaggtgctgattttataaacaggacctgccatcttttctttttggcatggccagataatagattgagtagttattaacctctgtgtgtggaattcattattatgtaatagatctaaagttctcaaatgcattatactgggcattattttatgtatgccatgactttttaagctatgcaataaaaataacactaattgagcccctctataataaatatatacattatctagtgtaactctgtataatcttttgtggataggttttattgttatcattttcattttctagatgagaaaagtaaggctttcttatcagtttatggtaggatttctaatagaaacttgtgaatccttttaatagttccattcttccaggaatatactttcttttcttataatccttccagcatccttgaaagttttagatatcccagttgttttccaagttatattggttaagcaactgaagctaaatagtaaaattctgatgtagttcaataaaactggtggaccttgaataaagacttatgaaaatgtgcttggtaccattcactcactcttagcaaattcacattatatatgattaacaattgtcttgtgatttgtttaaattcacaaggtttgctctcatacacagtgccaagaaatcaatcttgtaacagcagtatgttgtacttctaggtggttatcttatgcaaattcatcaagtagaattttcaagtgtcggtacttctttctctgagttattttgattaacctcagtactcctccctgaattttggaaaggggctgtagtaatggtacttgaaggatatccccctctgggctaaacagcacaaagaaggaagcaccacactggggttgctttgggatggtatgagaaggtaaaacaacgatgaaactcggattctcagtccagtgaggttttctagcctctgagggagaaaatggcctttatttaactaatgttgatggtcactgttactgtatataagaggagaaaatatctattaattttataaaaatgatatatatggtgtgtgtgtatatatacacacacacacacacacacacacgtttgttttttgagacagagtctgtctctgtcgcccaggctggagtgcagtggcgtgatcacggatcactgcagccttgatcttctaggttcaagtgatcctcccacctcagtctcctgagtagcagggactacatgtgtacaccaccacacccagctaattaaattgtgtgtgt

SEQ ID NO: 4595 - DNA, 1026 bp, Homo sapiens
tttagcacaggttctgacatgtaattaatacctagtaaatgattctcttaatatagccatgcttttatttgtagtttgatatcttttactactagtaagtgttctttctgtgtctgcatgtctaaggtctctaaacaatgacaacagtgaaattaatgcttccactttggtattaaataatgtcatttctagcagcagggtgtagtgagttaccacctacctccctcaccaaaacccataaaaataaaaaactacaataaaccctgagaaccaaaatgaacgaaaatctattcgcttcattcattgtgagtttttaagaaagtgaagtccaaaccctagttctaatacttgggcaagttacttaattctgtgagatttagtttccttatgtacatatctaccttatacagttattttgagtatttaaagctttcaaatgagtttacatagtaggtttccaataaatggtaattgctattattactattatcattatcattacacgtgaataatccggaacagctctgtacttttatggtagatagtcatgtatttgtgaggttgtaaatagagcaatctttccttttctctttgaattaatcacccctggtcatcttcatcatcatcatcatcacacctcctgtttattttgacctgggtatcagatactgtgctaagaactttagagtcagtatgttatttgattcttattaaaactcaataatgtagatatttgctcattttacagaagaggaaactaaatttagttaactgacttgcgcaaaggcacataggaagtggcactttaaaactttccaactcaggctgggcatggtgactcacacctgtaatcccagcactttgggtgggcaaggcaggcagatcacttgaggtcaggagttcgagacgagccttgccaacatagtgaaacacgatgtctgctaaaaaaaaaaaaaaaatacaaaaactagctgggcgtggtggtgcatgcctgtaatcccagctacttgggaggctgaggcagga

SEQ ID NO: 4596 - DNA, 1027 bp, Homo sapiens
tgggttcttattacatatgggtcactgagtagagcctcaggtataagatgattctcctaagcctaaattttatgaacagcagagtttttttttttttatccttttttttttcttttttttttttttttgagacgtctcactcagctgcccaggctggagtggagtggtacgatctcggctcactgcaaccaccatctcccagattcaagtgattctcacatctcagcttcctgagtagctgggattataggcacctgccatcatgcctggcaaatttttatgttttagtagagacagggtttcatcatggtggccaggctggtcttgaactcctgacctcaggtaatccacatgcctcagcctcccaaagtgctaagattacaggcatgaacctctgtgtccggccaaacagcagagctttataggaaaatgactaggtagaaaggtaagtggctcggccataggctcagagtatacctctgaactgtgtctagcttatctcagaaatctcggctgcctctccaacttactttacttctaactacagttcaagtcttgaggataaaaaacacaaagcatcatatatattaggaacacatgatagtactgttgtattagtaaaacagaaaaaatgttattgtcaacataataataagaaatgatatttattgaattgatttattgtatgtcaaacttagtgctaattgctttaccaggattctctcatctcatcctcacacaacaaccttttcaggtaggtacagttattatcccatttttacagatgatgaaactgaaacacagaatttaaataacattcacaagactgtatagctaatgagtggaagagccacagattgaacccgagcattctgcctccagagcctgagctgtcagccaatgttagagtattgcttttatcagtctacctatgttttaagcttctagcaccttgtttttctcataaaatcacagatcgatgcagttattgtccaatttagtgagaatgagtttcagaacttaggct

SEQ ID NO: 4597 - DNA, 1064 bp, Homo sapiens
gattgtttgatatgcttgaggatggttttagcacaagagcaagcataaaatacgcaattgaaatgtgttctttggaagggccttcattcttggataaaagttaaacatcacatagtgacagatggcagtgttttacagagtgcatacataataataataataataaaagtggcatttcactggtgaactcttttggacaattctgaatttttgagtttattcacacttttttttctgttgtgtgtgatattattgtacattttaaattaagtaatgttccaaatttttatgtcagcttttaaaatattaactaaagtttttttaattatagtgtaagttctgggatacatatgcagaatgtgcaggtttgttacataggtatacatgtgccatggtggtttgctgcacccatcaacccatcatctacattaggtatttctcctaatgctattcctgccccttccccccaccacccgacaggtcctggtgtgtgatgtccatgtgttctcagtgttcacctcccacttatgagtgagaacatgcggtgtttgattttctgttcctgtgttagtttgctgagaatgatggtttccagcttcatccatgtccctgcaaaggacatgatctcatccttttttatggctgcatagtattccatgttgtatatgcaccacattttctttatccagtctatcattgatgggcatttgggttggttccatgtctttgctattgtgaatggtgctgcagtaaacatatgtgtgcatgtgtctttatactagcatgatttataatcctttgggtatacccagtaatgggattgctggttcaaatgctatttctggttctggatctttgaggaatcgccacactgtcttccacaatggttgaactaatttacacttccaccaacagtgtaaaagcgttcctatttctccacatcctctccagcatctgttgtttcctgactttttaatgatcatcattctaactggcataagatgatatctcattgtggttttgatttgcatttctctaatgaccagtgatgatgagcttttttt

SEQ ID NO: 4598 - DNA, 1051 bp, Homo sapiens
atttattgaataaatacttggattaatgtattgtctagaaaacatatgtaaaacctgattactagtactttacgaattctctgatgtcagttttatacaataaataaaatgtatgtctagtattgctacattattagttttgttagacaataatctaaaaatctattctgaatatctgagtagttaatatggtggttagttacaaaaaatgtctactttctaacttcttaaaaataactattttaggtaagagtagtgtgatatatttaaagtaattttataatcgcaagtcttcctagtgtattgtggatatattcatttattaaaatatgtatatcaaatttattttctacatggttcgtaccagtgatcaccaaaaacaaatttcctgtacccataaaatgtattcttttaaatatatattaaaatgtcttctttaaagcttttctcaatttcatggacttattactcactataaaattggagctctgtgtatgaatattattgatcatgagttaaaaagacatgagctttggcaagaagaactctcaaagaagaagaaagctgatatccttttagagtggcatttgaaccgtctgttgtcttttgctttaagttttggatgggtgggatggttttgttcttttttcttttttaaaaattgttaattacattacttggaaacaatgcaggagtgtgttattgaaggttaagaagtagattgaaactatcaaaatgaatacagtttgatattcactttttgtctcttcacaacctttattagttaatgaggtagaaggagcaggtaatagttgtgtcgggtaacttagtaggtgagcctctaagtggttacatcattacatccactaagatcctttggttagttgaagcctggcccaccactgctgcttatatacttctgtgtgagtactaaggtgactttgattagaatgggtgtaaatttggtgatgaacctagttaaaggttctatttttctaggaaagtgcaaaaatactgttgttaataaataaaaatttgaaaggcctataga

SEQ ID NO: 4599 - DNA, 1028 bp, Homo sapiens
agcagtctgctaatgcattgggtggatcggccctaggccgcttttggctaaaaacacccaggggcgcccaggccggaactaaggaagcagggtgaagaccaggcgtcttgagcacaccagaggctctctctgcggcttgctgtagcgtggcccgcggggccaccactgtgcccggaccctgtttccaattgtttctatgtgcagtttgatttgtatgtctattctttgagagtctgaaataggcaacgttttgtgaaaatcatagaatgctggagggccccccggttccacgatttccaaatttgaagacaaaaatggtaaccagcaactactgacatagaaagcaaccagcctcatttgagaacttacagctaagttcagactcttgcaacctcgaggagaagagggagtatctgtacatatctggccacatgtcacctgggatgaacagggtgaccggtctgttacagacttgggggcatggggatacaattgcagtctctttttaaggcactagcgaagcgagattttcatgggtcgcgaggttggtcggtgaggatggggaagggaaactggacttttctgggcgtttaagagccaatagggagagctcctctaaggtgacactggcctccgcactgaagctcgcgcctcccggatgcagctcgcctgtgcgggatcatgcggggctggatttcaggtttcacccttaaaggacattccctttgcttggcccgagttttcccaagccagccgggcttttgactctgccagtctcaaacccatttgcggtagaggcaacagcagggggcagagagcagctccagcgtctggggccgggcgttctctcggggcctcccggtcgcgcccggccttacggtgcccgcgtggagagtgcagcctgagcagcgccaagtcctgctccctgtgcctggtgccctccctcaagccgtcatacgctgcccgagagaagcccttccaacccgactcagcatctttaacctgctgctttcccaaacagcgctggc

SEQ ID NO: 4600 - DNA, 1035 bp, Homo sapiens
gtcacagaaggactggggaaaaatgctgtgactagcctaagtggaataaattgaaggttgggttggaagtgaatcaagatgctggtgttaacatgcctgaatatttaggaaaagttccaggatcacttcatgatgaaaagcaataaggctgtcaaaatttgtctggcatatatataggattaggccaagtcctaaaatttcccaagacacctcagggtcaagggctttctgcagaaggtaagccttttgatgatataaaaattctagaagtctcagttgcagaaaaatgtgagagatgcatgtgcgtgtgcacgtgtgtctgtgtgtgtgtgtgtgtgtgtgagagagagagagagagagagagagagaggatttgttagttcgttaaggggtttcttccacttatttccatgaagattctctatttgacccattttaatccccaatacttgttgtagatgattacttcctatcttgaaaaaaaaaaaaaagattcaactagaacagacctggttcttaaaaaatagtagaactctagtggcctgaatttaaaaaaaaaaaacagctttaacttttcatcaaatacacacaacaatttaagaataatgtaaggtgatcccttaactacattctagaaagttagctacattgtaaaatatgtcaagagtgaattaaggaaagatatcccgacaggctcaccaattctatttattggaattttgtaggctgttattttgagttaaacccttcaaattaagaatttaatcaaaagtattgaaacaatggaaaataaattgggttcttaccccataaggatttatgtcagttattagaaagggcttcctgatcctggacaattgttattaataatacaaatgtatatttttcctggaaatgtaaacctgaatagatccaacttcaattttggtctgccaggataaaaacaactttattatggaattggctcctctctcatggcatgactttccatttgatattatatttatgtgtatatctagagtctagattctagac

SEQ ID NO: 4601 - DNA, 1030 bp, Homo sapiens
aaaaaaaaaaaaaaaaatttaccatagtgctcagctaacccttaacaaatatcctagcaggcatatccacaaagagaagactcctggcctctagttatttctagggatccctgctcccacatccaaatggattcattgcttccttcattttattggtcactgatttaatgtctaggaaagtgccacttgaagtgggcctgtgagccaatccatgactggtcgttaccagtgtgtgatgagataatcctggaaatgaagagtaaacattgagacatgtgtacagcaatttgcttgacattgcatgatatccaagcaggtggtcaatggactagtctcattgaacagaggataagccaatttgagtatgactaactcagaaagtgagttgcatgtaccttgagttatatttttcatgtcagcaaggactggttacataatttcctgagcccaacacaaaatggggggaactgtgtgaatatacaggttgcatgcccatggagtgagacctgaatgcattgtagaataatgttatgacatgacatgattattttaaagttggctaatcatctggaaactaaaagcatgcaaaaatttgagaaaatataagcatatatttttataacttatcatttttatactcagcttaaatttaaatcaagcctggttttcagtttagctgaatagtatcaagtataataggatagaaaatatttgtcttgtttatttttaattctcatgttcagtttgtactataagtgtcactggattttttttgtcaagaaaagacacatctcttatgaatgtggcagttgtagaaaagcaaatgttgaaaacagaagttatttaaaaaattgaagatccaaagagtttgtattgatttgacatacaagtgtgatcccccatatattgattttgtaaccatagttgaggttgaagtgtgttatcgcagagatgtagtagctaataaagcaataagaccatcagagcaaaagtactattaacatatgaaacttgaagaactacatgaaaa

SEQ ID NO: 4602 - DNA, 1026 bp, Homo sapiens
gcctggcttctttcacttagtataatgttttcaaggtttatgcatgttgtagcatgtatacaacttgattcctttttttgagtggataatatgccatatgtgtgtgttagattttatttgttcatttatctgttgatggacatttagattgcacttttcagctactgtgaattttgctgcaatgaacactttgtacaagtttttgtttgagaaactgttaaattcttttaggtatatacctaagatttctgtgtcaaatagcaattctatgtgtaacttgttggagaaccactaaactattctctgcactttaatttttgcacttttgagctcatagcatttacattgtattcagtaacttatttaagttttcctgtgctgggtttatagattaattctaaaagttgaaaatcaataatatggtctcaccatgactagataaaattattcaatgtataggccatgctcactttagttatatttccttttagtatgtacctatgtctttcgcatctgtaccctgcattatctctttattttatttttaaaattatttttatttttactttttttggagatggggtctcactctgtcacccaggctggactgcagtggtgtgatcatagctcactgcagcctagaactcctgggctcaagaggtcctcccacctcaggctctcaaagcactgggattataggcatgagccacaaagcccagctgtctctctatctttaatagtaattttttctttatttacccttgttggtctcttttatttggagagtttccccaaatttcacaaagtgtggttgctgcttaaaatttaaggatgtaatgcctcttgatggggttttgtgtgtgagcaaggcttgccacctgttgtactttgttttagagcaactgggagggaggctggggtcatgctgtagtatagctagacagaatgcaagactcttttctcagggagcttaacaatggtttttgcaaaagaaaaattctcaacttctgtctgccaatgtgtgtc

SEQ ID NO: 4603 - DNA, 1039 bp, Homo sapiens
gcataagtgtcttctcctactgtacacacaattaatttcaaaccagtcagtaacttttctggcttattcaaggcatatgtggctttaatttatcaaaagctcctggaatttcatcagctggaaggaatgtcaatgcaaacaaatgacatattttaccactaaagtttgcatcattgccatattgcctagctaatcccctcatctgaattttcctagaaatgctttggactgaatggaaaaaacaaactttattagtgacaacttgaaattcacttttagaagccttgattgcacctaattccaaacctgtcattacagtttggggattcaattagatgatagaaattttagacttttgggattttgatattttggaatttcgatattcaggattatggtgttcaggattttgcctttagggattgtaattggcatcgtagaaatacatattccaacatttcacatttgtgaagcaatgccaactttatactactctgtctctgcaagaccttaatttactcccaggagtggtgattttggttttcaggagaataaaatgatggacacaaatgagattaggtctttccatgactacaaacgcctacatgatctagccagtggttacttctctcatatcatctcctatactttcatctcccttgcccaattcactcagattctttggcttccttgtattcgctgacatacaaggtaagtgtccatcaatacgagacttttcccttctctcagtctagaactctctaactcagatatatgtaaggatcaaatcctcacctgattcaggtctctgattagatgccagctcagcagagaggcctgccctgaccaacttacctaaaccttgccagtcactttctttcctccacaccactatatatctcttttaagctttataccatctgacttacaacacatttatttgttcattgtctgtgtttcttaccaaaatgtaagctccataatagggcatagcaaataatagacactcaataaatatgtgttgcatgaatggatgcat

SEQ ID NO: 4604 - DNA, 1123 bp, Homo sapiens
ctcttctcattctctcattttgagaaccactaaggactcatgaagtaaaaaaaattcaatgttactaaaagtcctagaagagaacctaggcaacaccattcaggatgtaggcatgggcaaaacttcatgtctaaaacaccaaaagcaatggtaacaaaagccacaattgacaaatgggatctaattaaactaaagagcttctgcacagcaaaataaactatcatcagagtgaacaggcaacctacagaatgggagaaattttttgcaatctacccatctgacaaagggctaacatccagaatctacaaagaacttgaacaaatttacaaaaaaaaccaaaacaaaaaaacaaccccatgaaaaagtgggcaaagaatatgaacagaaacttctcaaaagaagacatttatgcagccaacagacatatgaaaaaatgctcatcatcactggtcattagagaaatgcaaatcaaaaccacagtgagataacatctcacaccagttagaatggcgatcattaaaaagtcaggaaacaacagattctggagaggatgtagagaaataggaacccttttacactgttggtgggagtataaattagttcaaccattgtggaagactgtggtgattccccaaggatctgaaactagaattaccatttgacccagcaatcccattactaggtatatacccaaaggattataagtcattctactctaaagacacatgcacatgtatgtttattctagcactattcacaatagcaaaggcttggaaccaacccaaatgtccatcaacaatagactggataaagaaaatgtggcacatatacaccatggaataccataaaaagggatgagttcatgtcctttgcagggacatggatgaagctggaaaccatcattttcagcaaactatcacaagaacagaaaaacaaacaccacatgttctcataagtgggagttgaacaatgagaacacatggacataaggaggggaacatcacacactggggcctttcagggagttgggggctaggggaaggataacattaggagaaatacctaatgtaggtgatgggttgatgggtgtagcaaaccaccatgtcatgtgtatacctatgta

SEQ ID NO: 4605 - DNA, 1051 bp, Homo sapiens
ctcacgaaaatctcttgtcaaattttcaaaaatgttgactttttgctaagaaaattaattattgaaaattaaattatataaatttaacattaagtagaaactgataatactaaaaaattatcactccctaattctttcgctacattttaccattatctatgctcttgaggttattcatgggcattgtgtctgattggcgggaatattaaataatgatgggctattgtgcatcttttcccagttccatggttagtgatgtccctttgaaagcttgaaattagccatcataaggatctttacaccagggaattggccttattttcagacacctggctgtcaaacatttactaacacactactagcagaatgacctctaaattagatgatagtgacccatttggacatgagagctactgagacactcaggcaggtcatgggagtcaatgcagatcagaaccaaacagaatagaaggcaaggaaaaacacgaaaaggagacaccagagagaaagaaaggcaaggagaaaaagactaaaggaaatgaatgaatattattttgccaaaataatagctttaaggagaaaaaaatagagctaaggactatgtcaatgccagaggccatttgtgtctttaccaacagtatatgaaatctcaacccagatcactttccactacttttctttcactctcctaggaagtcttgacagaattttcctttcagtttttgataacattgggaagagctctgggtaaagcaataaataatttgctgcttactaagataatgtacaccactggtaaatccatcaacttgtattatttatttaaagtaaacagaccatggcttatgtcattctaaatgcacaacgggtgtccactgataggcttcagttctcagagactatgctcattagataaacaacgatttattattggatgtattataaaagtaatgatttatagaacatttgcactgtcagcattttgcaagatactttggagtgtagaattacagaaaatggaacgtgcttaaattcagtcgacctggaaggt

SEQ ID NO: 4606 - DNA, 1086 bp, Homo sapiens
aaactaaaaattaataacaagaggaattttggaaactatacaaataagtggaaatttaacaatatacttccaaatgaccagtgggtcaatcaataaattaggaagaaattaaaaaatttcttgaaacaaaataatggaaacacaacataccaaaacctatgggatacagcaaaagcggtactaagagagaagtctgtagctgtgaagtgcctatatcaaaaaagaggaaaaaccaaatgagcattctaatgatgtatcttaaagaactagagaagcaagagcaaaccaaacccaaaattagtaaaagaaaagaaataataaagatcagggcaggccgagcacggtggcgcatgcctgtaatcccagcactttgggaggccgaggcgggcggatcacgaggtcaggagatcgagaccatcctggctaacacaatgaaaccccgtctctactaaaaatagaaaaaattaaccgggcgtggtggcgggcgcctgtagtcccagctactcggaggctgaggcgggagaatggcgtgaatccaggaggtggagcttgcagtgagcccagatagcaccactgcagtccagcctgtgtgaaagagcgagactccatctcaaaaaaaaaaaaaaaaaaaaaaaaaaaaaaaaaaaaaaaaaaaaaaagatcagagcagaaataaatggaattgaactgaaaacaacaatacaaatgataagtgaaacaaaaagttggctttttttaaaagttaaacaaaagtgacatacctttagccagactaagaaaaaaagggagaggatccaaataaaataaaaaatgaaaaaggagacattaaaactgctactgaagaatttcaaaggatcattagtggctagtatgagcaactataggccaataaattggaaaatatagaagaaatggacaaattcctagatacatgcaacctaccaagattgaaccaggaagaaatacaaaatctgaaaagaccaataacaagtaatgagatcaaagctataatacaaagtctcccagtgaagaaaagcccagaacctgatggctttactgttgaattctaccaaacatttaaagaag

SEQ ID NO: 4607 - DNA, 1068 bp, Homo sapiens
attatgaaaatacattttctgatgttatctggctaccttctttgcttttttcaaagcaaagcatctctatattatccttgagtcatcttttagtacttttaattattgtctcataaaattgtttattgaaagatatatgagagtataaatgtgcatgaatcatattggacagctcagtgaatgaccacaaaaggaacacaccagggctaccatttaggttattaaatagagttttagcagcatcctagaagcttccttcaaggctctcccagtctcctcctccacctttcagaatatattcttttgtgtctgctttcctttgcttcatattaccttttaagattcaaccatgttctttcatgtagcaatagtttgttcatttccattgctacatggcagaggctagcaaataaagttttcttgagatacagccattcacattggctcatttgtttacatatctatggttgttttcatcataccacagcagagttgcaacagagactatatggtactcaaagtctaaaatatttactattgggcctttaacagaaagagtttgctgaacctgctatatacaagtacatcttacgaatgcatcattttttaaatccattctgctgttgatgggcgtttgtgttgtttccagtttggagctattatgaatgatgaagttatgggaattcttgtacatgaattttggcaggtatttgtataactgctgtttggtatataactagtggatttaccgggtatgcttatgttccacttcagcggttactgctaaacagttatccaaagtggctgtaccaattttcactcccacaaacagtacgctaacattttcattgctctatgtcctccgaacaattgatactgttaaaatgtttcctttcagtcatcctcatgggtttggtgataatatcacattgtaattttaattttcattttttgttgttaattaataagatcatgtgtgtatttactggccatttggatgtcttcttttgtgaaatgcttattcagataagtctcttgccggtgtatatattgagttatctttttctt

SEQ ID NO: 4608 - DNA, 1024 bp, Homo sapiens
tttccaacttagaaagctttctattttcagggctttcttcatacttaaatctggtaaccaagcctatgaaaagaagttttaaatacagcaggtataaatgtctgtaggaaaaggcttgagcagtgtaggtaccatctcagaattataagagggtggacagaacttcttttgttaaatactattatcttaacccaagagaactgtcaatagagagctgagtttctggattatgggtgcttccctcctatgtcttaagattagccagcagcatgcaaggaattggaagcatgtcctcacatgacacagcaagaagggtgacaagatcctatttgcgtttgaaaaagtttactcttgctgctgcatacaaaatggaatgttaagatgcaagaatggaatcaagaaggaggctcttagaataatgggtaagagttaatggtggctttgacctgagtggaggctgtggaggtagacagaagtgagaacatttgctgatgctgtaggtaggggaatggtgaggtgttatggatggacttgtgtcactctcaaatttatatattgaagttctaacccctagtacttcagaatgttactatatttgaagacagcattcttaaaaaggctattaagttaaaatgaggtcatagggttgtccctaatccaatataataggtttcttcatgagaagaggagattcggtcacaggcatgtacagaagaagactgtgtgaagacacagaagaagttatctacaaaccaacgagagaggcttcagaagaaaccaacattgttgacaccctgatcttggatttctagactcaggaattatgagaaaataaatttttattgtttaagccacccagtctgtggtactttcttatggcatccctggctaatgaatacaggaggcagctaaaggaattgaggattatgcctagttttgtggcttgagaaatggggtatttagaggtctcattaccaggacgagtaagattgaggaaagaacatgtttggaatctatatgggaa

SEQ ID NO: 4609 - DNA, 1095 bp, Homo sapiens
gaagcttatgtctacgggagctatcctggcattggggcagttcttaggcccaagtccacaggggctggcctggtaccggggtgggcctaaaacctgggttctcagtggtcagtctggtgtctggggccatgaggctgctgcccttaaatctcaggcaggcctggaaaactgggttcgcaggagttatcctgcagcctgggaccattagatatggcctgacacctggttaagcctggagcctgggactgtgaggactcacctggcactggggtttagtagtgcaggcctggtaatagggtccagagcaaagttgcctactcattttcttctccttacttaaatggagggcatctgtctccatactgtgttgcctaggcttgggggagaggtgatacaggtagtgtgaaactgtccctcctatcctcttctatgtgttttttcttatttctgtgccccattcaggtgctgtaatctctcacctggattccttaggtcttgtgcaggtatttttgttgtggatggttattaaaattgatattactgtgagagaatgagcactgaaaattccgattccaccagctgacattctgtagtgttttcttattaacaacacggaaaagtgattaaattcatctgccagggaattttaggctctctggtaccttgggatttggaacagactttatttcttaccacaggcatgctaagagccattcttcctttgttctgaatataatatgctatgtttatcttttcaagcaagtctatgtaaatacattttttggtcattactactggttgcaaaacacattctctacatttgttgtgttatgggaacagcttcaggtttggatccacttaaatctttcttttgacatggtcaaggggaggagtgaaggaagacaatgaattagatgctgagaagttttccaagtttgagattaggttaatcaccgtaaaaagaagatattttattttgtttcctcaaatggcattactgtttaatcaaagcattcccatatgcagaatcccctattgtcattcaagtctgacttcctggactgacattcaattcagttaaatttattcactaac

SEQ ID NO: 4610 - DNA, 1070 bp, Homo sapiens
atttacatgtatttgtaaattttccaaagttctttctgtcatcgatttctgatttaataccatgtggtcagtaaagatacttgatatgatttcagtattcttaaatttgtgaagacttgttttgtggcctaacatattatctatcctggagaatagtttatgtgcacttgagacaaatgtgggctcataggtgaaagggattcatttccagataagacattggacttgagactcggaacttgggacttttaagttaatactagaatgagttaagactttggggactattggaagggataattatattttgcaatgtgagaaggacatgagatttgggggctaggggtggaatgatgtagtttgggtgtttgtgccctccaaatcttatgttgaaatgtaatccccaatattggaagtggggcctggtgggagatgtttggatcatggggccatattgctcatgaatggcttattgccattcccttggtgatgagtaagttcttgctctgatagttcactcaagatctgagtggcacctcctctctttctctcttgctcgccctctggccgtgtaacatgcttgctttccttcagtttctgccgtaattgcaagtttcccaaggtccttaccaaagacagatgctggcactatgcttcctatacaacctgaagaactgtgagtgaaaaataaaacctcttttctttataaatcacccagcatcaggtattcctttataggaatgcaagaacagactaacacatcacatatagtattcttgattggcattttatttttctttcagcatgttgagtatatcattccatttttgcctacaaagtttctactgagaaatctactgattgttttatgagtgttctcttgtatgtgatgaatcacttttttcttggtgcctttaaaattctgtcttttgacttttatgaatttgattatgtgtcacagtgaagatctctttatgtttaatctaactgaattctttgggatttatggatttggatgtttagctccctttctagatttggaaagtctgctatcattatttctttatata

SEQ ID NO: 4611 - DNA, 1057 bp, Homo sapiens
aaatgtttgacagaattaaccagtgaagacctggttcttggcctgttctttgtggaagagtttttaaactacaaattcaagtactttaatagatttaggtctattcaggttatatgcttcttcttgggagagctttggcagtatgtatctttcaagcaatgtgttcattttatcttcgttgttgtattggtataaacttatctctctatgttgatttaatgtcaataacttcagttaatatgaaaaatacattggttaatatactataatggacaaaataaaatgcctttacattttgttaaactttgttcagcctgaaaatctgtgctcatgcttattcaacttcctgtcttatcttaagcatccccaaatttgccaattcagcatgtgaaaagccttttagagaacagattcccaacagagagagagaggctgagtattttccattttacttatactttaattcaaatgggccaagactgattttcatatcttcaggaaaggagagaggaactatgttgtgattgtgtgtgtgtatgtgtgtgtgtgtgtgtgttgtattgtgtgattacacttctatgctgaattttgagacctcaaagactttctcattaataaaatgtaagtgtaacagccagaaggagtaatgggaatgaaagcattttaagcaaattgtaaaagggatggggtcgctgaacttcactgacaactcttgtcctggttggcttcactgtccggttccactgggtcaggatggcatttctggccccatcccacttccctggtcccatcagtcgaaactggtatgggctgcaagggccaaagtacacctccagggccaggcggggatctgtcaggaagagccatggtatgttaggcttggcccctatgaaagagcccagctcatccacatatgtgatgtaatctgtctgcaaagtctggctctggccaaacatgaagaaagaagagaacatactggaataagtgttacagttgcaaataggagcattaatttcttattttttctttcagaaaaataacattttagatagcacct

SEQ ID NO: 4612 - DNA, 1029 bp, Homo sapiens
acactactgagaagcaaaaagcaattctcgttgttttaagaagtaagtagacattttcctcagttcttacagcttttcctcagtgaatggtattatagcgagagcagtggggcagactttctggtgtaggcccttgagcatgatactacttaagggtagatttacttaagggaacaatttcattcactcttaaaattggctttgagaataatgctaatataaacttaaaaaaatacacatggtacagaatgtatcttacataaatacccattcctgagtggaataatttcattgcagactctctggactgcgaaatgcctttaaaagtctttctcatctcctattctcataagaggtctcattctagatgagatatatactaatcttttgagataaatgaaatactgcaaatgaatgttatatatttaaatatacagacgaacagtaaatttagataatgttacctcatgaaaatctgaaactaaatactggtaatatttacatgatggaagcaagtggtatatttgattgtaaaataagaccattcccaagtcatatttaaagcagcataatgccttctcatgctgtcttattttctcttagtttcaaaattaccatagaagctgagggattctcctgtggtggtgtatttagttgtggctatccagacttttagcttattctctctcttagttagtccattagcccttctaccaaagaagcagggaaggaatggggcttatttctaaatttcatatcaacttgcacatttaagaagagtgcttataccttttcctgttttctaatgtttaaattaattcccaataggagaaaaagttgattttatgaacatttggaattttacatgtctctaagcaactgaagttaggaagaccctaccttgctatggattatgagtgactgcgaattttgctacttgccattttgacttaacatattttcaggtccttgggtagaatttattctttctatgattcacatgagctgataacttcgaccagaaaacag

SEQ ID NO: 4613 - DNA, 1040 bp, Homo sapiens
acatatagttctgctgtgaaattctaatacatgtgctttaatgaacatatgtatgcatttttgttgaatgtacacccaggagtgcaatcgtttgttcttatggtatattaagctttatagttacttccaaatagttttccaaagtggttgtactaacttatactcccagcagcagtctatgagggttctggttgctccacttccttgcagacaatattttttcttttcattttagcaattctcatggcaccatattgtagcttagcagacttttgaaagatgcatggtattttattaggcaaatggggtgatagagcgagtcctggggaggatcaaaaaaataagaaagcagggagcctgtgggagtcctcagcagctctccttggaggcactaggggagaatctatttccttgtgtttttctagcttcaagaagctgcccaaattccttggttcctgaccctacatcattccaacttccttccatcatcacgtccccttctctgactctgactctcctacttttctctgtaaggaccattgtgattacattgggtccacctggctaatccaggatacccccccccatctcaaaatccttaacttaatcatgtttgcagattcctttatcatgcaacttacatagttacaggttctggggattaggacatgaacatcttttggagaccctttttcagtctaccatggtcatgttgtagcctcaccttatctatactatagtgtgtgttattcttatttatgtgggacaggtgctaagcagagtggtgtgatggaagaggccaggtgcagtggctcccgcctgtaatcccagtactttgggaggctgaggcgggcagatcacctgaggtcgggagtttgagaccagcctgacccaacatggagaaaccccccttctctactaaaaatacaaaaattagctaggtgtggtggtgcatgcctgtaatcccagctactcgggaggctgaggcaggagaatcgcttgaacccaggaagtggaggttgcagtgagccgacattgca

SEQ ID NO: 4614 - DNA, 1089 bp, Homo sapiens
agttagtgtacctaatacactaccattcgtaaaaagaaaaaatatgtaatgcacataattatatatgcacataacatacagggaactggtaacagtggttgcctctaaagagagaaactgtatgcctaggggatagttaggattgggagagagacttatttctcactgtatgtcagtagttctgaaactttttagtttctgggctcctttaactcttaagagtcactaaagaggcccaagaatttttgtttatgtgagtaaaattcctatcaatgtttactgtattagaaattgacacagaaatctgaaaaatatgtatttacagattcattaaaaatagcaataataaacccattatttgttaacattttacatgaaaaataattatgttttgtaaaacaaatactagtgaaaagagtggcattgtttgacatttttataaatctctttaatgtctggattaggagagacagctggatcctcatgtttgctgctgcatccagtccgttgtgatatcacacatcatggtgcctctgaagaacactattgtgcaattttgagacaattagagtgaaaaaggcaaatagcatcttagccttattatggacatactttcaccttgtggacccatggaaagggtcttgggaaccctgtgagggccctggactatactttcagaaatgctgctataaaatctgtttgaattctataccttgtgcatgggccactgtgtcaaaaatacatgcaaagtacatagacacaaacatacataacatgcatatgcatatataaatgtacacatttaaaggtgctctctttcaggctttctggaaggcaaaaagaaaagcaattgaaggttggtatggaacaagtgtaccacagttttgatgtcaataatactatctccagctttagaagggaaactaatatataactatttattatatttagcatttattgagtgcttactatatgccaggcagtgtgtcaagaattctagatgttttctcttatgtaatcttttcctgaaccaatgtgaaaggtgctattattttcttcactttacaaaagagaaaacagacttagaga

SEQ ID NO: 4615 - DNA, 1059 bp, Homo sapiens
attactgtatacttctatgtctggccattcctcttcccaagcaaagtggacagcgagttgcattgcttgaagttctgcccactgtttcccttcaccagtatccttcacagatgttccagaaaggggatgtagtgctgcagctgttcacttttggttggtgcctgtgtattatgcagaatcatctgtaaacagttctgggtcttcttatctgtcagctgttcttagagaactttgcatgagggtataggtgcaggttggcagagggcagtagagcaggggtgaggaccatggatatttggccatttcttcatattacttacttgtgcctcagggcctgttcagacccagtcccatacacatcaccccgtctgatgatggagtgctgctgtgtacacccaactttatggcttggtgggtcagataacacttcatgatgtgcagctcaggctacatggtaatttggtcacccacagttaagtgttcagccttgactaaggctcagtaggaggccgagagctttctcaacaagacagaagttatctgtgcaggactgcgggctttacttcaaaatctcaagtgttaattggtctggagcaacacaccaaaatgagaatatgttgcctccagaatccaaagaggcccagtaggcatcgtgcctcttttttggttgtatgaggggccagatgcaagaatttatctttcactttgcaagggatgtttggatgtttcccataccactgtacccctagaaatatcactgacgtagggctgggcacggtggctcatgcctgtaatcccagcactttgggaggctgaggcgggtggatcacgaggtcaggagatcaagaccatcctggctaacaccgtgaaacctcgtctctactaaaaatacaaaaaaatttagctgggtgtggtggtgggtgcctgcagtcccagctacttgggaggctgaggcaggagaatggtgtgaacctgggaggcagagcttgcagtaagccgagatcacgccactgtactctagcctgggtgacagagcgagactctgtctcaaaaagagaa

SEQ ID NO: 4616 - DNA, 1101 bp, Homo sapiens
atacatctgtggaatcattactgagattgagatactgatcatttccatcagcccagcacctccccttgtagtccttctctgtaatactccactcaaagataatcactattccgacttctgttaccattaatggaaattttacccatttttaaattctatatgaatggaataatatgtaatctttggtggctggctgttgatctttctgttactgacttgcagcagttctttattttggatatgagtcctttgctaaatacatatattgcaaatatattttcttagctcatagttgcgttttgactctcctaacgatgtctttttaggaatattagttcaaatcgctagtctttcctatggttaatgcttttaatttgttctatttagaaaatcttttaatgcttttaatttgttctgtttagaaaatctttgcacactctgagatcatgcgcaagttaatgactttgaaggacgaagaagtaaaatgtttttgttgcatttgagattgtgaggcagtgaggctgagccagaaacgaagacagaaagcagatagacttgtagggctggccttgagatggggcactgtcacagggtgagtctgagctttgcaggcactgtctatttactatagttgtggctgaaatcagaggcaggccaagtggatgagacatggggcagttgacctcagaagagattcctttaactatttcctttttttttttttttttcttgagatggaatcttgctctgttgccaggctggagtgcaatggcgcaatctcagctcactgcaacctccgcctcccaggttcaagcaattctgccttagcctcctgagtagctgggattacaagcgcccaccaccatacccagctaattctttgtatctttagtagagacggggtttcaccgtattggccaggctagtctcgaactcctgacctcgtggtctgcccgcctcgtcctcccaaagtgctgggattacaggcatgagccactgcacccggccaactatttcctttttaaaatttttttatttttattttttgagagagtctcactctttggccaggctggagtgcagtggtgtgatcttggctca

SEQ ID NO: 4617 - DNA, 1143 bp, Homo sapiens
agataatatagttttctatagtgtggaagaacagcatcatcttcaagcaaggtggaattaagcatggacagaactgtgtttctcacccaggaggagggtaggtttttttttcttttttacttcttaaaacttattttaatattattcttccctcccccaccccattgggaaaaggctaaaacaatctggatgggtttaattagaaattaatacatactgtcattgtataaagtaaatcaacattgtggcaacaagggactattcttggaaaaagtgaaacccatattaacaaaatatgtcatggaagatccccacatagtgatttcactggctgcctgaaagacagacagtgtaaaggtcgatgttctgcatgttctctggggcttgtccatgcaacggaagaaggtctttcccagactcagccaagcctagttagctccaaccaggccctagaccaaaagcaagggaagagcacatcctttcaatagaataagggtagaaagggattctctgaatgtagtaactatgaagctatgccaaaggtaggcagaaaatgggcttgggagccagacactccagggttcagtagttcctacccacagtctttgtgtgcttgctaaatggtgtacatttcttgttaaccacgttattaaaacttgatcagcatgtaagctttcttctgttagatcttttggcagcaaacaaccttccccccaagcctctgaattttggaggagggtaggcttgatgaattgtttagaaattttgtgtttggtggtggcaggaggggagggatcatgcggccttctggtcacaagcaagcctgcagaagattcagtggcctttccagttgacttagacagcctgtgtccctggtgtcactgactggcacctatagcaatacttggtgttatttagcttcttgtcacatacaactttcttctcttctttccttcaattgtccctttcctcctgacttctgtgagggatagcaggattgaggccacaggctgccactcagggcattcactctctgataagagtcagtaaggcagagccactggtgccccctgaacccctgctgcaggtgggcagaggctgggctgctagtgtggtatccaaaggacagtagctgtgctcact

SEQ ID NO: 4618 - DNA, 1048 bp, Homo sapiens
atttagcctctgattcattcttctcttctcccacccctttctcttctaccagccagcctaccaatacttattctctctgaaaggatcttatcctttaccagaagttcagttattacctctaagaaccagtcccttcccttttaaattttcttttccctgaaagagtcagttttatgtattagaaaaatgaaggtatatgttttcctttaaagggattataatcattacagaaaatttgaaagttttcaaaaaattaaaaaaaaaacccagaatttcccaaaacctgactatccaaagagaagcacttaatgttatgtgtgtgatcttgagtgaaaatttaaaatttatattagaacattttataaattatccaaactttttgtacgaaaaaaacagaaaatgtaaataataagaaaaaaaagcactcatcatcctaccatctagaagtaaatactggttttagttcagagtatgtgtacagatacgtgtgtgtgtgtttgtgtgtgtgtttgcaggctgcttggttggtttgggtggggaatagttgagcctgatctgggatcacagccttgctgtgttggagaaaggggtcgggtggagtgggtgttggtatgcaaaggttgatttaaataaatggtttcgattttggtatttggacaaggcttgaagtggaatctcctggtgaacaaaattggggaatggaaagaatttggtagtgttgtgttttgtgtcttcctgtcccttttcttctgatttcccaaagagctcaccctgttctgtagactaaatcttaggcctctgtggcaacaaagactataggctaatggcttagatgacaaagaaaacaagagttggaaaggggctttctctacatttcaatcagaacatagcaggactgcagcacagtcagcactgaagtgaactccactgcatcagttttgtagcatcagggagttctagaaaacagtgccttgtgttgggaactagcattctaccagtaactatgatattggtggagcaagggtgaagagaggaccaaagtggagga

SEQ ID NO: 4619 - DNA, 1024 bp, Homo sapiens
tggctcatcctggctcaaaaagctcccccactgagcaccttgtgacccccactcccatccgctagagaacaaacctcctttgactgtaattttcctttacctacccaaatcttataaaatggccccacccctatctcccttctctgactctcttttcggactcagcccacctgcacccaggtggttaaaagctttattgctcacacaaagcctatttggtggtctcttcacatggacgcgcatgaaaaagattctttgtatgacttcagttattccaaatttgtgaaagtttgttttatggtccagaatatggtttagcatggtgaatattccatgtgtgtttgaaaaaaaaagttttctacctttgttgggtagagtgttttataaaggtaaattatgtcaactggacataacgttgtttgggtctcatctgttggtactgattttctgtctacttctatcaattactgtgagaggaaagtcaaagtctccaactatggttgtggatttatctagttctcatttctgtttctgttttaagtttttggaacttctcttaataggtgtgtacatttaagattgttatgttttcttgattaattgaaccttatcccattatgcaatatctctgtttatctttagtagtatttcttgctttgaaatctactttgatattaatatagccactacattttttctttcgattagtgtttgtatggtatctcttctttcatcttattacttctattcccatctatgtctttatttttaaagtaggtttcttgtagatagttaggtcttatttatttttaatcaaatttgacaaactcgatgttttaattggtgtgcttagataatttatatttaatgtaattattgatatgtttgaatttattttattattgattttctagttgtctcctctgtctttaattcctctgttttccctttctattgatgtctcactatgtttgctgactctttttttcttttttctgtattttgctgtcgaacccatcaattg

SEQ ID NO: 4620 - DNA, 1024 bp, Homo sapiens
aaattattatttcttccacaatgtttggtaaacttcatcagtgaaaccactggggcctagagaattctttttggaaggtttaaactacaaattcaatttaaaagttatacatacatatatatgaaataaatcattgctttaacataaacttttttcttcctgaatgaatttggtaattttttttaattttaaaaattagtgcattttgtcaaatttacaaacagcttttcatagtactgttcccttgttatcctcttaaggtctgtggggttaatagtgatgtttcttctctcatttctgatgtttctaatttgcatcttatttttcttggtcatccaggctagaggtttatcaattgtgctgaacttttaaaataatcaacttttagtttcattaattttctctattgtttttctgtttccaatttatttgagttctggtcttctaataatactttccttccttctacttactttgggtttattctgttctttttctagttttgtcacttgcaagcttagatccttgatttgagatgttgttcttttccaatataagcatttataaatttctctaaatcaccgttttaaatgccttctgcaaattttgatatgttgcattttctctttcatttacttttctaaattcctttgtggctttccttttggcccatgggtaatccagaagtatgttggtgtattagtccgtgcttgcattgttataaagaaatgcctgaggccaggcacggtggctcatgtctgtaatcctagcactttgagagactgaagtaggcagatgcttgagactagcctcagcaacatggcaaaaccccgtctctacaaaaaattaaaaaattagctgggtgtggtggtgcatgcttgtagtcccagatactctggagactaaggtgggaggattctttgagccaggaagatggaggttgcaatgagctgagattgtgccactgcactccagcctgggtaatagagcaagactgtctgtcacacacaagaaaaaaaaaaaa

SEQ ID NO: 4621 - DNA, 1042 bp, Homo sapiens
tgatgctggtaaagatatacctgaaactgggtgatttatacaggaaagaggtttaatggacttatagttccacatggctggggaggcctcacaatcatggcagaaggcaaggaggagcaagtcacatcttatgttgatggtggcaggcaaaaagagagcttgtgcaggaaactctcatttttaaaaccatcagatctcgtgagactcattcagtatcatgagaacagtgcaggaaagacctgcttccatgattcagtcacctcccattgggttccttccatcacgtgtggaattgtgggagttacaattcaagatgagatttgggtggggatacagccaacccatatcattctgcccctggcccctcccaaatctcatgtcctcacatttcaaaccaatcatgccttcctaacagttccccaaagtcttaactaatttcagcattaactcagaagtccccagtttaaattctcatccaaaacaaggcaagtcccttctgcctatgagcctgtaaagtcaaaagcaagttacttcctagatacaatggggttacaggcattgggtaaataccgccattccaaatgggagaaattggccaaaacaaaggggttataggccccatgcaagtccaaaatccagcagggcagtcaaacttaaagctccaaaattatctcctttgactccatgtcttgcatctgggtcatgctgatgcaagaggtgggttcccatggtcttgggcagctccacccttgtggctctgcatggtacagcttcccacttggctcctttcacaggctggtgttgagtgtctgtggcttttccaggcacacggtacaagctgttggtggatctaccactctggggtctggaggatggtggccctcttctcacagctccactaggcagtgccccagtagggactctatgtgggggatctgaccccacatttcctttctgcactaccctagcagaggttctccatgacagccctggccctgcagcaaacttctgcctggatatccaggcatttccatacatcctc

SEQ ID NO: 4622 - DNA, 1034 bp, Homo sapiens
ggcctccccaaatgctaggattatggacgtgagccaccacacttggcctttatatttttattttagagatgggatcttgctgtgttgcttaggctgggctcaaactcttgggctaaagtggtcttcttgccccagcttcctgagtagctggactacaggtgtgtaacaccatgtctggccttttttcttttttttgataatttttttttttttagagttggggtcttgctgtgttgcccaggctagtcttgaactcctgggctcaagtgatcctcccctcttggcctcccaaagtgctgggattgcaggcaggagccactgcacccagcctggagtatcattaaatttgtgtatctttaaatttttagtatctttaaatttgtggtattttggttgtatattctagcaggctccatcctagaaaaagaagagcagcaaataaattttaaatcacattcagttgtcttaataatgtagctattattatttcggcctatttataatatggtaacgtgtgtaagaattcagattttcagtgtaggctgggcatggtggctcatgcctgtaattccagcactttgggaggccgaggtgggtggatcatctgaggttggaagttcgagaccagcctgggcaacatggtgaaaccctgtctctataaaaatacaaaaaattagccaggcatggtggcacatgcctgtagtgccatctactcaggaggctggggtgggaggatcacttgagcctgggaggtggagattgcagtgaaccaagattgtgccactgcattccagcctgggtgacattaaaaaaaaaaagagagatcatcagtgtaaaagatacacaattataaaatcaagtaagtaaaaactctaatattacatttaattgggaatatcagaattaactcttatttttaaagtgcaaaagttttaaattttcattaagtctgaccaatttttgttcttttattgcttgtacttttggtgttgaatctaataaatcattgattaacctcaggtcctaaaggttta

SEQ ID NO: 4623 - DNA, 1044 bp, Homo sapiens
ttgcaccactgcactccagcctgggagacagagtgagactctgtcttcaaaaaagaaatatgtgagaatttgatgataaagttaacaaagttaactttttagatgtaaaggtgatgttgaaggaagagtaaaagatgatgaaagtttttttagtggggaaagaaaatgaaaaggaagaatggaattattactgagcaaaacagagtacagtagttggcaaagaaagattgaataagatgtgaagcgatgattagttttgaacttaatgagtttgacggaggttggaaatgcaggactgggttgcagctgtaatggtctgaagacagagatttaggagtcatatagaatgattattttcctatgtagaatgaatgattttcagaatctggggccacctactattggaacatgaggaaaaaaaaagaatcagtaaataaattggaactataaaaagtaaggaggagaaaagcccctaaaaaatggaatgtcagaggaaacaaggtcccagaaagtttagaggagtaaggatgaacaaacttgatgaacaaagtatttggccatggttttggcaaaaacaatgatcttcgaaagtacagtttctttgtagtgatagatggaagaaagagattgctgaagatttctagtaaaatatttattagtaactggaggcaataggtgtagacgacgtttccaggagattggtctcagaaggaatgagacgaattggatttaaacacaaatttttaatgttagaaatactagaatatgcttggcagtgaaagaaaaggatcctgtataggagtgattaaagatgatagagatgtgaagtacagcctggttgtggtggtgcacgcttgtagtcctagctactcgagaggctgaggtgggaggatcgcctgagcccagcaggtggaggctgcagtgatatcaggccactgcactccagcctggacaacagagtgagaccctgtctcaaaaaaaaaaaaaaaaaaaaaaaaggctgaagtacacaaaggagatggtgtccaggggagatacaagtaa

SEQ ID NO: 4624 - DNA, 1092 bp, Homo sapiens
ctataattacattgctctttctaattagataattaagtattgagaacttaaatgtaagaccaattggccatgaacttaaacgtaagtattgagaacttaaatgtaagactaattggccatgaacttaaatgtaagactaattaattaagactaattaaaaatctgttaatagatcagtttaaaaattaggaatatataagtctataaactgtgacaaagctgaaaatcatatgagtgtacagctccatcaagcccttaaactttggcaaagaacattctaaattatggtaatcctatttatatttatatgcttgggaggtcaagcgttgctctaagcacacattttatcacttaatagatacaggatcccctgtcccatctggccatttctaagctagacataaatttcctttcaaatgttaaacaatagcaacgaaaaacttgaataatataacacctcaagttttaaagagagaatcacattttaatctgtctgaaaaaacagtctaggtatttagggactgcaacagtttactgaactgtcattatttcaggacagtgtgccaagaagttgtagaactaagagaacacttcatgatgtgtctacaataaaatgcttaattttgtagaagttaaacttttctttaaaaaactctgaaaatacttgactagtcatcaacattttctagatactctattttattaataacagaggttggtaccttcacgaagttcttaatttcaaagggcagcttcttgcaggcattcagaagctcagctgttttaactttgatttcaatctcacctgttggcattttcttggagagtgagaaggaagggttttaaaaattactcatcaggatatacacaaaatacacatttgtagaatctatgcatttatttacatatgtaaaatgtgcaaagtccttatagtgtatagtataaaacatacatgtctgtgcatgattttgacattcttatgcatatgtggctgatgtgttcagatatcaacaaatgtcatggcatatccttgcagtctgatacttgggaggctgagacaggaggatcacttaagcccaggagttcaagacc

SEQ ID NO: 4625 - DNA, 1047 bp, Homo sapiens
gcttgaacctaggaagtggaggttgcagtgaactgagatcatgccaccgcactccagcctgggcaacggcgagacttggtctcaaaaaaaaacacacacacaaaactaccaccacctaccccaatcggttaccctttacttttcatgtgaccaccatgacctattatgtgttttgttcttacttcccccacaagaatgtaagcgcttcaagtttattccttaatgttggaaaaatgaatgaaactgcaaatgtagtagatcagtttttggggaggtaccaaagacaagttggtaaaataccttgattttgaagtgaaaaacgatgttacatttcaaagtatcttttcgccaggttatggctcaggcttcgagaccagcctggccaacatggcaaaacccggtctctactgaaaaaaagcgaaaattagccgggtgtggtagtgtgggcctgtagtcccagctactctgaaccctggaggtggaggttgcagtgaaccaagatcgtgccacctcactccagcctgggcctcctaggctcaagtgattgttgtgcctcaactacctgagtagctgggatgacaggtgtgtgccaccactcccagctaatttttttttctgtatttttagtagagatggagtttcaccatgtcagccaggctagtcttgaactcctggcctcaagtgatccaactgccctgccctcccaaagtgctgggattacaggtgtgagccactgcatccagccaagttctattctttttttttttttttttgagacggagtttcgctcgtgttgcccaggctggaatgtagcggcgcaatcttggctcactgcaacctccacctcccaggttcaagcgattctcctgcctcagccttccaagtagctgggattacaggcgtgggccaccatgcctggctatttttgtatttttagtagagagggggtttcaccacgttggccaggctggtctcgaactcctgacctcgtgatctgcccacctagcctcccaaagtgctgggattacaggcgtgagccaccgcatc

SEQ ID NO: 4626 - DNA, 4596 bp, Homo sapiens
tcccctctctgctcttcctcctcagtcgggaggagggcgggagcacggcatcacgtggacggtcatgtctctgcccacaatggcgaggaagggcggggaaaaggggcggacttaaggggtgggaagaaggtgatactggatgagaggaagattgagggaggttagggggaggagccgaagcggacgctgccgggagcgtgcgtcgtgacgtcatcaaaagaactcttatatacaggagcccaggcaccatactgtcttttcgaggtaggagtcgactcctgtgaggtatgttttatctttgcgaatgttgcgggttttggggcgctccagcctttgtctgctaaggtcaccctgaattgactgggacttctaagccagtcgcgcgcctttgcagggcctacaagttgaggatggtgggggattgcacatatggtgcatgcgtgacctaagctgcgactatgttagagtagaactgcggagaagcctcggctctcgtgccctgcctctgatgaagcctgtgttggtagggacatctgagagtaatgatgaatgccaaccgctctgatggtggcacatgccgagtcacccgagtaagctattgttaagggccgtgacccgagcctccatcagccgtccgctctcatgaaaggctgtcggtggtagtccacgtgcttaagtgcctgcattccgcagtgtcaccaatatttccattagtgtttcttttttcttttttgagaccgagcctcgttctgtcacccaggctggaatgcagtggctcgacatcggttaatggcaacctccgcgtcccgagttaagcagttctgcctcagcctcccaagtaactgggactacaggcgcgcgccaccatgctaggcttttatatttttagtagagacggggtttcaccatgttggcgagactggtcttgaactcctgacctcaggtgatccaccagccgtggtcccccaacatactgggattacaagccgtgagccaccgcgcccggccgccatcggtggttcttaactgcgggtgcagtgcttctttgtaacattaagtgtatcctttacctgtcgctagataatgaatggtatgttacctgcatcattggtttaaaaagacgaaccgtttttttaaagaacactctttaaaaaaaagaaccgtggaacaatgaattaaaatctgtacctgatctctttaggtatggtgctgggtgcagatgcagtgtggctctggatagcaccttatggacaggtaagaattggggaaagtatggtgggaagaatgaaatctaagaggtggtctcagcctgtgatgctttaagagtagtggacagaagggatttctgaaattctattctgaggctttaatgttaacagcatttatatttaacgtgactgctgtgaggttcattctcactgttttgcttgcatctttttgttttctagttgtgtccccaaggaaggatgagaatagctactgaagtaagttgaaaattccctctcaaaaaggtttaaagccattggatgtgccacaatgatgacagtttatttgctactcttgagtgctagaatgatgaggatcttaaccaccattatcttaactgaggcacccaaaatggtgagttggggaacatagagagtacacctaagttcacatgaagttgtttcttcccaggtcctaaagagcaagcctaactcaagccattggcacacaggtgagacacctctattttgtacttctcacttttaagggattagaaaatagccaaagcaatgatgattatctatgttagtgcttctctcccctcttttcaaatgagaattttgctctcatattgatactaagtttaatactgaagaaaatgtgaaaacagatactatgatggttgcatagttcagcagatttaatcatgaagagatgtactatctgtctgatgtatctggggtagttgtggtttgctgttaatggttaagcagtgtaccaccaatctaccattaaaatattttttgctgacaattttgtattaaaattacaggcattagacagaaagctggaagttgaaatggtaagtgaaactgtatccaagtaagcaggtaactgggcaaacttcctacggcacaaatggctttttagttacctcctagtgctgaatgcattaaataaatggcggattcttgtcttgttatgattaataagaaagtttgtaaatgcagcctggatgatgataagcaaatgctgactgaacatgaaggtcttaattagctctaactgactaaaggcatttgttagttttggcagggggtgaacactcatctgtggctattctaagaccactcttatttcttaggtggagtccaacttgcctggaccagcttaatggttctggtaagtattaatgaaaacagtagatagacttaatgaaaatgctgatggtgatatgcttactgctgagctaatggcttaaggcttggctgatgaatactgactgtattttccttgagcatgtctggaacagtgtttatgtgttttccttgagcatgtttggaacggggtttgtgtaatgatgttgatcaaatgtctgacctgaaatgagcatgtagacaaaggtaacactgaagaaccctgtgacagacaactttgaaaagagtttaatgatgtttagcattttaatggaagtcctcatttgtattccagctcctggtaacgtttttatccatggatgacttgcttgggtaaggacatgaagacagttcctgtcataccttttaaaggtacatgttttattgatgttaacgttaattgattgagctactgttagtgatgattttaaaattaaagcagatgggaatctctctgagaaagaaaatggagattaatcttaaactgaaacagtagttgggaaatcttttagaaatccacctattactacctattggtaaaggagattaaatttctacaggtatggagagtcggcttgactacactgtgtggagcaagttttaaagaagcaaaggtatagcagttccaagtattttttttttttttttagacaagagtctagctcttgcccagaatggagtgcagcggcactatcagttcactgcaacctctgcctcccaggttcaaggaattctcctgcctcagcctcttgagtagctgggattacaggcatgtgacaccatgcctggctaattttgtacagctatgttgtccaggctggtctcgaactcttgacctcaagtgatactgcccgcactgacctcccaaagtgctgggattacaggcgtgagccaccatgccccgcctcaagtctggtttttaagtgttgtaaagccgatacaatgatgataacatagttcagcagactaacgctgatgagcaatattaagtctttcgctcctatctgatgtatctggcggtaacattctagtttatgccccgaaaaggggaatatagccattctataatgtttggagattttggattactcctaattgtatgcaagttgtcttactgtgtattgtcccttaatttcaggactcagaattcatgattgaagaaatgcaggttagtttaaactttgaaggaaatttttaaggtggcaaaaggttttggtggcatatacaccttaatctgtagatgggagtgattagctgtttaaaagttaaaatgtgactgagaaggaaattgagtagggcaaattttaaatgggtattatttttcatcttcaaacaggcagacctgttatcctaaactaggtgagtcagcttttggtacatgtgatgattttcagtgtaaccaatgatgtaatgattctgccaaatgaaatataatgatatcactgtaaaaccgttccattttgattctgaggttactctactaacaagcatcacacatttgtattttgccctgattaatatgttggcttcgctttcagggtttttaatgaccacaacaagcaagcatgcagcttactgcttgaaaggtgaggattggaaatgttgggactattataattgcagaatacatgatgatctcaatccaacttgaactctctcactgattacttgatgacaataaaatatctgatattctgcattcccatgtagcattttaattgaagtctgtaaatgtggctaaaagtcttgtcttattttttgagacagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccatctggagtgtgtagtgtttacttaaaaaaggacagtgcttttcatctgttcattagctgtaagcataaatcacattcaaaagctattataactccatggtatttgcttcattaacactgcagccagttaaaattttatgggtattttacaaggtgtcttatgcattaaagtgcaatatttcctaattctccatatgagcaaattgtcaggtttcataggcccctgtgctaattggttttgagcttaaagtat

SEQ ID NO: 4627 - DNA, 1078 bp, Homo sapiens
gccatttatatattttcaatcatgctaaattatatcccctgttgattttattgtagtaatcatttttctctctctcctttttcaaaattttaaaatgtcagcagtgatgtaccaaatggatcagccttgacacaagagaatatcagcctcctatcaaacaagaccagctctctgaacctgtcagaggaccctgagggaggaggggataataatgactcccagagatcaggagttactcccagttctgctccttaaaatatgaggagtcctacttttatcttctgctcctaatcagtttgtcgggcataggggtaggagaacgcataacttctaaactttttctcttaagagcggtcagagaaatccaggaaattcaccagaggcaatgtgcacaaacaccactactaaaaacaaaccctgcacatagttcacattaatgcatttttttaatttaaagaaaaagaaaattagcagtatctgcaagcaattcagattaaatttgtttttgttctgtgaatgaactttattttaataactttggacgccttggatccagggctttaaaaaaaaaagatattatatatacactctgtttgattaattgtatgatcttaatgaagtaggttttcttgtattttggtattacatacccagtgtataatttgtataattcctcacccccaatccttatcaattctcaccaccccataaacttaaaacagaccaaaaatgtcagctttcagagaattctgtggtgcttgagaaacagacagtactagactgagttattagaaaatgtgcagcaaaccaacttttcccagagctgttatttggaattctttatccctttctagatcactagcttcattggatacgtatatttttcttgacattgaagctttttgtttgtttgggagggttttatttcttgtttttattttcaacttttcaaatagaattaccaattttgaagtcctcattttcatattaaggatcatttgcattctcttaatataatcagaaagctgattcagtgtttaattagatttaaatgttgatcaagaattaactgtaactt

SEQ ID NO: 4628 - DNA, 1031 bp, Homo sapiens
tcaatctatcctagatactttccattttattttgactttcaagatcctaagtagaaaattttaaatgtttctgttttcttaaaaaagagacagggtcttgctgtgttgcccaggctggtggtctcaaactcgtgggctcaagcaatccacccaccatgccccgtccaaattttttatgtcatttgtaaataagtaaataaacctggatggaattggtctatagaaataatggataaaattgtatataaagatcagtttatgatgttaaaagttttcttcaaaaaaacataattttttcaaatcaggaaaaacaatcctctcttctagtttttagaaaatatatagtaaattattaactgtactcaccctgcagtgctatagaatgctagaagtaattcctcctgtgtagctataattttgtatctgttaaccaagctctctccccttccctccccccattccctttctagtctctcataaccacagttccactctctacttctgtgactcaactttttagctcccacattgagtgagaacatgaaatatttgtctttctgtgcctgaccaatttcacttaatgtgatgtcctctaggctcatctatgttgctgcaaatgacaggatttatttttttatgtctgaatagtatttcattgtatatataccacattttctttatcaattcatctgttgctggatacctaggttgattccatatcttggctattgggaataaaacatgagagtgcagatatcccttcatatactgatttcttttcctttgaatgaatgcccagtagtgggattgttggatctctgtattattattattattattatttgagatggagtctcactctgttgcccaggctggagtgcagtggcatgaacttggctccctgcaacctccgcctcccaggttcaagcaattttcctgcctcaacctctcgagtagctgggactacagtcatgcaccaacacgcccagctaatttttgtatttttagtagagatagggtttcaccacctt

SEQ ID NO: 4629 - DNA, 1050 bp, Homo sapiens
aaaaaagtggaaatgagatcatagtgtccccatgagctttttctttttccatataatacaagtataagaatgcccatgagatttattcaagaatttatattatgctacttgtttgagaattaatatcaacatatcagaaaaattaggactaccttctttgtttttgctttatttatatttggactttgaaacttcagacagaatgactttccagcacttttgctcttggtaatctaaataaatatgtgaattacttatctagattatcaagatcctaaaatgacaacacaaaatttatgtttttttgtggggggttattacacatctaatgttttgattttggttttagcctccacagcatagcaaatacaaaacatacatgtgtcgagatatgaagcagagaggaggatgccctcgtggggccagctgtacatttgcacactcacaggaggaactggaaaagtaagtgtgaaagtcaggagactttggaataaggtgtaagtggaataattcgctgacatacagaaatacagaaagagtagctgctttatcttaaatgaataggacatttttagaatgtaacacagcttgaacattcctattctgaaaatctgaaatgcttcaaaatccaaaaatgcttgaaagccaacttgacaccacaagttgaaaattccacacttgaccttgtgatggatagcagtcaaaacttcatgcacaaaattatttaaaataatgtataaaattactttcagactatgtgtaaaagatgtatatgaaatataaatgaatttcatgttatatatttgggtcttatccccaagacatctccttatgtatatgcaaatattccaaaatccaagacaaatccaaatcttgaaacacttctggtctcaagcatttcgggtaagagatattcaacctgtacataatttttaaaaatgaaaagcagtttcttcagcttttattgcatcatgcctatagataggaaactattttatgattagctaaatctaaaagtgggtcattttcactacaaaaaaaattaaaatt

SEQ ID NO: 4630 - DNA, 1064 bp, Homo sapiens
acctcttctttctctcataatgtatatctgatccattagcaaattctgtaggccctacctttaaaatccatccagaatccatttaccttcactgctaccatccccatctctcaggggattatggaatagcctcctgttgtctgtctgattttaacaaaagagccggagcgaccctgtcaccctctgctcataaattctcctgtggctttctatcaactcagagtaaaacccagtatccttcccatgatctatagggcctcatgtgatctggtcttctactacctctctcaaacctcatttcctaccctttttttccacttaattccctcctctctgattccacctccatgcaacatgccaggcacacttcttacatcaaggactttgcacttattcttccctctaacttggatgtttttcccttggtatattattctgcatgtcaagaagaattagttacagaatattctttgattatagggccttttgtagtttttgtggtgtgttgtatggaaacatacatatagctgtattgaacattgtacaaaacaaatattagaagataatttatatatttgaaagtctccagtaggcacacttaaacccttctttcaggtctttaatcaaatgtaaccttctcaaggaggacttttctggcctctgtctaaatttttttttttttttttttttttttttttgagacagtctccctctattgaccaggctggagtgcagtggtgcaatctcagctcactgcaacctccgcctcccaggttgaagtgattctcctaccttggcttccggagtagctgggactacaggcgtgtgccaccatgcccagctaatttttttgtatttttagtagagcgcagtggctcatgcctgtaatcccagcactttggaaggccaagatgggtggattgcctctgtctaaaattttacacattggccccacttctcttcttagctctattttttgaattcaacattatctaaatactactgtatattttgcttatttgtcttggttattatctggctcttctccttgaatataatgggga

SEQ ID NO: 4631 - DNA, 1086 bp, Homo sapiens
ttgactatacaaaaatccaaaatccaaaactttttgaacaccaacatgatgctcacatgctcattggggcatttcagattttcagagtaaggatgctcaagtggtttaatgcagatattctaaaatttgaaaaaatctgaaatctgataacacttctggcccaagcattttgggtaagagattctcagcctgtatttattctttctgaaagacctatccagaaaatgttggcctaaatccaacttgactcagaatgggatgatagcaatatacctacctcaacaagttaaggagaaaatattttgcaggcaaatggtatattcatttaatcttgctgttgatgctaaatttgttacattaaaaattatatgttcatataaagcataaactcatttttttgacttcattatgagattatttgtgtcttattaggtcaccaaacgtgatgaagactcttctttgatgcagctgaaagaagaatttagaacctatgaagctctgcggcgagaacatgactcccagatagtgcagattgctatggaagcaggcttacgaattgcaccggaccagtggtcctctttgctttatggagaccagtctcacaaatctcatatgcagtccattattgacaaggtaggaccttttttgttccttacttcttagactaatcttggcattttggtaattcatttaacaaatgtatattaaagtgaatactgtatagcttttgtaaattgtatttatagccagtgtcatgtcataaccaatcacgttataataccactttgttcatttaaagatttgattagtttatattttttattttacttattttatattttattgtatttttactagaatcacagagatgaaggccaactctagagaccactctacatttaatttagagaaatagagtcaaatagtaagagtaacctaaaaaaaaaataatgaacatttactaaaatcttaatatgtatctagtggttttaaataattcatttaatcctctcaacagccctgtattatccattttagacaaagacaaagggaagttaatatgtttttccagcatcacatagataa

SEQ ID NO: 4632 - DNA, 1033 bp, Homo sapiens
actcttttaaaggagtgggtctgaacagcactactcagagtgttctgagtcgcccaatgcagaggaagcttgtgactctagtccactgtcaactagtagaagaagaaggcaggattcgtgccatgagggcagctcgatctttaggtgaacgaacagttacagagctcattctccagcaccagaatcctcagcaactctcttccaatctttgggcagcagtaagggctaggggatgccagttccttggaccaggtacataattaactttaggtatttattctgctggtaattctaaaagtatgatgtaggaattataagtgatgtacaaagcctagttctttgcagtattttattgttaccaactaatatcttgtttgatgttcatggcttgggcaattccatgtaacttagtggacttactaggtgaacttagtgaacttaaaacttttctcttaatgccaaaagttgtttctttttttaattttttgatttttcctttttttcacacctgtagcaggaagttcattcattttgatagaagtttttcttaaatttattaatcactttatctgttttctttataaaatatatagaatgtaatacaaaattgctcacaaaaatggtgtaaaagtgtgttgctggttaatcttaactgtattgccagttaattgaatagctgcagaaatgattaaatattccccttctaataaatggatttatcttatctatgtacttgataaattttggttttgcccaactttccctagcaatgcaggaggaagctttaaagttggttctgctggccttagaagatggttctgctttgtcaagaaaagtattggttctgtttgtggtgcaaagattggagccacggtttcctcaagcctctaaaactagcattgggcatgttgttcagctcctttatagagcctcctgtttcaaggtatgaacctacattaaagctcagcttgaaaggaaatattgttctttccccaaagttaagtagtaaaactttgagtttaataaagttgcc

SEQ ID NO: 4633 - DNA, 1031 bp, Homo sapiens
ataccagtgtaagatgttaataataggggaaattgttagtcgagtgtggtggcttgctcctgtagtcccagctacttgggaggctgaggcagaagaatcgctggaacccaggaggcggaggttgcagtgagccgagatggtgccactgcactccagcctgggtgacagagggagactccgtctcaaaaataataataataataataggggaaactgaatacaggataatgagaattctgtgtactatctttgccatttttctgtaaatctaaaactgttctacaaaataaagtttactaggcaaaatgggcaaaggatctgaatagatattcttccagagaagatatacaaatggataataagcatatgaaaggatggtcaacatcattagctatcagggaaatacaaatcaaaaccacagggaagtgggaggaaggtagatgggaagaagagataattatcaaagaatacaaagcttcagttagactggaggaatgcctttagtgatctattgcacagaacagtgactataaatagtaatacattgtatgtttcaaaattgctaaaagagtagattttatttaaaatctacaaaaaaaaagtgaggtgatggatttgttaattaacctgatttagtcatctcacatcgtcacattgtaccccataagtatatgcaattattattaatttaaaataaaatttagacaaaccacaatgaattactacttttcacccaacaggatagctataataaaaaaagataatgagtagaagaattatctttctacataaaatgtagaagaattggaacccttatacactcctggtagatatataaaatgctactctgcttttggaaaatagtttggcagtttttcaaaaggttaaatacagactcctaggtatataccaaagagaaacaaaaacttttgtctacacaaaaacttgtacacagatgttcatagcagcattattcgtagtagtcaaaaatagaaacaacctatatgtctgtcaatgatgattgtgtaaat

SEQ ID NO: 4634 - DNA, 1075 bp, Homo sapiens
aaaaaaaaaataaataataataataatacttttcttacacacgtaagaaagactgtctggtacataggcccttaataaagactgttaaataagtaatatatatgttgtatttctatacgctggcaatggacaatctgaaaatagatcaatttcatctacaagagcataaaaaaaattaagaatatatttaacaaaagaaatgtaaaattagaccgggtgcagtggctcatgcctataatcccaatagtttgggaggccgaggctagcagatctcttgaggccaggagttccaagaccagcctggccaacatggtgaaaccccgtctctaccaaaaaaatagaaaaattagccaggtgtgaaggtgcccacctgtaatcccagctactcggggctgaggcatgagactcgcttgaacccaggagagggaggttgcagtgagctaaaatcacaccactgcactccaacctgggtgacagagcgactctgtcaaaaaaaaaaaaaatgtaaaactatattttgaagactacaaatcgttgtttaaaagtagcttaaaacttgaataggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcaatccggcctgggcgacagagcgagactccgtctcaaaaaaaaaaaaaaaaaaaaaaaaaaacttgaataaacatttactctattaactcaaaatggatcaaaggctaaatataagaactaaaactacaaaactcttagaagaaaatatagacataagtctttctgaccatggagtaggcagtgggtttttttcaagatgtgacaccaaaaagcacaaggaacaaaagaaaaagataagttgaacatcaaaattaaaaa

SEQ ID NO: 4635 - DNA, 1106 bp, Homo sapiens
aaggaccttttttaacattgagaaaactattgttcataaaaccactgcactttactcagtagagaaggtgcagctgcttcaggcagttttactcagtagacattaactgaaatgaaagatgagaaaggtgacaaaaactatagcacaacatttgggaaccattagaacacacttaatgctttataaacctaaaaatggttgggatggtaaattttgtgttatgtatatattatcacaataaaaaaaataaaattttcccaaattttcctttcatctaaaaggaaaaagaaaaaataaattagactttaaaatatataatcaccaatttctcctaggaatgtaagtttgacttaacatctgcaaatcaattaatgtaattcactatatcagtaaaagttgcaaaattgcacacatatgatcatctcaatagacacagaaaaagcatttggcaaaatccaataccttttcataataaaagcactgaaacaactaggagaaaaacttcttcaacccaaaggacatggatgaaaaacccacagctaacatactgaatggtgaaagactagatgctttttctgtaagatcaggaacaagtcaaggatctccactcttaactatttctgttcaacatcatacaggaccttctagctagggcaattaggcaagtaaatgaaaccggtgacattcagataagaagtaaaaaataaaaacaatctcattcacagatgacatggtcttatatatagaaaatgttaaggaatctgcaaaggaaaagctattagaaacaaaaaactaggcagagttgcaggatataagatgagtatataagtatcagttgtctgaaaaagcaaaagtctttctaaggtgtaaaaatgtgtttacagtgtttcataatttctttctttctttttttcttgctctgtcacccaggctggagtacagtggtgtgatcttggctcactgcaatctctgcctctcaagttcaagtgattctcatgccttagcctcccaagtagctgggattacaggtgtgcactaccatacccagctaatttttgtatttttagtcgagacagggtttcgccatgttggctatgctggtctca

SEQ ID NO: 4636 - DNA, 1062 bp, Homo sapiens
tatgcttgtatctccctgtactttacctacatatcacttaccataacttgcaattatatatttagttatgtgattgctgtttatatgtttagtgaaagaaacagtgcaagctccatgtggacttagaatgacttatcttttttttatcgttagtactgaacacatagtaaagaccaataaaacatttttttgtcatttaactaaattaaatttttcctgggaatggaataaggtttcttttttcttttttttttttttttttgagatggggtcttgctctgtcacccaggctggagtgcagtcacatgttcgtagctcactgcagcctcaaactcctgggctcaagcgatcctcctaccttagcccttagcttcctgggttgctgggaccacaggtgcatgccaccacgcctggctaatttttgtagagacagggtctccctatgttacctaggctggtctcaaactcctgggctcaagcagtcttcccatctcagcctctgaaagtgctggaattataggcatgagccatcacacccagcctgaaaaatttgtatgagtctgtcaagattgtggtataaatacagaggaaacatatgtttatataaattgtttctacttttaaaatattcttatgttgtcaaaagttttgtttgtttgtttgttttgagatggagtctcactgtgtcgcccaggcaggagtacagtggcggatctcggctcaccgcaacctccacctcctgggttcaagcaattctccttactcagcttcccgagttcctgggattacagccatgcaccaccacacctggctaattttttatatttttggtagagacggggtttcaccatgttggccagtctggtcttgaactcccaacctcaagtgacccacccgcctcagcctcccaaagcgctgggattacaaacctgagacaccgcgcctggctgtcaaaagttatttatgtcttgttcagtaattcttccctccctctacccccttccccaacaaagcttttttttttttttttttttttctgagatggagtttcactcttgttcc

SEQ ID NO: 4637 - DNA, 1040 bp, Homo sapiens
gcaaacatgactcactacagctccgacctcctgggctcaggcaatcctcttgcctcagcctcccatatagctgggactacaggtgcccatgtccagctaaattttttatatttctgtagagacggggtctcacttgattgctcaggctggtctcaaactcctgggctcaagagatccacctgtctccacctcccagagtgctggggttacaggcgtgaaccaccatgcctggcagtgccgttaagttttgttacccaaaaaaaaaacagaattcctttgcctttcaagtaaaaaatgactccacaagaacacagattttgatcaatggaagttttattacttgtcacaagtaaggagagcactgggagtattctccaaagcagtgggtctctgagggaaagtgagaggagggttttatggggcgatggagagggaagagagggtatgtcactgcatgtagaggaggggtcccagtggtgcacatatagtgagtctttatgcccggacgtaggtcacatgctatggtagtgaagctatagcttctcccaggatggagactttagcatggtaacgaggaaagttcactcaggtttatctgtgagtggccagggtctgtgaggaactggttccagctgtctaggtgactgcattctacacagggtttaggcaaaaataggctgcaaggcaggaggctataaaacaggctgattgttcaagttgattaattcctatagtccatgaagaccttgctgtctgcttacagcttgttgagtgtcttttcagacctttttcttccattcatttacatatattaatacgtagactaatatgtaagggttcttttccctcagcacaaatgatgtcatatatattggtcttcaaggcttttttttttacttaatgtattttgagtctctttccatacattttcatagcactggtatgtctctgtttatctagagtgcaacggcgtgatttcggctcactgcaacctccccctcccgggttcaagcagtccaactgcctcagcctcccgagta

SEQ ID NO: 4638 - DNA, 1109 bp, Homo sapiens
agagacaaggtcttgcctttttggccaggttgatctcaaactcctggtctcaagtgatcctcccacctcagccacccaaaagtgctgagattgcaggcgtgaaccacagcacctagctgaaataatttttttattttgataataagatctttatttctttgttaagaaaaaaaacctgagtaaagtcaaatggtaatattagtgataaaagtttagagatttaagaaagtggtggttcttaaccagaatttagacattgggataaattaatagtgaaatgtcagatgtgatattctgtactgtagcttcagtcaatgccatgaacaaggcatataactgaataaagcagtcttttcagtgttttctgtgagcactctttagtggtgtaaaaatgtgtatatataattggggaaattatatggtatttttgaacttgggtcttaggtcagacccttgaactgattgctatttaattatcatgtatattctgtattagcaattatcaacagtaaaatctcgtcatttttgtaggagaggtgtccttatttaaactggtggggaaactaatcattgctttcatacttgagcagcagtgtcactcttttgaatctttttggaaataaagagggctcatcatttgtcttctgtttcaattggaaggttccaatagaaatactcctaatgaactagatttggcctgacccccaacagtttatctgcaggccttgaatgcatgtgctttgattagtagaattatttacagctgtttttgttttgtggcccttttttagtttgctgacatacctttttctgaggaagttcaaaaaatctggatgttggtatattaataattttatttcatatgtttacttttgactgaaagaatgcttattgtatttagtaaatcatgtcttttgtggtttagatacatgttgtggttgaagagtatataaactgtctttgagaagcttggagaatgtttggaagaatgcgtttagagaaagatacttaaagaatgaggaaatggaaattcttcttagatctatgatctacaattaactgacactttgagtctcaaaaaaatctttgccttgtgattttttaagtcc

SEQ ID NO: 4639 - DNA, 1049 bp, Homo sapiens
tataatttacataccatagaattcacttattttaaatacacaaatgatttttagtaaatttacagagttgtgcaaccattactaccatacaattttaaggcatttctgtcactcccaagagctcccttgccataattactataaacttttattcgtgtggtggcacaaattatagagtttcaaagtaccagcctgggagtttggctgtcctgagtttgagtcttagtcgtgccactttctagctttgtgacttgggtactttggtttccttatctttaaaatgggcataataactacattacagtgttactgtgaacattaattagatactgtatatagagcactgaaagtataatatcctagtttttgcttcacaaatgttggttattggtggtagtccacattgtggatatttaaataagagaaacatctgaaaacacctagcacagtgactgacacatgattgattttcagaaaacaaagctgttctacgtctttccagatgcatcatgtcatcacaattttgtctgtagttgctcattgacaatgttttaatcatacttaaacatcgatgctcacaatatgtagttatttgttattttgcagaggcatacatttgaatttaacagctaagggagctgtaagacttggagtttggtatctacaaactagttacttagctggtggacccaagcaagtagccttgttgtttataattcatatctttctttctctctctctcttttttttttttttggtggagttttgctctcattgcccaggctggagtgcaatggcacgatctcggctcaccgcaacctctgcctcccaggttcaagtgattctcctgccttggcctcgcgagtagctgggattacaggcatgtgcctgctaatttttgtatttttagtagagacagggtttctctatgttggtcaagctggtctcaaactcctgacctcaggtgatctgccaacctcagcctcccaaagtcctgggattacaggtgtgagccaccacgcccaacagtttttttttttagagatggg

SEQ ID NO: 4640 - DNA, 1052 bp, Homo sapiens
tatgggcaaggagtggcttgccaatcattggacagtatgttgtatagaacctagaaaagggcagcttttgtaggagtaactttaatattattaaatgctatatagaaagaagtaaaataagaattgagatatgactcttgaatttcataaggttcttaatgtgcttgttaagaattattccacaatagtggtggatggaaacagggacaaggattgaatgacttttttagatgagacaagttggagacaaatttctttcagctcctgaacaaagatttaagcatgccagtggggaaagaactaataatgaaggacaagttgaagaaacagaatattagtgccaccctctaaaatgtcttaatttcatcatattcctgaggattctataggatagtatttaacaacctgaaacataaatttatcaggcacaggttagattttctttccattgtgattatttgtccctgcatcccacatgattatttgccagtcagatttgtgtgtctcaaaataactggacaagaggagtaaacttcctttataaaaatgaaccattattgcagcaagaggactgatttcaaaagatgacctggaaaactgtttagtcttgttaaaatatttggcctcatcttcaaaatgtatacatgaatctttcattttgggattgaaatatctttctgatttagaaaagaagcttgattaagaaggagatgtcaacttttacctcccccgcccccaacaaaaaaacagtttcagaaatttatgattaatttaaaagcagttaagataataaagcaaacaattttgtaaaattttttgagggtaatgagtaaactggaatgctcaatgtatactaaaaatactcctgatcttagtaaccagtttttattacatccttagtgtttgtactaacactaaattggtgattataaatttatttacttgatagtatagtatatgtaatattcaacagagtgttaatgcaaaaactgaaaaaattaaaacattttgcttttttgcttaatcggtaaattttcctttctactaccttt

SEQ ID NO: 4641 - DNA, 1051 bp, Homo sapiens
tattagtgtgtgacacatatgctgtgtgatgcatacactgttttcttgagtaaagaggagatttttgtctactttttttattgacactcatttttgttccttccagttcaacatgagaaatctgctgcattcaaaatctacaagtcatcattgctccaaaaataagttcacaaagggtagcttcctaactgtgatcattttaactggagtgctttgtaacagtttaaaatgtagtaaatgctgggaaaaaaaatctaacaaaaataatgttgtgtgggccggacgcggtggctcacacctgacatcctactgatctgggaggctgaggtaggaggatcacttgaggtcaggagtttaagaccagcctgggcaatatagcccatgtctacaaaaattgtaaaaagttgcccggcatggtggcccatgctcatagtcccagctcctcaggaggctgaggtgggagggtcgtttgaacccaggggtttgaggctgcagtgagccatgatcatgccactgcactccagcctcggtgataaagcaagaccctgactcaaataacaacaacaacaaaacattgcatgaaagaagccaagtacaaaagaatacatactgatgattccgttatatagattttttttttttttgagatggagtctcgctctgtcgcccaggctggagtgcagtggagtgatctcggctcactgcaagctccgcctcccgggttcacgccattctcctgcctcagcctcccgagtagctgggactacaggcgcccgccaccacgcccggctaatttttttgtatttttagtagagatggtgtttccccgtgttagccaggatggtctcaatttcctgacctcgtgatctgcctgccttggcctcccaaagtgctgggattacaggcgtgagccactgcgcctggcctgttatatagaattttaaaccgggcaaaactaacctattgtgttaggagttgggatagtagtgatatttggggaagaataaaggagtaatcattgggagggatagtgagggggggccttttgaga

SEQ ID NO: 4642 - DNA, 1052 bp, Homo sapiens
gcacctgtaatcccagcaactcaggaggctgaggcagagaattgcttgaacccaggaggcggaggaggttgcagtgagctgaaatcatgccactgcactccagcctgggcgacagagcgagacttgtctcaaaaaaaaaaaaagtgtagtggaaaacttttgaatgaaacagaatcactaaattcttagctttattatagaacagtatttaatttgtccaggtctcagtttagattaagaagtaggccaaaaaaaaaaaaaaggcctataattatcagaaaaattaatgaactaaatcatctgcactaacatattggtttagaagttctcttgctttgtacataattcaaggaatttgattatctattttctcgtcccacagcagattaaaaggtgcaaattagatgttggagtagagccatataggtaggatggagggccagctgggtggcaggaaaaaagtcacattagcctgaggctgtttaaaatagggacagcagttacctatacaacacctcattagactctgagtatatcattaactgttatattgtgctatatataaagtattgctcctgatggaaaattcattgtgggaaaattatgtttgtaattttgggaatcataaacatatatacagtagagtggtgtatattagaatatagacctcgctaaaaaaaatagaacatacactttggagtccagtatatctaggttctcatcttctatgacttaagcattataattcctcatctctaaaaacagaaatggtaatacttttatctaaaggttgtttggaaatgtaaataataatatctttagtatagtacctgacacctttaatgaatgttattttcctccttaaattctgtttaacaaaaattagaaagatattcatccagaatatttttgatcaagttctactgtaaaatgttaatatagaagctacatataaaaccttatatagtttagggttaactgtatgtgtacttttgggagtggtagtcagaaatgaagtaattcttcatatgccattctcattttcttcccac

SEQ ID NO: 4643 - DNA, 1032 bp, Homo sapiens
cattctgctttctgtctctaatttgagccaacatcgaggaagagtactctgtacaattgaaattgcagaaaaaactttgggatgtgattgttaggaataaaaaaccacctaattctttgcatgcttctctaagtacagtagacatgctgccagggactctttatggaagaaaagttgagactcatagaagtttgcagttttgttttgatcaccccagagggttttgctcaaactcttagactcatttgtatttcttcattgggttataagaactaaaatttaatgttctatacaaatgtgaacaactaatacttggtctcctatctagaacttgtttgccttttaggttttcttaatgtatagaagaaactaggaatattcacaaaggatttatttgaagttacactgggaaacgatttttagaatttgaagctctttgatccctgtgaatctaactttatgactattttattcagctaatctttgagaatatttagagttttgatttgcgtggcactctgcttttaatcccttgttgaataagtgttagaaaccttgatcttggccctatacctgatcacctctaaaaacatgaacagtgttacaaaggcagttgtttagtaagcttttttggattgttttaattggctgactgagggagacaaaattagtttttttttttctttctagaataaagggtaataaacttggactttagagttactgctaagattgacatttccatttggggctttagaaatatattgttatcttaaattcaaaatggtactttatctaattgaattgaaatcttaaaatttatgagaaacaaaagtcactttatgttcttagtaaatatttctaatggggttataggagatctaagtacaaaaaaaatttaaaattttgttattaatctcccctccttaaggaaaattttattaatatacataattataatttagttataagaacaacttaagttgagtacagtggctcaagcctgtaatcctagcactttaggaggccaag

SEQ ID NO: 4644 - DNA, 1006 bp, Homo sapiens
gttgtttcaacagcatttgtaaaaattactctattttttttttaacttgccaagttgttttgaaattcagttgattatggatggatctgtttctggaatttcttttctgtgcctttgatttatatgtctatcctaataatactacactgtattgattcctaatgcttttattaacagtagaacttcaaatcatgttgtgtaagtccctagttttattttttctttttcaaaattattttaactattataatgtctttgctttttcatttaaatttttgaatcactttgccagtttctactagaaaagtttgtatgattttaattggaattgcattgagcctatagataatgtaagaagaattggcattgtgacactattgagtctctggtctatgaacatggtataactgtcaatttatttaggtattctttaacatctctaagcattgtttggtaatttttagtatgtaggccgtgtgtgtgtgtgtgtgtgtgtgtgtgtgtgtgtggtttgtctctaaatgattcatgctttttatggtactataaatggtattttttaaattctatttgcttatcatttattgttagtttatggaagtgaactgattttggtataattgactttgtgtctgacaatcttgctgaagacaatttatttattctagtggcttatttttaaggtacattaggattttccacataggccatcatctcttttgcaaatgaagacagttttcttttttcagatccatatgctttttccttttcttgactgtcgcactgggttgtacctctaatacagtgttgaatacaaatggtgagagaaagcatgttcaccttgttcctagtctgagagagaaagggttcagtatttcaccactaagtatgatgttagttgtaagtttttcataggtattccttatcaccttgaagaagttcctttctattcttagtttgctgaagggatgatgaatgctctcaagtgcattttctgtgttgtgat

SEQ ID NO: 4645 - DNA, 1083 bp, Homo sapiens
gctggagtcaaagatctgcctcctgaaaggtactgtgttctgatgtttacagccaaattccattaaacattgactgatttattacaatggatacaactcagaaatagctcatgggaagagatgcatagggcaaggtattggagagtggcgggtggagtacacagaataggtctgtgctggtgactcttggaaacactttggcattttcttcccagatgggtaccctcctagtacctcaatgttttcaccaacctggaggccctggaacctccattttcaacaaactccctttgggatttatatataataaaatgctataaaatatcagtttttgagctcttttctgtttgtatatttgcttaataagaatttgctaaatgaataaattttatctgattaagttttcaaggacccaaatgaccaaaataagaacttactgtaagactcaaaatataacaaatgaggttaatttaaatcaggcagtgagtttttggagaatatgttctgtacaacaaaaaaaaagttactacaaaatacccttccaactttgacatattaacatccttatttccttctggctttatcagtctttctaagtcatttaagtctaaaaccccagaatcattattgttgcatctctttattttccatctaattattcatcaaatagcagtaatgctttctttgaaatgtcttctatatatctttgttttcgtttctgcttttcatctcctcatttctgttccttccccttccccttctctcgatttacttctaacagctttatgtccctttcagtcggcctttatgcactaccaaatattcatctttatacagagataatcaatcaaacattgcttgttacctttagttgacccaggtctttcagaaaagtttttttcaaattcagcatttgcatgtacctctatctggtatattttggccaacactaaaaataaggggaaattttgataaatatattacctgaacttgttagttatttaatctatttcacttcagatatctgtatctaattttaaaattatatttacccttactattaaatatgatccttaagaaaat

SEQ ID NO: 4646 - DNA, 1153 bp, Homo sapiens
tcagcagcaccccacttctggtaccaattttctgtattagtccattttcacactgctgataaagatatactcaagactgggtaatttacaaaagaaagaggtttattggactcgcagttccacatggctagggaggcttcacaatcatggcggaaggtgaaaggcatgtctcacatgacagcagaaaagagaagaaaacttgtacagggaatctcccctttttaaaaccatcagatatcatgagacttattcactgtcacgagaacagttcgggaaagacttgcccccatgagtcatttacctcccactgggtcccttccacaacatatgggaattcaagttgagatttggatggggacacacccaaaccatatcagaggagtctttttcattcctttaagccatcagtttcttttcttttcgacaaataataattgtaagtatttatggggtacaatgtggtattttcatatacatgtacattatggaatgattaaatcaaactaatgagcatatcggtcatctcacatgctttttttgtagtgggaacatttaaaatcttattctcttaacaatattgaaatatccactacattattattaactacagtcactctgctatgcaatacatctcaaaaacttactctttttgtctaattagctgaaactttgtagccttggaccaacatcttggcatcctcccactcccatcccccacctctggtaactaccattctattctctatttctctgagttcaattttttaagattacacgtataaatgagatcatgcagtatttctttctgtgtgtgatttattttacttagcataatgtcctccaagttcatgtaaagctgaatggtattccattatatacagtttaaccttgacaacgtgggggcaagaggcactgaccctccactcagttgaaaattcgggtataatttgattccctgactcaaaagcttaactactaatagcctactgttgactgaaaatcttaccaataacataaacaattaacccacataagctagacaaaagaaaatattattaagaaaatcataaaagaaaatatatttactgtttattaaatgaagtgaatcataaaggtcttcatcctcatcttcacatggagtaggctgagaagg

SEQ ID NO: 4647 - DNA, 1041 bp, Homo sapiens
actttctccacatatgtatgagactgccaaagcaaatatctggaacaattattctatctttaatagatggctcaaaaataaaaatacagttcatagaccattaatagaataattcctatactgagaaatggaaataaattatgtaggctatgaaaatctgcctgtgtaagtgttgccactttcttttacctctctaaatggaaatcttcctaaatgtaatttaagattcttataatatatttctggttctactatagacttattaggctggtgcaaaagtaattaaaagtaatgacaaaacccacaattacttttgtaccaacctctataaatgattttatagggtaattttagccttagaattatcagtattgttgtatcatttaacactgattgtttctttagattagtaaagtatagcttttgtccaagaatccttttcttacatgatttctaattagtcctgtgatctagcctttcaaatttgcccataaaagatctttgaactataactttggctgataattactattagactgtgatgtcctaattccgagtttttctattctaaaatactattattattatttgttttcaggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggtaagttttcatatcagttttttcaccttgggatctcatattatgcattatgtatacacagggtttgattaaattttaaaatataaattggtatgtggtatgtactttttaaaaaactttgtaatgtgtcaccaaagacaataggcattttaggtagtgattgaaatgcatagtaatagagcaatgtcatggtgtcataatgtccctctgtgacccatagcatttagtgcatatctcagttataaccattatcatattgtctgttcatatctcttctataag

SEQ ID NO: 4648 - DNA, 1416 bp, Homo sapiens
ggacaccatatttaagactaaaaataagtcaataaatttaaaatgcttgaagacatacaaaacagttttctgtcaataaatttaaaatgattgaagacatacaaaacagttttctgaccaaaatggaattaaattaaaaatcaacaatagttactttgagacatctgcaagtatttggaaattacatgacacattactaaataaccattagtcaaagaagaaataacaaaggaaatgtaaaaggattttaaactgaatgaaaatggaaacacatcatatcacaatttgtggtatcagccaaagcagtgttgatagagaattgtgtatccttaagtgtctgtctttaaaaagaataacaaagctaactgaagacaagcagaaggaaggaaataataaaggttagagtagaaattagtgatagagacagacaggaatagagactgcctgtgatggtggatgccaaatgagtgatcttatcggagtgcagaaatactctaaaactgatttatggtaatagttgaactgctggttaaatttagtaaagatcgttgaattgcatacaatatttttagtgtgtgtattttattatatgcaaaatatatctaaataatggttttttaaaacaaatatgggaaataagattatatagcattatgtttatccagatgtcccataatgtttatattaacatttttttcatgacatcattaaaacaaagattgatttttaagtttccagttattttgaccccttaatactctctttctagagccaatcttatatttgaaaaggattccttttcctttgttttctggctgttagagattagacatcatatgtgaaacttttaatgaaaaaaccaaaaaccagttaaaattaactttgctttccatttctgcatttactacatttatctaattttgttttgttttagatcactgtgtccactactatgatcttcgtaacactaaacagccaatcatggtattcaaaggacaccgtaaagcagtctcttatgcaaagtttgtgagtggtgaggaaattgtctctgcgtgagtattactctcctcagaggttgagcttaatacagagctctgtacttacctaccagcttgtaatgtcactgagggtgtatgtaaactataatattggagtatatgtactttttcttaaatagtagattttttttttaatcttgtccaattaaagtagtgtggtttctggtctgtattgtgcacttttatatgtgaattgtgggtaaaatcctgaagatactagttttttatataccctccccccttatctcatcctcctatgtttaattgcatttgaacttcagattagattttagctattgcttctaaagaagagataaacaacatagttgatgcaatagaatgagaagtattttattta

SEQ ID NO: 4649 - DNA, 1071 bp, Homo sapiens
cttttgtacagtacacaaggacataatttaacctttacttatatgcctttcacatattacaccccttttgtattaacatgagaatacgttagtatattattatatggtactatgttatttttataataccaaattattctcatcttatgaaataacttgagaaattatgtattaaaatgtttttgaattgtgaaatattagaatattgttactatttgacccaactcaaaatctccatgggaaaatacctgtcgatacccacagtattgttgaaaataatcagatgcagtatcacagctgtgtcagactctagtaccagttgggcaatcaaggcacagctaaaaattgaaaacaaagatctggacaacaaaacagccaaaggtgggggtcaagaagctctgacgtgtacctagctgtagaatgctatgcacatgtgccaggtgtagtgtgcatatccaggaaaaactgcagagagccccagtcttcacctctggttgaccatgagctctgtgtaagcaggaagtgaaggctaaggcagatttaagctctgaaagcattccacaacatacacacaaatcgtgcaaagcattaaggaaatcttgttactgctaagtgttgctgacccaggaacaactcctactcagctggacttaaaaataaaaacaaaaataaataaaaaactcattaaagatgtcagtggctccatgcagtaggaattacaggctgaacagatttagtcccagggaagtcattaaaccacaaacagcaacaccgccaatagcaaaaagctgagctggaagaaaaccaggaggaagaaccgagtccacagttgccacatagtattttccaaagtgtctgcttttcagtaaaaaaaggtatacacaaacaagaaaaattcttagtagaaattatcctagctatagggcttatatatttgtaattagttattacaaatatattcaaaaaaggtaattaaaccacaaagagttaaaggaaaatatgacaaatatactttatcaaatagagaatattaacaaaaagaaataaaaacaaataattctgttgttgaaa

SEQ ID NO: 4650 - DNA, 1037 bp, Homo sapiens
gtgtttgttttcttcttaatggctgtggagatagcatcatttggcttaacaactgaaataagagagacagattccctttatactgaaaaggccagaaggtcatttaagtaatcaaatttggcatcaccattggaacaaacatgtgcctcttcttttgatgtgatagaaaggaccatcacctttatagtatttgtgccaaaaacatttaatttgaacataataagaaaacatttagacaaattcagatgtgtggaacaatgtgcaaaacagctgtcctgaatgcttcaaatataacaatattatgaattgttttatataataggccagagacatggcaactaaatacaatgagtgacccactagtaaaaacttaataaatattcaggcccttttttaaacagttgggagatatctgaatataggatgcattgtatattatatcaatattaattttcttgagtgtgatataatgatattgtgtacataggaaaggttttgtttgtagaaggtagaggctgaagtttttaaaagtcaaatatcctgatgtttgaaacttaaagtggttcagcggtacagggggcagagagagagagagacaagaggcggtgtgtgtttggggtgtgggtaaagcaaatatggtgaaacatttacagttggtgagtctagaacaagtggtacaaggttattcattgtgctgttctttcagcttctttgcagactggatatttttttcaaagctaaaagggaaaaaggaaaaacagtaattgactgtaccctaattcctcattattaagcatactttttcagttatggcaatgcttcagaaatataaagacataccctcctttataaaggaaagaaaattattgcggaccccccccccccaagtaacctaaacttataacttaacatcataatgttattacaatatatataaaaatgtaaaggtgtagaccatcttcatatgcccctgtctcctaagtaactataactcagaacaaattctaattattaataaatgcaatatataaaatcaa

SEQ ID NO: 4651 - DNA, 1046 bp, Homo sapiens
ttcatttccttcagggaatcgatacattttatttgttacaagatttatgggcatcaaagtccataaaatgctcctccacttacaatgggattacagtcccaataagtccatcataaattgaaaatgcatttaatacttctaatcgtagcttagcctaacctaccttaaatgtgctcagaatatttacattggcctacaattaagcaaaataacacaaagacttttacaatacaatgttgaataatacaggtaagaatatcataccacatatcactagcctggtgaaatatcaaaattcaaaattggaagtatggttcctactgaatgcacattgcattctcaccattgtaaagtcaaaaaatcataagttgagctatttaaattggggactgtctatatttgtaatatactcatatctctagggtttgtagccatgctttttttttttttttttttgtttttttgtttttttcattacctctgagaagctgtgatgaagtcatcttctgtcttttattcctgataattggtattttgtgtcctctcgtttatttattgtttattaatttaggtcagcttggcattaggttcttaatcttttcaaatgctcaacttttggttttgttgatttttctgtaattttctatttttaatttcatagatttctgcccatttttcttcttgctttgggtttaatttcctcccctttctagttttttgaagattgaagtttatgtcatttgatacttctgtctttttaatctgaacattttttgttatatacatttcccattaagcactactttagcaaattttgaaacaaatttgaaaccaagttttcatgactatttactattatatttgctattatattattttcatgactagtatatttgcttttccattctgtttaaaattctgtttgatttctcttgttattctcttgttcatctatggattgtttaaagtatatttaaatttccttaaaattttcagaaatcattctgttgctgatttataacttaatcctcttatggttaaaggat

SEQ ID NO: 4652 - DNA, 1870 bp, Homo sapiens
tcactcgcggttaggagctggagaccagcccggccaacacagcgaaaccccgtctccaccaaaaaaatacgaaaaccaatcaggcgtggcggcgcgcgcctgcaatcgcaggcactcggcaggctgaggcaggagaatcaggcaggggggttgcagtgagccgagatggcagcagtacagttcagcttccgctcggcatcagagggagatcgtggaaagagagggagagggaatccgtggggagagggagagggagagggagaggtcacattcttgaagtggggagggaatacactcttaagttcttattatagcaaagcatatcactcatgtagcaaactatataaatgtttagaatcatttcggagctacatagcaggtatacctgcattagacaatataatggataataagattcttacacctacttataattagtaagtttggaatgttcagcaaatattggaaacgcaggggtagtttgtctttctatgtaaaatggatttcatttctatgctcagttaattataggattttcatttgcataaggatgagaagtataaatatttttggaggtataacgtagattgtgagacagtgaatatgatgagtaggattggaagagtaagggcaaaaataactttatcctttgctcagagtagaaacttagtagatacattgaatcctttatttctttctgtagtaattaataaagtgtttgtagtcactagacagaaatactacaattcccatttaggagaataacacagaaaacaaaagaaagaaatcagatggtcaaatactttaattaaaaatgtgattgaaacaatatatatcacaaaataagatgacagatacaaaagtaaacgtgattgataaatttaaataggctaaacttcctggcaataagaaaatatttttatagtagattataacataaaccacaaatcagtgcttgtatagacgagttctgaaaacttcaaactgtgaaagttgaaagtaaggtttaattcaggctagaaagcattagatcaatctctctttgtcttacacacacacacacacgccccattataatgatcaaagttcagtctgcactgaagtttaagtctaattgtaagtatctttatatattaaaaaatccctgtgttaactgtaagacaaaataaacacatttagtggtatgagactttaaattaaatcagatcttagtccatgacagattaagtgcacaaaaaataaatgttaataaaactgtagaagccctaaataacataattaacaaactagaacacatatacaaacatttataaagaatataccttcttttaaattgtccatggaacatcagaaaatgtaaagaatctagatcatataccaaatctcaaattacagaaaataaaaattaacattttctgatcacaacacagtaagatcaaacatttattacaaacttagaaaacaggaaaaatataccacacggaaatttaatagcttttttggcaacgctgggatcaaaatggaaatcaaaccagtatgatgaaatttctgtgtatcagaacttatgggacatagctaaaagtgcccagaataaaactccttactctaaaggaattaacctactcaaaaaggaattaactgaaaaagtaatgataaataagatgatataaaacaatttaattaaacaaccaagcaaagaaattagagaaagaacaaagtaaacctaaataaaatagaaggaaattaaataaatataaaaataagaatacattatgaaaaaacaattactaaatcaattcatgagcttttaaaaacaaaagatgaaaattgttagtcaacctaatcaggtaaacctggaagaaattactag

SEQ ID NO: 4653 - DNA, 1032 bp, Homo sapiens
tctttaagtgctttaaggagaaagacattttatcacaaaataaacacttgatattcacaaaagtttttcagaatatagtctatcaggtagtgtatttatttgttttagctattcaatgatagccagagggaataagaaagtaaatttttttaaagtagttgttttaaagcaagatcttgaggttttatggaattcaaacaaaatgagccacctaataaaaataatagaataaaaatatgcatagactttaaaatgtggcttcaatttagtgcctatggaataaagtctgtccattaattcagaataaggtcagcaattatctagcaggttgctattaaaaaaacagtttaaggtcagcaaactaatacctgcgagtcaaatttcaactcattgcttgactttgtaacaactaagaatattttttacatttgcaaaggttgaaaaaaaatacaaaggataatactttgtgacatgtgaaaattcagattctagtgttcataaatgaagttttgttggaaccactgacgctgttctgacataaaattaatagatatcaatggctcacacctgtaatcctagcactttgggaggctgaggcaggtggatcacgaggtcaggagttcgagaccggcctgactaacatggtgaaaccccgtctctactaaaaatacaaaaataagccaggtgtggtggtgtgcacctataatctcagctactcaggaggctgaggcaggagaatcacttgaacccaggaggcagaggttgcagtgagctgagatcacaccatcacagtccagcctgggcaacagagtgagactctgtctcaaaaaaaaaagaaagaaaaaagattttgcaaactccctaactacaaatttttaaaaaattatagtgtcttaattctaatataaaggagaaataaaaggaaaataagatgattttaatttgtaaatacttacctattctgtatggttaaaataaggagatggtcaaataataatttaatgactcacttgttttattgccatacaaaga

SEQ ID NO: 4654 - DNA, 1098 bp, Homo sapiens
aacgtgtcaaatattgctaaaacttaacatgcttttcatttacaggactaagatttgaatttattatgtatatgaagatcttaaaatttaagccattagctaaagaaactattggaggagatcttttattgtattctgtcagctgtttaactcagtaatgagtaagacaaaaatcatacattcctttatttttctgtatgttggcacttgactgagtaaaatttgaaaatgcagcagattatggggtgcattttattacataatttaattaacaaaaaatcattgataacgtagtgcaggctaggccagactaggcatatagtcatgaacaggccagacgtgttacttggattcaggagagctcacaatcttattttagggcccttatagataagaaataaaagaatagtttatgaaacagtttactttggagcaacatattagcattcttacttaaattcttaactatgttaagaatgtatactatgcttttaaggacttcagaaatgtagattgaatgtgaaatggcaaaaataagtatcaaagtttatttataatattgacctgatatgtatgcacttacctgtagttatgtgactatacaaagagtaataatctttttttttttttttcattcctgaaagccattttagcttgattttggggaagagatggtttcattattgcttttttaaagcttgatttaatgtagtgttgaattttttacaattgctaataaaccctaatcatactgacatttatgtgaaaacattgtgcattctgaggcagaaatacattcttaggaagacctaaacaagatcttagtttggaaatacttacaaattgtggttagattaaaacatttagactaatataagaaatttttaagatacctctggttgggccgtcttgcatgctacattcgttttttttctattaattacaccaaattaatgttttttaaagaaaaaattccaattttaaagtttcttaggcatgagagatgaagactagcaagaaaggatgatatggccaaagaaatgaaggtgtgaaaaactctcacagctctgttgattttttgcttttcttactttctta

SEQ ID NO: 4655 - DNA, 1094 bp, Homo sapiens
tacatatgtgtatatgtgtgtatatatagtatatatacgtacatatgtgtatatgtgtgtatatatagtatatatacgtacatatgtgtatatgtgtgtatatatagtatatatacgtacatatgtgtatatgtgtgtatatatagtatatatacgtacatatgtgtatatgtgtgtatatatagtatatatacgtacatatgtgtatatgtgtgtatatattcatatatgtgtgtgtgtatatacacacacacatacatacccccatcttggtttgtgtaagtatactctatgatcacataatgacaaaattgcctaatgacacatttctcagactgtatccctgtcattgagtgatgcatgactgcactaccttaggaagaatagttaggcatggtagggctttgcaagaggattctgttttagttttcatagccaggcttctccaaggaggtgacatttaagttgacacattaatcaagtaaagactaattatgatggaaagttatgggatagtgttgagcaggatctgatttagattttaaaatgtttacttggatccctgtgtggaggacagagaagatgtgtccctctcaaccccttgacattggaagctggggagaaaagttaggaagcattgtagcagttcagaagagaggagatgttggtttgcattaggattttattgatagaagaggtaagagtggttgtattgtaaaataaagtagcagatctcgtaaaacatactagatttcatgaagtttatgaaaatattgttggagaattgctaaaattgcttgcaaagctgtcattaaattagattctagcagagttaaatgggttagcagttcaagaagggaaaataggcaaacagtattttcttcaagagtgttttgatattttctctgaacaagtgatgtgaatatcactcaaggattgagagaggcacttgggaaaaatgatgtagcccttaaatactcttgagtgaaaatgatccttaagattacgatttgaaatcagacattctgagacaaatattatcttttataatactattcatatttgatttttctttaagcaatagtatgtagttg

SEQ ID NO: 4656 - DNA, 1063 bp, Homo sapiens
ctttaggaaagctattatggatctagttcagtacatcatgtacagaaagggtgcagggatgttctagttaaggagaattcagaggtttgacatttttcccattaattatagtatggagaatccttgtgagttcgttaattctggtgttattttagctgtgtaattcagccgattttcttctatattttactttctttgaaacatttgagaatgacttggtctgtgtatattgttatctttaagccttgaattcagttctgatatgcacaggatctttgtcaatggaatacttattatgtaagtacatacagggaagaaaaagttgtcacatcacaaaaagttcactaataatgattcattcccattgtctttttcctctctgtttaacagtagcaaattttttttgtatatattgtttccagatctttgttactcagtctctcactgattgttggattttatgaaattgtgacagtacggtgcatttacttaattgctctatttattgaatgcctctgatgtgctagggactattctaggtgttggatctagctgacaaagtcctcgtccctttggagcttacattttgggatgtgtgtatggaggttgggggagacactaaaagggccaatgtatagcatagtagtagtatataacatacaatacagtcatgcactgcataatgacgtttcagtcagtgatggactgcatatatgatggtgatctcataagaaaataatagagcacataaagagacctaatatatgacacttgatattggcattgcagatcaagtaggggaaatgactgatattcagtaatggtgctgggacattggtttttcacatatatatgtgtacatacgtatatatatacgtacgtatatacgtatgtgtgtacctacgtacatatacgtacgtatatacgtatgtgtgtacatacgtacatatacgtacgtatatacgtatgtgtgtacatacgtatatatatgtacgtatatacgtatgtgtatgggtatatatagtatatatacgtacatatgtgtatatgtgtgtatatatag

SEQ ID NO: 4657 - DNA, 1035 bp, Homo sapiens
aaagttatcagtaagattgactgcaataacttacctaaaaactataaagaattgaaaatagatgtattaaataacagcttacccttcaccatgaggagaaaacttaggaaaatttagataataaagccttaggtaggatatagtttttttcttatggtaaaaacatatgtaggcaaaaacaagtaaaaacatagctacctatttagaacttgggaggtctaactcatggaggatagttaaaaggcaattttgtatcaacagttttatagcgagcatgttctaatttaacatttataaaatttctcagtcatttcacactatacaaaatatgggaaaattaaatagtcaaaatcctgtgctctggatagcatgctaaaataactttgaaaactttttttttttttttaaatttctaactggctggaacctggtatgtttatgttaagaattgtctaattaggatactttttactcatttaaaaatgtgtaaattgtctgttatgtgctatgttctgggctatctttattctttttgacaataaatagataagagatgttttactggatgatgaagtgttgaatagctaaatattttttatgtggtttgtgactagatttttcttattctcaactgttgctaatttagttgtgattttaatattcctactaacaaacatctgttataaatttaagatttacttgtgtctcaggttttttttttgtggtaggaaagaagaagatgtccagtcattcatttgtttaaatgtctggtggtgcaatataaatggcaatgtgcatgaaagttgcctgttacggagcttgtggtgagccgagatcgcgccactgcactccagcctgggcaacagggcgagaatctgtcccaaaaaaagaaagttgcctgatgatcttgctaaaatgcatgttcagattaagggaggctctgttggagcctggcaatctgcatttctggagagataatggagaattcctttccaacattaattcttccgtgtgatcttcatttggcctttgatg

SEQ ID NO: 4658 - DNA, 1030 bp, Homo sapiens
tgtcttatacacacacacacacacacacacacacacgtatatttatatgtgtatatatatgtgtatatagtgtgtatatatgtgtatatatatgtgtgtatatatgtgtatatgtgtgtgtatatatgtgtgtatgtatatatatatgagctacatgtggtgatatgcacctgtagtcccagctacttgagaggctgaggcaggagagatgtcccgagcccaagaggtcgaagttgcagtgagtcatgatcatgccagtgcactccagcctgggtgacagagtgagacactgtctcaaaaaaagaatggagaccttctttgattctcttgttattcagaatacatttcttaaaagctattggctttaactgatttgatagtaatttttaggtactgtaacttttagtataagtagaacacattatgtgacatgacacgtactgtacccctgctttttcttttttctttttaaataaactaacggatgatggagctgtgtgcgaggtaaacctgtagtcatttcttccagttttcaggccagaaaccttcactgatttttgtctcatacccaacatctatcagcaaaccatagtcctaccttcagaatatatctagaatctcaccacttctcatcaacccaactactaccaccctagtccgtttcaacactgtttctcactggattatgatagcttccgtaaccatttctacacttggcttccctttagtcttcttttcagcatagcaggtagaatgatctggttcattactgtgtcaaatcccatcactcctcttttccaaatccaccagtgaattaccgttttactcaacttaaaagccgaagtctttaacacattccttagttctttgaggtgcccttttttttctcttttctttttgagatagggtcttgctctgtcacctgggctggagtgcagtggcacagtctctgttcactgcagcttcgcctgctgtgctcaagtgatcattcttcctcagcttcttgaggagctgggactagctagagtag

SEQ ID NO: 4659 - DNA, 1035 bp, Homo sapiens
atgtataaattgggatgtagtaatattctataagattatgaggtttagagtatataatgcatgtaaaaaggcattataaattataaaatcacaaagaatcaggtggttatttgctagtgtttggcatttggtatcaaaacacgaaagtgtttctgcagtcctgtttatgtgaggtgtaactactgcttgtttttctaaatgactctagattgtgcctggctctgattatctcagtaatattattatttttaagtatttaacctttgaaagattgattttttttttagttggaaccagtactactataagacagttgacacattttatgaaagcataatggagttagcatttgtactaaaatatgcatgtattgaactatgtacatattagtttgttggacagttctaagatagtactttgtaagtacttattaaattcacttaataagtttggatgctgcttttgaaggaaataatgcatataaaagggaatgacaaatagagcactgattaacgatgttacttgggccggattgcaatatgacccttgattaactgagatgatatgtcttataaatgcatattagatatgtgaaataattttctgtatctggatctgttctgtactgttttttttttttttaaatgtcccaagtgacatacattatcttttggcaagcttaaggttgtgcagtatgatatctgtccttctggcaattggtataaaaatgtcttcttcacagcattttattgcttgaagaacacgattttaataaacagtgacaagaggtaaaagttcaaaataatctctactaatacaggttgagtgtccctaatccaaaaatctgaaatttgaaatgctccaaaatctgaacctttttgagtgccaccatgacacgcaaagaaaatacttattggggcattttggattttaaatttttagatgagggatgctgaaccagtaagaatataaatgcaaatatttcaaaatgcagacagatccgaatctgaaacacttctggtctcaaccattttg

SEQ ID NO: 4660 - DNA, 1044 bp, Homo sapiens
ggtggtgtctgcagagggaatcgagcgtttgcaggcattcgagctcctggttggtggggtgaaggaatgttggagtagcgaggcagggtggggataataaagaggtaggtaagtgttgctgaggaggaagtgaagggagtttaacgaatgacgagggaagaggtggaaggtcaaataaatggttttggataacaaagttggcagagaggttgagtcttaaaatttttgcctctctgatgaattgaacactcagtcaatcaggagtccttgttgagatgaatgaaatttgcaaatggagaggactaagcttcctcggatgcagaggggtggagttggtcaaaatttatttgaagtatggtagatgatgctgtaaacataagcatggatgtcttataaagacatgctttttataataatgtaagtacctatcgtatgtatgtgtaaatatcttcttccatttcaaaggatgggccacttaggaatcggctgttgagacgactgtagtcaaagtctgttaacagatttttcacttctccaccaagtgtcttgaaaagagagaaccacgtttgttaaataacatccctgtgtcagatgtaactgtactatactggataacagagtatactggaacttctgacttgagaaatgctaggtatagacattttgtcgtcatagttggcatcttgaatgatacagagtaacatttagtcatgacatttgggatagagaggttagtcatatgaagtgaaaggtggtgttgattgtcttgcttgagagtgttttggaatttttattggattttagatattggtaggattatgagaagtaattgctgttagctagctgcttaagaagtggtagtgtttcgtactttcctttttgaggaaattgttgatcaaatattaggcatgtaggaagttggctgcttgcacagtcattatgagggaagttgattcagatcagggttgaagatggtctgagttggtgttattaaataagatagagctagaagttggaactgttaggaaagttattgattagact

SEQ ID NO: 4661 - DNA, 1031 bp, Homo sapiens
tgatgtataaagaaccatttgattggaagctactacttgacagtcttctgtatttttcttgtttatatttgcctggctttccaaactactccacgttgtctgggattctgaagtactttttccaagtcctggggtgctctggaataataggataagtattctgatttctgaatgtcaagcacatgaactgtggttaacgtaatcctctatttctacattggattttgtttattaacactttatttttagattttatttcctgagtttgcatatcatgtaacaactgctggtactacaggcataattaaaaaaaaaaacaacagcaatttgaccactgagccacatgctgaccaccttgcctagaatttgtaaatttgctgacaatgtgtaattattatttttattgcctcaaataacaataagttcagaaaaatatgaccagagggagccatcttcagagcatgtctacataatcattagagctgggattcatggtatagtgatacatgtagttccctgtagtttttctaatactgctagagactgataccaccccctggatgcatgaagggcatccagtaaattgggccatttattcattctaacttggcagatgggagctactatacttcatgtggactgtaatgtcttgctaaccactgacaccaatactaacaaaactgttgggctatttcatccagtcaagtaagaaagtatagcacataactatgctttggttttgctccaaggtgacgtttccaaaatacttattgttggagttgagtagacccaatgaatgtcacctcttttctccacctagcttcaggaccagctaagagacagagataagagccaggcagttggaaatgaaaatatcccttttattactgatcaaactatgctggaagttgtggcttaggtatggtcaagatgcttgcttaacattcttttaaactaaacttatgtctccaaatatcaggtttccatggaaatagagctggccctacaagtccccacagagtttagacagc

SEQ ID NO: 4662 - DNA, 1042 bp, Homo sapiens
acaagttcatgttactttgccaaattcccctcacttctccatgtgtagatggagctctcaccttgctgtgcatgcctaccatgcaatccatttctttagtgatgttgccaattattcttattttgcccaggagaaattcaaagaaaaccacacttcagtctctagatccaagtagagaaaaaaagaaaatgtctaggaggctgttccatttacttgataccctaccaactacagttccatttgcagaaacatggtttcctgatggccacatgtaggctagagccacatgtggaattctaacacatccctcttgctcttccttcataggagatgtcttcacactgaaaacactaggaagtgagtgaataaacccctactccccaacccttagggaaaagcaatttcaaaaattgcctggccctttgaaaagttgctttatagttcccggagtgcagctcagttgaacccattaaacccaacctatgctcttgataggattatttatttttgctttcaaaaataccaataacataataaaaactggggactagctggaaatgggagcattgtggatatgccgctcatcaaaatgtacaattactgggttatttggaggatggaaagttcacgttgaagtcatgctgatatgcaaagtacaatctgttcatcatagtatataaaagtgagtagagggaattatgtgtttctaaagaggctgttttgcactctgcttgtagtgtttactgtgcatgaagaggtacaagcatggtgcttaaaaaaagggagggctagcaggtattcaacatttcatttcttttttgcagaatcccaaaaccagggcctaatgctgtgatgtgcctactaggaaccaatgtgcacagtgaaagcccagatgttataagaacgggttttctgcacctctgtgcaaagctgcccactgcagtgtcctgttggggttgctatggtaatctggtgcaacttggcatttacacacaggcacacagacacactctctcacttcagggccagatgcactatttaa

SEQ ID NO: 4663 - DNA, 1047 bp, Homo sapiens
acaggaagtagttaatcctctgggaaatagacttgcagccctgggaagaaaagagttgttcctccttggggacatacaccatcatctgggctatttcatccagtgtctcttctttatacaggagctcctggctcaggaaggcatcccgtgcacacagcctcacgtgacggtactccaaaggcaggaaggggatgaagtagtcaatcaggttttccttcacaagacggctgtggccaaagccattgtctgaaagcaagaccaaagttacatggagtctgacctaggactgaacctagctggaatttagcgggggtgggggttgctgttggtttctttgaaacaggggcttgctctgtcaaccaggctggagtgcagtggtgagatctgggctccttgcagcctccacctcctaggttcaagggatcctcccatctcagcctgtgagtaactgggaccacaggcgtacagcaccacacctggctaatttttgttttttttctagagacggggtttcactatgttggccagactggtctagatctcctggactcaagtgatccgcccgcctcagcctcccaaagtgttgggattacaggtgtgagccaccacacctggccccgactgaaggggctgggtgaggttggatctcatctctcaactccaggagtgctgtctgcagcgtatgtcaagaactctacagctgtgtctcctttaggtaaagtcttgcagtgagactcagagtctcaggcttcagagaccactgcgcctgttcttggggccagtgcaaactactatttccaagcattcccagaaaaggagctcaggctttcttaccacttttcttgtgcccacccagggttgacaatgtgagatgattatagtctgccctctgtgttcccaagtaccctgtctgcttcataaacacacattccaacaaacacattaattatcaccagctgtggctctcaccagaggcatattgagtcagttactcacctatggtctccacaatctccgcctggaggtggggctccaggtgttccatcg

SEQ ID NO: 4664 - DNA, 1078 bp, Homo sapiens
tgcattgctgtcgtgcccattaagaaagggggagtaagtaaaagaggaatcgctcagatctttccttggatgaacagcagtggcgtggttggtgtgttgactgtgaacaggctgacttagctgttgatgtatactcagaacctccatctcctcccagaccctgcacttttccttctctgcagtctgattctctaatgactgtcactggacaaaccccagttttatgctcgcttagtaaaaataagtttaaacatttcatggtggttgacagaactttgtccccaaacatgcggattcaattctttaaaactcgttgaacgtttataccaaaggtcccgccccgcaggtgtgtatgtggtgcacagagggtgaggtttggagcatcgggcactgtgtgcattgctaaggggacatagtgagacaatgtgggatttaactaaaaacacatcaattgtgtgtcacattaccagtgttgtcaggtatttgttcttaattgttattgtaatatattttcagttgtttttctaatttaattctctccgtctgttgtctgactgtgaactgctaacagtgttaaacttgatgtaaataaatgaggcccttgaaagggactgctttctctgtcttctcacaaggtttgccaagttgtgttctgttttaaataaaggttgcaatattttattggcaaagtaggctggagattggagtgtttctcccatgattttagttgacagggagtctaagcagcatttctttctctctctgtaatgcagatgtctataaggtaaagaagctgattttagcaagcatccctctggcacattctttttttttttgagactgagtctcgctctgtcgcccaggctggagtgcagtggtgtgatctcggctcactgcaagctccgccccctgggttcacaccattctcctgcctcagcctcccgagtagctgggactacaggcgcccgccaccacgcccggcttagtttttgtatttttagtagagacggggtttcaccatgttagccaggatggtctcgatctcctgacctcatgatccacccacctctgcctccca

SEQ ID NO: 4665 - DNA, 1696 bp, Homo sapiens
gaaaactatgttttgaatagagtttggcatttttgaccaagaacaaaattgagttttcattggaaagaaaggaaaccttgattcttaccattgctgctccaaaggaggcccaggttaagaggattagaggagacacgcggtgctgggcattcctggcaggtgttgggtgatccccgcagtatgtcacctgcagttgcagcacaggcagctagtgattgggttcatctcctcctagtggttggaagagaactcagatgtaaaaaccagcggtccttctcccaccttctttcctgccattcttgctcatcatacatgtccgtaaacttgaagaactcgttttagcagctagccttttaaggtcgaggatgggaaagctaaaactgtagaatattattatgctgctttttaggtttatccctgttgttgtgggatgcaagttaagggattgtaattgtttttcagggtttttttgttttttgttttttaagcaagggctctattttcccttgagagttctggaactaagccttggagaaacactactgagtgtatttaggctccctggttttcttgcccaacaacaatctgaagggtagggggtgggggctgtgtcttactcaggggcagcacctagctgtcttgcctacagtgggtgcacgatatataaatggaattgatttttgtcaacactgtcaagagtggcattgactattggagcataccccgtccacatgatgcttgaactatgtaacttcaggggttgagggctcaaggttcaggttaaagaggcactgtcaacttactatacaagcataatttaggtttttcctttttctacttgaaaaggaccagcttaaacacaaacccttatgtaaattaaaaggtttgaatccaaagcagagagaactgcttctggaaaagtgtagtttaattttaactattctaaaagcaatgagcaaaggcccttgtccaaggcgttgacagttttctaaagtggttatgctgtatatctggatgcatgcctttgggctgccactgcttgattcctttcatgtacagataatattacttcagtttagatttcccactttaaaatgcagtgatttgtgttgaatacatcttgattgtgctttacctaaagtattttcttaaaaggctttgtgtaaaatttaaatgtatatattttcctgtagacttccatcatgattttcagagattagccttaaaaaatttggccctaagaaattcattcagtgtttttctagatgacctctgtacatagaggtcattatagtggagaccctttaccagcagcattttaagatttaaattagatagaaagtttcttaggattcaactgaaaattggctagtaaaatatgtcccaggtaataaagcatgctgactttgctaaggcactgcccatttttatttaactaaagtcatggagattttgagtttaaaggatgcagtatagatagtggtttagtgtttaggctctaatgccagtctaaaaggcaagtcatttaaccttgggagcctcagtttcctcactgtaaaacagggataataatagtaactacctcagggttgttgtaaggattaaatgagatgatatttgtaagatacttagctcaagtgcctggcacacaatgagcacactctataaatgttctactactactattattaacacc

SEQ ID NO: 4666 - DNA, 1032 bp, Homo sapiens
ccaaagtgctgggattacaggcttgagccacagcacccggcctgtacttttagtagagacaaggtttcaccatgttggccaggctggtctcgaactcctggtctcaagtgatctgcccgactcagtctcccaaaatgctgggattacagatgtgggccaccaggcctggtcctaattgcagttgtgtttgaacataagtctgtgttgtttcctcattgaacattgacgttctctgttgcactttgtcaaaaatgaactctgagatcctcctttttgatatccttttatatttctgaatgtatacagttgattatatggttaggctgagtttgaagacaggttttacttcttttattttcaagtggaagaaaacttgccattttctaaaacatctccttgtttctcctcatccttttattagagggaataggagctgaggctaaatcgaagcaccagccttagaaagtgggttaatggccaggtgcagtggctcacacctgtaattctagcagtttgggaggccgaagtgagcagattgcttgagctcaggagttcaaaagcaacctgagcaatgtggcaaaatcccatctacataaaaaatacagtagcttgagatcgctgtgtgtgctcactttggctgggtgcagtggctcaagcctgtaatcccagcgctttgggaggctgaggcgggtggatcacctgaggtcaggggttcgagaccagcatggccaacatggcgaaacccctgtctactaaaaatacaaaaattagccggacgtggtggcgtgcgcctgtagccccagcaaatcgtgaggctgaggctggagaatcacttgaacccaggaggcagaggttgcagtgaaccgagatcgcgccactgcactccagcctgggtgacagagttagattccgtctcaaaaaaaaaaaaaaaattagctgggcgtggtgttgcacacccatagtcccagctacttggggagctgaggcaggaggattgtttgaacccaggaggtcaaggctgcagtgagttga

SEQ ID NO: 4667 - DNA, 1042 bp, Homo sapiens
tgttttgttttttgttttttttttgtagactgggtttcgccatgttgccccggctggtcctgaactcttgagctcaggagatacacccaccttggcctcccaaagtgctaggattacaggcgtgagccaccacacctggcctagtggctgaatttttaaaatagttttctgcattagtaaataacttagtcttgtagaaaagcatctattgctcacctatcccagtgtacttataaatagggacccattttataaagcctgctttattccgcatcttgatgagtgctctacagtgacatatcattagtggctttctaaggtgttagtgattatcagaagatactaccatatttgtcagcacttacttaactctgcctataacacaaaaccaagaatagagtgttcatgaccattttcctcaccatctgaatggaatcacattagggttctctttcccacagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctggggtaaggttgaaagggacttttttctgtgtcattttatttttttttttataaatgccttgattctttagagcttctcttacgatgttcagtatcctctacctttacctgccattcttcttcagttattcagcaagcatttgttaaatacctcctatctgccaggactgtgttaagaactttgcataaacagaagtataggcctggtgtggtggctcacgtttgtaattacagcactttgggccgagatgggtggatcacttgaggtcaagagttcgagaccagcctggccaacatggtgaactcccatctctactaactacaaaaattagccaggcgtggtggcatgcgccagtaatcccagctattcaagaggctgaaggctgaggcaggggagtt

SEQ ID NO: 4668 - DNA, 1059 bp, Homo sapiens
aaatataggatttgaatacacagagggggaggataagcatagttctgattaaaacgccatcttgattttttgtgaatgtgagtgtatgagaggtagggaactatcctctttaactatagtcataccttggagatattgcaagtttggtttcatgccactgcaatgaagtgagtatcaccataaaatgagtcaaacaattttttttttgtttcccagtgcatataaaagtcgtgttcatgctatactgtggtctactaagtgtgtaattagcattatgtctattaaaaaaggacatgccttaattaaaaaatacttcattgctaaaaaatgctgatgatcatctgagacttcagcaaatcatttttttggtggaaggcctggccccaacattgatggctgctgagatcagggtggtggttgctggaagttgggaagttgggaagttggggtggctgtggcaatttcttaaaataagacaacaatgaagtttaccaaatccgttgacactttctttcatgaaagatttctctgtagaatgcagtgctttttgacagcattttacctacagtagaacttctttgaaaattagagtcaatcctctcaaatcctgctgctgcaaactaagtttatgtaatagtccaaattctttgtcataattaaacagtattcccagcatctttaccaggaatagattccatctcatgagaccactttctttgcccactcataagaagccactcctcatccgttcaggttttgtcatgagattgcaacaattcagtcacatcttcagactccacttgtaattctagttctcttgctgtttccaccacatctgcaattactttctcccctggagtcttgaactcctcaaagttatgcatgaagattggaatcaacttattccaaactcttgttagtgttgctattttgacctcttcccatgaatgatgaatgctcttaatggcatctagaatggtagatcctttctaaaaggttgtcaattgattttaacagatccatcagagaactgactgtggcagctattactgtataaaa

SEQ ID NO: 4669 - DNA, 1017 bp, Homo sapiens
gggattatttatacttttgggcagttggtttttggccataatgtgataaatgaatgttgtagcagttcaggcaaggaaataatgaggagctgaattaagataatggtaccaaatgaagaggaacggatgggtttgagagatatttaagaggtatgattcataggatatactcatagagtgaattagggaagaaagaggactctagaatgatcatgatgtttctgggttggatgcctggatatgccattagcaacaacaaaacatacacatgtacatgtacatgaaacagaagagaaacaaaccaggagtaggaacaaaatggatttttgttgcctttaggatatccaaaggtatctacttatccataggctataggaatcaggcaatctgttaatcaggaaaatgttctgggctggtgacatttgggagctatggtaggttgaaaagtaccccctcaaaagatatccatgtcctaatccctggaacctatgaatgttacctctcatagcaaaaataaagttgcaggtggggggaatttttggtctttatacatgtgatggggagcttatcctggattattgagttggaccctaaatgccatcacgtgtaacagaggacgatttcacacacacataggagaaggcaatgtgaacctggaacagagacagatttgaagatcctggccttgacgatgggttggattacaagccaaagaatgttggcagccactagaagctggaaggggcaaggaatggattctccttggagtctcccgctgacacctttattttgtcccagtgttgctcatttcagacttccggcctcccaaactatgagagaatgcatttctgttgggttaagccatctagtatatggttatagcagctgcaggaaactaatacaggagccaatagcctagagtttataactgaaagaattgtatgtgaatgacttcacctagggaggatgtacgaaatgaacaggaaagagtaatgaggttagaaatttctgttatcc

SEQ ID NO: 4670 - DNA, 1046 bp, Homo sapiens
tattttttttggatggattctaagttctggcatgagctgtataattttttttttttttttttaattgagatggagtcttgctctgtctcccagactggagtgtagtggcccgatctcggctcattgcaacctctgccacctaggttcaagcgattcttgtgcctcagcctcctgagtagctgggactaaaggcatatgccaccacgcctggctaatttttttgtatttttaatagagacgggtttcaccatgttggccatgctggtctcaaactcttgatctcaggtagtccgcctgcctcggcctcccaaagtgctgggattacaggtgtgagccaccgcgcctggccgagctgtataaattttaaaaactgttctctgagtcattgtgcattcactttggaaaaatttgtgattaccctgttgctgggagtaaatggcagacatttccagtttcctttgatgaaatggattgtttggtaagcacatgcatatcgttccgattagtctgttaggtttaactcttaaatatcatcacgtgtataggcagatgaatcaagatcagccgactttggggcctggctgttttcaaagtcttcaccagaagataagaaaaggacttttccagttctttttgtaccactctctattgcattagagaggcagcctggtatagtgaaaagagcatgggctttggaattagaaaagacctagtgttttgaatcctggttacaccaactagctttgggacttgaacaagttaattgacatttccaagtatttgtaagttatgataataatgcctgtctttcagggctgtaggtaatgatgttataaattacagtatatcagaagtacttggggctgctatgtgcaaggtacagtgattaaatacagaggaaaatccgtgatcatactgtcaaatgctaacagctgtttaaagatgagtctttcccaaatgtgaataccgtaataattatctcagaacacctataccttcaataagaaggcaaataataatctaataaataatgagaagggatgcta

SEQ ID NO: 4671 - DNA, 1078 bp, Homo sapiens
gagtaagcagttgttgcatgcttccatagtctcaagggaaacagctgactgcttgggttacaaaggattgtattgtagatcttgaggaatgatctagttttatttgcaagtccctcctcaggaatgtcagctctgaacttgaggtcatagtaccaggtgctagcaacattgagtttgggaattctattagggaaagaggattggcacattcctttcatcccttagatatttcattatcttttgcctaaataacataggcaatggtgtttttctgaagatgcaaagatcttggaatgctgaattccacatattttatgtgtttaggaaggaccttactttcacctaaacttttgttacaattctgagcagaaggtaattatatctaaaataagtgtggaaatttaaaattcaagtgaagctgcaaaattctcatctgtagttattcaataataactatgtgtcctatgatatgacattcatggcatgactttttattatttacatataactggcatgaaaatgtgcttcaacacattttctgctttttttctcttaatttaaaaaatcgtcacacagtaaaatggattttgttggtttattgtacggttctgtgaattttaacacatgtaaattcgcataaccccacaaacagcggaacagtttcatcaccccaaaagactgtctcatgcaatccctctgtagtcacatattccccccctttaatccctggcagccactgatgtgttctccaccactagagttttgtctttcagcagtgtcatagagctagaatcatatagtatgagatcttttgagattggcttctgtgggagactcagcaaaatgcctttgagattcatccaacttgtgtctatcaatacttcattcctttgtattgttgagtggtattccatagtatggatgtgtaccacaccttgtttatcccttcattcactgaaggacatttaagttgctttcagtttgggacaattttcttttctttttttgtttttttgagacggagtctcactctgtcatccagactggagtgcggtggcgcgatcacagctcactgcaa

SEQ ID NO: 4672 - DNA, 1068 bp, Homo sapiens
agttgcttatcggatatttttggcattatttatattagtaaatgaactagaatttcattgaaaatttaaagccttagaaattggactacgaagtcatgctagttagtgtcatatagcagtgtccttattccttttttgttcacatacttccttaaaaaatttctgaaagctgtgtatgtgggaagaggatgtgactctaaagggatagcacgagggtcatgtatctactctgtgtcctgtacaagcaggtggtgagtccataaatctgtgcatgtattaaaattcatagaactgtacacaaaaagaaaatagctatctactctgttgcacatgctttgcaagagcatctaagagctttgggtgacatctaaaacctttttcactacaagttttaaaaagtgctaattctatcatttttgttgtgttataaatacagtcagtccttcacatctccaggttctgcatcttggttggattcagccaagcacagattgagaatatttgagggacaaaaaacaataaaaaatatacaacggaaaaaaaaaataacaaatacagtataacaactatttatgtagaatttacattgtattagatattatcagtaatctagagatgactaaaagtatatcagaagatgtgcataggttatgtgcaaataccatgctattttatataaaggacttaaagatctgtggattttggtatctgctaggggtccctgtggaaaccgtgggacaactgtaatgtcattttaaaatggaactgcatcagcattattttaaatgtatccaggaacctaatattgcaggaatttgttacttaccattatctatttaaaaatatacatgaacaagctcttctttaacagctgaatttgtaacttatctctgtttttatttggatttgtatttctcttttaatttgttgttgttgttgtttgtttgtttttgagatggagtcttgctgtgtcacccaggctggagtgcagtggcacgatctcggctcattgcaacctctgcctcccgggttaaagtttctcctgcctcagtctcctgagtagctggg

SEQ ID NO: 4673 - DNA, 1025 bp, Homo sapiens
tctgctttcagaatctcctcccttagttcattaagcctgtctatttcattttgtacttcatcaatatgttcagttgcttcctgctgttctttttctctcttcggcaagtctagagaggctgatgatgtctcttccagtctcagaacaggaggtggtcttggtttcttcttttgaggtgggcgtggagactagcatttaggggccatgctgctaggaaagtccaagaaccagaccacaagtctccttgctcatcaggaagaagctcagaaaactctgaaataattttagagtgatcttttcccctgctccttaattttacagatgaagaaatggaaacacagtaaaattcccgtatctagttatggcagagaaaagaccagaactttggtcttctggcttctggtttagtgctctacaacattttaacttacgtttgtattataatttttttttaatcatttcagttgtacatgaacaaaaacaggaattatctttttttgttagattgttgctttgtgattaattgacctgaattgagtgctttctgcatacatagaaagatgcactctttttgttgagaaggttaacagccttgtgattgtcttcctttaagtgaaaatcaacctgtactttctagggatacatatttatctaaactttctaatgtttttgttgttgttgttgttgttataaatttaagtggtacaagtacagttttgttatgtcgtggtgaagtctgagcttttagtggaaccatcacctgaataatgtaagttgtacgcattaagtaatttctcatccctcacctcccgccccacccactgagtctccagtgtcctattctacactctgtgtccatgtgtacacattatttagcttccacttgtgagaacatgcagttctctatttgggaggctgagtaggagatcatttgagcccaggagatcgaggctgcagtgagccgtgatcttgccactgcactctggcctgggtgacagagtgagacactgtctcaaaaacaaaaa

SEQ ID NO: 4674 - DNA, 1051 bp, Homo sapiens
ggtattctacttaagtacagacaaataatttaatcatcccatagtgtatccaccatatttgtggcttgtaaatgttttaaaacttgggcataagtagctgataagttacaaaaaagatacaaatttcaataaggtaattttagttaaagtgacaggaaatgggggtgcattttgaatagaaaaacacagaactccaaaaacaagacaaaaaaccatgttatttccaaagagaacatctcagttgtgcagaaagaattaacatagcaggcctgattgagactgatatgcttagcgaggtctgcttgcaaggttggcccttggctggcatctaggaacttggatttggggaggaactcctggcctcaagtgatccgtccacctcggcctgccaaagtgctaggattacaagcgtgagccattgctcttttcatactgttgtgtaaccatccatcactaccatataaccatacatgaccaccatccatctccagaactcttttcttcttccagactgaagctctgcatctgttaaattataattccccgttttataatttcctctagcccttggcaaccacattttactttctgcctttatgagtttgactactctaggttcctcatataaatggaatcatatagtatttgcccttttgtaactggctcatttcatttaacttaatcttcaaggtacatctgtgttgtaacgtgcaggagaatttctttttttttatttaagggctgaatgatatttaatggtgtgtatgtagcccattttctttatccactcatctctttatggactactttgattgcttccactttttggctattgtgactaatgctgcagtgaacatgggcatgcaagtatatctgagttcctgctttcaattcttttgaatatatatatacagaagtgaaattgttggatcatacagtaattctatgtttaatttttctgaggaaccaccatactgtcttccatagtggctttaccattttatattcccaccaataatgcacaagggttctagtttctccataccctcac

SEQ ID NO: 4675 - DNA, 1033 bp, Homo sapiens
ggctaattttcgtatttttagtagagaaggagtttcaccatgttagccagtctggtctcaaactcctgacctcaggcaatctgtctgccttggcctctccaagtgctgggattacaggcatgggctactgtgcccgacccacaatttttgtgtgtgtgtttatttatctggaaggtctttctattccagtatttgtagatttctcatcctttttgacagctttatagtgtcccatgctttagccatatatttaaccactttcttattgatgaatacttgtttataagaatatttaaatatcttctccatctttcctgtgttttttctttatgtttgtaatttgaatccatccgaagggtatatatatttgagcttggaacaaacaatgtttttccattgtattaatttgtgaatagtccatcaattctccactgatttgaaaagccatatttatcatatattctcatatatatatatatatatatatatatatatatgtcattttaaaactgttgttccattgatctttgtctcctcctgcacattgttaatatactattttaattattgtaagcttatatagtgtgtatgtgtatgtggttagctccccaatcattatgttgttcttaaaattttatttagatgttgcatcttatatcttccaaagatctttaggattatgttgttaagatttaggagattttgatggtcatatcaaattataggttaatttgggggtgaattgatgttgcattattgtgtttttatggccaagaacatgacatccctttgccagtccaggcagatctttttttgcccctcagtaaaatctttttcattttcttaatcttgtttttggacattacttggtaggtttattagtgggcattttatgatttttgttgttaagtataatctttcctaattgcttattgctaatgtataggaagccttgattttgtatgtccatcttgagtctaggtttggttgccttacttgtattgcatctaataactttgtactgatattttta

SEQ ID NO: 4676 - DNA, 1402 bp, Homo sapiens
aaatacttaagaaccttttccatgttaacagatgtcttctggacgaggtaaatatgtagctacttcaaatcatatagaacagttctgaaacttgagcgtggagagcttgttaaagcagattgctgggtcccacctccagggtttctgatttagggctgaggaggagctcaagaatttgcatttctggcaaattttcaggtgttacaggtgctgctggttggggaccatgctttgagaatctcctgctcatgtgagattaagaagagtacttggcctggtgtggtggctcacgcctgtaatcctagtgctttgggaagccaaggcaggtggatcacaaggtcaggagatcaagaccatcctcctggcctacatggtgaaaccccatctctactaaagatacaaaaattagctgggcgtggtggcgtacgcctgtagtcccagctactcgggaggctgaggcaggagaattgcttgaaccagggaggcagaggctgcagtgagccgagatcgtaccactgcactccagcctgggtgacagagcgagactgtctcaaaaaaagaaaagaaaagagtacttgatcagaggtgattgaatgactgtcagaaaacaggatgtaatgtactaactctcttcaaaactggttcagaaattcatttgttcctagcctattagtgtccacatgcaagtcaccacagtcttataccatttttttggtggtttatctctaaaagttcgtacattagaggtctcttgagagacacatttttgaaaaaaatctggagttatcagggaaaggggaagtagaaaacagttctgctgactcattcttgagcagattgggctacagttcctggaagaattgggtaatgaaataattgccatttattgagggctgtgtgccaggcatgttctaagtactcaatatctgttttttcttttaaaactcataaaaccctcgttgctcaaattaaaaaatattagagaccaaagaagatgggatgtctgtttgtgattctatagttttggtatatgctggtgcctagttaccttttagaatatgtgtgtatgtagttatacatatgtatgtatatatataatacaaagatttttaggtattttttaccccatctgtcttgaccagtgatgaggttttcagactggtagaccagggttagatttgtatagtatgtggctatggattgagtcttagatatatatgatggtctaatgaaggagaggtgggaactcaccataccatttggaatctcatggtaatgttgaactcctgtcttaatctttaggcttagtgttactaatatttcttttctttttttttttttttgaggtggagtcttgctctgttgcccaggctggagtgcaatggcacgatcgaggctcact

SEQ ID NO: 4677 - DNA, 1029 bp, Homo sapiens
atgccataataggttgtttttgttgtttgtttgagacggagtcttgctctgtcacccaggctggagtgcagtggtgcgatcttggctcactgcagcctccacctcctgggctcaagcaattcttgtgcctcagcctcccaagtagctgggattacaggcacacgtcaccatgcctggctaatttttgtattttcagtacagatgggttttcaccatattggcctggctggtctcaaactcctggcctcaagtaattcacctgccttgacctcccaacgtgctgggactacaaatgtgagccactgtgcctggccagttttcaaggtcaggtttttgtatgtgtctaaaaaatctcgttggattacatcactataaagaagatgttaatcgtccgaggacagtgctaacagtttgtcttctcttttagcccgttggcctactaagaaaaatgtgagaacctcatatcgccatcaagacttttttcaccccaagtaactctaatggcctgtctggctttcacatctgaggggtgggaggtcactaggataaccagaattggattttgatcagagcagtttgaatgctctcaaaatgtgaagtgaaagcctcatctgtaaattggctcatacttgtaaaagtacatccagtctacatattctgtcacattgtagtggggaaggctgagaggtaccacatcaggaggagagtcaggagtggcagcagcaggagaccccatgtgagagatctcagtgggaagggcagtctggagagccagggccatccacagcagctcagaagcttgcgaactgcaagttcttcttgattgatttcttctgagtgaaaagaccttcagtttcaccagttgaacattcagcagtatgtagctgtcagaaataatgctactgaaaaccagactttcagactggcttaaaatcctgccatatactgcttataaaacacatacctgtagaatttcagcagagattaaagcactagctgaagtttgttttctgtattccatgctttagt

SEQ ID NO: 4678 - DNA, 1050 bp, Homo sapiens
gtggaaatgggaggagtaatttcaagggtcctttcattcattcaacaaacaagggttttttttgagcacctgttatgtactggattgtgggaatgttgctgtgaacataacagagtccctgccctttggaacttaaaggactttatgatttgatagaggatgaaagaagagagatcactttggagtatttgttaagggcatgaactctggacccatttttcctggatttgaaaccttgcttggctgcttatgagctttgtgacctgggacaagttatttaactttttgtgtcttggactcttcatttgtaaagtggtgataataatagtacctagtattaaatgaatagtggctgggcacatagtatgagctaaatgtgtgtagctgctgccattactaatactactgttattattaaaaacaggagtaattcggccaggtgcggtggctcacgcctgtaatcccagcactgtgggaggccgaggtgggcagatcatgaggtcaggagttcgagaccagcctgagcaacatggtgaaacctcgtctgtactaaaaatagaaaaattagctgggcatggtggcacgcgcctgtagtcctagctactcaggaggctgagacaggagaatcgcttgaacccgggaggtggaggttgcagtgagccaagatcgcgccactccagcctgggtgacagagcgagactctgtctcaaaaaaaaaaaaaaaaaaaaagtagggataattcaaagatgacaccaggatttagaacctggctaactgggatgatgaagattctattgacaagtttggaagttagaagctgattgaaaaaatgggaataggtcgagtttattgccaaagactagtatgaaaagaaaggaattagcaaataatataggaaacaaaggtgcagtgagtactgttttttagacagatgggtttaaaaagtttttttctgtacatcatagtttctttttttttttttttttttttttttttgaggcggagtctcactctgtcgcccaggctggagtgcagtggcgcgatctcggc

SEQ ID NO: 4679 - DNA, 1032 bp, Homo sapiens
tgcctcggccttccaagtagctgggactacaggtgcccgccccgacacctggctaatttttaaaaaaatatttttagtagagacagggtttcaccgtgttagccaggatggtctcgatctcctgacctcgtgatccgcccgctttggcctcccaaagtgctgggattacaggcgtgagccaccgcacccggcctattgacattttttaaggtttcagattttcttttgtgtgtctagtaattcgtcttttattgtcaaagataatttgcttatttgacttagaaaaatgatttgtgggcatacaatattgtatgtggtacctaaacgttgccatttagttactcttacagaacaactttcattacactgtatattaatataaattacttcttgagtaatcccagaattgtagaaccaattggtagaatcagaaactgtctttggacttgaggtttttcttcccttagggtaaattttaggttttctggttagtttccaggagttggcggacaagttcatatcactaaaggtgttcatatcactaaaatagtaatgctaatttgtttcatatttctattttaaaaagcaatcaataaagacatttcaatacatttcatttggaagcccccaagtgtatggtggttaataaggctcagcatgctggtaacccaccattctcttagctagtgactccactaaatagtgctagccgctgagatggttttgaccctttaacagcctttttttttttttgagacagagtttcactcttgttatccaggctggggtgcaatggtgcgatatctcggctcactgcaaccactgcctcccaggttcaagcgattctcctgcctcagcctgccaagtagctggattacaggcacgtgccatcacgcccagctaatttttgtatttttggtagagacggggtttccccacgttgaccaggctggtctcgaactcctcacctcaagtgatccacccgcctcggcctcccaaagtgctgggattacaggcgtgagccaccgcgac

SEQ ID NO: 4680 - DNA, 1065 bp, Homo sapiens
ttaaaaaatgaatgtattaaatcttatgagtaggaagatgaaatacaggtttattgtatagatacattatttatgaaggataaagatctatacatgaacagcagaatgtataagctagcatttactagcatgtctctgatgcttttgttcatttctgttaatcgtcatttctgtcccctctgcatggaattttatacttgtctagggtaagagtttgtagactctttcagcagaacagattttaataaccaatttatttgttttattttaaaaatttatttttgaataaccaatttaatagtaaattttatatgaacatttggcataactttaccagtttatttctatgcagtgatggaacattatgtaatgcagctcatttcttgaccaactagttatagaagtaccattaggttaaaaattagagaaatctaagagatgttatacttagtgagaggaagcagaaatggtgggtagattctcagaggttttgatgttcagtactgacggaccatgttctgtgattgtaagaaagattgaaaacagtttgtatggagatagagttgattagcatttgagctctgaaagcagaactctagtaaaatgatctcgacctaacaaagggtctgttccattatatagactattaccataatcctggattatttcaactgggttttggcctctccattatatgagatcatatgtatatagctaagaagtctgattaaagtatggaaagattttaggaaacactaagaagatacagggatctttactgatacctaaaaagattacaattgagtaattgctcaattgagtgtaggggcatacctgaaggaagaatttgcatttgggacttcgaaggaagcttccaagagatttgggaagagacctgaacaaaaagttaaagcatggtgaatgtgatatcactgtcaatccagtataaaagcagaggaagttgaaggaaaatctgtatcccatatgcacattttttctgtctttttagatcttagatgctagcgttacatccacaaaaccagtgttgccttgtataactattat

SEQ ID NO: 4681 - DNA, 1063 bp, Homo sapiens
tttattttattactcatttaaaaaggcagtaactacatcaaacatacagaaaagtgcagagaataatatagtaagacctttgcccagatctaaaatatatgaacattttatcccatttacctcagatgtttttatttttttaaggaaactttatgtgtacagttgacaccctctcttattccttgcagaagcaagcactaaatggaagttgatatgtatcctttccatttatgtatttatgttttgttataaatttatatatgttaataatgctgtacattattctctgtacatgtacatgctgtaacatatcactctgtagtgacaaaaaatggaatactttcaaaccttcattagtatcaaatatatatacatacacaaacatatatatgtatgtacatatatttattttgtttgtttttttcccccgagacagggtcactcaggctggattgcagtggtgtgatcttagctccctgcagccttgaactcctgggctcaaaggatcgtcctccttagcctcctgagtagctgggattacaggcgtgtgacaccatacctggctaatttttaaattttttttgtagagacatcatctcattatgttgcccagactgatcttgaacttctggactcaagcaatcctcctgccttggcctctcgaagtgttgtgaaggttaaatgagttaatacataaagtgatctgaatgctgcctgacacaaagaaagcactcaataaatagtaacttttatagttgtgtatgctttatatgttactacttgttttcatagcagaattgtaacatcctggcttacatgcatgagccatcatacctggcccaaatttataaacatgtaatatgtattgaattgtagttagccttatagcacttaatattgtatgttggaatcttctaaacttggttatgtaaaaagtcatttggtataccacacaatgtcacctaccaggtagtcaaagcatttaccattttacggtgagatgaagtagaaaggatacatcttagaagacagagcacaaggcagccacatttacagaggaagc

SEQ ID NO: 4682 - DNA, 1049 bp, Homo sapiens
gctggttttaaccctgcattacagttaatcttgaccagaacagataaaaccttaaacaaaaaactgggccaaaacaaatagcttctataatagtcaaaattgtcaagtctagaggcttttgtgtaggtagcccaaggaagatggaaaaataattcatttctaagtctgacccagattgtcactactttgggaactgcttaaattgttggatctgcttccgtggcctatacatattttattcacatgaatttagttagtattccagccagcctgttcatctagactgaggctaatctgttcatctagactgaggctaatccgtatttcctataaactgttttggaactaacttaccactcctaaaaaaatttctgcaacctaatgagtgtcatatgacaaagtagtcctagaggggaagtcctatactgtgtgcttcatagtggtatttctaatgataacttttgtgggaaagcagcctcgttatagctggatcctagattagtccagtgaattttaataagaaattacactgttgtaaactcacctcttatgcattggtcagtgatgagatatatatataaatagatagatagataaaatttgctcttatatagccatttattcatcattggccctgtttggcccatcctcagtgtggctgtgagattattgataactggtcactgtcagataaatcacattctattaggaaacacctatataggttatgcagaaacatgcagaaatgccacctgtccatacttacgtggctttacataaacaaaagactgtcttgtctttgtggtgactgaatttacaacgtcctcccctggaaatggaaaagtacctatcaggagatgtatgacaaaagaaattatcaagcctgacttcatatatattatgaacagtctagaggaagcatctttcttagaactaaggaggtctgctgaacattggccacattctggactttcatgaaaatcatggacccagagttggggttaagccacttagaaaaagctgttgaaaacatctcaaaggccactgaa

SEQ ID NO: 4683 - DNA, 1027 bp, Homo sapiens
aatatttattggacactatagcagtaaatagaaaggtaaaatgtcctgctttcagggagtttatattttagtggagaaaaatagccaaaataaataatatagcaaaatggtacctgttttatgtgaaaaaaataaagcaagcctagtagtacttgttattgcattgctgatagagccatatggggggatttgaggctaaggggatgggatataaccaagaagtcctgtgtttcaggtggtgattgacatgaacagagatataggtatgagattggtcctgatgctttcaagcagataattgaagctgtattgaagctgtgagtgttggggtggggataggggttaggaatcttgccaggagcattttcccaggcccctctcttcactcctactcatccagtagctctaaggctaaagaatgagtgaggaagctggtaatgggtggtattattttgagcatttggagttctggggccccctggtggctcttgcctacagaggtttaaaggaccaggagaggagggaagacttgtctgaaacatatggaacggtggagttctcttgatgcaggaatacttggaattctagtgcttgtttgattcttgaagttgtaaaactgaaggttggggaatggatggaattattctgagcacttggagctttagggctttctcttgactcctaccaatagagtcctctgggaggagtggtttttgctatagtatgtggaaccccctttgtcagtttttgtagtgtggtagatgtgaaatagtatcttgctgacactacaatagtatcttgttgcatttacttgatttcactctaaaaatgtaaaatctgatcaattaaatgtcagacttttaattttttatcttttgtgtttatccaccattgtgggagttttattcgtcatctctctgtaccatgactagagacccaagatttaattcagtagctgaagctttcactggtagctcttgtcagcagaccctcagggaaatctattatgccctgtgctatcagcacc

SEQ ID NO: 4684 - DNA, 1051 bp, Homo sapiens
aaaatatctgtagaatttgatctgcgccaggcattcaattcctgtgtaaaaaacaattccctaaggaagtagagtgctttttgttccgaggctagtactttttcaaacttctttcaaaaatctagaataagtcaccagttagtgaaaatacagagaaacgaaaaattgtgaaaataataatgctgggatattatgacagtggatatggtacagaggagtgggcaagacttagaaatttagttttagacagacaataaatagctagcacaagttatagaaatacctaagcttggcaccagatctgactgttgaaagttgtgtattagccttaaaggtttggctgctggtgttttgaagtgaaattgtagacagaatttggaccatgggcttttggagcattagagcaacatagatagaaatgtaccagtaggtttccaaaccagttgttctcctttatggccatgcccctcaaaaagtatggtagcaatgcatacacacctgtttcgtttgtcagttcctggggcaagagagaggagaacattctgcagctattttctaaccttgggtaatattttttatttggcttctctgttctaaagagggaacagtgtgtgtactaaatagtactgaagattgtcatccatatgccttctctcagtgatctcaagattgccaaattaaaagtagtttctcacaaaacaagttgacttttttccaggagcattttattttcaacaaaaaattattttagattatatgaattcaaaaagaagaatgattccttttttcatactccttaatctctcattatctaaggtagttgtgaaataggaaactcttaagatttcactttgtgtatgaaacttattggagaaaccatctcatacaaaaaaagttatgattattgattagccttgactgtagtaccccctagaagaaaatatttaaaatgggaattcaagagagtttaaagcatttatactttttctatgtgcctatcttgattttatgtatcatatgaggaattggttgaggctgaagtctaagggat

SEQ ID NO: 4685 - DNA, 1043 bp, Homo sapiens
aaagtgtttgtcatatgggcggggaccctggacgacattcgggccgcggcggccgctgggtgcagccgagcggtgtggagcggagagaatactcgaagggctctcctgatactaacagttttacgatttaaaacttcgccagaatttgtaagtaaacaaaatgactatgcagcttttccatgttttagtattgaaactgatatcttgaatttttgaaaaggactttcagaaacggtccctccccacccccaccttcgtaccgcacaaatggtatttttatttttattgtttttgagacaggtacttgccctgtcaccgaggctagagtacagtggcgtgatcatagctcaccacagcctcatacttctgggctcaagggatcctcccgcctcagcctcccaagtagctggaactacaggcccgcaccaccatgccctactaattactttattttttatttttatagcgacagggtctcactgtattgcccaggttggtctcgaactcctggcttcaagcgattctcccacctcagcctcccaaagtgctgggattacaggcgtgagccaccacgcctggcctcactcaaacagtaaacgaggtaggttgggggtatatttttgttttgggataaaaagaaactgaatcttataaatattaaatgggttaagatgtgagtaaatttttgggtttagactttaaggtgagaagccgaattattttagggttcgaaatgtgagtgggaaatttgcctactagtgtaggcggcgattactccattcccaacatgcctaggttctcgacattcataatcttaatcctgaaaagataatacttaaaaaaaaaaaaaattggtgctaaaaagggcaaagttgaagttttagtaagacctcctaccattttgcttacatattatatatgtaccattctcccaattgtatttaatacctgatgaaaaagtttgtgccttttccttcttttaacaaatttcatagtactctctactttatgagtaatgcttaattatcagactttatactgtt

SEQ ID NO: 4686 - DNA, 1051 bp, Homo sapiens
cctctgtcccacaaacttccttttctatttccacctgggcctctgcaccaatccctaaataaggcctccccagactagacttcaacaccccatcccttctgaggcctgccccccattccccttatgaaaaaacatggtggggggagctcatgctctttaaagggagcaggaagatgaaggctccactccattgtcaaatggccatgagttagccttttccctatacctgtcatcccaaatgaccagggccctctgcgggagccacacgctccctgtgggaacgatcatgccttccaggtatacaaatgtgccaggctttccccaagcacatccacagttggttgtgttcattgatccccacaacgcagtgagatgggcaaagatatggtattcctcttgggaatactggggctcaagagaagtgaatcgatttgacagagctgcactggaaaccaggtctctgatcgccagttgagtactcttccctttccccctccgcagaagaccttccacatttgagaactcagtacctgagaacagttatgattctttgcaaacaacctgaggattcataacatgcagtaatttacaattttgctgatgcatgaatttgaatatagtgcatgctgcaaagcttgtgtgcaggggacagaatgaagtgagtggtggggaaagggatttcggaagtgaagccagttccccatctcacatgcactcacagtactgatttcccaggaaaaaacctgtggagcatgacctccccaccaccaggactggaggaaggggtggctctaggggactatgggagtaggccagtgtcccagcaaaggggacaaagatgggagaggggctaggggcacaaggctggaacccagtcatctgttcatagctgtgtgggctgatgagggaggccccagtcagcaggaggggaggggagaccttggggccacaggacggggcctggcccatcccagcttccagacctcagcaatcttgtttcctactcctgtcccatggtaaagggccactaccatttcccccacccttcact

SEQ ID NO: 4687 - DNA, 1053 bp, Homo sapiens
tctcagcctaataaagcacttaacgcgggagatgattttggcaaagggtcatgactctccttgatagcagagggggtctccactaaaagacctttaatccctccaagaatcccactgggcattctgcctgggaggtactaactttccggtttaagtgggtagactttaggggacaaagcagttgtaggacttaggttaagtcacaacaacccagtggcagcattagagaactcagaggtccagagcccaacctcctgctttgtacctaagtaaattgttctatgtagtgcatttttttttttaagttttctctatccaggaaaggagaaaaaacaaagggggagagggaaatgccacacacacaataaggtggcagagaagttggcactgctactgtctaaggagtctcagaatatttcaccaagtattccaggataactaatagctaaacatgtgatgaatgagatttccttgcccactctccctaacaagactctatgagcaccgtccagtagagccatctgcaatgatagaactgttttatatcagtgtcgtccaaatacagtagccactggtcacatgaagctgttgagcacctaaaatgtgtctagtgtaaggaactaaacttttagttttatttaatactaatttaaatttaaatagccatgtgtggctagtagctaccatattggacagtgccactgctttggatcttctcttcagccaaacaaaactaatgactagtggggaaaagaaacacgctgtagtttttccacagtggaatcccagctgtaaagaaatgctatgactttttttttttttaatgtaatgaaaaagtccctgttgctgtttccattccagctaaacttagggtctgcacactaataaagactcctgcagagaaaacaaacctaaatggagattctcctggaaaatgtttgtccaggagccctgatgactctgatgaggtgtttctgtccctctgtaaatatagacatttgcatatactttctctagaaagaaaaatgtatgagtgtgaaggacttttaaaat

SEQ ID NO: 4688 - DNA, 1089 bp, Homo sapiens
aaaaacatgaaattcttagggatacatcaaacaaaataagagtaagatttgtatgtgtataattcctaaatattatcgaaattaaggaaaatttaaatggaaagagataccattgttcatggatcaaaagactcagtattgttcagctgtccattctttccaaattgattcatagattcagcggggtcccaatcagaatcccagcaggatctttgtaaaaacttataagttgattctaaaatttatatggaaaagcaaaggacctagaataatcaaaacaactttgaaaaagaataaagttggaggccccacactggtttcaggacttactataaagtacagaaatcaagccaatgttgtattggtataagaataggtatatagatcaaaggaacatgatagataacctagaaatagatccaatcacaaatggtcagctgatttttgacaaaaatgccaacataaaattcagtggagggaagactagccttttcaacgtatagagctgtaacaattggacatcaaaatgcaaaacaaaacaaaaaggtgagcctgaagcctactcaaaaattaactgggaaggtaagatcttagatgtatatgtaagaggaataatgataaagaactagaagaatatctttgtgatcttggtgtaggcaaagttttttttagatggaacacaagcacaaactataaaagaaaaaataaattgcactttatcaaaatttaaaaattccactcttcaagatactcttaaaaaaaatgagaagtcatatactgggagaaaatatttataaaacatatatttggaaaaaaaaattttgtgtccacaacatataaagacctcttataagaaaatgacaaccttattaacaaatgaacaaaagatttgaacagataaatcaccaaagatagatagttggcagataagcacatgagaaatgttcattgttagacattagggaagtacagattagaaatcacaatgaaaagccaccatagacctaactagaatggctaaaaaatatttttaataatagtaaagtgctggtaagggtgcaaaggaactggaatttatacttattggtg

SEQ ID NO: 4689 - DNA, 1034 bp, Homo sapiens
cacacctggctttaaaaaaaaaaaaaaaattcttatagagtcaaggtctccctaatgttgcccaggctgatctcaaactcctaggctcaagcagttctcccacctcagcctctcaaagtactagaattagagtcatgagccaccatgcccagccttcaaatgaagttttgatccttaattattgcttacacctaataagaaagacgtccagagaatcaagtccttgtattttgctgtattttgtcagctttttggaatatatactgttactttctggtttttattcatagagaaaacttaagaaaactgaggagtgggctggtcagaaagttatcttgtaactattgattaacaagttagttccattattttgtggaggattagacaaatgtccggaaacagaaagacagccagtaaaaagagttacttctaacttgtccaaagacatgttacccatttgtggtgacactgatggcaactggtagagaggcaagaaggcgaagtgtgcacgggctacagatcaccacccagagcagtgccactttaatgttggctttatttacttgtcattccagattctatttgaatacaagcttccatagaatgttaaaaaaaattgaaaatcactgattaagaatatagtctatgcttagaaatgctccccaaaagtttaaaaaaagaatatagcctaaaaccaagataaaaccaacatgaacataaaatacacagatctataataaagctttctacaaatcatgttgtgagaccattcccagactatcagtcagagacagtttcccagttttagacacagcttgaggaacttgcttgtctgatttccaatccttagcagatgagaggtagaaaattttaaagagttcaggtacactgataataataaaggataaatgaatatcctatggctgaggaaaagctgcttaaaaaaggaaaagacaaaaatcaaactcaacaaaaagcaaaagtagtctgggtccatttggtgaaagaccaaatagccttatataccttagtgc

SEQ ID NO: 4690 - DNA, 1083 bp, Homo sapiens
tattaaaactacagaaaattagccaggcgttgtggcacacgcctatagtcccagctactcgggaggctgaggcaggagaatcacttgaacccaggaggcagaggttgcagtgagccaagatcgcgctactgtactccagccagggcgacagagcaagactccatctcaaaaaaaaaaaaaaagatagaaaggaatttaaagatcatctggttcaactcccacctaatgcaggactcctctccactaaatttccaaaagatggttaagccagctagcctgtctgaagatttctgtttacttcacaaaatagcctattctgtttcagaaagtgctaattattagaaatttctcctacctgttaaatctatgtctgcttacctataactcactctcgttttagttctgactcttaaaactatgaagaaaagttgtatctcctcccttccaggtgtcaaccgttctgttatttgaagacagtagacattttcttcctaagtcttctccagactagtttcaccaacctagtggctcattactgaatcaatgtccctttttaaacatgtaacactaaaaatgtacattatataagatgtcttatcactggtagggaacagagtagagctgtaacttaatagatgtgacatcaaaggcaaggtgtctgcctttactgttcctcttaaagtgtagcttatttgtaaaatgtgctaggccatcaataagtgaatggttttatagcaaatcactgtatagatgtagatattatattagcccaatattagccagacaagttatagagtttctttgtagacttagtgcccagtctttattgtagcattgttttaaatatttgccatccctttttttaaaaaggtaaagaaaaagcaggaaaaaaggcttagacacatcttgtattcttgttggtatcatggcatttgtcagtgtgttcatactttttaattttctagtacttgccgacttaatcccatgagcttacttctaatatcagtaaagggtatgagctgtctatgtggttcaagctgccacttgagggtttctccattttgtggagctttctaatggaat

SEQ ID NO: 4691 - DNA, 1027 bp, Homo sapiens
aactgttgagtactgggcttaatacctgatgaaataatttgtacaacaaacccctatgacacgagttaactgtgtaacaaaccttcacatgtacccccaaatctaaaataaaagtttttttaaaaaggaaagaaatgtatccccctcggatagaaggggactgctgtaccaatactttagtattatttaagtcctggaacttggagtcattttgtaagtatttgttgactaatgaaacaaatttattcattcccttatgcaaagaaatctctacatctgcaaaaacataggcagagtttctgggctaacaaaaagacaaatgccaatgcaaaggaagtctgaaaattgtgaacaaagattattaaaccagtatttacagatcgaacattttaatcacgtttctattctgcaaagtatgtttttctgtattagctcattttatccttacaggaatctgtgtagcattatcttcattttacagttgaggaaactaaagctcagagaggttatgtgaattgcttgaggacacaaagctagtaagtggtataaccagggttcacagccccctggtattttcactgcagattccaccctttttttcctgcattgtgttgccgtcatagtttatcatactgactcagtgcttctagaattcatagctatcggatgcattttatgaggatatagtaataagttcctcatatcttctatattatatataatgaaattcatatatgtagatgacattttattcatcaggcttttcctttcagtgtaacttttaacccatattcctattcacaattttgtttaatcagttatttctctgtcatttttatattgaatagtcacttcctttgctaagtttatatctgagaatgaacagctggctcacagtacagtgtgaatcaagttcaaattactctgagttcagagaacacccagtgtcatcttatttttacatctaactgaattataggacactgtcaaagtgttatgacctgctatagtaaattgctccttctta

SEQ ID NO: 4692 - DNA, 1049 bp, Homo sapiens
ttccactcaacatactgttttccaaagttacttatgtttgtttcttccccactcccttcagtatagttatgttattcaggtcaggttcatttgtgggtgtttgtatgcgattttagattcacttcaaatacatggttggctttaatgttttgtttatttggggggtatctgaaacattactatagatatgagcatcagaggcgtataaatagatgtacacagagattgttatttttcccccgttcctgctacctgagtgccatctctgtcttttcagtcctttttcacccactccctacaggtaaccagtctcctttgtttctgatttatcttttctatatttattttgcactagtgagagagtatgtgcacattttcatatcccattttttttacatgaaaggtaacatactaaagatactcttttgctcatcactttttcacctaacagtgtatcctagagttactccatatcacttcatgaagatttttatttacagctgcatagtactcccttatgtggatgtaccatagtttattgaaacactctcctattctgtgggcatttaggtaatgtctaacgctttgcaattacaaacagtgctgcaactaataaccttgtacatatgtattttcatgttgttggaggtgtaccttcaggatagattcctgtaagtggaattactgggtgaaaaggtaggtgcatatgtagtattttgttagatgttgccaaatttccctctagaagggtttactaatttatattcccactaccagttcataagagagcctgtttccttatagctttttcaatagattgtgctctctcacattttagaatttttgccctgatagagaaatggcatctcagtgttgttttagttttcatttctctaattatgagtgagttcttatttttatgtatttcagggctatttttatatcctggttttggtgaactatctgttcacatttttccccatttttctatcaggtttttggccttttgtgactcagttttttcagagttctttatataccatggatat

SEQ ID NO: 4693 - DNA, 1070 bp, Homo sapiens
aaccctactgattttttatatgttgattttgtattcaactcgactgaatttgtttattagatctaagagatttttggtggagcctataggtttttctagatataagatcatatcattgtcaaagaaggacagtttgacttcaagttttcctgtttggatggtttttctttctttctctttcctaattgctctcactaacacttccagtactgtgttgaataggagtggtgaaagtgggcattcttggcttgtgccagttcttgggggaaaggttttccgatttttccccatttggtacgatgttagctgtgcgtttgtcatatagcttttatatgttgaggtatgttccatctatgcctagtttgttgagtgttttttgaagagatgttgaattctatcaaatgctttttctgtgtctgttgagatggtcgtatggtttttgtccttcattttattgatgtgatgtatcacatttattaatttgtgtatgttggaccatccttacatccctgggataagtcccatttgatcatgatgtattctgtactgttggatttggtttgctagtattttgttgagaatttttacatttatgttcatcagggatattggcctgtagttttctttttttgttgagcccttatctgattttgataacaggtaatgctggccttgtagaatgaattagggggaatgccttcctctttaagttttttttaaagaatggtttgagaactggtgttagttcttctttgaaagtttggtagaattcagcagtgaagccatccagtcctggacttttctttgttgagagactttttatcactgattcaatctcattactcactgttggtctattcaggttttatttttcttccagattcaatcttggcagtttgtgttgtccaggaagttacccattttctctaggttttctagtttttttattgtgtaattgttcataattgtctctgttgatcctttgtatttctatggtatcagtttcaatgtctccttttcgtttctgattttgtttatttgggtcttctctctttttttcttggttagtc

SEQ ID NO: 4694 - DNA, 1044 bp, Homo sapiens
tttacatttaatgtaattactggtatggttgtgtttaagtctaccagcttgctatttgttttctgtttgtcccatctgctctgtttctctatttttttctttcctgacttcttttgtgtttataagtattttgttgcatgtatagaatgtgtaatgatcaagtcagggtatttggggtatccataacctggagaacatttcaggttctctcttctaactgccttgaaatatacaatgcgttgttgctaactgtagtaaaagccctactctgctatgaaacattataccttctatctaactgtatgtttatacctattgatcaaactcttttcatcactacctcccaccagcacactttttccagcctctggtatcagtccttctacccactaccttcatgagatcaacttttttagctcctacatatgaatgagaacatgtaaaattcgtctttctgtgtctggcttatttcacttgacataagggcctccagttctatccacattgctgcaaatgtcatgatttcattcttcttcatagctgactagtattccattgtgtatgcataccacattttctttatccattcatctgtagatggacacttcagttgattccatatctttggtattgtgaatagtgctacagtgaacatcaaagtgcaggtgtacctttgatacacttatttcttttcctttagataaatacccagtagtgcgattgctgaagtgtatgttagttctgtttttagttttttatgaaatcttcatactgttgccccatagtggctgtactaatttacattctcactaaccatgtataagagtttttctctgcatccttgccagcatctgttaatttttaatcttttaataataaccattctaactgggataagatggtatctcgtggtcttgatttacatttccctgatgattagtgatgttaagcatttctttcatgtagctgttagctatttgtttgtctacttttgagaaatgtctattcacatcctttactcattttttaataggattattattt

SEQ ID NO: 4695 - DNA, 1046 bp, Homo sapiens
attaggagatatacctaatgctaaatgacgagtcaatgggtgcagcacaccaacatggcacatgtatacatatgaaactaacctgcacgttgtgcacatgtaccctaaaacttaaagtataataataaaaaaaaattgcattgaatctatagatcagcttggggaatagtaccatcttaaaatattaagtccatgaatacatgatgccttcccatttatttaggtcttatttaatttctttcatttgatgttttatagttttcagtgtacaagtcttacacttcttttgttaaatttattactaagtattttatgtttttaatgttataaatgaaattgttttcttcatttccttttctgattgttcatttttaatgtatagagatacaattaatttttggccaggcatgatgggtcacacctgtaatcccagcactttggaaggccaaggcaggaggatcacttgaggccaggagtttgagactggcctgggcaacatagtgactctgtattgctacaaaaattaaaaaaaaaaaaattgatctgtgtttattgatctgtatcctgcattctttctgaatgcttctattagttctgacagtttgttagtggattccttataatttttatatacaagattatatcattggcaaatagagatagttgtattagctgcataaaaccagatgggaaatactcctttattctctgaaagagtgcatttaagattagtattaactattctttaatgcttagatgaggggtcttcagttcctgataagacttatttctgcctgttcttcctattcagttcagatttaaaaccctggacatacacagcaaataaacataagaagactaaagggttagaagaagagagctgactgactagggacctcaagaattgagaaatgaccctgtggtgatttctctgggttttctttttctttttttttttttttttgagacggagtctcgctctgtcacccaggctggagtgccgtggcgcgatcttggctcactgcaagctccgcctcctgggttca

SEQ ID NO: 4696 - DNA, 1021 bp, Homo sapiens
ttgttgtttgtggttttaagaaatcattgtctaatcaaagatcatgatgattaagcctttttcttctaagaattttatagtgttatctcttacattgaagtctttgattattttgagttaattgggtagagtgtgaagtaggggtctaacttcattcttttacatatggatatccagttgtttcaccaccattattgaaaagactgttctttcccccattaagtcattgtagcactcttgtcaaaaataaatttgtttataaatatgagggtttatttctagattcttaattttattccattgatcagtatgtctttccttatgttaataccacacagtcttgattactatggctttgtagttaagttttgaaattgagaagtgttattcttccgccttttttcaaagttgttttggctattctgggccccgtgaatttccatgtgaattttaggatcagtgtgttcatttttgctaaaaaggcagtgaagattttaataagaattgtgtgaactcccattcacaattgtttcaaagagaataaaatacctaggaatacaacttacaagggacgtgaaggacctcttcaagtagaactacaaaccactgctcgatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaattgggaaaacctactttaaagttcatatggaaccaaaaaagagcctgcatctccaagtcaatcctaagccaaaagaacaaagctggaggcatcacactacctgacttcaaactatactacaaggctacagtaaccaaaacagcatggcactggtaccaaaacagagatatagatcaatggaacagaacagagccctcagaaataatgccgcgtatctacaactatctgatctttgacaaacctgagaaaaacaagcaat

SEQ ID NO: 4697 - DNA, 1061 bp, Homo sapiens
tgcataatagaaaaaagtttcgtagttatgcttagatgttttagggtccaagtttgtaacaccatggtgtcatatgtacttttttaaaaaattaaattacaacttttattgtgttttcagtcatttgagaaatgcttgaaaattgaattcaaaatatgaagggaaaagttaaagagaagatcttaaagcctacttatttttttaaatggcggttcaatttttatccttgacccacattagtacagctcttcacacataccaaatatttatgattcttccaagaaaatattttttaaggggcagggatgatttcaataatttgtgaagtgtatttaaagtatggggagagtatttgctatcaaacatcaggctcaaattatgtttacataattcttgtcacacgttatttctcagattagtgtactatacaatcaacactaaatacatgcttattgatagtatttaaatagtattttaaatctttgaagtaatttaaatgttttagatcaaatgtaacagtgtaatattttagcaaaatagatgaccatccagtgcacctgtttatcatcagtccccccaaaagcattcatacatagttcattggttttccatagattcttatctaatgcactcccaaattccactttcactgggctgcttctttagttacattctttccttttctgtccttttgacagtataattgttgtcattagccattttccgtagtctattgattctttcagatactttgaagaaagtcacctttctcttgactaccattcgtttccttttctactttgttttaaatctgtggctcctaacaatacaatttgcatgcttttggcttgagaaactgctgcaaactctggtgaaactgtgacagtactaagtaacagaaaagcaaaagatttaagaggcagggtcggtatactgagactaaatttatgcagttatatgagatttgagaaaggaaggaagaaaaaatgcatcctcttaaatcactttctatatcagggtatatattattttggttatatagttgattaagatgttaattt

SEQ ID NO: 4698 - DNA, 1029 bp, Homo sapiens
cagagtactttcacttattactatattatctctacaacagttctctaaggcagatattgtccttgttttacagacaggaactgaagttcagagacctacatttacttgctcaaatccatataactgctaagtagaaaccaggtctgggagagtattcttcctaccactagattttagaaggataaataaaaagaagaaaaagaaggataagcagttgtcatttggccttccctgtgttatgctctggtttgcagcaatttcttttataaaatattactggaagtcaaatccacatgtgacctccacaaagatcactggatggacaacagtgataggggtggaataagtgcctagaacacagatagcttacactaaataacacatattttgtgtgtgtaaagacaaggaaaacttggcaaaatgtattgtttctgccattttgttactttgatgtagtgctgctttccagatcttccagtttgttaaccatgcagctacctttaccctcagcctgccagaacgttgtatttcatgaacagatgaagtgcttacacattcatagactgagacgccaagaattcagttgggttctctcattgctccaagcagatttctgccctctcagccatgacaattcaggctgagctttgaatactgatggcaaacccttttattattaatcagggatttgtatgaattaatttaagaacataagggaggtgggagcttaaaatcaaaatcaaacttaacatcccaaaataaaataaatagtattgcttcatcacatttaaagctctagcaaataaaacaatttggtaagctttgatgatggactaaaagtgtgtagcctcaaaattaaacttctagttaaatacttttaaccctttctgtccttttgacgttttcttattatgagttgggtaacaattatagttttgaaaggacattcagttcttttttgtatttatctgatatttgaaattgagatatttccctactgattccctaagattctctgggataatatac

SEQ ID NO: 4699 - DNA, 1100 bp, Homo sapiens
cccccttacctttctcaaccttcatagacttgaagagaactagggctttgccctggatcaggctttggcataagggaatgttgtggctggttgaatccagaccactcactttttccatatcagcaataaggcttttttacttttctatcatttgtatgctcactgaaatagcacttttaatttcctcaagaatttttctctgacattcacaaattggcagtttggcacaagaggcctagcttttggcctgtgttggttttcagtatgccttcctcactaagcttaatcatttctggcatttgattgaaggtgagagacggtgcagcccttttcctttcatttgatactaggttttacttgaaacttagagactattgtattactggctaataatttcaatatttttgtgtctgagtgaatagggaagcctgaagagagggggagagaccaggaacagccagtcagtggagcagtcagaacacacaaagtatctgttggttaaatttgccatctttctcagtgtggtttgtagcactccaaaacaattacaatagtaacatcagagatcactgatcattaccctaacagatataataataatgaaaaactttgaagtattgcaagaattacctcagtgtgacacagacatgaagtgagcacatcttgttggaaaaatggcaccaatagttggcttaactcagggttgctacaaatcttcaatttacaaaaaacacagtatttgcaaagtgcaatgaagcatagtgcaatagaacaaggtatgcctgtatagctttcttttttaaataaatttggcatgattgcttcccttgattttttaaattgtagttttttatctttgtgcttgtgagttaaaatttttataaagttaatacatttgtttttttaaaaaatcaaatgttactattagtcttataaacaaaaaaattctctcttacctgcatccttcttacattttattctagctcctttaaggcaaaaattttctcttttttttagacagattctcaggctggagtgcagtggcatgatcagggctcactgtagcctctgcctcctgggctcaagcgatcctcccacct

SEQ ID NO: 4700 - DNA, 1023 bp, Homo sapiens
gaaattcatgagttcaacactgaaggcatctactgcaatctactggctcccaaatacaacatctctaattcaccctctagatcggggggttataaggacctttaaggctcattacacatggtactctatggaaaggattgtcaacaccacgaaagagaaccctgatagaacattatgaaggtcgggaaggatccattggagatgctgtcattatagaaacggcggtgaaaaccgtcatgcctgaagcaataaatttctgctggagaaaactgtctacatgttatatgtgacttcacaggatttacgacagagccaatcaaggaaatcatgaaagattgtgagtatggcaaaaatgtgtggcagggcggggcagagagttggttttaagatatagatcttgaagaaattaaagagctaatagacaccacactagaggaattaacagaagacgacttgatggaaatgattgcttccaaaccagatagatatgatgaggaacaagatgtagaataaataatgccccaaagagattgacattagacagtcttgcagaagcgttctgattatttaagactgcttttgacttttactacatggacccttctatgatatgggcacccaaacttaagcaaatggtgaaaggattggtactgtataaaaacttttagagaaacaaactaaaaagggagaaattatggtgtattttcacaaagctacactgagtgtgcctgcctcacctgccacctcttctgcctctgccagtgctgagacagcaagaccagcccctcttcagcctgtgaagacaacagggtgaagacctttatgatgatccacttccacttaatgaatgtatattttccttatgattttcttagtaacattttcttttctctagcttactttattataagaatatactatataacacaaataaaaatttatcaactgtttatcgataagccttcaggtcaacagtagcctactagtagttaagtttttggggagtcgagttacatgcagatt

SEQ ID NO: 4701 - DNA, 1055 bp, Homo sapiens
tcattgtatgtagcactatactctaaaccttgaataacaccatgagacccatatgaagtaccactagtgatgctggaagtactcccaaaaagcagagaaatgtcatgacattataagaaaaagttgaattgcttaatacgtattgtagattgaggtctgcagctgtggttgtctgccatttcagggtaaattaattgagcattacggacttctgtaaaaaagaaaagggatgggccaggtgtggtggctcacagggtggccttgggagcaccttcgaaggccaagacgggtggatcacctgaggtcaggagttcgagaccagcgtggccaacatgttgaaaccccatctctgcaaaaaatacaaaaattagccgtgagtggtggtgtgcgcttgtaatcctagctgctcagaagtcagaggcaggagaattgcttgaacccgggaggtggaggttgcagtgagccgaaatcatgccactgcactgcagcctgggtgaaagagcgagactccatctcaaaaaaaaaaaagaaaaaagaaaagggaattcatgaaccatcaccacagctacactggcaagtacaagaaccttgcacattttgtgcaatatcttttaatctcatattgtaagttcagcttttatgtaggtgtagtattgctataggaaaggcatacttagagactctactatgatttgagaaaaaagtcattctgtgacaaagcaaaaggaaggtgaaggatctatacctggaaaatgtaatgccagcaaaggatgatttgataagtttagaaagaggtttgactttagaaaggtcaagataataggagaaacaacttcttctcaccaagaggcaacaaataagcaaatttacaagaaaaaaaaacattagaaagtgggcaaaagacatgaacagacacttttcaaaagaagatgtacatgcagccaacaaacatgtgaaaaaaagctcaacatcactgatcgttggagaaatgcaaatcaaaaccataatgagatgccttctcatgcctctcttttagtaacagtcagaatggctgt

SEQ ID NO: 4702 - DNA, 1015 bp, Homo sapiens
aaaaaaggacataaaataatgtattttgaaggtttgttttgatactttataactccagattttttttacatttgtaaagatcaggcaaatcactatctaataaatccatttggttaagtttgggttccattgttgtggcagcttttctgacgaatgtgtattgtataatagatgatgagttatgagtttgagccaagggccagtggggccaattctgagcttgcttcctgctttctactctgtcatagaaagtatcaatataatgtcagaggttcagatctctgtgttaatattgcagagctctgacatcaatttctcattctgaagcaagttaattgttctgtaatataattgagggggtgtagggggattctaattaagtacaaaaaattatggagccaaaccgctggcattcaaatgctagttccaccacttactagctgtgtgatcttgggcaagttacttacctgtaaaatggggataattatagtacttatctcacttgatacttagcagattatgtgaatacatagacatcctcgaacagtacctggtgcaaaataagttactgtgtaactgttagcttttataaatagtattgttattcggcagagggagtccctacagaggagccaggagctgatgttaggagctacaataacatggcattctggttatataattaaatgcaagttgtttgcttttgcaaaagaaaatggaaaacaaggaagggagagccaatatttttagaactatagaaacgagagtaacaaatcttataacagggagtaacctctggttttgcgatcagctgtttttcatttataccgcagatgggcagaaaaagtactggtcaataagcataggggtttgtagagtaagatgattctgcactacatatacaagaaattgcttctggttacttgcatgcttcaaaggtttgatctagaagtttgcacataaattgagaaattagggtaagaattaaaaatgtagtaaatgaagattgaacagt

SEQ ID NO: 4703 - DNA, 1047 bp, Homo sapiens
tggaacatgtatttggaatataattggattaagtaaaataagttctccctttgtacacgttcctcagcttataatgaggatacatactggtaaatctattataagtcaaaaatatcataaatcgaaccattgtaagttggggatcatctctacttttttttggtataaagaaatacattatctatcccagaaattcttcatagcatttattctctaaaaatggccctcagagcacagagaaatctgtcatttacctagtgcttcttgtttgctagcatcatactaatacactttatatactttgtcatttaatcatgttaatagttgtcgtctatgattttataactttgtttctattacaagttgataactgacttgattcatctcctcaaaaatttacaacattttttgaaaccttagttcccccagtagtgttaggaacagatagaatatgctatctccggggaagggggtctttttcctcagcccagtgatccacagactgaaacaaacaattaaaaaacaaaacaaaactcgtacttctcttaagtactgaaaaaatgtgtatggggattgactgtattttatttgaagtaaaactagtctttttgcagtcaaattaaataataatgtaattttgattctaagggaatatttatgtccggaatcagagttttgacttttgcagggtgtcctgtactaaacgctgtcaatacatggggttttgcagaggttgcactttgatccttgcagacagtattatccaggttcattgcttccacattacatgttttagaagaatcttattactaaattaattttactcttgtgtgttttgagaacatagaggggcaagacgtgttgaatccttgagtttggaaagtatttctgtgcagtttgcttcttttttcttttatttgagatataaacctcctttcctatccctcctctaccttttctccttccttttttttttttttaacccaaaaacattttctttataattaaatttgaacttttactgtaatgtagcttcttatttgggaa

SEQ ID NO: 4704 - DNA, 1050 bp, Homo sapiens
gcaactttgctgaataacagattgggtggaatctttaggatttttttacatataaaatcttgttgtctgtgaacagataactttacctcttcctttccaatttggatgccattttaggaaaaactttcaaactgtgtttttcctctgctctcataccactacaacaacagaagacttctgtgaccaaatacgtggggatttctccccaacattatgtgagcagttctgcagcagacaccaactgggtatcctcctaatcagttctgacactaggtgcctagagatagtgtcagattccacaggttgaggactcagtccccaggactgcctcccaccccttgaccagtcacaagccccggtctccagaatttcttaccaactggcttcaagttgtggttcccatgaccccctctttgggttcaactgagttctggagtggcttacagaactcagggaaacacatttgccagtttattataaaggatgttacaaaggatacagatgaagatgtcgagggaaaaaagccaaactgcaaagtatttgaagagatttattctgcaccaaatgtgaagaccatgacccatgacacagcctcagaaggtcttgagaacatgtacccaagctgatggggttatagcttgattttatatcctttaaggagatatgatagcattaacattggcctggataccatcttgaatagaagtgatgagaatagatatccttgccttgttcctgatcttagaaggaaagctttcagtttttcaccactgagtatgttgttaactgtggccttttcatatatggcctttattattttgaggtagttttgtttttgtttttgttttttgaggtttcaatattttattcaggtttttttaaagtgatgttaattacagcatttgaaggggaggatctaattccacacaaaatggaagactctaaaatgtacccattaaactgctaaaaaacaaattgagtggtgagaatacaacagaagtccaatttagattctgagtgttgtcaccatgtgattacaatcatacagac

SEQ ID NO: 4705 - DNA, 1024 bp, Homo sapiens
ggttgacaacaaaaggaaaagacgaccaacctgtaattctatactcagttaagttataatagctttcaaaaatgaaggtaaactttacttaacataatgggtatttatgaaaaacccagaggtagatcaggaataagacaaggatgcttgctttcaccactcctgttcaacattgtatacataaattctagccagagcaattagacaagaaaaataaagaaacagcatccaaattggaaaggaggaaataaaaatgttaatcggtgacatgatcctacacagtatatagaaaatccagagaatccacaaagacaccgctagagttagtatgttaattcagcaaagttacaagatataagatcataagatcagcatgcagaaatcattgtgttctttagaccatcagcggatactctgaaatggaaacaaacaaaaaaattccatttacaatagcctttaaaagaattaaaaacaaaaacctgggaattttaaccaaggatgtgaaagattttagactgaaaactatattgccgaaagaaattaaagaagacctaagttaatggaaattcatcttgtgttcatggattggaagatttaattttatttagatggcagcgctgtccaagtcaatctgatttatatggaattgcaaagggccccaaatagtcaaagtattgaaaaagagcaaaactagtggattcaaactttgcaatttcaaaatttactataaagctacagtaattaaaacagtatggtactggtataaggatagacatatggaaaagaattgagagtgcagaaatgaactctcaagtttatggtcagttgattttcaacagggccacttcatacccagtagggtgtccgcaataaaaaagataataacaagttttggcagggatgtagagacattggaactgtcttagattgctgctaagactgtacaatggtgcagctgccataaaagacagtttggtggttcctcaaaaagttaaaaatagaattaccaattcttttgggtata

SEQ ID NO: 4706 - DNA, 1030 bp, Homo sapiens
ttcagggtgttctttcacattgtagcatgtatcaatacttcattcctttttatggatgagtagtattctattgtatggatatgccacattttgtttatccattcatctttttttggacatttgggttctttccaccttttggctattttgaataatgttgctgtgaacatttgtgtgcaagtttttgtgtgtacatatatctttatttctaatggatatatatccaggagtggaattgctggatcgaatggtaattctgtgtttaactttgaagaaccattggactgtcttctaaaatggctacaacattttatagtcctgtcaacagtgtatgagggttctgatttattttctgcctttttgattgtagccatcctagtgggtctgaaatggtatcttgttgtgatttcaatttgcatttccctgatgactgatgatattgaccaccttttaatgtacacattggccatttgtatatcttttttaagttacatttccctttcttgttgtaagcttgtaatctcattattagaatgaatttattggttatttagactaattttctgtctccagattattctagcatacagtcttttagcttctattggaagactcttaatgaagggaaatttactatttgtgaagaaattggcccaatttttgaagaactccagttgttagaagcttctttttatattaagccaaaatttatttcactgttttggtatcgttattgttttctactctgttatatttttgctttttaggcccacatagacgatgttcagttttttatatgagtctttcagaagtttttttttgtttgtttgttttgtttttttgacagagtctcactgtcgcccaggctggagtgcagtggcgcaatctcggctcactgcaagttccacctcctggtttcacgccattcttctgcctcagcctcccgaatagctgggactacaggcgcctgccaccacgcctggctaatttttttgtattttttagtagagacggagtttcactgtgttag

SEQ ID NO: 4707 - DNA, 1030 bp, Homo sapiens
tacaggtgcacactgccttgcccagcttgcagaagacttttttaagacttcttatttgtgcattagagcagaataagctttttgcagatacaacagttacacattttagtagattaattgaattatgatgttaaagctatagctaaaagaaataatctagaaatagtttctttcctgattttaataaaacatttctgacttattttagtaaaaaagtaacctgtgtgtattagttgggaattaagaactagaactgcattttatctgttttttaaattataaggagattattttttctactgaaaaaaaaattcgttctaatgataaactctattatgacatgttttgttactaggaacagagattgattatattttgggccaaatttattaacctccatatagaggtaattttcagtacagaaaagcatggtgtgttattaaaaacatttaatggtctatcctactgactttataaagagttatgcaatatttaggaactgtaggattcttaatgcttgtgtgtatgctcttatatgtgtgtatgtgtttgttagtggtccctgtttgtggtttaaaaatgtatagcagtcctccctgatctatagttttgctttctgaggggtttcagtcacctgaggtcaacggtggtccaaaaatattaagtggaaaattccagaagtaaccaattgataagttttaaattgcatgccctgttgtgataaaatctctcctgtcccactccatacatccctttgtcaagatgtatccattacctgttcctgtataggaaaaaacatagtgtatatagggctctgtagtgtctacagtttcaggcatctactaggggtcttagaatacataccccatggataagggggtataatgttatacaaagcattatattgtgtaatgttttggttagcttcagaggggaactggttaatagatatataatctgatatattcattggatattttcacatttcttccatccatgtacttgtgttgtttttgagttttcttgtttt

SEQ ID NO: 4708 - DNA, 1044 bp, Homo sapiens
cttactgtatgtttataccctttaacccacttctcttcattttcccctcttccccctacttgcccctcccagtctctgttatgtgtctttccactctctacctccatgtgatcaaattttttagctcatatatataaatgagaacaagtgatatttgtctttttgtgtctggcttatttcacttaagataatgacctcaagttccatccatgttgctgcaaataacatttcattcttttttatagctgcgtaatatttcattgtgtatatataccacattttatttattcattcatccgtgatagacatttaggttgactttttatctttgccattgtgaatagtgctgcaataagcatgcaagtattgatttctttagagaagaggctttaaatgagattgatgaatattttgtttgtttttagagacaaggtcttgctgtgttgcccaggctggagtgcagtggtgcaatcctagctcattgcagcctcaaactcctgggctcaagtgatcttcccaccttggcgtcctgagtagctgggactacaggtgtgtgccatcacaccagcgaattttctttttctttttctttggtagagatggggtcttgcatgttgcctgggctggtcttgaacacctgggctcaagtgatcctcctgccttggcctctcaaagtgctggtgttacaggtgtgaaccactgtgcccagccaaatggatatctgaaataggcatttctctagtataaacttctttttaaaaaagggatttataggctgggtgtggtgactcatgcctgtaatcccagcactttgggaggccaaggtgggcagatcatctgaggtcaggagtttgagaccagcctgaccaacatggtgaaaccccgtctctactaaaaatacaaaaattagccagcaatggtggtactgtaatcccagctacttgggaggctgaggcaggagaattgcttgaacctgggaggcagaggttgcagtgagccgagattgtgccattgcactccagcctgggcgacacagcatgactc

SEQ ID NO: 4709 - DNA, 1018 bp, Homo sapiens
ttaaattgaggttctctaggtgccttatgctagagaatatttctttaagttatatatttctcatgtattaaaactctcatctcagaaagaaattcacctgactatcgaacttgatagtactccatccagcccatagactcttcaaggcaaggaccgtgtcagattcgcctttgtgttactatttaccacctacaaagttcagcacagggccataccatagaggatacctagattattctaatttccttataattctcttttccagggtaaataacatgaatccattatatttctctcttagagtgtatttccaaccttctggttcttcttttgtttcttcaagttccagggcataacttatgctcagtataaggggaatactttatttaatttaattagcatttttagagcatatagatatgtaggatgctattagcaattcctgaaaaaagctacctgggaataaatagaaaacttagcatttttggttaaagactaacagtgttgctgaagaaattaaaatatacacagggaaagtgaattttgaattaagatttgagtatggtaaaggccacttttaaggtaatagaaatattataaagcacaaagtctgcatgattaagtatttttttgccccaagtttcagcctgtgttgatgattttcaaaactgtgtctctccttatcattcttgcagttttaaccacagtctatattgattctaaatttattttttagccctgatcttttctgtgatcctgatcagggattagggtttttagaccagggtcacaaaaaaaaaaaatcaaaaacaagcgccttcatgggccaagccattaacataaatgaatgaagtcggttttgatttatatagagagaatcacaaggttgtggtttgcagtgaagtgcatgccctatttaaagaggggaattggatgttagctccagccagttattgccatgaatgctcagtagtgccagatctgatataaaatcttgttttttttttgtttttttttt

SEQ ID NO: 4710 - DNA, 1050 bp, Homo sapiens
ttggatttcgtttttatgatcactttctatgcaagggcaaaatgcttattagggataaaagatgaataagacatgatttctgccattatgtagtttaaagtgtaatagagaagataaaacatatcaaaatatatatctttaatagtataaaacaataataatgtaaatgctagggaatccagcaggaaaagggattgctttggactttggaagcattggatattgttcacttaaatataccctgtttttctcatatacttattggagaacatctagaaagaatttaataaaggtgaggttactatttaagaatattgttaaatgattaacaggtatttcagtgagatagaggttgcattgtaccatgtaaaaaatgcaaattgaatttttttcaataaaaatattaaggccaaacattttagcagttaatgaattaaacaattttcagtgtttttgtaataattacataatttcatgtgtacatagttgttactggtatgaaggaatttgttccattaatcatggaatcttaaaaatctcagacttgttaggaactttaaaagattatatattatgacatattaaaaatgtatcttaagagtacaaagtgggagtgataaccaactttggatatctttaatgatatgactgccttttagaagtcattgaaaaatgtcctttttttttttttttttttttatatgagacagagtctcactctatcactcagactggagcacagtagtaggatcttggctcaacgtaacctccacctcccaggttcaagtgattctcccacttcagcctctgggactataggtgcacaccactacacctggctaatttttaaattttttttctttttttttttttttgagacagagtctcactctgtcgcccaggctggagtgcagtggcgcaatctcggctcactgtaagctctgcctcctgggttcccgccattctcctgcctcagccgcctgagtagctgggactacaggcgtccaccaccacacccggttaatttttttatttttatttttatcttta

SEQ ID NO: 4711 - DNA, 1046 bp, Homo sapiens
gttataattgctatttttatgtcttaaagtttgtataatttatctcatttattatttctaacagtctggtagttcatgtgattttagagagtccagaattgaagcccagactctatttagcatttaagacagaatgatgtagtaaagggatattgagctttggagtcaaacactctttgatttaaatccggactactaattcaggatatactaatgtgtgaactgagacaaccctcctgagcttctctcttcatttataaaatgagtttgtgatggcatacctagcaggattttttttttggcccatttgagataaaatatgtgaagtgtttggtctatcgtgattgttcaagaaatgtggctccttctttttcaccctttcttctctctattccatcataacagggctgcttctatgtaagtatacattttaataacagcatagggccatgcaattaatcgctaagcaaatgatagaggtggtaattgttatgaattcagaggtagatgagatcattgtagactgaaagggttcttagaatctgaaatttgagtagaactggaaggtcgtgcagcatcttgaaaagctgaggaaagaagaaaaggcatttcaggtgagtggagtaacaagcaaaaccctgaactaggaatacctaaggcagtcagtagatcattctggttagatgaaggcatcagttagagtaatgggaaacagtgggaaaatccctgagaagtagataggttctgtggatgagttaagaacagttacaggctctattctaatagaaagatgagactttacacaaaactttctaaacacatggtagaaaaagtgaaaagtaccataaaagatatatagagtaaatgctctaagagttcataaggaaggaagatgacttctggcagtgggaatcagggcctgtatagtgaattctgcacttgtgtgaatttcatttatgcttattcttaatgaaaatttcactgtgcagtttaactacaaatgtcggttgaggattaaaattaagtattgacctcaaacaaaagat

SEQ ID NO: 4712 - DNA, 1013 bp, Homo sapiens
gagtatgtcttcctttctgtttgatacaatctaaaaattttagagctatgaacaccagaggaaataatgcccttcttttacagtaaaggaaactgaaggccatagagagtaggcacctttcctagggtcatacaaatacatcagtcagaactggattgtagctcctgactcagtctaaggctgtgaactttacctggaaatagggaggtgtatagacacgtttaatttataattcagggtgacattggttggtaccagaaggaaaataattgctttatcataagcaacatatatttgttcagcagcttttatgtgcaagacacttgggtataatgcctacagagaatgcagagaagcaaaaacatcatgacactttgcagagaagcaaaaacatcatgacactcactttttttttttttttttttttttacagagggtctgggtttcaccacatttcccaggctggtcttgaactcctgagctcagacgatccacctgcccaaagtgctgggattacaggcatgagccactgcacctggctgacacttttttttttttttttttgagatggagttttgctcctgttgcccaggctggagtgcagtggctggatcttagctcactgcaacctctacctccccggttcaagcgattgtcctgtcccagcctcccgagtagctgggattacaggtgcctgccgccatgcccaactaatttcttgtatttttagaagagacggggtttcatcatgttcgccaggctggtcttgaactcctgaccttaggtgatctgcctgccttggcctcccaaagtgctgggattacaggtgtgagccaccacgccccgccaacatttgctttaagagacttaaagtacttgaggagtctaggtttgaacatacctgaaaaattgctgacaagagttaaataacagttcaggaaaattacagctctttgaaacactagaggaaaggaaattctggataatagcctattttgttttattaaaaatgt

SEQ ID NO: 4713 - DNA, 1054 bp, Homo sapiens
aaccactcataatgttacagttaaaaaaatagttttgtgcattcctctagggccgaactgtgccgtacttctggtttcactgtacagtgtctacaaagcacagtgtcaaagacagagctcgggatgagaactgggctaaggcgcgccccgaactccccaaaccctattattcagggcccggagaggtgcgggctccgaaggtgtggagagcgaaacacgcagagcagtgattccactcatcagtcacacagtaagacgggacagccccatctcgcagtttttcattattcaacacagagcccaacgcgcacgcaacagatccgcgcgcagggctgtttggaggcgcttggggcgcacaatctggggcaggcggaaccttagtcctcagcctcgcgtttcccgcgactccgctctcaccgctacactaccacacaaacggcctccttcccccacccccgggggcccatcccggtggcgggctccggagctcgggactgctaatttcagcgaaacgattaaaagacgcccctacagctgacggcactttctctcctccggcagggaaggacgtccagcgtagcgtcgcccgcgcttccccgccggcgcagagcaggcctcacagaatcgcacgccgctggcacgcacgccgccccgcccccacggcccagcgccagccgcgccccgcgctcgcacgcatcccggcctcactgcccctcgactcctgttccgttggaggggcctgaggcgagcctgagcgcgctgttggccggagggaagccggaggagaccgggtcgactgggcagagcggcagagggtcgaggagcctgctctgcacgcccagggagtagaagtgggcagggagcagggtcacgtgagggagcgcgccgcgactgagcttgggtccgactggagctcaggctcgcgacccagactggtgggccaggcctccaagccggccttacacccaatccaaggaggacagaccggacacagagggacggagcgagcaaggagacatggcttcatcattcctgcccgcgggggccatcaccg

SEQ ID NO: 4714 - DNA, 1051 bp, Homo sapiens
tgtatctaggtcagctgtggggtccctgttcctgtggagctcatggtgagctcttcagaagcatgcttccctccccatagcccccaaaaagaagactccatccggagaaacagcctagcccactgcacagaaaggacgccctcccagcccagccgacccaatgcaggcaaaggcccacagggagattctgcacacagcttcacacaacgacccctccacaggccccaaaagctagtgccctgtccgctggcaggatgtgggctgtaatttctagggaggaaaagagcctagctttaaaggcagtgcggtcctaatctaacaagggagcccaggtcccatgagccacatcagtggtcttaactttcacacacagggtggtgaattgagcaatcctggaattcactgcagaggcagacatttttgttctaaaaagagaaattgaggagcgcttaatcacataaggtgctttcagcccaattattcaaacccagaaagccccactagcagtgtcagcaactgtgcataaaggcaggatgaagattttggagacaagtgcaggacgaatgaggcagctaagcgttgagcaaatcccacacctgccaagttctcaaggtgatgctccacagaagctccagtagtcactcctctaggggaggatcccgctgcagtcctggagacatatggcttcacagggacccctttccagagtcccactttccatagcattgctcccctaaccacacaatcaatgtgatgtacacaagctctgcagtctcaacacagccactctctctgacccaggacagtaccacttacagtgtcaccctcccagccctgcctcttgctgacatgtcctgtcctcctgccatcagtaacaccaatctaggcatgtctatccccaaaatggcaaaatcttgtgcttccaggagctgctccatttctgtattaatttgtttccagaaaaatgcagctgctgctacctcttcacctcctggagtccctgtctgttcaggcttgccccagctgcctctagccagacctaggataaaga

SEQ ID NO: 4715 - DNA, 1051 bp, Homo sapiens
tttagtcctcatttttggtcttgtctctgcggactgtgaagaatcacaatgctctatatgccctggactgtgtggcaaatgcaggttgcagcgtgtgtgttacatgaggatcttccacaatttcagaatgcacgccagagctgaagggggaaacttggtaacttgcccattattctctgcttttagccagagttaaacagactgatgggtctggtagccaacaacttggcaacttccactccttctcacctcgtgagattaagggctgtgaaaagaaatctagtctaactccaacagaaatctgtctctgttaagtgttttaccttctgtaagtagagatggtagagccaagatttttcttttggtaatttccctgtctataaagtgagaccaaagggatatctgttccctgttacctttttggagaattcataacatttgaagatcaaaaaattgaatgataaatatgaatggcttttcaattctgtggactttgtaccatttggcttcaccttgtactgcaagatgaatttgtaaacaaaacaaaattggactgtctggaaagctaaagttctgaaatatggaatgtactgcctctaatttttctttgtcttcctctcactggcatttttttctctcccaggtttcttaagaataatgttttttaaaggaggctttttgcccatcaagaataaaaagaaataaaaccaaagggttaccggacttaagcccccgcagtcactgtgcgccatccctgagcaaagtccgcccctgaggacagtgcccctgccccagtgacaggccttactcctcccagggcctttgcttctaatagggggtggtctttcttttctttctctcctttttttttttttgattaaaaaataaaaccaaaccagaatttgctgaaagcaggtacctttcagtagctccgatcagagtaactcagcttagagatactgttactcaggacaacagtatgtacaaaagtctccggaaaaggaaaataaaacaacctgaaaagaattcaacttgaaaaggactgaattac

SEQ ID NO: 4716 - DNA, 1062 bp, Homo sapiens
attgctgtagcatttcttatcccctgagagctgatgattattgaggacagaaggctcagaaacagtttgtgacagaaaatgcagtgtttcatttttcagggataaatgctaagataaaattgcttttccaggtcatttttttttgtggtaagaataactaatggaaaataatgaaacaccctggggtttgggggtgctaacaacttgtggctttaactgacaggagcaattaaaaagagcaagagggttctgcattggcatagcttagggaagggttaatgatgtcgccacaggtcagctcctgatccttgccgacttgatgttgctgtaccagggcttcctccccagaggtgcagcttgcgttttgagggtgattgctacatatgttgttgctaaacagctcagtaacacacttgaatgaatttggataccagattgtcctcattacagttcttttactcttagggcactctacactgggggttggggttgggagtggttagtacatttattacatttattaagaaacgtaatgacataaaaggttagctctgggccagacttctcttactctgtgggtaatggcaaggatgtgtaggtaaacttggttcttttttttccctaagatgacagcttgattttatcatctgcagtcaaataactgagccaatccaaatttaaatgatagatgctttaattgagtttaagtagctgaaactgctgagacactaaactttaaccttctgatgactttttaaaatgcctcaaatgtgcacatgtatataggatatttttataacttccctgatgaataatctgatattaaagtagtatttggacccagagccagaactcggtggtggaggctgctggtctctcctcaccaccttcttttgcacttggaaagaacagcaacatctggatagagttctagctttgacttctcatttccttgtctttttgggtgcattcctcagcacactttttttttaaacctttttgttttgttttgtttgtatttcatgtggttttatttgggggttttggttttttcaccctttt

SEQ ID NO: 4717 - DNA, 1051 bp, Homo sapiens
tcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattt

SEQ ID NO: 4718 - DNA, 1004 bp, Homo sapiens
caagtataagttctagcttggaagcctgggttctgcagtagctgtggaacttaagcctgtgagctcagggatgcagaggcattgagttactaccaagggcctgatcttttctttagcaggcatctgtgttaattgtttcaaaaggtggtgatcagttttacagcctattataaaggagatttttgcctactataaaactaatccccctgaaagagtgagtaaacataactttttgtgtgttgacttccacaagggaaggagttggcacttacactctgacttttgattcagtcgtccttcttgagccatttttgcaggggatcagtttggagtgggcgttaacaatgttattctttttttcttctccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaaggtgagacagcaatgtggagtggagcacatgctgggtgggatctgcagaggggtgggcagcagcctttgactcagcctctggattaggcctctttcttctgtttgtaaaggttttctaaggcagggcttttcagactttattcagtcaacattaagctcctacactgcctcaaagcagagcgacgatggaaccctttatttcaatggaattgtgcacgtaggccagtgtattgaagaaaaactaagtctggtttatggagagttggcatggggcttagaggttgccgacctggacatccccacttagctggctctaaggcaccctcagaaaaccactgctctaacctgagaatgccatctagtttacaaactcttagaaaactgtgtttaatactcatatcactggcttctagatgtgaagcaaatgctctacaatggtttttaaataggactaatt

SEQ ID NO: 4719 - DNA, 1048 bp, Homo sapiens
tttacactttagaaccatgggttagaaccagatgttagctgggcatggtggcgcatgcctgtagtcccagctactcaggaggctgaggcgggaggactgcttgagcccaggaggattcaaggctgcagtgagctatgatcacatcgctgcactccagcctgggcaacagagcaagaccctatctctaaataaaagacaaccagttgttgagactgttccacccttcactgaggctcttctttccctgatggctaggctgtcctccatggaacattcacagcagccactatgtcctctggggtcttccgtgcaacatatcagcttctgctggtttttccttcctgtctcaaatcctgtatctactttggatcacccactaggctcttatttccttcctggtggatgttcctagttctcagcacatttccagggtggacaagactgacctgccctgactttgaatgaagccttccccattttaggttaccatcttcatagcttcctcatattctgtgataactctgatgtgatgtcctcaaggggacagcctgtggtcattttcccagaaatctatgaccattttattatagtcacaaaagtactttgaagatagagtaaaaataagatcctttctaggaggaagagaggagccatccctgtatgggtcctgtcctgattagacatgtcgggaacacagacaatggggacagctttggttttaaacaagaaaaagtacaaaacagaagaaaggtaaagaaagaagtggctgggcaattttaatgagggcaggcatggtagagagaagaaaaagaatcctcaagtggggaagaaaaaaggctgtgatttatgggaagagaagaaaacgtttacctgatagttcagggctaaagagaagtccttttgttcaaaagcctccaacatctggtttgtcttttttcccaggtagttataggtactggcaagacaataacaaatactgcaggttcaataactcaacaggaaaggtccagatcttcaaatccctctgctgtttaaaagggaaaaaata

SEQ ID NO: 4720 - DNA, 1025 bp, Homo sapiens
ttcaaaaaccttttatcacataaaacaggctaatataaccacatttctgtccaagtagatggaatggcctcttttcaatcaaacacagtacttgctgagaagctactcttaacattcttaccaaatttacccagagctttggtaacctgacgattaatacatagcaggcctcctccctttttataataatagacagcctgtgccatgacatcgtaacaagccctaatttattttaatatttatcctatatattctgaatgtttataaatcctgtgcacaattaggaacttggtaaatcattctcatcaaagcagaaacacatttattatcagttgcatactcagtacacaatatgtgtgaagctagccattcattcctcttcagtaccacacctcagaccatagagttaagtgattcaatcaaatgagtaattcattctcttcaaatagtgagtcagatacaaattgacatttaaattcaggtctcctgttgctcaagatttcttagatcaagggtcagtagcctttttcaaacagtttgccaagtgtatatttattcattcactccaaagagggagtcttttagcctgaagaatagtcgggaatcattgcagtccaagattgaagaaaagaaacttctgatttgggaggcactgaggtgacagttggggaataatattcagagctttctctcccccttcacttctccattctcctaatatttactaagggaaatcttactatcttcaaggtttcccccaactcccaataagcaaatacctctgagaaattaccacacctaaaattcttatctgctgatttaatggacacaatctggagaagacaagaagagatgctcataggaaagattgaaaagtattgaaaaacaaaaacaaaaaccgtagcctctcttattttattggcagaaggccttagtgttcatgcatctctttactacccgaagcacagtacttactgaaatcatcttgtgggtccctaatctaacagcaacatatttcatgtcaa

SEQ ID NO: 4721 - DNA, 1051 bp, Homo sapiens
catacaatggaatatgattcaaccattaaaaggaatgacattctgacacatgctataacattaataaaccttgaaaacataccaagtgaaatgagccaaacacaaaagaactaatattttataattttacttatatgaaataatctaggataggcaaacacaaagggacagaaagtccttagaggttactaggaagtagggaaagcaaggaatagggagttagtgcttaataggtacagagttcctccttggagtggtaaaaaagttttggaaacagatagtggtgatggctacagtacattgtgaatataattaatgccaatggattttacacttaaagatggttaaaatggcaaattttgtgttagatattttacaacttttttaaagaattaggagtttggaggatcaagaattcttaaatcatgtttttctattttcatgtgtatattttgcaatgtaagtagatgctggtacatcatctgtcaaaagagtataagtgattttgagctttgggtaaaaaactggataacatgtaaatagaaccagtcataaaaatattgagtgtttgaagtgtatctgagtgaaaacacaaacataagaaaaaagcacatagtaaaacaatagttcccccttttactctaaaatgcaccaatttgggtagtaatttatatggcaccctattcatggaacactttctgttgccaggtaccatactattaatgttttatttaacctttacaacaaccctgtgaagtatataaatatctttatcatcctcaatttacagatgaaaagctagctttaaaacccaagcagcgtagttctagcatagcctcaagattgcagtgaacattgattacttattatattccacatattcttcaaaggactttataaatattaactcatttaatcctcataaaaatggagggaaatgcttgctattattcctcttttgtcactgaggaaactgaggcatgtgtgaagtcttcatttcttccaaatgtcagtcaccagtttttaccaatcttcgaagtatttctgaaat

SEQ ID NO: 4722 - DNA, 1031 bp, Homo sapiens
taattcaaggtgaaactgcaaatctgcctccttgttttgttgggaattttttttttttttttttttttttgagacggagtctcactctatcacccaggttggagtgcagtggtgcaatctcaactcactgcaccctccgcctcccgggtttaagcaatcctcctgcttcagcctcccgagtagctgggatcacaggcacacaccaccatgcctggataatttctgtatttttagtagagacagggttttaccattttggccaggctggtctcgaactcctgacctcaggtgatctgcccatctcggcctcccaaagtgctgggattacagctgtgggccaccacacccggccgttttgttgggattttttttttttaagatcaagacataaatttaaatgttgttttaataaattgttaaattatcacattgatctgttagcaaatcctctcagctctgccttcaattatgttaatagtctgtctagtttcttaccacctccactgctactatgcttaccacatccagcctgtattattgcaattgcctcctaattgctctccctgcttctaccttatcccctactcccacagcttattttctgtaacatagatgccaaagcaatcctgttaaaatgtgagtcagattatggcactgctcttaaaaccttccaatgtcttctcatttctctcagtaaaagccaaactccttacaatgcctgtaggccttacacgatctgtcctcccataacctctgacttactcacgtgcttttctcccaccaatccactccaaccacattgggtttttttctgttcctggaacacactgaacacacactaatagcactgttctttcctctgtctgaaacactttcctcagttatcccaagccttctttcacgtccttcaggtccttactcaaatgtcacattcatagtgtagactttctgaaattctaaaccctcctcatacagatatgtctaaatgttctgttatttattgacccaccaggaccgggcaggcagcattg

SEQ ID NO: 4723 - DNA, 1138 bp, Homo sapiens
ctgttgttatactgtctctaaataaatcactgttaacatggacttctaagaataggaaatagcttcactggttagcatgggttgatataatgtacttaaacaaaaattctacttgtcacattaaaattcattgatagatctgttttgagctactctggcattactatagaaaagctaagtaggcatgcccatctgtacctagactgggcagccaataagtgtttttgaatgaacctttaatggcttgggagccattaatatcttgtgcctaaaacactagccaaagtgtaggttggttcctggttgaggctatgcccagtatggcagcaccaatttactgcttagtgccttatgcagagcccaacatacgaaagttagactaaatatattttgactgaatgaaagccacctagctgcaatgggtttcaataaggaggacatagatagctggttccatatgtcatgagcaagtttctgggatccttcagaagggctgggttattctcaaactcattactgaaaagtaccttttcacctaacattatccttttcttttcctagttcatagatgttgacaatttcctgactaatccacagaccctcaatctactgattgcagaaaacaaaactattgtggcccccatgctggagtctcggggcctgtattctaatttctggtgcggaatcacccctaaggcaagtcttttgcttaaatgaattaaggctactagttttaacaaggcaacacccggtcaacagtagtcccattcacctttctcttgtttactcccttgaaacatgcgtgtcattgtgttcccagagcaagcattttttaggaagggcagtaaatctgggtccaatgctacacccagttgggctcttctgtgttaatttattatgaaaaaaatagtctaaagagcttagccttagaaacgtcaaattagccaattcctgattcaggaattactatttttaattaattctttttgtccttacaaaactaacataagaacactatagaaaaacttagaaattaaaaaaagtttaaaagaaaaccaacaagacagatgttaaatccccatcaccgtaacaacatcatagatagaaacttgcacgtttttagtaactgtgttatcat

SEQ ID NO: 4724 - DNA, 1079 bp, Homo sapiens
gtagaaaaatatagcagaattcacatatgaaagtcaactgcatttctgttagataccaactgagtatctaacagatactcatttatttaaaaatattatttatagtagaaaccaaaaatgtaaggtacctaagaataaatctaacaaaaataatatctttatgaaaaaattctgaaactttattaaaaacattaaggaaggccaaaataaatgtggagacatagatgtacatggaaaggaaaaattgataaagataatgattctctccagacgattaatttaatgcaattctaataaaaatcccaagaggattgttcatgcactctgagatgctgattataagatttatttgaaagaacaaaggaccaagaatactcaagtcattcaaaaagcaaaacaataagatgaggggactttctatcaaaagacatcctaaaaatagtggacaaacaacccataaagtgggaaatcatttttgcaaccaacagaggaatagtattgagaatcaaccaaccgacagagaaataatgtagagaatcaacgaagaactcatgaataaaagagaaaaatcaaagaacctaacagaaaaatgggcaaaaatacaaacaggtttcacaaaagaggaagcacatgaatgaccataaatatatgaaacattccaccacctgataagtaataaggagatgcagataaataccacaataatgtatcgtttctcagcagccaggttggcaaaaattttaaaatctgacaacattctaagcattgctgggaatatatatgcaatagacacttgcatatactgctcctgggactatcaattggtgcaactactttgaagacaatttggcattccctagtaaagttgaacatattcagacctatgacagatccaggaatgccactcctaaatgcactattgttcatatacagcaggggatacgtgcaacaaaggtcatagcagcattgtttgtaattgcaaaaatctggaaatatgctaaatgtccactgacagtcaaatagatcactaaattatagtataataatacagtgaggtattacagcattggcagtgaatt

SEQ ID NO: 4725 - DNA, 1095 bp, Homo sapiens
aagattccaatcctaatgttagctggggtaaaaaggtccagcctatagactccatattagcagactggaatgaagatatagaagcatttgaaatgatggagaaggatgagctatgacttgctaaacaatctgttggtaggtatttaaaaagaaaaggtaaactgtgtgtggttaatagacatcctaatactaagcaggctttctaatgggaggctttaagtatggtgatgaacaaccacgttctgactggcgtagttatcgtaggaatctggagcatgctgtgttagaattgaccttgtttaaaactgtcccatcaaaaatggaaatccacagttcccccttcaaatgcagcactgcaccaccctgcaacacctcaggccagggaaagattactgagcattcctgcgaaccagatttctgttgtctctggatagacaagaaacaaaattcatttagtagtggagtggggaataggagtttggatagccttctaattaaaggaagctcgcctttcttggttttgggggttagaggctcttttgggaagatgcatccgagtattgtggcattctgattatgctgccttcacaaaacactctaagtgacctaagtggttatgaagcaaatgcatttatggtgaaaacagtctttgctcattgctttctcttgtttcatttagtgacaaatgatcaagatgacttgattttttttccttcttaacaatgtcttttttatttaaaccaaaggtgaagccagtgtactttctcagtgagttctctgcataaagactaatcagtgggaccaggtaaaaaggtcatataatacattgtggagattgcttacttaatacttctgaaaaatggagtaagggagaaactgtaatgttgcaatatgaacctcccattgggccttccatagggaaagctgtgactactctgaaatggaacctagcattatatccttgtagggtagattataaatcatttccagttcatttctcttagaggtgattacctctagccatcagccttactccatcccatgtttggtatgcaatttgagccacaaggctcgtatcgccaacagctatataca

SEQ ID NO: 4726 - DNA, 1043 bp, Homo sapiens
aggaagtatcatactggatgccatccgggaatatgaggaggtagaagtgctcctctctgataaagcaaaagatcgaggtaagagtaaaataccatttgtttttttatgcagcgtaatattaattttgctagtttgataacaagaatgagtcacaaaaaattgttttggggggttcactgtgaaaacaagtaaaacttttagaagatgatttcaaaatatatttttcttttggaaataagaataataaaacatttattttgctttgttttctgagttaggatgtttttagacatatgtttttatgtgtgatttgtaatttttgccctgagtctgttcaggtgataaaaatacaagagactgcttcaggaaagccattttaacatccggaaatgttcacaatttgatttcactgatactacatcttacatgtcttttataaggaatgagaagacatatatagaatgttgtatacaatatcatagtagttagtctcaacaggccacctataatcaaatgactgctgtcttggtgaaggcaatagaaatctagcagcttcttcccaatgagatctaagtttatcacatggatataagagttacaaatggctgtttctgaaaaacaagatagcatgtcttaatttatgagagtagatagtcctctgtaggccaaaatgtttgttagtaatttgaaatgtctttgaaacccaaattacaatataaatgcaaggccttactagtattcttacatagtttcacacccagggatagaggagaaatgagggaatgtgagccttcagatcttgcttgtggtagcagtctttcctgtctgctggagagacctgaagagagagctaaagttctcccatacccttaaatagatgaagttgcataatagtacagggttgttacatcccctggggtgtttgacagatatgtaggaaactgattcaattcaatgtgacttccaagtgggacatttaaaaaaaaatgttcggtgataatcatgctagcataatcatgctagcctaattttgtcttcttgta

SEQ ID NO: 4727 - DNA, 1033 bp, Homo sapiens
cttcatcacaccctcaagttttcatctcatccatattcttgccacatccttccttcttttaagagtattcttccttcttccttgtattttatttggcctcagtgggagtgacatctcttgtgacattgcttttacttacttaggctgccaatggcataattactgccaagtggcctcttgatccttatatgatttaacttttctgtaactattggctgaacccttcataaaacattttccctttttggcttcccaggatatttcagaaacaaagttctttttctacttcactgtttattgctttgtagctctccttggcacaaccactcaatgtaaacagtttccaagaatctggatgatattcttttctctatatactcttcttcaacagtgtcacctatttctacaagcttagctatcatttttatacatatgacttcttagctatgtatgtgaatcctgattcctaaatttactattaaattcaactttcatctacctctcatacatcttgcatctcaatctcaatctgtccaaacttgaattatctctttcttgtttactctctttctaccctcacctcaacctatgtttccttctttggctctccatgtcagtaaaacctatcatcattctttaagtcatcaaagctggaaatttcaggataggtttgaactcttcttctcttccagttcctcttatccttttccatcctctaacttctatcatgtcttgttggtttttcctgtaaagtatcaggaatcatcttatttttttctattatagtcattcttcaactttccctctgttaagactcaattcaagtgtcattctaaatctttcccaggtacacacaagcagaatcaattgttccctcatctgtgctccttttccactttcccacttgagaaattttatcatagctaactttacatgtctttctcctccagacacaaatttcttaaaggactgtctctccaatgcctaggcaagtgctgagatggaataagtgcttcacagatatgttttgaat

SEQ ID NO: 4728 - DNA, 1043 bp, Homo sapiens
tacaattttatattttataatcaacttcatttgagtccagatttttatagaaactccattacctgaatgacattgtaaaaataatttttaaaatgtgtagtggttttgtgtcagtatttcctgatgatgttgaacagggacagcgtaaaaagtgatatacattccaaaaaatcagttgataaagtagttttattttcaccttttatcagaaactttgcagatctgccaataagagatgtaatagatttgagttttacctaatcttgtttgtacaaggataagaattattgaaatatgttactagttagctttttcctttgtatttcaattctttttgaaatcttggaagtttggcttagtctttgattacaccaaggatacagggctttgaagacctggagaaactagtgagtattcatttcaaaagcaagtcttaagactggttcagaaccacaagcatgtttttttgggaaaagtgggaggattattgaacccaattgaatcacctttttaactgaagcaaactgaaatgaatatagcaaactcatcagttatatcactatattctttttaaactaatctaccatttccttgctcacctatcagttcatccatgttgtatgtatgagacagtatgacatggtgattaaaagtatggaggagaatggcgtgaacccgggaggcggagcttgcagtgagtcgagatcgcgccactgcactccagcctgggcgacagagcgaaactccgtctcaaaaaaaaaaaaaaaaaagtatgggagatgtactggtttaaattctgattgtaccacctacgggttttgtgactttgggcaagtaactaatattatttgcctctgtttctcatctacagaatgggagtactagtactatttatagggttattgggaggattgagtttatgcattcaaagtgattagagcagtgcctttaacctatggccaatattcaataatagtgattaaataataggtaaatttgcaaaaaaaaaattagtaaaagttaataagtcattaattgaatac

SEQ ID NO: 4729 - DNA, 1033 bp, Homo sapiens
atgcagtggtacaatgatgaacttctccaaatggcaaagcagttaggttacaaacttttaccggctttcaacactaccagtggccttccttatccaagagtaagtacttctgaaaaatatgagtctttatatactttctttgctgttttacaaaatgaagttttgtgatcagagccattgttcttcaccagcttgaggctgaaaaaaaaatgcttcaaagctatataacaaatttatattttcatttcaattaactgattatacttctaagtgatgtgataattagattagtttaagctttaaaaaagttttatttctgatttctgtgggtacatagtaggtatatattaatggggtatgtgagatattttgatacaatcatacaatgcataataatcacatcagggtaaatgaggtggccattacctcgagcatttatcatttctttgtgttacaaacattccaattatactcttttagttgttttaaaatgtatgatacatttctgttgactgtaatcgctctgttgtgctattaaatactgtatcttattcattctgtctaacctgtttctatacccgttaaccatcccctccctattccccatccccaccacctacccttcccagcctctgataaccattgttctactctctatctccatgagatcaattgttttaaattttagctcccacaaatgagtaagaacattcaaaatttgtctttctatgcctggcttatttcttttttttggtgggggggaatggagtctcccactgtcacctaggctgaagtgcagtggcgcgatctcggctcactgcaacctctgccttccaggttcacgccattctcctgcctcagcctcccgagtagctgggactacaggcacccactaccacgaccggctaattttttgtatttttagtagagatggggtttcacagtgttagccaggatggtcttgatctcctgaccttgtgatccacctgcctcggcctcccaaagtgctgggattacaggcatgagccaccac

SEQ ID NO: 4730 - DNA, 1027 bp, Homo sapiens
gacaaacataatgtatgagagtctcttgtggccaaaaaaagcaaccaatggaaagatgggcaaaagatcaacagacatttcaaaaaagaaataacaatggataatacaaaaagatgtttatccttattagtaatgaatctttagataccatcttttacctaggagtttggcaaaatgtgaactattgatcatttcctatgttagtgagaatgtaattgagtgtagattggtgtcctcaatttgtagcatttaccaaaaattagttacacatacctttgaccctaatgggtctatttttaggtatctgatacatagaaatactggcatatgttcaaaagatacatgcacataggtgtttattgcttcattgtttgtatagaaaaaaattgaaatcaacctccatgttcatcagtaaagggatactttgaggaatgggtactgctaaggggatagactctggagtcagggtacctggctttgaattctggatcatttactagatgtgtgatctaggcttacttaacttctctgggcctcagttttttcatccatgaattagagataattgaatctacttcagagcattgtgacaattaactaaaatatatagatagaatatcacttagaatataagtactcattaaatattagctaatgttatcagtttgtagttattagaatagagtacatctgtaacattctaaaaacgtgggaagaaaactccattatttaagtgacaaatgttagagcaatatgtgcatatggcatgaacacctgttcataaataaaattttagaataatatatgtgtatgtatttgaatgtatgtgggataaatctggaaggataaatgccagtcttatcagtagttagctctaggaagtgagattggggaggggaggggaagcagattatcagttttttaaagaaattttttggtattgtttgacttttttccaagcatgtattacatttgtaattaaagatttttgaaaagattccacagggtgtaaatttagtacaacttt

SEQ ID NO: 4731 - DNA, 1032 bp, Homo sapiens
acattcttaggcttcacccccagatattctgactcactgggtacaccgtggggcctggacttggcttttctagcacacggccgagtggcactgatgctgctggttcgcgaaccacccttggggtggtgttgcttcaggccactttgcctccaggcatggacttaagcaatgtgacatcaatagtaaaagagacttctcattccaatatgtgatgtttttgatatactgaggtgaatgctggtttttctggactccacaaagtcttcagttacagataactgcgctctttgttcttggcacttggaaaggcagccagtctaagagtactgagggcttactctgtgccagcctctacgtaggtgttaggaagagagtaatgaagcatacagagttcctgtctctgggagttgaaattcaaacagggaggatggataaacacccaccaattatcatttgaaagttatcacagttaatgggttaaagagcaacgagaggttactaactagtgaagaaaggagtgccgaactttcagctctccaggggagtcctgtatgagcaggtgacatttgagctgagtcacctcacccattgtgcctttatttcctaatatggttaatttcactgtatacttattttaaaattcagaggtttccctgagagtgtcagtcccacagagtgagagtcactagtgatgcatctcaactaactcttggttttagctgtgtattgatggggactcacggaaaaagataaggtcagtctgttttgccacagcaaccctgagtaacattcatcatcatactggatcataactagttaggaacttttttaaaaaaatgatacccttattaaaatcttgccttgtgtttttgatgttctagagacaaaaaattgcccagcactgactgcaccctttagctcattttccactacacttgcccgtctgtgtttagggcctcggtctagtaggaacatgcagttggcactcagcacaggaactgcgaagtttcactgagtgcagaatgctccctg

SEQ ID NO: 4732 - DNA, 1129 bp, Homo sapiens
tattaatagcttgttactacttagagatcccttctcaagaattaaatcaagcactaatggcctaaagcatgtattatatgtaatgaataacttctctcctctgtgtccagaatggcactacgtaccattcctttaagaattgaaaaaaaaaacagtcactgaactatttttctatgaagcataattttctcacagagcctaagttgagaaagtctgaccttgtgagatatgcaacatgcctcctcacgggtagaaaagggtatgtaacacagtgctagggaaagttactattattttgcattttagaaagaaagatacagttgccatttagttaacattccgactgtaatgttatcaagaaatccaaacataaaggatctcatttcttaaatatttaaaacatatgcacatatatacacatcaatattttattagtttatagctaaatgattctaacatactaaatgtaaaatcattttttcattactttgtagccatttcaatgtaatttgtgacttgaaatcattatgagaaaatattctgaagtctcccatgttcaggaaatagagtgattcttagtaagccatgctagctaatggaatgcagccatatggagttactcattttctaacaattataccatagtgaaatatatttagcaaacaatgtagtgtttgatgaaccacaaaggtattttaggattttgtgctttcctagggtgattgttcttaggtatcataatacagatgtattgatgtgctggacagtcaagatagtaaattaactttcattaatcagatgtttaactgagtgttactcttttgtagagagtgctgaataaatcagttctttggttttggtttgtttacatctgccaaaccgtttgcattaacacaaaataatataaagttatttttcaaaatgtatatttattgttttagatgtttacaattattttgtgttttcttggaaatcttttgtttagaattattttgtgtttccctggaaatcttttcttttttccatcttagcttccactgctaaaccacctaaggaaattttgaaagaggcagacacggatgtacaagtttgtcccaactattctatacctcagaaaacagattcctat

SEQ ID NO: 4733 - DNA, 1054 bp, Homo sapiens
cagggagtgcttaatatgtgccatatctacttcacaattttacttcaggcaaagccagccaggctctcaaaagctaacatgagactacaaattgtggaatcccaaattgtaggacaccaatccattatatctagcatctagaattcaaagtgtcaaagaattcaatcccgtaaataactcttttaatctactgggagatggtctatgtaagttcacaaagagcacccaacatctagtatagcatctggcatgttaagtattcaaaactggcagtcatttttattttaacagttacactgtcattacttccttggcttctgagatagctctgccatattcatggtgttggagagaaccactagctacctctcccactgcccctcccacatgacagatctcttgatggagagtacaaaggaagaagaactgaggggacaatcagaactcgggacaggacaaggagtagtgacaacaccgaagtaaataataataaagtaaatgtaccatatttggaataatgtcacttcttgacaatgtgtggtttctctgagactgattaaagcctgacttttgggtggctcacatctgtaatcctagcaactcagaaggctgaggcagcaggatcatgaaggccaggagtttgagagcagcctaagcaatacagtgtgacctgctccctaaaaataataataaaaaaaatttaaatctgacttttggctttgtgtaaccctaatctcattttctacatttaaagtttaaaaatagggctatggtgctgccaattcttcacaactactcaaaaaaatgattttgaaacactcttaagggattcaaaatagcagagatataaatgttttcttacaaacttaaaaacgaaacaaactaaaagggtaggcccctattcctgtccttatttattccacatgtgaaaaaaatatccttcagtaactagacttttgaatctatttctgtgtcttatgtttttcttcctctcaccccttgtaattaagaaatgagctctatcttctcttttcctcctagtggcatttgtttc

SEQ ID NO: 4734 - DNA, 1051 bp, Homo sapiens
atctgtgaagttctagtctgtgcagtcacaattgaccactgcaggttttaacaagaggaccctgtggggacacaacagacttcaattctttagccagcttttccttggctcagaatatggagagagctggaggccctccaaaccagaggatgttcgctggtcttcccaggagagaaatgaactatcttttgtaaaagtaagtttcaaaggccaagtgtagtggctcatgcctgtaatcccagcactttgggaggccaaggcaggtggataacttgaggtcaggagttcaaaaccagcttggcaaacatggtgagatcctgtgtctactaaaaatacaaaaaaaaaattagccaggcatactggtacatgcctgtaatcccagctacttgggaagctgaggtatgagaactgcttgaatccaagaggcggaggttgcagtgagccgagatcgagccactacgctccagcctgggtgacagagtgagactctgcctcaaaaaaaaaaaaaaaaaaaggaagttgcaaaacagtaaaggaactctcaacccctgcattacatgattaggacaacaaatagaaaagtaataaagtttacgatcataaaaaaaaaaaaaaagcaacaaagaagggagagggaaaaacaaacaaaaaaaagcaagacctgacatttcaaatgatttcaaatggaagaaataaaagctaaaacaaaaattttaaaacaatgtttttgaataaaaaagactagaaagttaaaaaaggacatcttcacatctcaataatattgaaaaagttttttatataagactgaagtaggcataagggtaaatatgtgataagactgaaaagaaattttaaggaaaggattaacctatattaaagcgataaaaaaaaaaaaaagaggagttaccagaacaaggaaaaacaaaaacccaacaataacaactagaagttgaaggataagggtctgaaaaaacttcttttcatgggggtcagcaggcaacagatgaatgtatatttatttggcttctcaggaaagaaaaggaaagaggca

SEQ ID NO: 4735 - DNA, 1034 bp, Homo sapiens
ataaaggatttaatcagcatttctatattaggcttgttattaggcattgcttttgggcctttctctttcacagtcattttctcttaattatagtttgtacattagaacagtttttttacttcagtacagcctcaatgtaagcatcatccatttgtgatatttggatcccttcttcccataggttgggatgaggttttatgtaccttgtaattcataataatagataaggttagataagtctaaccttattttttattcttaatattcatagtataaaagtgatatgaaagatgcattcacaactttagtaacagtggaaaacagcctgtcatagtgtaaatctgttttatagtatgacataacttgtcatagtataaaaaggatggggtttatcttcataattcctaatctttattttagttgtattgccttgggcaatgcatatcttcttgagtttcaatatttttatctataaaatgggtagataatatcaccctcactggactaaaagagatgatgtaaataaagtacctagtaatacctaggtacatagtaaacatctaagtggaatttaatcataaccattgataatgatacattccctgccttttctcaaaatagcctacgtatgttgtaaccacactcaggcctaacttttgatatagctttttcttaatagcttcaagtagctagcaaaatctttttctcaattacttgttatatggctttttgcttccactagcaacagaaatttccattagaaattttacctatccatgtgttctggccatctggaccagcacaagtgggatgagcaaactaggccaggtgctgaagttgctacctgttcatttggcagttcctctcagagtagtctttactcttccaattccatatgatcatatcctttggaagtggcaaaggctaaagtaattggaaggaagccatcaaggaaaactcatacatgagaacacatgtgtaaagtagttctcttacaatcatttggaaattggcagctttgttcatttctccct

SEQ ID NO: 4736 - DNA, 1030 bp, Homo sapiens
ttcagtattttattgtaaatatgtatattctttaagagtatatattgtactagtgctttttttcttactgttatatgatagaagctatgaaaaaaatgaagatttctttcaagccaatcaagccaacgactcttcagccagtattggaagattttgtatttgattttggttttttgtttttgttttttaatttttaccaccatgacatgtatttttctttacctccggatcctgccagagtaatatgtcaagaagctcaagaagcacactggaggttaccttgaggcgtttgtgtaatctgcatactagtggagtagccatggtgaccgtagccacatgggtgttctgttgctgttttgcaggttcaaaccttgtactactcagctgatcacaagctgcttgatgggaacctactagatggacaggctgaggtgtttggcagtgatgatgaccacattcagtttgtgcaggtacacattgcacagtctgaggtaacctcaggttaaaatttgactagagaatttgatagcatacttaaattttcctttaataaaggaaagtggaccaatttcattggtataactggacagaaacatttttgggagaaaacaagcatatcttagagttagtatttttgccacatgaaaagatattaacaaattaggaaaccctattgaaatttttttctcataaagcaggaattacaaacagtaaaggccaataagatggaacaatatagaaattatttgggaagattatgaaaagcagttgtttgtgtcaggcatgactgatagttttttttaaaaaggggcagggggacttaaattgttgatggctatgaaagaaatttttggatgttaccttaactactgagctgtcttactggaaattagaaatggtatagttaagatggactatacaatgtaataagtctaaaagtggtggatcatatgttaaaacctgatctagatgtttctttaaccaagatgaattaaaatatagtagagttccactgtgctgattgagttac

SEQ ID NO: 4737 - DNA, 1565 bp, Homo sapiens
atttgaagtaaaccatataattagggaatatcttcagaaaattccaagtcttgctacatatatttaaattaagtgtgttttaaggctttggtatcataagtaactttttttttaaataggttgaaagcagataaggaattggtaaaagatgtttattctgcagcaaaaaagctgaagatggatcgagtaaagcaggtagagtatcagaagtaaataaaatcatttatggagtcttattttgtgtgattgcaatgctgaatttgtcataaaacatcttgttagtttcaaggacttgaacatgtcccttttttccctcagagtagtcaatatgttattttaactgtttggctataataatgtagcaagatcacacttcttctcagataatttgggctgaagtctgaccctttcagcaatcttctctggtagggtggctatgtcagcctttgatagcatgaattaaaattaatatttttcttaagagttaatcacataacttatatcctcaattctgtgttctcctaaacttcctgtgctctctaaaagtattccttctagaatttaatgccagtaaaaagtacttttggaaaacaggcatttaatcccctaatgcatgggggtcagtaaacttaaggcctactggccagctgcctatttttataaagttttattcaaacacagccatgtgtgttcatttacatatggtctacactgctttccagctacagtgacggaattgagcagttgtgacaaacagaatggcctacaagcctaaaatgcttttactatctggccctttaagaaaaagtttgatttgctagcccttcttctaataccactcctttgttcaaaaatccttccttaatttacagtacatatccctgcatttagtttctagattttcccttatatagttgctgtctttccaaaactatttcctagttatcttttctccaaccaaattaaattgtttgcagcatcttctctacttctgtctgcattcaacatcaacatcatctctcctgtagagcccagttcagatactgcgtttcatgaagccttaccaaattattctacttgaaaatacttatgtgaacttacatagcatttcaatttgttgtacctctccttaaactaaaacttacatatctgtatggcataattagatgtttatcatttgtatacgtgttattaccactattaacatttgttgtattaagacagtgatttttgattctttgtatcttcacatagtctttaccacactgaacattaaatatttgttgaataaaagatatgtaagtgttggcactcatatatttcttttccaaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaaggtaaggagtaaagtctataaacagatatatactatctagttccaggcgtggaatcttgg

SEQ ID NO: 4738 - DNA, 1035 bp, Homo sapiens
ttcttttttatgaaagaaatcagtggcaagatttgctctttttccgtccctccacgcttttggttaagtgtctctgattataagctcttgatgataggaaggtatcaggctgagggttgaacctagggtaacttgaaccactacttgagaactacatttactttttcccccaataggtagtggacatatctattggtttgagacagctgacatttcaaggagaaatcagatgtccaaaagggcgcatttttgtgatggagcgtgcagtgatggagcgttagaacaccttggcatcaagctgttcgttgagtgtgtcgtggtcttctgtctactaatagatgacaactctggaagcctagtaccactcttaacagatgaataagtacagcatggactagactgccacaggccatgctttcttttaataattctagcaccagtgattgatttaggaaaaacaaaatactgatgattacttttaggctaaagcctgctgacacttctgtcttaaagatactgaaagagtagttgtatttgttaagtctggacgtgaggtaaacatggactttagaattgaattgagactagtatcatttaacgccagctggcaggctgcttatcaagcttataatttggtagccagaggtaaacggaacttgagccactgaccaaagagagccctggaatggttttcctctgtgttttcctaatagatgatatctctggttaactaatagatactaatttctatagccattgtcttaatttgtagttgattttctaactttccccccaagacaaaacatttcaggttttagtcttagttttaaattagtgtctttttggctacttgcttttggaaggtgggattttttcttgcttgaaggatttgttagatggtaattaaatgtagttttgcaaatacgtttttaaatataaatgttttcctgttaaggaagtatcttaattgatattaagatgaagtaacactaagtaagtcatttcatccactttttagcagtgcgattgtatagt

SEQ ID NO: 4739 - DNA, 1042 bp, Homo sapiens
gtgaattatgctgtttgtggaattgattaccttttaatcctcagttggaattcatattaccctctttatttctgggaagctgtctggcacttggtaaatgaatagagaatgcatactactattacaataagctcaatctttagccatcataaaagtcatgtaatgtaacatctgcttgtttaggatattagttctaacactgaaggcctcttcttatatgaaattgtaagttgactttgtaaatttaaaatgttatgtgattttgtgactttgtatgttaatacagtttcctagacttgggcatctaggcttaaattggaatgccaacattttaagcttagtaaccttggtaattactttgttaattactttgtaattaacatccatagttggatactcaataaaattagcttgtatgaaactcttaagagcattttagcgaatgttttaagggtactgtagcattagaaagtttaaaggatgtctttaagttgtatttaaaattttgaggccaggtgcagtggctcacacttgtaatcccagaactttgggaggccaaggcaggaggatcacttgaggccaggagttcaggtgcagccttgacaacataacaagactgacccctgtctctacaaaaatgaaaaataattagctgggtctgtgttggtagccctagctccttgggaagctgaggtgggaggatcacttgagcccaggagtttgaggctacagtgagctatggtggtgtcactgcactcttaacttgggtgacagaacgagaccctgtctctaaaataaaataaaaaataaaagtttgagagatggatttttgcttgatggaataattaaatcgtggactttagtaaagttgtatatctccaataattaatatttttctttcacatccctgacttgttgataattttatgtttttttcagtcattcattaatattcagaattgtctttaggtttaggaatgtatgaaacacccctgttcctagctcatgaagaagagtcaggtggccgaagtgttcccactac

SEQ ID NO: 4740 - DNA, 1034 bp, Homo sapiens
tgtctttatcctttttgattgttacactgattctctaatggtctaacctttaggtaatttgtctactttattaaaattaatccagatttattaaatgttaattttagttttattttattttattaaatgtttactttaattttagtgtttttaatgtttatcataggtcgagctaagagctttatgttcattatctgaaatctttagaaaaaccattttagaaacaccagacttggaggttacatttgctctattaaccaaccaaaaaatagactcaaagaggttaagggacttgcccaaagccacacagcgaataagtacacatcccattgtctctgggtgtaaaacccacatttgcttccatcacacctcactactttacttctgaaaatattcgtacggtgaacattcctgttggcaagatttatacttctagggattgtccaagtttttttgtggtaaatttagcagttcaaaagtaaatttctcttttcctacaggtgaaggaaatacaggtgctgcagaatcttctttttctcaggaggtttctagagaacaacagccatcatcagcatctgaaagacaggcccctcgagcacctcagtcaccgagacgcccaccacatccacttcccccaagactgaccattcatgccccacctcaggagttgggaccaccagttcaggtattaaaagtactggtcattatgaaaaatgaacttgaaaaaaatcttggcttttctccctttccattatgtatttctctctctctcttggtttttttaaattagcaatcccatgaactttttggtattttggcatatttttataaaattctttgaactaaaactaatctctgagggatgtttagaaaggcaagtgttactaaaagttgtgcatacattgaaatggttatagtcatagcaaataaaattgttatttctcaagtgagaaaagaaaaagattttcttgggttttaattaaagtacattttcgcagctcaccattatctgatttgaaggtttctttctctac

SEQ ID NO: 4741 - DNA, 1060 bp, Homo sapiens
gatgggagatgagggtgaagatagtaatgaaggaactggtagtgccgatggcaatgatggttatgaagctgatgatgctgaggtaactggctagaattttaaccattcatagttctttctatgagctttctttcacttgctgttttccaaggatatagaaaggcttatgaaattcactaaaacctttggttgttttgttcatttgttttgttttttgttgttatggttacttatttgtttttgttgtggtttggtttggttaattattctgtccggtttttttaacatatttattttatttgagcattatgttaccacgttttgtttttagggtggtgatgggactgatccaggtacagaaacagaagaaagtatgggtggaggtgaaggtaatcacagagctgctgattctcaaaacagtggtgagatttttattagccttttttgaattgaatatctctggtattttctaaactagaattgcacttaattctaatatataaatttatttattgaattggtaaaaagagattggcccctgttctagctttgtgactgttgtgctctcataaaaagtctactatatttatgattgttaggtgctgtcattatactcttttctgcctcattgggctgctgtaagatgcaaacattttgtaacccttacggtattataaatgctatatgctgccattaagaggaaaaattaaattagggactacttgtaacagcagttcacaaccagaggaggtcagtctaatcaagctgcatgcttcaagatttggggctattggagctttgcagtatggtctgcttttccaatgaataaaagatttttggatcaatatagcatatattttgttaaatcttggataagtcctggaggtccactgaaaagttgtgggcattaaaagagtatggaagtcgtagaaaataattttattttgaaatgtgtattaaataattagtgattatctggtaatagataactaacaactgatactaagctgaaatcattagtgttgacatagtaaaaccttagctgtttagactaatggga

SEQ ID NO: 4742 - DNA, 1034 bp, Homo sapiens
cacagaactcattactatatgccaaatgttgatctaagaaatttttatttattaactaatttaatcttcattatacctcatagttacagaaactgatacccagataaagtagtgtaccgaagttcacatagcattggagctcagattcaaacccaggctgtgtagttttcaactgtcctaagcttgaaacagtacttttgtctgtataaactttctggatcatcttatgctataattattttatcatgtaaaattaaggaattgtctcaagctaaccataaatagccatatcgcaagtaaattttagtttcttagctgcgtttattttgtaagttaattttaccagctttctttgactgaaaacactaaactaaatcttcagatgattatgtagtacaggttgaacatccctaatttgaaaattcaaaactttttaggtgccaacattgcaagccacgtgtgtaatgttccacacctgacctcatgtgatgggccacagtcaaaacagttagaacttcattttatacacaaaactattaaaaatattgtgtcagattaacttcaggctgtgtgtataaacttcaggctgtgtgtatacacctttgtatatgaaacataagtgaattttgcatttatgcttgcatcttatagctgtctcattatggatatgcaaatattccagaattctaaaaaatccaaaatctgaaacacttctggacccaagcattttaaataacttattcagagcgtactataaatgatatctttttcatctatccttcagagagcattgtttctgaagaacataacaatttgaaaataataagattttctgccttcttgtcagacttggttaaattatactgaaatcttctgcaaaagctttttcttgaaattagcaaaattgtctgtgactccaaaataccatttggatttttattccacccctctagcattgtctactgaatgtgtaacagttcatttttctgattttctgacagtgaagcagacgttcttttcaagtgttgcttttt

SEQ ID NO: 4743 - DNA, 2807 bp, Homo sapiens
attttgaatctaaatattgtttttaattcctgaaggtaaggaatttgtatgttgagaattatgtatttatttcatgttggattagaaaataaatataaagaaaaaaaattcacaattaatacccctttgttttagccactattagtacattagtatcccttttcatacatgtaagcgacgtttttccaaagaaataatattatatgcttatattcttttgtatacttttttcacttgattcattatcatgaaaatacagttaagtgttgaaaattcaactataatgcatcattttgattagctgtttagtattcagttatgtggaaaaccataactagttccccatttttggagattacagttgtttcatagaaaattctgttttgaataccttcagggataaaatttctttgcaaagctgtgattattttcttagacaaacttgcagaaatggaattactgaatataaatatgtgagtgtattattactgtttgttgtcttaggttatggagacatcggctcagtcctctggagaccatcaggagcagcatgtttcagtccaggaaatgcaggaactcaaagaaacgctcaaccaagctgaaacaaaatcaaaatcacttgaaagtcaagtagagaatctgcagaaggtatgagtgtgagaacagtctgttcctaattctttcctgttatacacctaaagaaatatgtgttaactactgacactttgtcttaccatgtgggaatggatacattttattctttttactttgaatggctcatgtatgtaagtagtacccaatcatcttcaagtgtgcatttagttggtctgaccaccatttttatacttatacttccatttaatcttttaaaaagcaaattaataagttatactttaagttgctaccacatacagtttatattgaaatgattgaattccatggtgaatactttgttttcctttaaagacattatctgaaaaagagacagaagcaagaaatctccaggaacagactgtgcaacttcagtctgaactttcacgacttcgtcaggatcttcaagatagaaccacacaggaggagcagctccgacaacagataactgaaaaggaagaaaaaaccagaaaggctattgtagcagcaaagtcaaaaattgcacacttagctggtaaatatctgtttaaagtttgaacttggtagtgaaagttgattatgtgttgcaggcctaaaactaaatggaatagaaataaaaggtatctacttatgaagggtgtttgtgtgtgtatgtgtgctttaaatattaggaataattagttggacacaaagagcaatcctaattttcaagtgatgaggatatccttgatatgatgaaatttttctcaattgttggctggcagtagataatggaatactgctatccttctgctttcatggataacaattctatcttgtgacagagatcctttgagcccagaccgtgctgtctagaaaccttatgtagactgcataaagatctttaccagcccagggatttttttgtgcctcgtttggtggaggacccctctagcttttcagggagagtatcatgtcaaatttatgaagaacctagttcttcaaggctcagggctttattcagccttgcctatcagtctgctgagtagttaaataaaatgtcaaatcagttggattttgttacaggcatttttttaaaatgatctctaagacagtgtcctaacaacttacttgattttaaaagttcttgaattatttttaaacagtgctgtagattatatgaaataaaaattttgcaattcatagtaatgaattgcatgatacattgaaatataaacgggcttctgttaactaggatctttagctttttgagattttagttaggaaaaagtaaatttttatgttggagtaagtatattttatattctagtaataagttaaagcatgaatgtacttagaactttgctcattgagatgtatgatgtatcataactaatgtagatgttatagtagtagaatctgatgtgaccatgtgccaattaagtgcataaatgctgttttaaatgtttgattataatattaatataatcgcctggttacttctttaggtgtaaaagatcagctaactaaagaaaatgaggagcttaaacaaaggaatggagccttagatcagcagaaagatgaattggatgttcgcattactgcgctaaagtcccaatatgaaggtcgaattagtcgcttggaaagagaactcagggagcatcaagagagacaccttgagcagagagatgagcctcaagaaccttctaataaggtgattagctaattctgcttaagtaacaaattgtttttctttgtacattttacttgaaagtgcttggtgatataggagcctttgtcagtgaattttggctaaaattcaatatatgcggagagaattaacaataatgacaatttttttgtggcatttttagtggactcttgtgggctaggaacaacaatcaagagctttctctttataggtccctgaacagcagagacagatcacattgaaaacaactccagcttctggtgaaagaggaatgtgagttttagttatttcatagtctgttatttttcttttaaagctcagggaatatctagtgatctttctgtttaggaaaaagaaatctgtgtattctattgtaaaaacatacactaaagagttgttttctctgcagaactgtatcatgtatttgccagcttgttttcaccatactttcagtcctatcagatgaagctttgtgacagagaaaacg

SEQ ID NO: 4744 - DNA, 1034 bp, Homo sapiens
ggaaaagaagttgatggaagtagagaaggaaaaacaagaacttcaggatgataaaagaagagccatagagagcatggaacaacaggtaaataggttaaccgtattaattttttttttaacttgtaaggatttgaattctttcaactaagtcattagttgccatttagttcatctcaacagaaatttattgaacacataggcaaaattttagttttatgttttactcttttctgtacctctatatacatttcccgttgaaatttttagactactttacagaaataggtatcactggttctttttaaaagcccctacctgagacttgacttatgcaaatgttagggaatggatatggagttgcaaaactgattatatcagggtgtaaacattttaaatttagcagcagttttttgggctaattggatcttaaaaaatgagacttcaatttagtaacactacaatacagtattttccaagtaagtttgcaattaattttggttttaatcttgttctttctgcttagttatctgaattgaagaaaacactttctagtgttcagaatgaagtacaagaagctcttcagagagcaagcacagctttaagtaatgagcagcaagccagacgtgactgtcaggaacaagtaagtatagccaattattgagaaatgagcttcgatcctagagaatgattcttgaagtatatttatgcattataagaactggtggaccttacaaaaattcaagataatttccacttttgtggaacttagacaagacaaattgaaaagtatagatggaaggctaaaaataaatacatagggcaatattcattaacaaagcaatcttgacaatgggaaaataaaaacaggactaggagactaaaatttgtacttggctctcatttgcaaaaattattttactattgtccttcactagatctgattataaaattacagatacagttgattagaggcaacctttgctaacaaaacaagaacctcttgataacattgttaatgcattaccaagtttgcg

SEQ ID NO: 4745 - DNA, 1930 bp, Homo sapiens
ttcattcttgctcatctgtaataaaaagcaatataaaaattacattgcattgaatttatatttctgaattttaacttgaatataaatgtccatttgaaattattacttttaactaaatacttagttttgtgatgataaattttttatatagttttctttgttattcagttatctcttctgtctttgatcattacttgtaagctaggtatagttgtcccccattttacctgtgtaaaacagactcaagagctaatgtataatttgcctattttgggacagtcatgagagatgggttggttaggacttgaacccatgtcttataatgctcttataaggctgtattctttatttttatcttgctccaactccattgtgaggagtgggcagcagcactttttcaaactggtagagtgaattttatcattgatcatttatatgaatctgtgtgtaaatatgagtacttgtgtgtaaatatgagtactttgagctttcaaaacactctccctggtccccttgagactcagactcttggggttgaggggagggagaaactttaaatagatcaatcatcacttttaaacaggtactttgaaaccggcttggattctaaaagttacataatttaatagtagtcaggtatgaatgattacagcagtcatgcaattctgctttcttcttctcacatattaaatttttcttgctgttattttttaaactgtggattgttagagcaaggaaccataagtatttgtaattgaaagattttttcattgatgatccccaataatttttgcttcgtattttagcacatgaaactgttttgtatttccttatacaatgaggagatatagtccctaagagcattaaaaaaaagtagtgatgtatgaatcattttaattttataatcttaatacacttgacaccatgtttttcagcattttttatttcatttctacttatgtttaggtaagagcagaaaatttgaagaaggaaaaggaaatgcttaaattgtctgaagttcgtctttctcagcaaagagagtctttgttagctgaacaaagggggcaaaacttactgctaactaatctgcaaacaattcaggtaaccaaataaaaagcctatgtagaaaaaatgtataaaagttaaatttagattttttttatcctctcaatttccttaattagaaaatttatccatcacttttgtcatccattatgatcattgaattttgcagtttattaagacatttaaatattttaaataaaatattgaaagagaattgattgaaaccatacattggtaagtcctcaggtatatttacagtgtcctgtgcagttttactatttataagattaattctttggtttttattttctttaaaactttgggaaatctgaatgacgattataatacattccatctctttcctgtataatagatgttttaatataaaaaataccagaatactttcttgataaatactgtagattttagctgcttcatgtagaaatgggttgtaatattgtaattctttcttgccttcaatttttatttttttgtattgcctttttcttaagcataaccaaaaatcttttctttgctttagggaatactggagcgatctgaaacagaaaccaaacaaaggcttagtagccagatagaaaaactggaacatgagatctctcatctaaagaagaagttggaaaatgaggtggaacaaaggcatacacttactagaaatctagatgtgagtccatcagagttctgaatttctgtagggtgtttatgttcagtaattaatctggtgtgtggacagtctgccatccaagatgaagcatgattttgaaaaactttgttactaagtttttcttgcctcactctatacccagtaatttttttattgggtgccatatattgtgagttttaccat

SEQ ID NO: 4746 - DNA, 1027 bp, Homo sapiens
aacgttttgggaggcctaaatggggtatcatttgagcccaggaggtcgagaccagcctggacgacatagtgagaccatgtctcaaaaaaaagtaaaaaattagctgggtgtggtggcacatgtctatagtcccagctactcaggagacaggctgaggtgggaggatcacttgagtccaggagtttgaggctgcagtgaagcatgatcatgcaccacactctaagtgggacgacagggtaagaccctgttgcccgcaaaaaaaatctatgtgttcctaacagtgctagatacttgggatatagtgatatagggaggaaagaattgagcaacaataccaaacaaaaaatttctactccaagacctcaggttatgggtaagacagatgtaataaatagataataaaataggcaagtagacaatttgcattcactgtgattagtgcctatctgtgggatcatagcggtagaggacttgtcctagatttcagggagcagaccggcttcatggagaacctggagaacctatgtaagaattagtcagaggttttttcaaaatacatgtataatgtcttctagaagaggaagaatggctaagaaagcaagaagactagagtttggagtgagtggaactgatttaatttttacaaacaaatttttcagattgcattggtaagtataagtacctgagtcctgtgtggtggggatttaaaaagtagttcataaaatactcagcatgaaaaaaaataatgagagagacaaaaatggtatgatgaatggtaggcaaagatgcttggttaattacagtagaaattacaatcagttaactctcagttcagtcctgtgaattaggccgactttttctacagaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattaca

SEQ ID NO: 4747 - DNA, 1734 bp, Homo sapiens
aatgagattctagagcttaaatgtaatcttgaaaataaaaaagaagaggtaagttagtaaaattgtgtttttcttcatgttgagtataacttacatttgtatgtcagtttattaaatatgtattcagtagtgtgtacctgattagttgtaagatgagtggttaaatgtgaataatgcattacatttggcgtaaaaaatcaaccaattgcgtttacataaagaatttaagattctttgtcaaatctggttagtatctactgtcttacgatatatctttcctaaaatatgtgtttgtttaagaagtggtggtaagtttttgtgagctaaatctaaacattgttctgtgagcagttactcttagttttcttaaatatgcatattttaattgctttttcaggtggggagggggagttacttagcttttccttagcagcataaacctcatgtcagagtaatttcagttaatatgacatcctttccccctgctctattttttgtttttaggtttctagactggaagaacaaatgaatggcttaaaaacatcaaatgaacatcttcaaaagcatgtggaggatctgttgaccaaattaaaagaggtatatatgaccattaaaatgtcttttttacaaaatactaaagcacttacgaagctgttatttcacaaaatgatgtcattttttaatctgtccttggccccataaaacagtgagagtcctccttccatatgctgtagctaggctaaaatagaatcagaaatagcaattatatgttatattgaaaatactatctaaaaaatgagtatgggttaattttattgtttaattattttactttgaatttaaaatattagtaatattttatccttaatttatctttgtcatgaagactgatttgaatttgagtgttttagatttagctcttactttacaaaaatggaatttttcatcttgtcatttgataagcattctaaatttagttcaaagtagactgctataattgggctatttttttcaggccaaggaacaacaggccagtatggaagagaaattccacaatgaattaaatgcccacataaaactttctaatttgtacaaggtaaatatcccaccacacatgttagtatctaaatgttgcattgttgactgttaggtaactttttaagattaacttttagagtgccgctgatgactcagaagcaaagagcaatgaactaacccgggcagtagaggaactacacaaacttttgaaagaagctggtgaaggtaagtgttttcagttatgggaacattatttttgttattgtactctttttttttttttacccttgttttgtatagatgattggatttaggtgttagactttatttgggacagaattaggtacagaagaaagaactttggattaggaaattcagaattatatcttaagcaaatgtaagtttatatatttttgaaaatacagacagcagggggttttgtttgttttttatctaataatcttgtataatttgctgatttctaatgagaaagttttcttttttgaaacatttactctgataatgtttgaatactcttactttataaataagacatcctctttatttgcattttgtaaagtcttttatttcctcaaatttttgcttttttcaatgtattatatttatggtcttttccaataatttcctttacttaggattaaagatcaaaatcgaaatcaaagatatacctagaac

SEQ ID NO: 4748 - DNA, 1084 bp, Homo sapiens
aacctttgtaggcacaaacatcagtcaaattaaaatctaggtttggcagttcactcaaggcggtcaatttcaaaatgtctttttaaaaaagatgcataggcctgttttccttttattattgcaactaactgatctgaaaaaacttatagttacattatcacttctaacctgactgatataaaatagaagtttggtcatgaaagtaaattataatccttggggtttaaaaaggaggaagaaaaagaaatgggggaacatcagtatgccaagtggtaatcatcatcccccaaatcatttccatgtgtctgtgaaagcatttgtcactctgtccctctgtagagtacctgttaacctagttgtctcctcagtcgcccttctccttccaacttcttgagtgaatcttgcctaatgaaattactgaagtcaaccacatatttattaaatgaacagttaaatgaatgagagattacttttcattcaaatgggagacctggattacttggtgtggtagacagggtaattgttccccacagatgtctatgtcttaatcttctaaatttgggaatatgttaccttacatggcaagagggactttgaagatgtaattagattaagaaccttatgattgggagatttttttctggattatttggttaggctcattctcatcaaaatatgaaaaagagaggcaggaggtctgaaccagagaacaagatgtgaccatagaaacagagataagagagggaaagttagtgcagttgatgatgctatcctcctgacattggagaaatgtcttattttaagccacaagtttctagtaatttgttatagcttcaataggaaattaatacgtttgggatgtactgctgttcatctacctttctaataccttctcacagagcctgaatggaaaaactgttgtttacagtcatttctgttaaacactgatcttcttatcgggtcataggaaaaaaatgacactattcaattttctattatttaattatagccagactacaaaagaggatagttatttaccatccattcatttaaataatagctatacacttcatctcaagttcca

SEQ ID NO: 4749 - DNA, 1034 bp, Homo sapiens
tagtttgaagccattgtaatttgatgaaagggcacaaaggatcacaaattagctcccctgggtagattttctatttttagtcagctactttagtaactaaggaaacctattagaagtttttgaaaacgttttatttcttttcaaagtatactactgttgttttgtttattatttgtttgggggaggtggatatttgtttttcatttgagggtgtgtttttaattaaaaacattaagtgacatttctattcacctatacctagcatgtattaagagtgttatagaatttagtttatattgttttatgttcatttatgaagtgttctgtctgttaagcacaaaaatacatcaatgaggtaaattaatagtaatttctgcgcacaaagtaatcataatctctggagcaaacacataaaaatagatattagccatgaaacctgaccaatgatggacatatgaccactctttaataaagtcataatggaagacgggtatctcaggggaggtactgggaagagatggatcaaaaaagcttcttaaaattgttttaaaggtgaagaaaatttttaactaagtaaaaagggtggaagatttggcagcagaggcacatcaaggaagagggaacaacattccatttatttgattatcccaatttcctcacttgctattacaatattaataatacctacctcttaggaattacaaaattaaaataaaatgtaaacataaaacactatgcttagcatatcatagatgcccagtaaatttgagctatgttatagttttatactatgtttcaggagatttttagagaaaattttctttaaaataaaactattttgcttatttagcctatttgctagcaatcataaggataatatgatagaaattatactatctagattcacttgatacagacctatagaatgcgtatactcatttgttcagcgttatacttagtacatgagacacaaattcatctgtaagaagtaaatcccctataaaattaggttaccttttttgttattcagaatt

SEQ ID NO: 4750 - DNA, 1062 bp, Homo sapiens
tcttctaaaacgatttagtcttcttttcttattctatgtgttgttcctgatctttaagcctttagatgttctatttttttacattcctatattctctataggtttaaatactacctttctgtttctataattttaatattacctcgttgtgtctatacactgatgacatccaaatttataacctgacctcagactgtcttctaatatccaaatattttttatctctttctttacatttgtaatgaaacctttattttatatatttacagtataacacttaatttcctctaccaaagaaaaaataaaaaacaaaaacacctttccccccagtctccatatcttaatgacaggcaataatattcatctagttgatcaggccaaaaatatcagaggcataccctcccataactctcacatctaattgactagcaaaggagtatgggcttaatatttgtactacacgcatggtttaacttctttttccctccatttcccccactagtaacctagtcctggtcaatatcatttcttacatctttaatctgttctctctgaacagctacagaaatctgaaggaaactattaaagagcaaaggataaataaagaaagaagtaaaataggaaagaaggaagggaaataaaagaagagggaaggagaaagaggaaaaagaaataaaaaaagagagagaaaccaattcttgccattttcttgcttaaaacagtctaatggtttcccttaccttgctcatcatgccttaggtgattttgtcctctctctgcctcctttgtcttatttttctctgcctctctcattcattactctttacccataaagagtcaaatatttttatcaggatatggcccaattattcttccttatgctttatagaagcatttccctctttatttcttcagttcttcttatggtctgctccttcccatcattctggaaagcaacaggtgcccaataaatatgtattgcacaaatgacattctttgtaatcctcagtttctattctcccaaagtgagatattcacatcattttttaaaaagaaaatgct

SEQ ID NO: 4751 - DNA, 1093 bp, Homo sapiens
atgatacctggataagtgacagaatttgtgatgcttcaattttcaagtataagattttgctgaggatgatagtttgaagactacatgatagtttgaagactacaattttctacaattggagcatgaaagttgccatttctccaaacggaaagttttcaaaacttaacactttactaaagttatatggacaattcagacattaattagaaatgatgtagtcctgaaatagtggacattttttgtgaaatgtgaaatcttcttttagagggtaatgaatggatcactttggttaacttagggttacaaagtgattgtttgacatttgattttggcctactctgatgatggtggaaagtctatcaaactgcatttacttcctgaaccaaatcttttcttctcccctgtgaataatcagttattgcattcttccaagctctgacaatctacaactttttgcacacatgctatatattcttgttaaaggtgtacattcagggatggtaacacagactgtttagtgagtgtgatatattgggacaattgaaaacttaattgtggccaaagattgacagaatatatcaactcagtggaatagaaaattcttagagcagctgtttgtgtccatccttgcttcaagacactaatacacgctccttcttgaatagctttagtttttaagacatgaccacctgcaaaaccatctgtttgcttatttaatcttatttaagtttcatatatagatttgttataaatatgaatctactttggtccccaaatttggcttgcttgcaaacatattataccaacacagctgatatttgtataacctctcaagaaaaacaaatgccaaccccatttgaaaccagtctttggtttcattgtcatattgacctgggagtattttttttttctaatcagggattctttttttcttctagttaacatggtttgatacaccagtattttgctttaacattctgtgtatttgtgactattgtttcattactagtttcttagaaagttaatgtgtgttgtgtgtttcttagaaagctaacgtgtgtgtgtgtgtgtgtgtgtgtgtgtataaatgtat

SEQ ID NO: 4752 - DNA, 1027 bp, Homo sapiens
taacttttaaagcctataaaaatacaatctaggaccctccttttcttttttgtatattagaattgtattctaaaagatttcagttttttattagaattgttttctcatcagtactttgcaaatgtttacttaggttgtgactttgttgtcctcatacttcattgataagtttttcaatcttttattttccaattgacttttaagttaaatcatttatttttgtattatgtcagtttaatccagctcatttggactggagaggcgaagacaacacatagttggatagagtgataagttgacgttatagaactgaggtttcatgcttttatcgaccatttactctttgtacaaatgtataaaattttatcagccttctgtctttgagtcctcatctagtaaatgaagatgacagggaattctctaagtttatttctcactatgacattccattataattaagttttactggtcacctttctgacataatctatttgataatgttgatatgtaggataacatcactgtatatagaaattaaaagtttctaaatatgccgtagaacggactgcaggttttatttctttaaggtcaatacttaaattgttttgagtatagtttggtgatttacataattatattgaatgaacactgtggcttaacataaagatatcaaatttttctaatttctaaaattcgtgtgtaatttttttcaagataagtcctatttgcttgtaaaaagagaaacgatttaaataatgcaagagacatgaataaaacatatcagatggtaaagaaatttccattgttggatttccttagattatatttttagcaaatcatatgaatggattttcttttattttacaaaaattacaaatagctgtttcctataatcgaactttatacaatcaatgaatacattttatactacattgtacctttctaaaaatctgatttttgataactactggaagaaatacagtctgttatgttagcatatcttatattaaagtggttattcaaagta

SEQ ID NO: 4753 - DNA, 1023 bp, Homo sapiens
ttgcctggctgactgttcatgttttatagcaaagttcctgtccacgttcccaatcaggtctgtttatagaaagaatgaagcttgcttaattcagattagtcattgcagctgagttctgattgtttgatacaagttgggccttgattggccagggtaggtaagttctgattggttggtttccaagccccaaactagaagtcgctgtcagatgtttccaactgctggtggtgggggataaacctctcagtttatcttggcaaggataacagacattggtttggcaagccaaatgcggaaagggaggtcctgtgatacttttacaacatctttctgggaatgcagagtctgtgacccactgctccctcatgcaggtatggctgcctggttctgtttcaactttgaataccccagtttgccagagtgtccattttgtttgccagtagcagagatactttaaactagggaaagagaatgttttatactcttcagttccttttaaagattctcagagttctttgaatattttcttttcttttcttttcttttttttttttttgagacggagtcttgctctgtcgcccaggctagagtgcccaggcacgatctcggctcactgcaagctccgcctccctggttcacgccattctcctgcctcagcctcccgagtaactgggattacaggcgcccgccacaatgcccggctaattttttatatttttagtagagactgaatattttcttttagtcaagatacagaaggctggacaggcgcagtggctcacgcccataatcccagcactttgggaggccgagtgaggtcaggagtttgatatcattctggcctatatagtgaaaccccatctctactaaaaatacaaaatgtagacgggtgcagtggcgcacgcccatagtcccagctacttgggaggccgaggcaggagaatcacttgaacccgggaggcagagtttgcagcgagccgagattgtgccattgcactccagccttgggcaacaaaagcgaaa

SEQ ID NO: 4754 - DNA, 1021 bp, Homo sapiens
taccgtatcagtctttcagttttccatgggttctacattattcaaaatgaaagtaaatatgtttgatacaatggttttctgaaatgactttgcatattcaagttcttcagcaggttttagttcctgagagaatattttggatatgtaagcagcaaaaatcagtccaaatgcaaatacaaaaaaagaaatgatacagtttgcaatgttaattgtttaacaaatagtaataattatcactggacatctaattcagttgtggataataagatactgaggtttaaaagatgcaccactatgacatgacccaccactttaaaggatattaagtttaattcagtgattccgaatattttgtttatatctttgtagtttcagttctactggaaattcacttttactgttatagtaaatatttctttcataaatttcaatatttatgaatttcaaatatatatgatatatcagtattttagataaaagtaaggtaccaccaccttggaataagactactgacagctagtaagaaagaataatcatatttagactatatattatacacatattatttatgcatttattatgtattatatgcattagtatacattagtatatatgtaacatatttttgatgtattttatttctgcacagattgtcaaggccattgaggatttgcaaataaacttgtatcatgatgtggtcttcacagttatttttttttttttttgtgagaaagaatttaagagtaggacctatactaaatatctgcttttcaaatagatatttcaatatttatgacttattttttatgaaaaaaaccataaatacttaattaaacaccatgttttaaacataaagtcatgtttttaattttgtattgtttttaatgttttgtttttttgtgttcttcattctcttttatttctctcttttatataaaatcactctcccatggtccagaaaatatggtgcattgatgttctcatctctttagttggccagttagcctcttggttatgaata

SEQ ID NO: 4755 - DNA, 1052 bp, Homo sapiens
catggcagccactctgtctgtgcatataccaacacaaaacgcccaattcagttttcctgatatgtaatcatataaagacttgaatagttctgcagctgtggtgttggttggcaacaaaagtaaacacaacatatctgtcaggcctctgagcccaagcctgcatgtatacatacagatggcctgaagcaactgaagaatcacaaaagaagtgaaaatggcaggttcctgccttagcagatgacattaccttgtgaaattccttctcctggctcagaagctcccgcactgagcaccttgtgacccccgcccctgcctgccagagaacaatcccctttgactgtaattttccactacctacccaaatcctataaaacggccccacccctatctccctttgctgagtcttttcggactcagcctgcctgcacccaggtgattaaaaagctttattgctcacacaaagcctgtttggtggtctcttcacatggacgtgcctgacatttggtgctgtgactcggatcgggggacctcccttgggagatcaatcccttgtccttctgccctttactccgtgagaaagatccacctatgatctctggtcctcagaccaaccagcccaaggaacatctcaccaattttaaattgggtaagcggcctcttttcactctcttctccagcctctctcgctatccttgaatctccctctctcactacccttcaatctccctgtccttccaatttcagttctttttcctctctaatagagataaggagacacattttatccatggacccaaaactccgcgccggtcacggactcaggaagacagtcttcccttggtgtttaatcatgcggggacgcccgcctgattattcacccacactccattggtgtctgatcactgcagggatgcctgccttagtcattcacccacattcccttggtggcaaatcaattgccgggacgcttactttggcagctcacccacattgcagcccagggctgctcaccacccgcttctccgtgtcgctgccctctcttttctctgggc

SEQ ID NO: 4756 - DNA, 1031 bp, Homo sapiens
gatttggccaggcgtggtcattcacgtctgtaatcccagcactttgggaggccgaggcgggtggatcactaggtcaggagttcaagaccagcctggccaagatggtgaaaccccgcctctactaaaaatacaaaaattagccaggtgtggtggcatgtgcctgtagtccagctactcgggaggctgaggcagagaactgcttgaacccaggaggcagaggttgcagtgacccgagattgcaccactgcactccagcctgtgcaacagagtgagactctgtctcaaaaaaaaaaaaaaattatttgattttaatttttttctaatctggccttttagtgacatctggagagactgcttaatctaatttttcagactgtctctagatgaggggactatttcctataatctatgtaatatcagtgtatgaggaatcagtatttctattctaataatgccaatatgacctttcctaatatcttatgcctgaaatagcctatatctaacttacttgtttagaatgctctgcacacttggtacaacgtgaaaagtttttctcttagggcatacaggatagttattggagtggctgcattgcttatacagtgaacaccttgggtgatgcagttactcttcagatttcaggcagaaatttacttgaattaatgtttgtaataaaaaacaatggtgtgccaacttaagtagcctcattacatcttccatgagtaacttgctcactctagcctctatggccattctaagaactgtactttcttgccaattttattgaggttggtaaacacaacttcacagataagacagtggactttgtgcatattcttttattctaaaattgtaaccctatgttgtagtaagttggagaacagactactggatttggacttaggggacctgggattctagtcctgctagtctattaactattgtgtgatctttgcttatatcctgttatctgctgaaatgcactttgtcctttcctttgttgtaattttcaaatagcacttatagagcaa

SEQ ID NO: 4757 - DNA, 1098 bp, Homo sapiens
ttaactggcctaaatccaatgactgacatggtaaagattcaccacttctagcatactgggcactttttatttttgacttgattacattaactttttgaaaactattcagtgatttattcagccaatcttatgaggtacatctgagttgttctagatgctagaggatagtataacaggaaaaagcccctgctctcatggtgagacagataataagtatgtaatacaacttttcaaatagtagtatgaatggtaaaaaaaatagggaaaaggggtgggaggagctgaggtttgatagaatggtcatggaagatcccattaatgagatgtactttaagtagagacctaaatgaagataattttttctctagtactgaactagcactgtacaagtggattgcatataggcatataggcagaacttctctagtactgaactaacactgtacaagtggattgcatataggcatataggcagaaccaatgtgcaataattaagaatattaatttgcaatcatgtttgatggttaaatggtttattaatgttggagtgtcaatatgaaaatgggttgaataaaagatatatggaaatgcctaggactactgctctatttactttttagcttatccatatattttatgtaatatgcttctttgattctttcttgtagcaatgataatataatattgaataaaccataaaaccagtggggaaagtctcatgtaggtgtatttttaaaaaacattttgaactgtcccccgccctcccattataaccattaagactaaaacaggctgggtctggtggcttatacctgtactcctagcactttgggaggctgaggcagaagctcagaagttcaagcctagtgtgggcaagatggcaagaccctgtctcttaaaaaaaaaaaaatagctgggtatggaggtgatatgtgcgtatagtcccagttacccaaaagactgaggctggaaggtcccttgagccaggagttcgagaatgcagtgagttgtgatcagccactgtactccatcctggataagagagtgagaccctatctcagaacaaaacaaatgaaaacaatgaaattacttgaaaaa

SEQ ID NO: 4758 - DNA, 2275 bp, Homo sapiens
aattgtttcaggaaggtctgagtattatgcttcaaagcaaaatttcaggttaagaagaaattgtaaatcttaaagaatgttggtgttactctcaatggaatattgtttcaagcttgtaagctgtgtataaaaaaactggaggtctgacagttcatgttatctgcttttttaaaaagatggtagtggtgatgggggtctttctatgccaatttgaataaatttcgtacagcctgcagttttcaagagccatatgtaatttgctcacaattgatttttaaaaattgatttgggagttgctttgtaataatcttctgcttctaatcttcctttgcaagtcagactttaaagaagactttataaagctttcttttttaaaggaagtaacctacttttttctttatcaagaatatttctgaggttgatacatgactttaacattttattatttattgtaaaatcaatttagcataatttattttattagggagaatgtgtacccatcttccagcttcagcacatttttaaggattgtttttaagcttagtaattgtggtattaaatgacttagaactaatggagaaaaacctgataggaaattgatagaaaaacgaatgaaatatttttcatacataatttcagttggaggtaatggaaaatatgtagtctctcagttatttgtgggtaaatatgttttgctgttgatacagtaataattatggagtgttttcaaagccatgatataatttttaaaaatagatttttaaggaaggctcatcttgatctcattcgtttatttcagcttaatttatatattctttcctattgaggcttaaattttgttaagcaatgtgaggattattgtggtaagttgtatttagtaatcaatacagtgtgatactggcactaggattgacaaataaagcaatggaacagaagagagagcctgaaaacagatcaacgtttatatgatcacttgatttcgacaaaggtggcaaaacaattcaacagagaaggaaagtcttttcaacaaatggagccagaatagaatagctgaatatccatatagaaaaaagtgaacaatgaccccctacctcacaaaaatgactttgagatgaatcatagacctaaatgtaatattttaaaagtatgaagctttttaactgaaaacagatgatatttttgtgacttggggggttagccaaaggtttcttaggtcacagaaagcagtaaccataaaagatccaaaattagagctcatcagaattgtcattgaaagtgttaacaaaagtaatatcaaatgacatttgaaaaatatccttgtaaaatgactatattaataggtataaggatttttcttattaatctaataaaattccttaataggaatttccatagcttaagagtggtttattttatctgcatcttctttggtgattgcaaatcccttgtgatacttcatgattacttctgtctgtgaataaagaagtgtgacttgtctgggtgctatatgttgctggtttgaaattaagtcatgaagctagagggtagagaaaatggaagaataaagagcaacccataaatagataaatgctatttggaaagttttttttaaatgatattttatagaaaatcttgctcatttcatatttagtcttttctaaaattttatttaattattgggtaggtgaagtcgcttccattctattttaagccttcaaaatagccaattctaagggatgtacttctgttattatcaacaaaaaccttgccaacagctgcggcactggctactctcaccttatatgtttagttcccaagatagcttgcccttttccgaacagcagtcagctcgactgtgccactaaaacagacaaatatttgctcgggaatcacaaccacggggacttgctcccccagttaggaccatggtacatatttgtgtgtatattatggtgttacatgcagattaatactttcaattaatcctcctagttgcctgtaacgttaacatttcaagatgcatttagatatttttatcctgtaggaggattttgtttatttgagggaaaaaaagggcttttaatgtattctcctcaaaaaccatttagagaaaacagataagtaaaaataaaatttaaattaccatatttctatttacagggatgagcacattaacattttatgtatttagtgatcctttttcctcatgtgtacacatatgtttttgtgtgttagtcttgcttgccctccccatagtctgaaatagttctatgaa

SEQ ID NO: 4759 - DNA, 1033 bp, Homo sapiens
catttaattatgttgtaaagtttatatcagaaaccagtaaatttatttcttgttaatccttctcaatattctattaagtatactcagatcaataaggaaagaagcacatacttttattttaaattatgcctaaaaccaaattatatttattatttgaggacagaaaactttgtatgagatgcgatacacatatcaaattacaaattatgcttgttaactaaaaacgttgatgttggcaattaactttattatttttaatatgacacacagactatttgctcttattcattctaaggcacagcactgttttatcatactgttaaataataattatactacctaatacattacaaaaagagattgtaattgttttaattgctgtattttttatttaaggacgttttaaaaaaagttgtataatgtagaagtctaattcattgactcttctgaagtggcacagtggaaaaatattgcattgtagtactctaaaatcttgcttttagaaatgtcttctgaacaccagcagaactggcatcatctgagagtttgttagaaatacagaacctcaggcattttactaaatcagtctgcattttaacagggtctctaagtcattggtatatacattgagaagcaatgctataaagcatatgtctttgatctgtattgaggacttactgtatactagctgtgggactttggtcaagcttgataacatctataagctctggctttttcatttgctaaagaataaaacaagtactgtgttcaagctatataattgtaatgaagatctattgaactagtatgtaaaaacatttttttttaggtcatataaataaagtttgttgacaccaaggatacataatcctttagtgacattatgttaaagtcacttaaactgttatgttaaactcatttattcacatttgcagaaactaatgtaagatttttcttatgctcatgtgaataggaaatgggcaaatatgtgtatatatattgttttggaatactcatgaatgagtttgacttt

SEQ ID NO: 4760 - DNA, 1033 bp, Homo sapiens
tagcagaaatgtagttagtgtggattgatgttttattttcagattgagaatatcagaaggaagcataattatctgcctttcattatggaattgttaaagactttagcagaacaccagcagttaataccactagtagaaaaggtaagtattttattggtagatacttaaattaagtttagagtctccaaaaacataaaatgtattttttattttttgcttgaatagaggtaaaatttttggaagcttgtacgtttttattcttttgcttttgcctcttgttttctactctgtaagaattagttcaattgagactgtaaaacaaaaataaagaattaccccactgctttaggcttccagattcttagtgtcaagacctcaggttatgctgtattaaaataaaatttaaaacacttcctttaagcaaaagtagatttttaatgctgataattgaaataatattttcctatttagcaaaaatttgagttgatataacagaatttaaaagtagaatggacattgttgggtttaaaaaaaaaatagcctgtactacgaaataggttttcttatttctaatttagtatccattccactgagggaaaactagcataagttagtgaagaattctgatttctatgatttttttcataagtaacaataaaatatttgttgaataagtaaaatgcagttaaattgtttttaagttcatactgtaaatcagtgtttctgaaagtgaacatcagtggatactctttaaaatacatgttacctggcccctccccagatattctgatataggggaaggattctttaataagttccccaagtgattctaatgcaactggtctgtgtaccacagtttgagaaacactttgagaagacactactaggcaaataaaattttggaccattaacttaaagacgagaatacatggtaggtatattttccttattaattttaaagtttacaaagcaaagattgatttcaaccaagctgtttcatgttatacattctaaataatatgagatgtgagct

SEQ ID NO: 4761 - DNA, 1074 bp, Homo sapiens
ctatagttatgttggggccatttgttttcagtgaatagaactgtgtatgagaaactcttagagataaactaatgcaaaatgggctcatattttctatatattttcatcttaatgccatttacatagtgttatgaataatgcttttaatgtcagttgctaccatgaaccagcttgttatgagatgcttcattgatatcagagtagtgaaaatcaaacattcagaaattttactatacgatataattatatattatattaataaaatatgttatatttatttacatataagataaaatttaaaatatataaattaaaaatagaaagttcatcatgacttggaaaaaattatataatacggagcatagttaatacccatcaagatgccagtctaaataatttaagaaatatggagtctccatttgtttttttctgagctcttaagttaatgtgttgccatatttcttataaaggtagggaaattgatgaaaatgttttttatttcaaatgttttatgacattattttagaatatttaaaaaacatttgtgattgatggaatttagccaattttgtttttctacagttgtctttcctatatgaaagcttttttttgtttttttttttaagagacagggtcttgttctgttgcccagactggagtatagtgcactatcatagctcactgcagcctccagcttctaaactcaaaggatcctctccgctcctgagcctcccaagtagctgggaggcacctatgtgcctgacctgaaagctttttaaaagtgtccatttttattgctagccaattgatagacttttgtttatactagaaaatcaagaggggaatcacgatggattatcttaacggtaatagttgtacaattctttattacattataaacttaaataattttcttctaggtacagtgaaggtgaaattcgatttaatttaatggccattgtgtctgacagaaaaatgatatatgagcagaagatagcagagttacaaagacaacttgcagaggttcgtggccatgtttctaagtacaaagttctagcttggttattctctcag

SEQ ID NO: 4762 - DNA, 1417 bp, Homo sapiens
gtgaaaaaaaatatgtggacattgtataccctgtttgggaatttaaatgagggtggaaactaatgtgagttgggttcagaatttctctacaatcacacaggtgaattgaagcttatgctcggttataaaatactaattgaatttgaataggtagaaatgagtctaggaggaaatgaataggagagggggacaagctctgttggcttaatcagctatgttttccatcaggatgattgatcttgttaccctaactggattggtttttggtaatattatgagttcattgagttcatttggtttcctagaattttcaactccagaagtgcagcaaatttctgaaaatagattaggatagaaattaaacatatttattctgtttatgctgagacttcataaaatataatttgaaaactgttcatgttttggggccattgtcaccagttaaaaaccattttttatttttttaaacacattgatatcttcacttttatattttataggtaattaataatgcttgtgctactcaagccatagtgagtgtgttactgaactgtacccaccaggatgtccatttaggcgagacattatcagagtttaaagaattttcacaaagttttgatgcagctgtgagtacaatcttcttattcctaaaatgtcatatttgtgaaagtttgtatattaataggctactttaaaaaattattttagatgaaaggcttggcactgagcaattcagatgtgattcgacaagtacacaacagtttcgccaggtaaagagactttatgttaaataaatactgtttctttctttgcttctttgagtttcactatttttttatttactgtagacagcaaatgtttgaatttgatacgaagacatcagcaaaagaagaagatgcttttcactttgtcagttatgttcctgttaatgggagactgtatgaattagatggattaagagaaggaccgattgatttaggtaatgcagttcctgttcctgatatttcacttttgacaggggaaaatctgttgggtatttaccctcattcagtgctgcttaaattttcaaggtaaaagtgactatgaggtaacataatataatgaaggccttaagctcttcagtgtgttatattaatatataggaaggacatcttgactaccatagttcagttgatgcctttgagtttttcccaagtaaaattattttttaacctataggttacataatttatattttattttccatttaacatttaaaaactacccttagtgaacgtaaatagttactcttgtcatttttaacccattcgtaagggatagcaagcatttcttaacatccgtattaaagtattttcatttggaattggataatttattgttttgcaatcaagaaaatatttttcttaaaatttctcta

SEQ ID NO: 4763 - DNA, 1031 bp, Homo sapiens
ggttgctattggtattgctgtttggggtagatttgtcttttgggctttatatcagagttatgagcagactgcataccatagtgacaatattattctgggtttctttgtgtatttacttttaccagtggattttagaccttaaaatgttttggttttgcgcattagtgtttttttctgttcagattgaagaagtgcccttagcatttctcataaaacaagtctcgttgtggccacttctctcagcttttgtatgggaaagactttacttctcattcatatttgacggatagctttgctggagagagtattcttggatggtgttttttttttcttcttttagaatttgaaaatttcatcccactccctcctggcctgtatggtttctgttgagaaccccgttgctagatgaattgaagcacctttagatattgtttgcttgttttcccttactgcctttaggatcctctctttgtctttaacctttgagagtttgattattatatgacttggagtagttttctttgggtagttttattttttaggttgttgcctttggcataaagacaggcagttcactttcatctattaatattatatttagccatcctgctaaacttttctattatcactaataatttgtttttttttcttgagtgggtgtgtttttatcaaaatgaccatatcaggtataaataatgatagttttatttcctcctttataatccttttgactctaatttatttttcttgtcttagttcctagctaagaccctccaataaaaccacttgcaacttaaaagagaatgcctcttaccatttctccatttaggatgatgtttactccagcttttttatttttaatgttctgttattaattagtgtgtttattatgaaagtatattaaattttttcaaatcctttttctgcctctattgagatgatcttctgtattttcttccttttgctaggttaatgcagttaattatgttcggatttttctaatattaaatcattcttccaaacctgggata

SEQ ID NO: 4764 - DNA, 1029 bp, Homo sapiens
ccctttctctattgtatattcttggcacctttgttgaaaatgatttatctgtaaatgcatggagttatatctggattctctattctgttccattggtctatgtgtctgtatttatgctagaatcctgttgatttggttattatagctttgtagtctattttgaagtcagataatgtgattcttccagtttagttctttttgctcaggattgctttggccatctcgggtcttttgtgttccgtataaattttgggattgctttttctgtttctatgaagaatgccgttggtattttgatagggagtgcattgaatctgtccattgctttcagtagaattgtcattttaacaatattaattcttccagttcatgaggatggaatatccagtttttggtgaactcttcatcagtgctttatacttgtccttgtatagatcttgcacttctttggtaaaattgattcttaggtattttagattattattttttttttgagacatagtctcactaggtcacccaggctggaatgtagtggcacgatcttggctcatctccaccttgcctcccaggttcaagctattcttgtgcctcagcctcctgagtagctgggattacaggcatgtgccaccatgccaggctaatttttgtatttttagtagagataggattttgccatgttggccaggttggtctcaaacttgaggccaggttggcctcaagtgatctgcccgccttgggctcccaaagtactgggattacaggcttgagccactgcacctggcctactttatattctttgtagctcttttaaataggatttttttcttaatttctttttcagattcactgttggcatatataatagcagctgatttttgtatgctgattttatattcttcaacttttttgtttttgagacagggtcttgctctgtctggagtgaagtagcacaatcatagctcactataaccttgtgctcctgggctcaagcaatcctcctgcctcagcctcccgagtagctaagactac

SEQ ID NO: 4765 - DNA, 1073 bp, Homo sapiens
aaatggcatttataatgggattacctcaatatagagaggtaacactggctattttgtgctgatcatatactctaattcaagggggttgcgtgtgtgtgtgtgtctgtgtatcattggttaataaaatattgaggaaagaaatatatcctagtaattgcaatttgtatataaggatccagaaatgaaattttgataactgttctccctctgcaaaatattgtagtcttgttatttcactgatgagagagctgaggtgtgatttacttgcttaaaatcatgctgcagtggtactggatttgtgtgactccatgtgttcagtctttcaggaaagaatgactgaatacctacaatgtgccagatactgtggtgcttggagaatgaaaaagtgccatgattcctgccctcaaatatgcttagagtttcgtggaagcaattgatattaatcaattaaatgttaaattacaatgatgataagtgctgaatggagtgaaatgaggactatattacgaagtttaggaactgtccacaaaactaccctcactttgaacaccaactgtagagttcgaccaagaccaccttcacctctgacagcattgcaggtttgtggtggggggatccccagatcatcctcaggttctataattggttagaagactcatagacgttactgaaagctgctatactcatgattatggcttattacaacagaggaatatagattaaaattagccaagggaagagccacatggggtagagttcaggaaagttccatgtgcagagcttccagttgtcttctcccagtagtgtcacagacagtgctcactattctggcaatgctatgtgacaatatgcagagtattgccatccaaggaaccccctccgattcttggtgtccaaagtttttagtgggccttggtcacatagacctggttggccacccatgtggctggaccttagtctccagccccacaggaggttgagctgataatcttgacccaatacccccaccctaagtcacattattagactatcagtgtggcccaaagctctcaggtaaacaaagactcttaggc

SEQ ID NO: 4766 - DNA, 1114 bp, Homo sapiens
atccaataatatatgaaggttacttcctatatttaatatagataatatatgctatcaaccgtttatctataaacatgttacatgaactttatatattttggagttcagccagcttctggttttactatattcttattttttaagtgaggtaatatcaggtagaaatgaatagtctacagatttgagaataaacctttcactacaattttattttaactgatataattttaagttgtattagcatcttctaaggcaacagtctagtaactatgaatggcaatagtgatcttttaaaaatttcccatatttacttcatttgtattatatttgttagataactgactaaaattttatagattaacaatgtattatgaaagaagcagggtttgatgtcattaatttgtattttattttgtaggccagttcatgggttaatttttcttttcaagtggcagccaggagaagaaccagcaggctctgtggttcaggactcccgacttgacacgatattttttgctaagcaggtatggtccttggatactctgaaaagtctcaagagcaaccctttttataaacaagactctagtttactactgtttgctactagtgtagtagtcctcaaactcttacactcttaaaaattattgacatctccaattacagtcttaaaaattattgacatctcaaaagagcttttgtttctgggattatctatcaatgtttgccatattagacattaaaactgaaacattttaataatatttacgccaggcatggtggcttataactgtaatcccagcactttgggaggccgaggcaggaggatcccttgagcccaggaatttgttttttctttttctgagatagagtcttgctctgtcgcccaggccagagtgcaatggtgcgaggctcattgcaacctccacctcccaggttcaagccgttctcctgcctcagcctcccaagaagctaggattacaggcacataccaccacaccaggctatttttgtatttttagtagagatggggtttcaccatgttggccaggctggtctcaaactcctgacctctcaggtgatacacccgccttggcctcccaaagtgctgggatta

SEQ ID NO: 4767 - DNA, 1058 bp, Homo sapiens
ttgcctgggtctaatcccagctcttccacctattagctgagaaccatgaacaaattgttgatcttcctctgcacctcactttcctcaactgtgaagtggggacaataataggacctacctcaggattgtagtgaggtttaaataacacagtgaagataaattgttgagaatagtacctggcacacagaaatggttgctgtatatgaattggctacaattattatttattgttattgctctatgccaggcactttttgttatatcttttttctaataacattgctttgaaatgaaaaatatcctcaatctgcagatgagaaaaaatagatgatgcttagtttgagcccagaatcatgagagaccaaaatccataccctttccattatatcttaatttatttccaaatggtaatgtctagaattaaaatgattttttgtggttttatttcaggaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgtgagtatatcctctgtggtgctgttcctctttaataggttgtaaactagatcacccagagcctagaaccttgtgttaggaaaatgagccagacattctctgaggatagataaagcagctgcagatctaggaaccagattcttagaataggaaacagcagagttgatttattttatttttattctgtgtgtgtgttttgactggggttgatgagtagtgttattatgagtgcttgtctatggatctttgagttcctcttggagctcttggcaagatgaaagtattcttcctccctttacctgggcaatacaggggttggtcttcaattacttttctaataggagtgctttagtgctccatgtttttagattcttgaaatttggatttttccataatatgcataatcagaaaaatgtacagtgttgccactt

SEQ ID NO: 4768 - DNA, 1042 bp, Homo sapiens
cctactataaaggcactgttgtgtatccagcactatactatttccactagattatgatggcatgtttaaaacacaggagagttacaactagaagaagaaatgacatcaggaaagtatatttataaatggacctcctattaaaacacacaaacacacacacacaaacacacacacacattcaatatccaacaaatagagtaataaacgtttgttgctagtgttattgatattgtggatcattttacaaggatatattaatgatattattgttatatgtgaaagtttacagttgacagatgttttctttatatattaatgtgatatgaattttcacatttctgtcaaatagaagatggctgttattatcctcacttttttataggggctatgcagttttattgtggagaaagagttaggaaacattcaaaacagaactcaaatttgtgtatattatacatataaacttaatgtactttttattatgtcctgttggaagaaagagaaaagaatgcaaattccaaacatgtaaagagcaattgatgtgttttgggtttggatttcctaaaattaaccctcaaattcttctcatttctttttactgtagttaaagtgaggttagtaaagaaatgttacttattttatggaattattgaaaaaaaagatgagattcttacagatttttatgtacaaactatgacagtttctcttgggggtattcaaaataatgctgaataggctattaaatattgcttaactaatgtatacataggtttcagttcatcttgtagatgtatactttacatgatgcctgatacacatggctaagaaaagcattcacaaaatcagtgtttcatctcctacttggaaaagaagtgaatccctatgctcccatttaaaattttttattaatttatggttttgtgacttgaattataagtgatattagatgaacatagtatctttaatgtttggtttggcaagattattatttccacatatttgtaggaaatcaaactatcactcatagggacttatgactaga

SEQ ID NO: 4769 - DNA, 1033 bp, Homo sapiens
tgctgatcaaatttatagtttgacacttatataagttaccagcagaaaataggttagtttttctgagttgcttcttggtggtgtcactttagcttcaggagtgttaaatggagctatgtggcctggcacagtggctcacacctgtaatcccagcactttgggaggcctaggcaggtagatcacaaggtcaggagttcaagatcagactggccaatatggtgaaaccccatttctactaaaaaaaaaaaatacaaaaattagtcaggtgtggtggtgcacacctgtagtcccagctactcgggaggctgaggcagaagaattgcttgaacctgggagtcggaggttgcagtgagccaagatcacgccactgcactccagcctgggtgacagagcgagactctgtctcaaataataataaaaaaaaattttttaatggagttttgctgccgtctctcctcctgagtctgagtttttcttttcctgtggtggttgtggttcacactgcaaagaatgagacaaatcaagagaaaatcaggaatgactgactggaaaaacaaaccagacagttaaatatgtaagatgtttgtctagatatgcctaaaattttaagaatactggattcaaaacaatattatttaattaaaggttaagagaagatcaagtgctttcatacccaagtaattaagcacgatcatgatctgttcaggctgctataacaaaataccatggactgggtggcttgtaaacaacagaaatttaattctcaaagttttgaaggctgagaagtccaagatcagggcaccagttgattacgtgtctgttgccgacctgcttcctggttctcagataggcatcttctcactgaattctcatctggtggaaagggaaggggatctctctgagtcctcttttataaggctctttcatgatctaatcaccttcccaaagccccaccttcaaatatcatcaacattgaggattaggttttcacatatgcattgtggggtgatggagaacaaatatttagtgtata

SEQ ID NO: 4770 - DNA, 1044 bp, Homo sapiens
atgaggatcttatgacctaatttcagtggaaggtcagctaaattttatggcctgcttcagggaagaaggggtgagagaaggttagagtccatcctgctgctgctattttctcacatgtcaagctgacatattttggagtagcatgtcctgaatcccatcaccacaacactgtccttcaatgagaaatcaaaagagctaaaaacacggaaggataactagttcataacaacaatatgaaaaatattgtgaagttcattgactattccttgccatcttgaggagctcccttttccactgtcttctgtagcccctgtctttccactcaagcttcttctcaagccatcattacctatgtaacttcagaaatatacactccttgcagcctgtgtaatttttgtagcctgctacatgcctatacaagtttgagaaagtttgaagatttttatgcttattaaagcttacaaagactaaaggtttttcagactatatttgcctttctgtgcctggcttatttttcttaacataatgactgttatgttaagagaaaccatccatgttgctgcaaataacacgatttcattatttttacagatccataatattccgttgtgtatacatatcacattttctttagccagtcatctattgatgaacacttaggttaattccatatcttggccattctaaatgatgctgttataaacatgaaagtgcagatacctctttgaaatactaattttctttcctttggatgtatacctagcagtgagattactggatcatgtggcagttctattagttttttgaagaatcttcattttgttgtccataattgctgtactactctgcattcttataaccaacagttataagcgttcccgtttctctgcatccttgctagcatttgttattttttgtctttttgatactttgataataggcattctaactggggtgagatgatgtctcattgtggccttgatttacatttccgttatgattagtaatgttgagcattttgttgttttggggagaaatgagcag

SEQ ID NO: 4771 - DNA, 1085 bp, Homo sapiens
ctactacttaggccagatatgcattttctggatgcaatctgttggtttccaatggtttactacatggtgggctctattgacaagtaggtgacaaaatctttggcacactaactagtgtagtgtcctgtggtttgtcatgtgctgtgccttgttactgcatgatgagtgtaatttgccgtgtcagtattgcaaatatgatatattttgcatgtagagcttatgttctcgtgttatacatcttgtattaaactttctgagtagtaatctattgttgaattaaaacaaatcttgctgcatgtcaattttgtcagttttgctcagtttctaatgctgttttagttttgtgtcatctataacaacattattactattgacatagtggtagagaaaactaaagttgcaatattgtgatgcattgatagcgttacgataacttctggaaactttgaaataatttagaaatgctcattttaacttagatttataaattggagcaattcctttagagtttactttggtcacatgtcagagtttataatttctaaaatatttgttaatgaaaaggtcatatgtgtttaatacattagtaattaaatacaaattcttatacatgtattatggtgacattaaaaatatatataaaaataaaagatcaaaacgctaatatacttgaaataatatatgttacttttccacttctaaaaaatgtcagccagagccttcaaaataaaatgctaaaatttaccaattgagaactttaacacttacattttatcctgtagatgttgaagaaaacacagttttacaactttgaaagtatttagtgctgtggatacattaaaggtcaaacagtctaaaatatgattagcctccattctatgttaatataatttacctcatcagttatgataatactaaccaagtaaataaactgtagttagatgtactaaaattactatttaaattctacacatgttttataaccaatcatcttttttgaaatcttttgaggtaatagtgttctgttaaaatttattagaaaaacagtatatctaaaagctaaagaataaacgtcccatatacct

SEQ ID NO: 4772 - DNA, 1047 bp, Homo sapiens
aacctagtaaaataaaaaaatatgccaaaatatatgaaatagtttgcaagtacacaagtaatgttccatcatgttgtggaaaaaaaaaattctagaggagagagtgacacagaaaaaagagcaccagaaatctaaaaacagcgctttgtaatttttttctgagtattaggtcacacatgtacaaaatgaaactctaaaagccaggctaaaaacaaccaaagaatcataagcagaacaattctcagtgctcagacagggtgggagatattcacactctgagcagacatagtagaatgaccttggcgatcagcagggcatttgaaatcttatgagatacatagtttgctagtaagactgacttagccccagagcaaagggtactctaaatagatcagtattagttttcagtaataaaagcttaccactaacttttcaatttacagtgacacaaacctattatctgtgtttctgtgggtaatgattccaggaatgggttatgtagctcccctcatcaaggtctcaccagtctgcagtgaagatatccacttgatctataatctcatttgaggtttgacatcttagaactttgtctactaacactgcccttgaaagtttaaaaatccagcagaccttcaaggtatcaaactaattctaccaaaatgaagcaccccattttaaacattgtataagataacattcacattggccagtatccaattgaaatgactagacatatcaataaatgggaaattccaactgtgattaaggtagaaataaaacctcttctgtacaagcttatatccagaaaataaaggagaggagaaaaaaaaatttatagtgattttgtaaggccggcattatttgattaggccaaagccaaagacatcatgagaaaagaaaattgcaaactgatacgttttatgaacacagatgcaaaaatcttccaacaaatcagtagcaaatccaattcagtaatatacagaaagaacatactgttacctagttgggtttatcccaaggttacaatagtcatataacatttaaaat

SEQ ID NO: 4773 - DNA, 1032 bp, Homo sapiens
cagaggaatcaaacaataccatatagttctggaaatagaaatcaatcttaaagtatatatttaataaatattcctagtaacatgagaatatggtacatacataaaataagaatagtagactagatcacaaaacaaaacaagacactcagtgaacctgaaagagctcctggaaattaaatctagcataacaaatgaataatttaataaaaagcctagaaggtaaacctaagaacattgaagaatgaagaataataaaatgaacaataaaaccaaatagtgtaaaagaagaattaaaaagttgagaaaattatggtagttagagagaagcaatatcaatatagtaggaatttaagaaagggattttataaaacactagggtagaatattatgaaagacataatacgcccaaattttccacacaaaaattgtcaaattgagagggcccactcattatacaataaggactagaaaagatctgtgctggtcagggagaaggaaacaaaagaagaagccaaaggaaaaaggaaaaggcatatgaggaagaggaacaataggagaaaaagaagaaaatattcaaaactaagggtggaaaattggaatgtcttcagatgtctcatcagtaatggcagaagacagtgggacaatgctttcaaaattctgaagggaaatattttttcacttagaattttgtatcctggcaaaagtttggtctagtaagaaagtagaaccaacccaaatgtccttggaaccaacccaaatgtccaacaatgatagactggattaagaaaatgtggcacatatacaccatggaatactatgcaaccataaagaatgatgagttcatgtcctttgtagggacatggatgcagctggaaaccatcattctcagcaaactatcgcaaggacaaaaaaccaaacaccgcatgttcttactcataggtgagaattgagcaatgagaacacatggacacaggaaggggaacatcacattctggggactgttgtggggtggggggaggggggaggggggag

SEQ ID NO: 4774 - DNA, 1030 bp, Homo sapiens
gttcatttgtgctgctgtaacaaaatacttgagactgggtaatttatgaacagaaacatatttctcacagttctagaagaaggggagttcatgatcaagggctcacagatttggtatctggtgagagccttctctctcaccaagatgacgcattgtggcgtgtcttcacatggcagaaggcagaagagcaaaaagagggctagctggttccctccaacacttttataagattgctaattccattcttgagagctccagatttaatcacctcctaaagcccacctctgaataatgttgcattctgaatttaagtttcaacatgaattttggaggggacacaagcattcaaaccatagcaattatacactgattgctgtgttgcaaatcttacatcttcctccaacattgcaaaacacattttattattcatagtctcactttgcttttttttgttgttgttaatagcagcattatttctaatgtgattttaacacatttctaatttgaggacatctaacaacttttacgctgctctcttactgtcacctcatcaatagctttgcacaaatgattgattcatttaaggacttgttttaagaattgttttgtgtcttagtccattttgtgctgccataaaataatacctgaaactgggtaatttataataaatggaagcgtatcggcttatattgcgtttggaggctgggaatccaagatcaaggtgctggcaactggtgagggccttcttgctatctcataacattgtagaaaggcaaagagagagaaagcacacatgagacagagagagagaaagagagagagaaagagagagagaaagagagagagagagagagagagagagagatcgatcttgtgagggagcccattcccaggataccaacattagttcattcatgttggtggagcccttatgacctaaacacctcttaatggtctcaccttttagtgtggtacaatggcaattaaattttaacatgagttttggaggggacagcattcaaaccatagc

SEQ ID NO: 4775 - DNA, 1032 bp, Homo sapiens
atatatatatatatacatacacacacacacataagtatctattgctaaatagcaaaacacccctaaacttagtggcttaaaatagccagttggttatttctcaaaattctgtggttgatttccagggcagattttcttccagtcttacctgtaattactctttcaacttcagtaatggcctgaggagaaatggaggatgtaagatggccctactattatgtctggcaattggaagagaaccaagtaggacatcttagttctctttcacatggcctctcatcctctagtagactgtaccaccatcttcacagtgtggtggtctcagggtatcaagtaaatgagaaaaaagagctgcaatgtctcttaaggcttagcatctgcaaccacataatgtcacttttgtcatatttattggtcaaagcaagtcattagtccagttcagattgaaggacctgaagacatagacttcatatcttgatgggtggtacaggaatattatattgcaaaagaagggtttgtagaacatatgaagacttcatttgttggcagctattataataatctatcaaactacaggttatagaggtttctttaaacagtgagaatcccgcagcttttcgaacctgaggttgagctgtgtttaaagaatatgaatactgcccttatgagtacattatgttaaaaggacaaacaaaagacctggaagcacagtaggagacttttttggtagtttaggtctagaaaatatatatttgaattaagaaatatacattttaactataatcagagatcggcttttaatgcagactcaagcaaaagcaagcactcaatatttgaatcattaaaaatatatgttatctttcttctctgttctctagtgaagtataaagaagttaagcaaaaattgtttacactctcaaacatatgttattttaaataaaattttaaaacttgacttcacagaagtgttatacaattccatttttggtaatactagactacatttgaatattctcgtaattagtttggcaa

SEQ ID NO: 4776 - DNA, 1957 bp, Homo sapiens
aatgactcatatcaccaatagtaagagcttagttcctaagcaattaatcatgtaaataaaaccaaaagtatgccatagcataaaaggagtctttaagaaaggctaagaaaatatgacagagcacaagatgtctgatttatattgttgaggtgttccctagagtctccgttacttctttgttttgttttgtttcctactgaatttcatgcccagtgaactttttgtaagtttctatcgcctctacttctgtttacttcctacagatcctttttattttctgttgcttttaaaaattacaaattaatcggaagaatagaatcaccaacatcagaaagaattggagattggaagacacttgagtctggaggaaagagaaagactttaagactcactgcttaggagcaatctttaaactagtttatttatttattcataaagttgtatacatttatggggtacaagtgcaatgttattacttagctattttgagtagtggtaaagtccagcttttcactatatccatcactcaaataatgtatgttacacttaccaggcaatttctcatcatccaccctcttcctcccttctcactcttccaagtcttcaatatctttcattctacactcattccacatgtctttcaaagtcacgatgattgtgaagtctgtatatttgtatgtgataatgaattactttaagtatgtgtgcattgtgatcataaccatgaaatcaagtttttactatgcctgggtgttttaagttttgttaaagtcaagttgttttttacatttccttactctgacttttgttgcaatatcatattaattcataaataacactgaaaatattgaaatgttcattaaaatgtagtattttaatctctgagctatccttcaattaagtgcacatttaaaataaattgttttatgaatagccatatattatcttcaaatatattttgatctattcaaattgctttttaaaacagtgatatttgaaaatactaacgatgctcttttttttttttttttttttttttttttttgagacgaagtctctctctgtcgcccaggctggagtgcagtggtgcgatctcggctcactgcaagctccgcctcctgggttcacgccattctcctgcctcagcctccggagtagctgggactacaggcgcccgccaccacgcccggctactttttttgtatttttagtagagacggggtttcaccgtgttagccaggatggtctcgatctcctgacctcgtgatccgcccacctcggcctcccaaagtgctgggattacagacgtgaactactgcgcctggccgatgttcatttttaaatagcactttgagtaaaatgttaaaaatgctctagagatcatctaatgctatgtacttctacaaaaaaagcatgagtaattatgatttagaggatttatggagaaaatgaaagagatttgcgttttctatcataataatgcctggctactgcacatacttctgaacatattttacttacactgttatgcattttatctgttttcttattgttctcctgttttaatattcttttaaattcaaagatttttatcccaacagaagaaaaaatgtaatctccagggtatctgccgttctcattcgaatagtcttaaacctcaaaaatctataaacatatatatttacctgagacactttttgtttatatttgcttatttgattctatttatctatcctaaggttgtagagtatttaacacagaataattttattattttttctagttactttttgtggcacagtaatatatttttggtagttaacactagagatggtgtatacaatagagaatatagaaaaagataaaaggatacgtaggaagatagtactaacacttctatctgcacaaggggaattggttatgaaattcattcaaataaaatctgaaagtattttga

SEQ ID NO: 4777 - DNA, 1028 bp, Homo sapiens
tcttgcatttatctgacttgctccctttgttctagccattttaattccttttacttccctgagtgtactatatatacatatatttacatatttttctctttattcttgctgttgcttaaataagaaaatatcttccatgtgtcttctcatccaaccttgccaatcatattctatatggttccctgtcaaattcctactagcgctaaacatttgattaatttacttattggcagaacatggacatttcttctcaagatagtcctatggagtcctcctgcccatttttaataaatacatttacaattgctattaatctccagaagttcagatttagtttagttgcaattcttagtttgtggcacactctcatcattgtcatatggatagactttaatttatttcattcatttattacttcattacttaattaattaacttattaaaaatatacagacacctatgacacttgaagaaccaataccttataaataaatgaagtctaactctggactgctatactgtcttctctggtcttcctcacagaaataatttctatccttgttttggcttttcatacttttgctttaaaaagtatagcttaacagatatgtatgcatctgtaaataagttattgtttaatttttaaagtttttttgaactttataaaactgatcactgacatatagtcttaggcttgcatcttttattcaacgttaggtaactaagatttattcatattattgcatataaccatagattatgaactttgactgcaattttccattgtattaatatgccacaagttatccctgtcagtggatatttaagcttcgtctgtttcatatttaaatttgctctcatgaacagtgcttccttgaaccttttttttttttttttcggagtttcgctttttttttgccccggctggagggcagtggcactatctcggctcactgcaacttccgcttcttgggttcaagcgattctcctgcctcagcctcccgagtagctaggattacaggcacacg

SEQ ID NO: 4778 - DNA, 1050 bp, Homo sapiens
tttattgaaatgaaagtttctgagtaattaagcatatatccttcatatgctagaaatatatgcaactttcaagagcacatgctgattcacaagcagaataatggtttcctattaatattgttccccatgaaagaaatttaagcagcttttaaagtacttgaaactgtaaagataatggcctcattttcaaaaaatttgttagattattaatatcattcattttacgttaccctgttttgctaataaactgtcattactcacacgtgaatacttttgaacatatttcaggtaatttaacctaacttcatgttagtatgatgcatttttatgtctgtgcttcaacctttgtgttactaataccttatattggacaaacagaagacaagttactgaagcttattaatagctctcataagttctatgaggtacatctttttacattaaaatgaataaaagagataacttgccatttcaaacgctcttttgcttcttctacaagaagatttgagatatcctatagaacagtggtccccaacctttttggcaccagtgactggttccttggaagacagttttcccatagaccagtgggggcacagttttggcatgaaactgttctacttcagatcatcagacgttagttagattctcataaggagcacaccacatagatcccttacatgcacagttcacaatagagtttgcgatcctgtgagaaactaatgtcgctgcaggaggtggagctcaggtggtaatgcttgttcaactcctgctgtgggcctaacaggtcacagactggtactagtctgaggcatgggggttagggaccactgttacagaataaacacactgaggagtatgcaaaaaagtgctagacacagtccctgactttgtgttgttaacatttaaggaacagacaagaacacattggcttatccaaaaaaaactacatagtggccgggcgcagtggatcacgcctgtaatcccagcactttaggaggccgaggtgggcagatcacgaggtgaggagattgagaccatcctggccaa

SEQ ID NO: 4779 - DNA, 1018 bp, Homo sapiens
cttgtattttatctggaaaagggaataattgttcttaaagtgtttgactacctcatatcaaaaaacatatttatttaataattgaataggtggtatatttaaatatattactaatcaatatataatggtgcattggacattatctctcccaactttatggcatatctcatgtcctagtggttaatagtatagaattattatcagataattaataataaatcctgtgcaatcaaaaactgagtcttttaaaagtgacactcaagtgtaacacattagtagaatataaaatatcctgcttgttagaaaaaagatcagcaaagtttttctgtgtaaatgccagatagtaaatatcttagtctctggggccataaggtctcttattaaatatactcatttatgctgttgtaacttaaaagcattctctgacaatatgcaatgagtatgtttgtgcgccaataagactttgtatatggacactgacatttgattttcaagtaactttaacatgccataaaacattcctattcattatatttgttttgagacatttaaaaatagaaaaaaaatatcttagtttataggttgtaaaaaaagaggcaatgggcaggattaggtccctggatttcctgacctcactctgtagcaagttatattgttgggttatataatgtaattcattttatttctgtttttttcaaatgtattcaacatattgatttaaaacatatttactgacttctttggtttcgtatattctatttattacttaggaactaagagatataataattttggagtgataattagatattagatgctttttttatctcagtacagtcacctactgaacgaatataaatagatttttatttatttatatatttatttatttatttattttgagacggactctcgctctgtcacccaggctggagtgcagtggcgcgatctcggctcactgcaacctccacctcccgggttcactccattctcctacctcagcctcccgagtagctgg

SEQ ID NO: 4780 - DNA, 1024 bp, Homo sapiens
gtctttctttcgtatttctaaggcctgatttcctctcctggcaactggcaaggctagtgattaggacctagagtaaggttcctacatttttggcaattttggggaaagactgaaggttgaaggcgtagagtaattactattcttacatgtagtgctcaagtcctggatgttagaaacctcaaattttgggacagcctctaaataataaagtatttactcctttatgttaattttctacacagaaggtcaatggacaactaggatgagtttaaagcaaagattctgcactatatttagatggtagagtttagctaaattgaaaagaaaatatctggtgtgaaagaaaatagtattttattgggtattcaggtatttcgtttggtttccttgtttacttttgtcaatagcggacattgattgttaaagacattgagctaaaatagaattgccttgggagtaattagcaattcaggaaaaaaaaaaaagagaagaaagaaatcagaaccttactgtagtaatcaattcaaaatcaacgatatcatgaccaatttattatttttgtttttttcccccagttccctcaaattcagtattcaaatttctcaaacctagcacatgactctcccccatatttgctgctcctttcatgtccaaatttcttggaatactatctaccatgttattgtaaactaaaaaataaaattctaagtcctccaatcatctgaatggacccctcctcttggccaagagcatttcaaagttagcctgcaaaactagttcaggccatgatggtaaggaggtggacagacatgcctcaacataccctccttccttttgaatgcaggcacaactgaccaacattaacattaaaacagagatcttaagactttttgtagcaataaggtaccaaattccagcctgacactagtatagtgtcatgacagatagcaggtcctgaaataaatcaaaatattttattccaaaatatatatttctttgtcatattttgaaatggccctgaaaa

SEQ ID NO: 4781 - DNA, 1044 bp, Homo sapiens
cctcaggtcttccttctggctgccattggacaattcctctctctggaatgaataacaacctctgaagacatcccactccacctctacatgtcacatgatattcacctattttttgaccagttatcacttacataatctttatctcagcattttaggaaggctttttcgctatgcaaatctctgtattttataatcctgtataattatattttataatcctgtataattatattttataatcctatgcaatctgtattatcttctgtattttatgcttttcaaacctttattgtactctatttgttctactttatttagtttggacaagctgaagcaggtgacatggttcatctgtatccttgcctgatgcatcactgaaatgtaaatgaattggtggtgagagaataattcaaaggactcagtgtttgaaccaagcctagtcaatgctgtcaatgctgctgtatcttgggtgtttgtggaggcactaaggtagtggccaggactgaagaaattgggaacttgaccttataaggcagctacaaaacttgccctctatcattctaaccaacccttccaaacttctaaaaatctcagctccacttctgcaagtttatcttccctgcttgcataaaattgcagtgcctaatttgaacaccttcggtattcatcaaaaataccaaaggtgctcaaattagacattgcattttttgcgcatgtcaagttgaaatctattcatggatctttagctccttaagagaacatgcatataacattactttttactagcattcttccaagtactttacatgcccaacgagaaagcataatattatccccattgtacagctgaagaaacaggcatagagaagttaagtaatccgttggtgattacaaagctagaaaatggcagagccaggaacttgaaccctgtttttcttggccattaggcttgctggaaggggatactaagatgtaggaagggaaggtggagatgagggtctttgttgattttcctaaaaaagttggcgttgtactggcatatgg

SEQ ID NO: 4782 - DNA, 1059 bp, Homo sapiens
ccattctagttttcaaaaatcaggtcacttgtttcaaatccaataatcatgcataccttttgtattttataggtggcctttagaagtaattcaaggaagtcaactaatgcattgtagttgttaaaacattaaaggatttgaacatagtacaagtcaatccattaacagtttaagaggtatttacaaaaatagaaaaatatttccacagcatttggaatatgtgtaattttagatatacactgcaaaatatattgctttacataatcaaattcaattgtgagaatgggttttgtattgacatattaaacattttataaattactaactttatctccattataaattatatattgttttgaaaaacagccatttattataaaatatttattctaaattttaagttcaggttagtaaagacaattttaaatttttgagcgccattaaaatgaatgacacattatttttactctttaatcgatagtggcatcaactatgcatatacaatatctacaaaaatgatttaagcatttactttagaaagagagtttagacaatcctgtgtttcttatcaatatcgactttattaagaaaaatatccacaaataaggcaatagaaaattagaaacttaaacagataatggtataaaaaatagactttgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacctgggaggcggagcttgcagtgagccgagattgcgccactgcagtccgcagtccggcctgggcgacagagcgagactccgtctcaaaaaaaaaaaaaaaaaaaaaaaaaaatagactttgaatatatatagtgtaatacataaaatgcagagaaaaatgtattatttaataattattgtttttcaatcactactaa

SEQ ID NO: 4783 - DNA, 1050 bp, Homo sapiens
agaccttgcccctgtcaagacacagatcccttttgaggcatccctctctactcaccgaatgatttatgcagataatgatcagggcatttacttactaagacacttcactgttgatacccattctttctctgtgcatgttacgtgagtctataggggatttgaaggagatacaaagctatattcacaggagtaatagaacagtttttttttcttgtgaactggtaaagttggtttatatttatcttggtcatataattgtccttgttttatttctgcatatctacaaatttctcttgggagaaaaaaacaaataaatatcctgaattaaagaatatacagcttatatttcaatgatgtcattgatgcattttattcatttaactcattaccacttgtcgttagtgattaagaaacagagaactatatgtaacccagaatgcaaaagtatttaataacatcattgttaaagaagacactataacatttttggagtcaaatcaagtgtaaactcttttgaagtgtctccaagaagataacaatacagaacaacacaaaaatcaaggtagaggatctgagtagctttatactgcagtcctctcatgcctaagatttacgtaggttgggataagagtacagattttaaatctctattcaattccgttctcctttcttttctttgcctgtcatgaaatcttttagcagaaagccgagccgtgtctgcccctgctagttcagctaagatactgcctgggtaagttttttatactatcatttttctgactgtaaacataatgtactttcagtgaagaaaatttagaatgaacaaagaatcataaaacaaggaagcaaaagctcaccccaaataaaaaatccgagatataattacaactggattatgatgaatagaaaataggtatgtacatgtgtatacatttgtatatattgtgatggcaaaatatgaaaataatttagaattggcattgtctctagaaaaatagatctgtgtggatataacacatcatataagcaacatataaataaatattaata

SEQ ID NO: 4784 - DNA, 1807 bp, Homo sapiens
tcctagacttactagcatcatatgtattttgttttattttcgagcaagctcttcttcctctcaaggagcatgtaatagagtaactaattagatcctgcctttatcattatcttacctatgattaataataccacagataagttatctttttccttagagattcttactaaagtggtcttatctttaaaagtttgcttttattgacttcaagatgtttgttttcagaggttttaaatttgatttattttatgtgaaactttagaattagggggaaaagattaagattaaaatgtgaatacacatatatgatagatccgtaaataatgataatatcaaagctatttcacaaagtcctttgcacttgctgcaggtggtccaaaaatttggctatactaagtatggacttttgtattttgtttttttggttgggttgtttgtaaatgtatgtgtttattacaacttttaatttcattctgttctcttcaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgtaagtattagtcagttgcctttctttaagattatttttctgtggtcttaagtctatgacttttatagttttcctttagtaattatcactctaaaatagggttttatgtgtgttcaaacctgctttttgcacggataaaatgaattcaggatgtatctatgagttgtttctttctgactattaaagaaactgaattctgaaaataaatttattacagccatataagtaaccatttcccatttactagagagaaaagtatcctagcaagatagaaaaccagataggtataacttcttatcctcctgttgtaaccataattgtatttcaagcttttctacgatgagacctctgagtcattctttttaagtgtcataattaacatggggaaaccataggccataattggactgtggcctttatcctggtaagtgggaaccgctgcagggtaaagcaagggaataatattttccaatttaaattttaacaacactctggcttctgattgaagaatgaatttgggagagcatgtgtggatatagtgagaccatcaaagaaggtggcaagtgttgatatgtagtgatctaggcaagagattgtgcttgtcttaggattgtgtcgctgagaggtaagtagaagactttggaaactgcagaggtaaacttttcaagacttggtaactggatatgataggtgtgttgactataattgctatgttgactataataattccttcttatattcagtgtggagttaagtatgcaacttttgaatatttatcttccttataattgccttgcaaattagctcgtaatttaaatcaatctacctgccaaacttggtgaggtttctttgattattcaaagcttaaaagtttactgcaggctgggcacggtggctcacgcctgtaatcccagcactttgggaggctgaggtaggcagatcacgaggtcaggagattgagaccatcctggctcacacggtgaaactccatctctactaaaaatacaaaaaaaattagccgggtgtggtggcgggtgcctgtaatcccagctacttgggagactgaggcaggagaatggcgtgaacccgggaggcagagattgcattgagctaagatcgcaccactgcacttcagcctgggcg

SEQ ID NO: 4785 - DNA, 1032 bp, Homo sapiens
gattatgaaacaaagaaaactgcaattgtggttatacagaattattataggttgtatgttagagtaaaaacagaaagaaaaaactttttagcagttcagaaatctgtacgaactattcaggctgcttttagaggcatgaaagttagacaaaaattgaaaaatgtatcagaggaaaagatggcagccattgttaaccaatctgcactctgctgttacagaagtaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaatagcaccataaaaattcaggtatttctatatttaatttaaatataaaactgtgagtctttcttttgaccaatatttgttagaatgtataaaatgagcttaagcaggtcataaagaatagtacttagttgaggtgaccatttatcttccaaagtggaacatttttgaaagagggaaagggcactagtaagtcagccaagacagcacagaacggggattgttctggccatggtcaccctatgtgtggtgcatttcagtatgggttaattgtagcactcttagaagaattttgagaaaataggagtcctgtatttggcaaagttatttctttaagtggaaaatataagctaa

SEQ ID NO: 4786 - DNA, 1863 bp, Homo sapiens
ggtcaatcagaggaagaacttcttgcaagtcaaaaaagcagctacttgcttgcaagcagcttacagaggttataaagtacgccagctaatcaaacaacaatctatagctgctcttaaaattcagtctgcttttagaggctataataaaagggtaaaatatcaatctgtgcttcaatctataataaagattcagagatggtacagggcgtacaagactcttcatgatacaagaacacattttttgaagacaaaggcagctgtgatttccctccagtctgcttatcgtggctggaaggttcggaaacagattagaagggaacatcaagctgccttgaagattcagtctgcttttagaatggccaaggcccagaaacagtttagattgtttaaaacagcagcattagtcatccagcaaaatttcagagcatggactgcaggaaggaagcaatgtatggagtatattgaactccgtcatgcggtactggtgcttcaatctatgtggaagggaaaaacactgagaagacagcttcaaaggcaacataaatgtgctatcatcatacagtcatactatagaatgcatgtgcaacaaaagaagtggaaaatcatgaaaaaagctgctcttctgattcaaaagtattatagggcttacagtattggaagagaacagaatcatttatatttgaaaacaaaagcagctgtagtaactttacagtcagcttatcgtggtatgaaagtgagaaaaagaataaaggattgcaacaaagcagcagtcactatacagtctaaatacagagcttacaaaaccaaaaagaaatatgcaacctatagagcttcagctattataattcagagatggtatcgaggtattaaaattacaaaccatcagcataaggagtatcttaatttgaagaagacagcaattaaaatccaatctgtttatagaggtattagagttagaagacatattcaacacatgcacagggcagccacttttattaaagccatgtttaaaatgcatcagtcaagaataagttaccatacaatgagaaaagcagctattgttattcaagtaagatgtagagcatattatcaaggtaaaatgcagcgtgaaaagtacctgacaattttgaaagctgttaaagtccttcaggcaagttttagaggagtaagagttagacggactcttagaaagatgcagactgcagcaacactcattcagtcaaactacagaagatacagacagcaaacatactttaataagttaaagaaaataacaaaaacagtacagcaaagatactgggcaatgaaagaaagaaacatacaatttcaaaggtataacaaactgaggcattctgtaatatacattcaggctatttttaggggaaagaaagctagaagacatttaaaaatgatgcatatagccgcaactctcattcagaggagatttagaactctaatgatgagaagaagattcctctctctcaagaaaactgctattttgattcagagaaaatatcgggcacatctttgtacaaagcatcacttacagttccttcaggtacaaaatgcagttattaaaatccagtcatcatacagaagatggatgataaggaaaaggatgcgagagatgcacagggctgctactttcatccagtctactttcagaatgcacagattacatatgagatatcaggctttgaaacaggcctccgttgtgatccaacagcaataccaagcaaatagagctgcaaaactgcagaggcagcattatctcagacaaagacactctgctgtgatccttcaggctgcattcaggggtatgaaaactagaagacatttgaagagtatgcattcctctgcaac

SEQ ID NO: 4787 - DNA, 1048 bp, Homo sapiens
caactcttataatccaatctatgttcagaaaatggaagcaacgtaaaatgcaatcacaagtaaaagctacagtaatattgcaaagagcttttagagaatggcatttaagaaaacaagctaaagaagaaaattctgctattatcatacaatcatggtatagaatgcataaagaattacggaaatatatttatattagatcttgtgttgttatcattcagaaaagatttcggtgctttcaagcccaaaagttatataaaagaagaaaagagtccatactaaccatccagaagtactacaaagcatatctgaaaggaaagattgagcgcaccaactatttgcagaaacgagctgcagccattcaattacaagctgcttttaggagactgaaagctcataatttatgtagacaaattagagctgcttgtgttattcagtcatactggagaatgagacaagacagagttcgatttttaaaccttaagaagactattatcaaatttcaggcacatgtaagaaaacatcaacaacgacagaaatataagaagatgaagaaagcagctgttataattcagactcatttccgagcttatatttttgccatgaaagttctagcatcttaccagaaaacacgctctgctgtcattgtgctgcagtctgcatatagagggatgcaagccaggaaaatgtatattcacatcctcacatctgttataaagattcaatcatattatcgtgcttatgtttctaaaaaggaatttttgagcctaaaaaatgctacaataaaattgcagtcaactgttaagatgaaacaaacacgtaaacaatatttgcatttaagagcagctgcactatttatccagcaatgttaccgttccaaaaaaatagctgcacaaaagagagaagagtatatgcagatgcgggaatcttgtatcaaactgcaagcatttgttagaggataccttgtccgaaagcagatgaggttacaaagaaaagctgttatttcactacagtcttatttcagaatgagaaaggctcggcagtattatct

SEQ ID NO: 4788 - DNA, 1050 bp, Homo sapiens
ttgattggtgtttaacatatggttatcttacaaagaataatttaaggtcttaagtgagtgtttaatttacatttgctgacttttttattttaggagagagagaaagctgcaagaattattcaattggctgtaatcaattttctagcaaaacaaagattgagaaaaagagttaatgcagcactcgtcattcagaaatattggcgaagagtcttagcacagagaaaattattaatgttaaaaaaggaaaagctggaaaaagttcaaaataaagcagcatcacttattcaggtatagtatcctggactaatttttgaatttaaaaaattttaatgacttttttaagtaagaaggcaaaatgtgatgaagttttcaatgattatattttaggattctttatctaatacttaatttaacaaatatttactacctgaaaagctcgttatggtgttcagcagaaggctgaaacataattgaaatgcatttgctctgaaaaagcaaacattctaattctgtacctgttgctctcttctttgttgcgtcttctacgctgtgggacatgctggcctactgaaccattctactttgtagatccacataaccaaccaggttcttttttatctttgctttgagtcctggaaacttctctttgggacaactgtacacatttttctctctactccacttagttggcatgtaaaggaaatagtacttataattagtctatagaatacctatattatttttctttttaggaaaaaatatataatactgacttaatatagtctttacatctatgtaaattagtttttttatattaaattatattttaatgacatgagagatgtgcattatttaaatttactatttataaatgccattgaagcttcaccccatcaatatatctgatttatgaatttgaaagtttttgtgtctggctaccattattgataaatgagggttctctgacttaaataattgtcttttttaacctttttttaacatgtaaaatattacacatagaaaattacccaaaataaaaatatagagcct

SEQ ID NO: 4789 - DNA, 1035 bp, Homo sapiens
caggtgatccacccacctcagcctcccaaaatgttgggattacaggcgtgagccaccgcggctggccagaaagcccatttttatgcttttacaggagttactgaggatttagcactgttggatgttgatgttatttagtcggttaggaattctaagtagttaagagatcaatcttgtataaccaaatttctgttttgataagtgtcagcaaaatgactgttttataaatctttgaagtcacttgagaatgctttgggatggttactctattaatgccatgggtgatgggttggtctacaattgactggatggttggcctagaattatcttaagtctctttctagcctttagagactatggttgtataagtaattctaccagctttttgttgaagacagaaatcagttggggtttgctttttctgtctttgttaggtagatactcaaatattcgtgcgtgtatatatacatatatttttatatatatataggaattactgtggaaacaagtaaaactggattttagttctcatcttagttttgccattaccagctctatgaccataggcaattcatttaagctctatgggccttagtttctttatctaacaataattaattgtgcgctttaccatgataactaaaataagaaaataaagcacttgcttgatgtgtacaatatagtacatcccaataaatgtgcttcctctctgctctacatccctctcctctcttttctgtcctttcctttctttctcttttctgtagagccctattattttgttgatgtgtgcatttatatatgtatatcttattttcttatcatctgttcacacacttcaatcccaaacttaaaataagaactctacttgccgactatggagcaacagagttttgagatagttttttgaagtctttctgatcataaagccctgtaactgttgggatttatgtgggaaataactatatttcagtgaagggttttttcatatacgtttttatgataatttcatctgaacattttattactgccagg

SEQ ID NO: 4790 - DNA, 1030 bp, Homo sapiens
ttatatccttatcaaggaagcacttttggggtcaaggcaagagatttctttaaagcaatgaaagtttttttctctgtgtatttaggaagttgctatgcctcaaaacagctagttaaatgttgacgtatggggagcacagatttaatggtctttataaaatatctctgctacagtaaaacttaacaaactctttagctgaccctggtacatttttgtcagattttaaattgcttgtattgtagctaaaattaattgcaggcagtcttcatgttaaaattcatgttgtctaaaactcaactgaataggaaagaagctatttggatatactttttaatttctttgtttcgactagagataactttagagtataaactagaaaaccttatatccatgtttcatggagaccaattgaaagaactgtgaatatttagagaaatagaacagaagagaaaactctggggcataaatgttttaagatatttgaagaactgtcttataataaaaggtgattaaattgtttattgccaagcaaaataagtatgcatgaacaatgaaaatttcaggaagatgaatgtgggtttggtttaaaaacttgccaatattcagacgtgtctttatcaaacaaccagttcacagtgttggaaggttcaagcagaggtcagaggaccgcttggccagaatggaggaattctttgacatttatgaggacaagatcctagatttttatgaatctccggtttttgaaaaacagtttacatgtcccttgccttcttttaggctaaatttccatgaacattcttttctttctgatcagtattctcacaagttaatagtctttttactgcagctttgtctcactttagcagttccatatgagctaagatcattttgcttaaaatatttcacatttttttagttggttaatttgtttatttaataaattcaagctaccacatcaatattctggccaataggaattgtttttatactttttccactttctaggaggaacaaggattggtttaatgtt

SEQ ID NO: 4791 - DNA, 1025 bp, Homo sapiens
ttattctctatcacttttctaataagttggtattaagggttgtttcttccactattaaaataactctcctctgatttgtctccattgactctgttttaatttgtctcaccatatccaccttgggtcattgtaataactgctttgtaattttctgtttctaatcttgaccctgttcattccattgtccatactgttttcttaaatataaatgagggtttttacttccttgattaaaattcttcactagcatagaaggtgcttcaaagtgattaatagtggaggttctgtaactatactgcctttgttcaaatctttgctacttactagcttatgtgaccttagaccatgtggcttaattgctcaaagcctcagtatcctaattatatacattgtggtaataatagtacacttctcataaatttgttctcataactgtgtgagaaaaagattatgatagtgcctggcacaaagtatttaagtattagctgccactattattttgaatattattgaactcctccctacctcttctagcctcttgtatgtcatttcctacgtgtattctttgcttcatccttattgcagttctggcaacaggccacattcctcatgcctaattttaatttcataagttaactcaagtagattcccatctgggaaggctcttctaccatttttaaacttctttttttaccagactgagaactacttcagggctgagaccatatttttcaattctgcatattctcagcacctcgtagagagtctggaatatacagacacaataagttttggttgaatctagactttagcctctgtaaacacaaaataaattgtggtttatggtctgtgacttctggatgttggtttgataaaccactgaattcatagcattagtgcgtggagtacagtggttattaagtgtttgctaaatgaatatgattgtgaagaacccaaactttaactttcaaatcactgacctatttagggaatttgtattttaatgctcttagttttgttttcta

SEQ ID NO: 4792 - DNA, 1027 bp, Homo sapiens
tgttcttgggtgagttacttaacctgtctgtgtttttgtttcctcataagtaaagtgagatgatgctaatgtgatgctaatagtaccttctcatggggtagggaaaggttattatgaggattaaatggggtaattctagggaatcacttaaaatattgcacaaaatgtaggtgttctagcatatttattgtctctaagctgccaaacattattaaacaaatatgaaatgatatattctctgtcatcaagaaccttagagtttaatgggtacatgaaaaaacacaatcatgttacaataaagataattttatcaggataagtatagaagactaaggaaatcaggagaagtgtctcagagcagatagtatttgagctgagactcaaagaatagggaacagtttacaagacagaaggaccagcatgtgcaaaggcattgaggtatgttgtattctggaaattgctcaagtgtgagtggtttcaaggtggtcagggaggcatagtgaaaataacaggagatgaaggtgggcaagaaagtggtggtcagattttgtatgtcttgtatgttctacagaggtgtatactttggacaatctaatttaactagactagactttattcagtaggtgatagggactgttgaaaagaattttacaaaggaaaccatggcctgtaagaattttagaaagatcatggtggcttcagtgtggagaaggaaattggaaaaagggatgaaaaaagagccagggagacaagaaggagcatataacaaaggaccagaatgataatgtagcttagacttggaagatgagtggcgttgggagtgggatgtagaatgagagtaaagcagagagttatgatacattgaatgtagactaagtagactggtgatgagtagaatgaaaagaatatgtagcagaagatccatgtgtcttaagtgtcctctcttaccatctttattattagaagtacagtttatttaaaaaaataacaacacaggagttcgagcgccaccttcccattattctca

SEQ ID NO: 4793 - DNA, 1053 bp, Homo sapiens
agtgaaccaatattgatattccatactttattcagattttcttagttttctcctaatatccattttccacatcaagatcctattcagaataccacactatattgagttggaatgtctccttaggctcctcttgcctgtgacagtttcttagactttccttatttttgatgacattgacagctttgaagagtactgtcagataaattgtagcatgctcctctcttggagtttgttgggtatttttttcatgattagactgggattgtgggttttgaggagatgatcacagaagtaaagtgccattttcatcaggtcatatcaagggtacgtactgtcaacatgatttgtgaatgctgacagggaccttgataacctggctgaggtagcgtttgtcactctaaagttcttcctgccctttccatgctgtcatttttggaaggaagtcactacatgcaggagtgaggagtcataattccccttctttagggcagagaagtatctacataaataactgggaattctgtatagaaaatttgtttcttctttctcaaattcactgttgagctttggaattcatctgagaaggaatcatgtactaattacttcatgatagactagattaccaggcacaatcagggaaaaaagcagtgatagtatggttaaattgttattagcattttcagtatatccactttatacatccccaatcatgattttttttacatttctttttagaaaagatgttcaagaaatcattaaagaaccccaataagactatattctaaatatttattgaaagaatataatttcagctaaaatcctagaagagggtttgaaataatttaaagaaaatgaccaagtttttttaaaacctacgtttcaaaatctaaatggatatgtgttatttgggacacttattcattatgattatataagaagacaattcttgtttcccttataagtatggactgtatacattaaggaaaacaatgtttaatccttattttttaatacagaagtctcaaggttcttgtcaaattttgcctttataag

SEQ ID NO: 4794 - DNA, 1087 bp, Homo sapiens
tgaccttaacacaattatgtagaagtcatcaagcaattgacatattctatcacctgtttggacgttgttatttcttatatataaactgcagttcctaatgcaggttgatatatattcaatgactattaattagaagaagcttatttcatatatgtatataattttaagtacataagtacatgtataataagtatggataacacaaaggtcaacacccaaggaaaggaaaacaacatattaatcagttttacttctgtttataatttaattgtagtgttaaaacttatcataagatatactgtttaacatccctatatagaaatggatagaatgcttgtctagctaggaaacatgaaactaaaatgtaaatgtatctgtgaagcttatatcatgacgtagatgtttgattgtggaaaaagcagtagcttcataaaaaaagttggacttaaaaaatagagatgctatagtatatgcagacagctacagaatataaaggtaacttttgtggaagaaaatgaacaagggacttgcaacacaatagggaaagacataagttctgttttctggttcctagttttgataaagtgtgtgtgcttgggcaaattatatacttctcttggaataactccagatttattgtagggtccattagacttagagctgtttagtgtcaaaggcttgacttaatttaacttcgtagtatctgtgtgtatgtgagagtgttttgcaaagtactctacaaatataaacactgttgagtatgtattatctaatcttcctgtattagttcttaagtagcagtgattttaattgatagcaatataaagtctcagcttcctcatagactttgtttcagtttgtttcatttgtaaacaaaaacttaaatgcaggacctgctagctggtataaagccaagcatatacagagctcagtgtaatactaatggcttgtcttcagaaacaaaggattgtatcatattttgtgagttttggagagagtacatgaaatgtatttttcccacagaaatattgctgtgagtggtggctttgttcttaggctactctgcagatttctgtttaactcatgt

SEQ ID NO: 4795 - DNA, 1032 bp, Homo sapiens
ctctgctagaaaactactagtgatggttattactgagtatgaatttaagaactgaggttatgattggtaatacaatccaaaaagaagggtctgaacaccaaaattctttatacatatttaagtaactgtattattattatacagatgtctttacctttttgactttatagatcactgcagcattaagaaagtttccagtttaccattccataagtacaattaatccttctagtgtaaatgttcaaatactgttataattatctaggcaattaataatttacaaactgatatttttgcacgattgtagtggtgtatagtcttgacttgcagagcattttgcttgagtccttgaaatgtcgtgttcattcattatttgctgagtgcttacaatgtattaggcactgttctaaatattaagtgtactaaataaacaaaaatccttgtattctgtatcttagtgtgttaatttttggcctggtataatagcaattttttaaacttctttgtatgtttgttttgaggaaaaaaaacttcagtctatatgtaaataaatagatgctggaattcagaaatgacacatgaaaagacaaaacgtaataagtactcatctacacatttcacaaaatttaacgttatttttaagattcattttcccaccatgaaaatatagaaaccattgagataattggttcattaaaggaggtacaaatgaactcagtagttgcggacctttatctgatgtaagtgtagcatttcattgaaagcatttagcttggggaaaagttagtttgcttgactcagaaagtaagctgaatgtggaatcattcagctccttgcttccttcagttcatgggtaaaaatttagcttcaatggaacttttgtgttaaaataacacttttttacttctcaactcagacaagcaaaattttgtcagcccatggacaagttgcttaaggcatctattcggtatttacataactgctgtctcattatctttatgacccgtggggctagtagcttttatagaattg

SEQ ID NO: 4796 - DNA, 1032 bp, Homo sapiens
aatgtagtatatcacatttattgatttgtgaatgttgaaccatccttgcattccagggataatccttttaaaacactgttgaatttggtttgctagtattttgttgaagatttttgcatctatgtttaagggacattggatgtaattcgctttctttttggagtctccttgtctggctttggtgtgagagtaatgctggccacataaaataactttggaaatattctcttcttttcagtttttttgaagagtttgaggattggtattctttaaatgtttgttacaattcagcagtggagtcatcaggtctggggttttctttgatggaagatttttgactactgattcagtctccttgttcattatttcattatttgttaataattcagttttgataggttgtatctaggaatttattcatttcttctgggttattcaatttgttggtgtataattgttgattatagtagactcttatgattctttatatttctgtagtatcagttgaactgtgtcctcttccatttccaattttacttatttgaggcttctttatttttttctttagttagaccagctaaaggtttgtcagtttaatttttcagaatctaatgttcagtttcattgatcgtttctattgcctttctagtttctatttcatttagttctgttctaatctttatttactgtcactatttctgtctttatttactgtcattagtctttatgatttactgtccctctaggaataaatgaatgaagaaatgcacatatacttgttgttcttgttttctctgctttgaatatcctctctccattttacattccacaactcagtctattctttctttaagaccaagctcagatacaccttttccaggaattttttttttttacctctcatacttctatgaatttcccttcttttagcaccatatgatatttgttggtttgtttggctccttcttgtgttgtagactctgtaaaaacaaggttcatgctttaagtgtttttgtatcctaatagctaata

SEQ ID NO: 4797 - DNA, 1047 bp, Homo sapiens
gtaaaatatcagtacctttttgtatttttctctatcaagaagaggcactatcttccattatcaaaactgagttgtgaagattaaattatatgggggttagggattgaatgggtaggtagaatatctaacttatttccctttgatcatgaacttctgtaactagttccttaccacttaataaagttaataaaacagtaatttttttgcatagttacagaagagtttactttttaggagtcatgtatagttgggttgcattttgactgtatcgcagaatatctgttttacatgagtacatatttctttttctttaaaatagaaatattaccacctacctcacaggattattataaggtttatgtgaattaacacatgtacactctcagcacaatgcatggtgccttgttgatgctcagcaaatcttaatgtctgcctcattcttagagaaattacattaacaaaatacatatctgtgtaggacttttaaaaaatacagtttgttcaaggacgttaaatgtaaaatatgaaaatggtcaaccaaagaactaattatgtggacaatgtggatagtcttacttgcacaaattggctgtcttctagaacttgatatgctcatgattcttaaaaaagtgatacgtgaagatagccctgaaaggattgaaaagattctcgttgacagagtttcacaaacttctaaaagaagagtcaattggtaaaaaactaacacagatgaatcctcaaagatactactcatatggctgaaaaaatataaaaatatttattaggtacaaaagatttatgactatgactttgtgatccattataggtctagaattattcaggttatctcttagaacaacttatgcttcaaatttgagaggactctgacccaggagagcagcatataattttaaggaaagagttaaagtgaagttttatttctgataatatggcagggtaggatccataaataacctacatactacaatttaaaacgtaatatttaaagaactccttatgttgagacagtacaggagacaaagccta

SEQ ID NO: 4798 - DNA, 1076 bp, Homo sapiens
catatacaagcaaagtcagggctacttgcataaagaaataaaaataacccttcttgcatagatatatgtgtgcatgtgtatttgtgtatatgtgtgcatgtgttgtgtgtgtgtatatgtgtgcatgtgtatgtatgtgtgtatatgtttgcatatatatgtatgcacatatatacctaaaaaggagaaatgactattttgttatatgatagtttcataagggtaagaatatgctctgttaagtgagcattctttccaaaatttgtcgtaccagttttttttctaaataaaacagaattgttacacaacttaatatgtttccattttaagcattgatgaatatatatgagaaccaatatttttaagtgaacagaatatagttttctattttgtgtgaaaggaattggtacagtgaattggatgcataggagcattttatatctcctcctccttaaaaaataagagtttacatcaggagtatgatctcacttaaaattctgttcataaataatatgcattttctaaaatacatagcacttaaaagatagaaaaatgtatgaaaaattaaaacaaacttaaatatcttttaaaattatgcacatttttaggtaagtttttctttgatttgaaacattagtgttttaatctgattaccggttcatgaggcaatgatactgaattcaaacccaccatgtggtagtggaaaaaactggacagaactaggtttagatcccagctttgccacttattggctacatagtaagggcaaatgaattcacatctttgttcctctatttcttcattcataaatgggaatatgaatgcttttcttagaagactgtggtgaagattaaatgacacaatgtataacatttgcataaaattctccactcatggtataatttcaataactttatctcttctcccctcttctttatctcataatgacaaaaactattcaacaaatgactggaaaattatatatgcaaatgagacttccaaaaataaaattaaatggtaagtgatcctggaggacctgtaacaaataaccttacatagcaaaaacgaacaaaacc

SEQ ID NO: 4799 - DNA, 1045 bp, Homo sapiens
ccttaactgtgcttgtaaacatttaaaatatttttgttagtttctctcaattgagtaagagaacctggctttcccacagcaatgatccaggctttggtaatacccccctttatgtctctgtacttctgccattctaaagttgatttattgtttgttacttttagtgattttaagtgctcaatgaagttccttggctttctcatggcttttcatttccaactaaattacctagcctttcttttaatgtcttcctcccatgcttctttctcttgttactgcagatattttttttttctaaaaaaggtaaaccttgattttggctgttaaaattatttgcaatttatttctggtcctttaaattcttgatttttccatatccaagcaactttttgtgtgtaatattgtgagcactgtcacaatagcagttcccaaaccttgccgatatcataatgacctggtgaccttttaaatgaattatgtttctgagcaccatcacagatactttgattgagtcaactggaggaataaatgtagaattgtgcatggaacagattgttagatttgttcatttattcattcaacaggtatttatcaagtatctactatgtacacgcattgtgctaagaactgggtatatagtggtgaacaagcaaacatataccctgatttcatagagtttatggtgtgttaacactcatctagtattacaaatagagacaaatgttataaaagaacagggtgcagttggagagaattacagtggtatcctaatttagattaagggtgagataggtagaggctggacctgttgtagctcagtggcacgggaaaaaaaccatgtgtgtctctgtggtgcagcaaggcattatcttatgtggtagtgcataaattctcgggggctcaagtgttcttctccagcttaatagtaaaggttgcaagcctgaggtttcatttttcttatgacgtggcaggaacctgatgctgtgccagttgcactgaggatgggatttcaggtgcaccagtatgagaaagtatggaagcagtt

SEQ ID NO: 4800 - DNA, 1032 bp, Homo sapiens
tctagtgtctaatgtctgaaatagcctttgggttgagttctaagagcttgcatgccaaaaacctccctggttcaaagagtaagtcagtgatattcaaacaagaagttatctgaaacttcctgaaccttaaggtcacaatgataggctcagcttctatcataggaacggagtaatataatataattatttttttaaagaatagccatcagaaaacttggtaaactaaactgtttcctagggtaaacagttttcttccatttccatccttgaggttaaaaaatcatactgatctacatgtaaaagggaaaaaaattacagatcatcccttcaatctcatagttttgattaaatactttttatgaatattccagttcaaaaatagtgtcatgaagatttgataggaaaagatatatctttgctaactctttggcacgattggaactttctgaatcctgaggtaatcctacctccataaagtatttctgtttttgcaactggtagctctggtgtgggttggactgtggagagccgtaatgccatcttgtgaccatggatggatatcgcatcttggtccaccaataaagccttgctactttgttgattcattcatccattcacttgttcattaaacacttagtgaccatctattaatatttgccaagctgtgagtgtgtaatgtaatgaataagatttagtttatgccattgcaagattcacagatagcaagaaatacacacatacttacatgtgcacacatgcacacacacagcacagtgtaatactgcaatactataagtattacagaataggcatacaaaggaccatggatggcaacacataagaagaagtggcctacagtccctggtagcttagggaaggtgcctgggaggaaatgacaccatctgcattttcccctaatcagccaatgtaagagtactttaatgtggcaagtctatgatgttgcaagacagtcttaacctatctaagtccataaacacatggcaggtagtgtgactgtaggactagtaaaat

SEQ ID NO: 4801 - DNA, 1064 bp, Homo sapiens
ttgaagcaactagataaaccacaagagtcctatctggtttatcacaggatttactatttcgggaaaacaagcagtttagggatagttctgaactaggttccaggcaggaccagaaaaacaaaaacaaaaacaaaaacaaaaaaaccaaggttaattataatttattgctctgaaacatattttatcactatgttccatctgttgcacaaaaatcagttttctaatatatggcctgggcagttaatggagaatatttgcatgaatatgatgacagaaagatagtatgaacatagactaggtgtgaggactaagagaaataatgtggtggtttggtgtctacaagactgaggagaaatgtaaaatagagactgacaaagaacaaagaatgattgcttcaaaagtaaaatagaaaccaaaattctgtaatacaaggcaatgatagaaaaaggatgttctctaaggttatctttagcaataccctttgtcaagatagttgaagacaaagtctgaagacaaagcctacttttaggttgtagatgagaccaataaatacttctgtttctcaaactggccagtgccttatgtagagttggtgattaatctttatgattggattgttgaataagtacatgaataaaagaatttgatcagtatgtcccccttaaattgaaaatatctgttgatatgactctgaaggtatttttaatttgaaagaaagcagctaatgtagtagtccaaagtaagctttttgtgtgtgatgaaatcatcagatatgtacatcggataactttgcaatgttaacagtgtttgcttctattgtgtttggttagatagaagtagttgcatatattcaaatatatatttgtacatacatctgtatctatatccatacctacttacaaaatgcatgaaaaaatcttcaaaagagcagataagttattcagtataatgcttttcatcatattatatctcagtatgttaaagttttggcaacaggcattggacacaggacctttaatattgtactgtacttagtaaacacttgttaaatatatatgaattta

SEQ ID NO: 4802 - DNA, 1049 bp, Homo sapiens
agtttttaaacaattgtagatgtgtctagaatggtattgggtggggtgaagggtcactttttaaaaatttaaatgatcttccttagataatctaatgaacagaaagggttgagaactgctatgtagatatataggaaataatttgtgaacaatgggaaatagaatttcagtaaaagtttttgaatttgttttaaattatatgtaggggcgatccatttttttttttcacagctcttcaacaagagagaaaagagttaaattatcttctgagatatttagttggacattgggaagaactttcaactattagtttacactttaggagggaagctgggagatttggagcagtccctgtatatgtgtagaatataaaaggatgtgtctttttttagtggaacataaaggagcctgccatgtagggagaggaaacaaggtctcttgtgatccttcttaccgctgatctaagatatatggcaattttgtgtaatgtcacatgacaaattatctttgtgaacttgtgtttgctcttgaattctgcttagtagaatccagtccaattggcctcaaaatcagatcactgttttctattagaaatacatagcatttttaatataattcccagtaacttgataattatatgttttctttttctttttctttttttttttttgagaaggagtctcactctgtctcccaggctggagtgcagtggcgcgatcttggctcactgcaagctccgcctcccgggttcacgccattttcctgcctcagcctcccaagtagctgggactacaggtgcctgccaccacgcctggctcattgtttgtatttttagtagagatggggtttcactgtgttagccaggatggtctcaatctcctgacctcatggtccaccttccttgccctcccaaagtgctgggattacaggtgtgagccactgcgcccggcgctaattatgttttaagaaaaatgggtgaaaattactgtaggacttaattattagtaagcatgttcagactaatagttttctgccccttcaaggaaatg

SEQ ID NO: 4803 - DNA, 1026 bp, Homo sapiens
ttcttaaggtcaaggaaacaggtttaataatgtccatgttcattttcttttaaaatgttaaccttagaatctgcaaaattaggattaattttcctgcatttagtgtggcacatttgaaaaaaattagataaaaactattttcagtctaaaagccaccgtaacagattaaaaaattcaagtagccctttactttaaacatgtgattaaccgtaaagaattttttcttttccaatttaagttcccatgtcataatacagagataaaaaataatggccccctgacacaccttatttggctcacatggtattcatgaaatgtttaattatttttcccaacttaaaaattaggtgattttgttttcataaatattctggattttcttgaaaaatcaaaagtatctgtcaacactgggcccacattccacatggatggagctgaataatggttgcttttttgggaaggggaatgggatctattttttactacatgtccttttatagtctgtcttttgtaggctcactctactcatttttattacctatatatcctaaaggcatttaaccttgaaatctcccctttgtcttttctacctgtaaaaagggactatatttgtgtaatatataaggtataaataattataccttgactttttctcaggttttaaagaaaatcttaattagaaaacaagttttataccatacataaaaacattattttaatctgtttttaaaattctttgtgatatacctctggctctcaaagtgtagtctaggggtctgtggcggttccctggagtacttcaggagttctgtgaggtcagaacttttttcgtagtagtgaggcattattagcctttttcgttcccatttctcacaagtatatggtagatttttgcataggcttcaggacatgatgaagttataactctgatgactaatgaagtgtgtacttgaagatttttgtgctttactaatttttaagttttgatttttaatacataaatgtcatttactataactcacctaa

SEQ ID NO: 4804 - DNA, 1045 bp, Homo sapiens
aagaatagatgcttgggtgtgtactcagcagtcgcaaataaaaaggaagctgttttcagaatgagtggtataacaaaaatctgaatagcagtctaagagaaaggcaagcaagatcagtagagccttggggctaatgaatagacattccagtacaacaggaatgcagtatgggcatttgtaaggaaaggttacagtaacaaatttatcacagattatctcagggatgatttttatgacatacatagaatttattattttaatttaaaacataagaggctgtgcatggtggctcacacctctaatcctagtgctttgtgaggccaaggtgtgaggattgcttcaggccaggaattcaagaccagtttggacaacatagtgagaccctgtctgtacaaattattattattttttaattagctgggtgtggtggcacacgcctgtagtcttagctatttgggaggctgaggcagcctcaactgaggctgcagtaagctatgattgtgcctctgtactccaacctgagcaagagagcaagatcctgtctcgatagatagatagatagagagacagacagacaggtagaaagaattgggcaaaccatttaatcccaagtctcaaaatgagtagatcttatgttatctctgactcaaaatttttgctattcaagttcaataaaagttggaatctgcagcttaaaattgagcttgaaatcaaaagagtgggttgttttgcagtattccaacctatattttctttttttttttttaagtccaatatttatttaaaaatctaatctgccagtttagcgttttccaccaactcgagaactgaaactttcacgggcttcacaatcatttacttaggtgctgcctttgtaggtgccttaacagcagccattgcagtgtttttagatactttgcttagccttttttgcttccttagcagccctgataccttgttctcgttgagcctttctaacttcaggtttctgattcctcttggccattatatcagcaggagaggcacctgtaatagccccctgcaa

SEQ ID NO: 4805 - DNA, 1043 bp, Homo sapiens
taacataaagcattttatgaactgagtttttgaaagaaaaaattactaaagaaattagattgctatgttagatggtatcgaccaagacttgaaatagtgccattgtattatatttaacatttctccttgtaatgtaaatttgtgtactaatttacggattgaaagggattttacatatattattttaaattaattttgattttctcagcaactctctatgttaggttcagtagctatcctcattttattgagcaaattaaagctcagtgaagttcttccatacttaagattccaaagttataaagtggaagagctgagactgcaaatcgaatctctaaatgaagtttaatgttctttctgcctttctgcataccataggtgtgggttgccacgtttattttagttcttttttttctttttgagtgtatgtagtttatgcccattttattcattctgtgtataggattatgaaactgaaattttaaattctttacctggtgagattgtatagataccaatgttttaagttttgtgcctgttaaatatttgaaactacttttagaagttttattaaatagtaaatctttggtaatggcataaaaggtatgtttttgtgttactttataattactttaaattgtcaatttgataattaggttcaaacgattgtgcagaaatgtgttaaagattgtgtattgacattctcacattaggcttgttctactttgaagattaatattctaacattagaattttaaaagtatatttgtagtttaaaactgctttaatgattatttgctctataaatatgcataaataaggatggcatcattgtaatcgctttaaacccttttttgggtaatacatccttagttgggttgagttggaagtgatgatctttggaatatgcacatgaattaattggttactctatcttgggatatgtcagaagtactactgcttcagtgagaggactctggcaggagatgttattttttaccagccagcggtgtttatcttgatttgaaggaagcaagctttat

SEQ ID NO: 4806 - DNA, 1025 bp, Homo sapiens
aaatagcgagacctcatctcaacaaaccataaaagaattagctgggtgtggtggtgtggacctgtagtcccagctactctggaggcttaggggaaggattccttgagcccaggagctccaggctgcagtgggccctgagggtgctactgtattccagcctgggcgacagagcaagatcctgtctcaaaaacaaacaaacaaacaaacaacaacaaaaaaacccaaaaaacttcactataaattgaaattattaagtaagagaatccccataattatttttgtttagacaatcagttccttttttaaaaagttaagaaatgaaaaaaaaaatcttatgtacctactatttaccatttcttgcattcttcctttatgtaaatttgaagtatgatctggcctcattttcttttagcctggagtattaattgtacatcaagtctgctggtgacacattctctcagattttatctgaaaatgtctttattatatcttaatttttgaaggataatttacttgggaatagatttctagtttttttctttcagcatttttaataatgttctgttgtcttctggcttgcatagtttttgatgatacctaagcagaagtttttaatcattatctatgtgatatctttttttttcctttgtctgcttttaaggttttccctttttattgtggttttcaaaaatttggttgttatgtgctaggtttagttttctttgtatttatcctgactgggactttttgagcttcttgggtctataaatttatatatatgtacatacatattcagaaaagttttgaacattattttattgaagctgtttttctgtttatcctcctttattctttttcccttggggacacagttcatgtgtgttagactgatagtgtttcatgagtcacagggactctgttttatttttctcagtattttttgtttctgtgtctcggtttgtacagtttcaattattctgtacttaggttctctaatcttttattctacagtatccaatctgctg

SEQ ID NO: 4807 - DNA, 1044 bp, Homo sapiens
atgtatatgagtgtaaatgcctttatgttttatcaaaaaactccaggcccattgcaaaagattcaaatagaagaagaaaataacatgaagagactaaaattctatcacccagagaatataatgggtaatattttgttgaacaatctgttacacatctctatatgagtatatttgcatgaatatgcattttccgtaaactggttcatctgttcatggtatcctattatctaaccattaccaattgataatttgttatgaacatcttctcatgtctgaaaatagatttactgtatcagtttttttttttttttttttttttttttttgagacagagtctcgcattgttgcccaggctagagtgcggcgtagcacgatcttggcttactgcagcctttgcctcctgggttcaagtggttctcattcctcagccacctgagtaagtgggattacaggtgtgcaccaccacatctggctgatttttcaccatgttgcccaggctggaactcctggcctcaagtgatctgcctgcctcggcctgacaaagtgttgggattacaggtgtgagccactgtgcctggcctactttatcagttttaatagttacctggaattttattatatgggccgactgtgtatgtatctcatttatacttgtattattatctacttcaaataagttcttgagtatcattgttggacttttgatatgtattggcagattgcctttccgaaaagatatatagtcttatcaatagttagagagcctctgtgtaccacagttctccacaatactgggtattaatcctctttttaaaaatattaacaatgtattttatttaattccatatatccaaaacataattttaatagtcaatattgaaatattattaaaataatttacaggttttttttagtcttttaagtcctatatgtattttaaaaatagaatttattttatttattttattttattttattgtttttttgatttagaatcttgctctgttgccaggctggagtgcagtggcacgatctcggctcact

SEQ ID NO: 4808 - DNA, 1052 bp, Homo sapiens
attttcttaagattatcatcaaattaattataagttatttgaaattaacttacatgtttatacaggaaacatggttcaaatgaaagccaaataagttcaaatgtgttttaatacacgggaacatcatatgtcctcaaggtctatgcattaaaattataggtgctcttaaacttgcatggaagtggttcagaaaggattctttttttttcttcttcaagattacagtgtattttagatatgatatttggaagaggaagtaatataatatttagaaaatatttttgaaggtcttcatcatttttactcatattaaaagagcaatttctgtttaataattataagcagttaatgaagttaatttttttggtttttagaaaataatgtctttaaaatttttttgttcttattacttcaagacttgagaactaagttttggagtcttagttttactatgaaatgtgtgattttgttgatgaatacctgcagagtaatcactgacaataaggagcagcacaatttcatcaagattatgtgttggttctttcactgtgtacaggtttagacatgttagagaagaaataataagctaagaactgttacgtacaaaaatactagcttccaacttttaatgattactgtagtgtttgttagggatgttgactgtataccctaaacgtggaaatattgaaatggaatgctagttgaaagacaaaattttaatttgtaaatatttgtctcattttagcttaatagttgaagacataaatgagcccgcagtataatgtttaagatgtcattgttctaaattttgcctttgatagagctgatatagctgtttaaaattcattataaagcccattactaaacccattgactaataatttactcttcttgggggattataaaatctgtgggtaatttttttttttttttttttgagacaaggtctcactctgttgcccaggctgaagtgcagtgacgtgatcttggctcactgcaacttccacctcttgggcccagcatgatcttcccacctcagcctcccgagtagc

SEQ ID NO: 4809 - DNA, 1024 bp, Homo sapiens
aattacttggaagggtttcagctgtcagttccgtacaatttcctgaaaagatgagagcataatactttaatgtcatgattttcatcatttccctccacttttgtcatattgtgtattgtgcatatgtgtggtaggcggcagggttagcagacaagaataaggaattcttttcttgcctattttcttttaatgtgttcttgcatggtatgtctttctagatacttaaagtatatgtctttacttgctgtgtgcttagaccctggatagcatgatgattaagcataggggtttcgtggagactgattggccatcctaaagccttggaggaaagtctgctgacaattttagcttcagaaactatccagcaattacctactcttaagtaatttggagctgcacaccttaaaatagagaagcccaacccagttgtggtgaaatgggcatggctaattttagtatgaagtcacatattgttggctccaccagccctactactgtactcctggtctatctgaactgcagctgtggtcaggtttgtctattggcaaggagtgatcctaggttgtagggagccttttctagttgatgaagttatcttttattgtcctgtatgtagtaaagtttgtccatttgcattattttgagccccaaccgggtcctctttgaagaatggatatattaggtagaatggatactcaaatggatacattatgttttcagctccaatttaattctattctatagtggtttatgatataagttaatctaaaaaatatctaccacaacattaccgaaggtgcgtgaagtaacgctcatctgatattgcttgtaaaggcgtggcacggtggctcacgcctataatcccagcacttttggaggccgaggtggacagatcatctgaggccaggagttcgagaccagcctgaccaatatggtgaaaccccatctctactaaaaataccaaaattatgcaggcatggtggcctatgcctgtgatcccagctactggggaggctgaggcacg

SEQ ID NO: 4810 - DNA, 1096 bp, Homo sapiens
atatatgtatatatgccaaaacttatgaaattgaacactttaaatatatgcagtttatattacatcaatttgcctcaataaaatcgattctagaaagagagttatatggaattcaggctgtagctagacagaaagattttgtagctaccatcctagtggtgatagcttaggagttcctgcaaataaattcaaggtgccacaattcttctaatatatgcagaatttgagtgccctaggttatttatagtcaactgctggggattgaatcccagctatattaagttggaaagtgtggctctttggcaagttttcttatccagcttcatggagttgttgtgaggatttaatagatcaaatagtaagtgctcaataaatgttacgagcacatgttataaaatggtttattattatgtcaatatttgaaggaggagtttcattgctttggtcagctacttaaagtctatgactcagaaagtcagcaacttctctgataattgaagctatggaagagaatgagtgactcaaagacagagtgaaaggtagaggaaataaatgagaacagaaccttgggggaatgtctgagcttaagaggaaagagatggaagaggaactagataagaaaactgagaagtgatacaaaggtgggaggaaagtaggaaatggtggggtcacagagtataagaggaaatattttcaagaaaagaaaaattctcaaatgctgcagccatgaaaaagaagctcaaacataagaaaaggccattggatttggcaataatgaattcatgttgtcctttgagacagcaatttcatcagagggatggggaagcaagacacatggtatggggctatgaattagtggttaggcagtgtagcaattaacgcacaccacttttcaagaaacttagagatgcatagaagaagaacaataagattattagctccaggcagggctaagagggtatttccagtgttagggagtacctgagcatgttttcaggcctaggtgaggggacagaaaaacttaaaaaagactaagtgaactctttcaaagccaagttttgaaagaaataaaagaggataggaaataaaacacaga

SEQ ID NO: 4811 - DNA, 1053 bp, Homo sapiens
aggattattcagaaatatattgaaccactgtatatgagaatggtcttattatctagattttattcagaaaaccaaatctcatagaggttatacaatgaagctagtgactgggaggtcatgggttcattgactcagttctattgctgtttctttagttattatattatgctgcccaataaactacacctttacattgctgcaattcatatgcatagaaaaactttatgcatacagacatagtgtgcatgtatacactctactgaacaaaaacagtttaaaccagcatgtggtaagaagtgatcaatttgaggaaagtaaaataagcaaaatatatcaataatgatcaataatatcaataatcaatgggagattattaaaatattaatgttgagttacaatgattctttttaactttcttattacattaaactctgaatgtctgagtttgtatgcagtttttgaacaaacaacacacaaacatttatatctgtaaacacttataaaaacaaaccaaaaagttgagtagactgtaaatctctaaatctttccagagcttaaagctgctttaaaaatttttaatgttggccagatgcagtggcttacgcctgtaatcccagcactttggaagcctgaggtgggcggattcatgaggtcaggagatcaagaccatcttggccaacatgatgaaaacccgtctccactaaaaatacaaaaaaattagccaggcatggtagcgcgtgcctgtagtctcagctactcgggagactgaggcaggagaatttcttgaaccccagaggcggaggctgcagtgagccaagatcgtgccattgcactccagtctgggaacaaagcgaaactctgcctcaaaaataaaaagaacaaaaaagtttcagtgttcagtatgtgtcaattggttggatcttactatggaaaagatttttaaatcactcgaagtctgttttgtaacagaggcacaatgtgggtttcttatatgtaaatacagttaatatgtatgttaagaataaacctattaatgtttttcaattactaata

SEQ ID NO: 4812 - DNA, 1087 bp, Homo sapiens
gcatctattgagataattatgtggtttttgtctttgcttctgtttatatgctggattacgtttattgatttgtgtttgttgaaccagccttcaaaaggctaatatccagaatctacaaagaactcaaacaaatttacaagaaaaaaacaaccccatcaaaaagtgggcaaaggatatgaacagacatttctcaaaagaagacatttatgcagccaagagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactggtgcaaccattgtggaagacagtgtggccattcctcagggatctagaactagaaataccatttgacccagccatcccattactgggtatatacccaaaggattataaatcatgctgctataaagacacatgcacacatatgtctattgtggcactcttcacaatagcaaagacttggaaccaacccaaatatccaacaatgatagactgggttgagaaaatgtcgcacatatacactatggaatactatgcagccataaaaaatgatgagttcatgtcctttgtagggacatggatgaagctggaaaccatcattgtcagcaaactgtcgcaaggacaaaaaaccaaacaccgcatgttctcactcataggtgggaattgaacaatgagagctcttggacacaggaaggggaacatcacacaccgggacctgttgtgggatgggaggtggggagggatagcattaggacatatacctaatgtaaatgacaagttaatcggtgcagcacaccaacatggcacatgtatacatgtgtaacaaacctgcacgttgtgcacatgcaccctagaactggaagtataagaaaaatatattaaaaaaaagaaaaaagaaaaaaaaaagaaaattactaaatttcccataaaagtagagcctttagtttccatgtttgcatctaaaactaaaaaaaaa

SEQ ID NO: 4813 - DNA, 1081 bp, Homo sapiens
cctgcctctttctatctcctgtcaaccaccatattactttctgtctttataaatttgactactctagttgtttcatgtaagtgaaaccatgtaatatttgtctttttgtgactgacttatttcacttagcataatgtcttcaagtttcatccatattgtagcagaatattcttcattaaggctgagtagtattccattatctgtgtgtgtgtgtgtatatatatatataatatagatataaaatcagaagatattatatatataatcataagatttttatatatgtatatcacatttcatttatccattcaaccattgatgaacagagagcagtgggttgctccaccttctggtaattgtaaatactgtttatttgaacagacgtatacaaatatcttttttagtctttgctttcaattatttttagctatgaagatttttaagaactcccattcgttatcatcctgggcagttgccatcctaggtgttaaaagaaaactctgagactggccgggcatggtggcttatgcctgtaatcccagcaatttgagaggctgaggcaggtgaatcgcttgagctccagcctgggcaatatgacaaaaccctgtctctacaataaatacaaaatacaccacagggcatggtggcatgtgcctggagtcccagctactcagaaggctgaggtgggagaatcacttgaacctatgagacagaggttgcagtgatccgagatcgcaccactgctctccagcctggggaatagagctggaccttgtcacaaaacaaaacaccctgagaatactttctttagattggcagaaggaaggatagagacaatacacgttttatatattttcttttacaatatttttgttacttgaatgcatttaattttctaaaaatgaacaagtgttattgatacagtatccaaattgctatattctaatttcaataatatgaaaccattagaattttaagtatagacacaaagttactaatttgaatagcagattttataaacactttttttcatgctactccacttaataatgggatacatttgcatggaatactaatcaaa

SEQ ID NO: 4814 - DNA, 1173 bp, Homo sapiens
actgcattttagtgtcaccaaatgcctaaaattattttgtgtttttgagctgataaatctatatattttttattcagatttctcttattctttaaaaataatcaaagggatgactgctggattgatttactgcaaatttatctttgaaatggctacaaataattgttattctcattttaagagcattagtgtcttttgttcatcaaattaagaatgaaatggattttagtactgccctacaattactttggtaatcaaaatgattgccaatgatctccaagaaactaaactgtcttgctacagaacagattgaggattgttttgattcacaggaaagctctgcaaaaatatgattaattatgattttgatttagtttataattttattttttatttccgttttccctcttccctacattcttttaaaatatggcaaagttttccattgtatatttttatttgacctaatttccaattaaatttaatatttctccttgcttaattatttcttctggaattttacactcatagtgattaaatctcaatctcctctctcttattctctttctttttttattctctttttctatcacacacaatttaatagttcatcttaagtgatttctgatgccttgtattcagtgactctaatttctaatatcctcttcttgttaaaaatatttttgcaatgtatttataatatctttctattacactgattctgtgttatgtttaagcgtttgatcacttttattcaaatgttcctatgataaccagaagatactgtgcattctcatattattttaatgctccaatgtatactgcaggcttaaataaccataaaagtaatgtttgtttagaaagtgactggtttgtttaccttcactgctgcagaaaatctcactaggcaatttgcctggggctgatacttgtaaccattagcaattatggattctagaaagacgttgataggaagtttttaaaaagctatttcaaaatcggacacaaaaaatacaacacattttctaggattgtttttcttgccattcatgctgcttgcctttcttatcttaactaaaattcacttttcatcagcctgcaatgagtcacaaaaaatgctgtatcaatcttgggttgttcctggacattcatagtcagataaattattttcag

SEQ ID NO: 4815 - DNA, 1061 bp, Homo sapiens
taatagaatcttgggggaaaaaacagtaaaattacatcggtgttataatttcagatggttgaagctaagatgttctggacagatagttttaaataaggaatagaactctgagctactcccatttttctccttttccttgttactctggaaaaattggtcttgatcctgcaagattgtagataatcaaaaatattacataaaataagaaacactttctacttatctttgaaataagttttggtacttttatttgtgttgggtcatggttgagatttactgctctgtttccatgtatcctgattctgtaggcgaacagagcataaaaaaatagggccagttagggaagctttgcaatcgtgcaaaatgtctgccccttgctgtatcctctttcctgttctctaagactgcgacaatcagttaggaacagcaatccttgagaaacccaggcctcttttaactctccagggacactacttctatctgttttcatgctccttctaaaggatcctccttcagactatagcacacttcctgaacttccacccagtttgctacattcccagtcatttctgcttagttaggactttgcctcaccctcaatggtgctctttatgtttcacacgcagagctgtcttcttaaatttttgttttaaaatgttatatttttaactctaagggaaacagggttaacagggtagacatgacatcaaaaggataaatgtagggaccgacgcagatgtctttggcattctgaaaatctgcagtgtagtagacagaataatacgattacactgaatttgattgggcagctctcacttctggttcatgaagtgttcccacttcagagtggaaggcttctctcaactaatgcacttgaagtagatgctcgactcattcttgtggtttatacttgattcggtatatttcctgtagggaaattactgttttaacttaaaggaactaacttctccttcagcaaatgttggactagaaaaataaaagacaagtatgaaaagaggagactatgccaataagaatatcagggtgtaaactgtatcaaa

SEQ ID NO: 4816 - DNA, 1043 bp, Homo sapiens
ggggtccaaaatcaagaagttggcagggtcatgctcccttgggatggtctagaggagaatccttccttgtgtcttccagctacctgtggctcctattgcttctttgctcatggcagcatcactctagcctctgcctccacagtcaaatgactgctttccctgtgtgtctatgtccaaatctccctttccttataaagataccagtcattggtttaaggcccaccgtaatccagtgtgaccttattttagcttgatgatatctacaaagactattttcaattaaggtcacattattctgaggttctaggcagatgtgaatttggggagacgatgttcaactcagtacgtgagatattgccaagttctttctctgcctcgagcctttgcacatgcaaaagtagctaacattcattaattctgtcagttctcagattaaatatcacctcctcagagagatcttctatgtctaatctaaggtaacctcattattctctatagtagtacctcttcagttccattctttgcgcttatcacgtgtaattgtttgtatatttgtttactttctacttcagaagaatacaatctccctgagattgcagagcccatgtctattttatgtactgttttagcctcagcgtttggtattattcttgacacacagtagaatctcaataaaaagtgtcgtagaaatgaaatggataaatgaataaatgaatgatatagctgactatacacaatgtttttttgaatcatactcttataaacattttgcattttggtctaataaatgaatactttgctctaataaatgaatactttgctgagtcaatatctgtataaaatactgatggccttctatgtggggtgatatgtaggagaaaatatgagaacaaactagattcaatacttgtctcccagaagcttataatttaagatataagatacagattttatgagaaaacaataatcatccttaggattttttaccccaatggtgacattaattcagcagcttctacatgttcaaaaatttgcgacatttt

SEQ ID NO: 4817 - DNA, 1093 bp, Homo sapiens
tgttgtctataacaacaaccaaaaagatctgcagttggcaagctgggcatgcaggaggagagccaatggtaaaagtttcagtcagagtctgaattaccaggagagctgaaagctggcagactcgagatccaagaagagccaatgtttctaactctgcaagccagaaaaggcgaatttgtaactcaagcaagtcaggcaggaggaattctttcttattcacctttttcttctattagggccttcaattgaatggataaggctcatcagtaattaggaaggcaatctgctgtactcagtctaccaatccaaatgttaatctcatccccctcagagacacacccagaataatgttagatcaaatgtgtgggcaccatgtggtccagtcaagttaacacataagaggcagaccaatgtggattggaatagtgaacctgaccttagccttaaagagtaggcaatattagaataggagtggaggtacttagagagaagaggaggaattgagtcaaggtagaagagatcaacaacagcagcaaaactctagaggctaaagcagagggtttgagatgagcagtgttggcacacagcatgagatagggtagtatcacccattagagagtgaaattttagagtagtgagctgaaatgcgatgtaatgatgtgaaaagcaatgggatttaatgttaggagttttaaaaatgactcaaaatgagtgatgattttgaagatcaatctggtggtagtatgaatttgagcggattgagaaatggaaactggttaaagacaatattaacagtgattcagacaagacatgatatcttagaaggaaagaaagtggttaagaaagaggaaaaatccaagaaaaatgactgttgctaggtagctgatggaataaaggagatgaagaaaagaaaggggccaaaaatcccaatcaaaatcatttatgtatttcttactgtgtactcgggtagtgctaaaactttaacctgaattagttatcacaataatccttgtcaagtatcccacatctatatagagcaaaatctatagagcatggcacacagcccatcactctaaaatttcactttcaaatg

SEQ ID NO: 4818 - DNA, 1031 bp, Homo sapiens
tttcaaaaaaaaaaaaaaaatctcagccatgtgccatggctcacgcctgtaatcctagcactttgggaggctgaggcgggtggatctcttgagcccaggagttcgagactagcctgggcaacctggcaaaaccccgtctccacaaaaaatacaaaaattaaccaggtgtggtggtgcgcgcctgtggtcccagctactccagaggcagaggtgggaggatcgcttgagcctgggaggcagaggttgcagttagctgagattgcgtcactgcactccagcctgggggacaaagtgagaccctgtcttgaaagaaaaagaaatctccctgacttcctgaaagacagatcttattttgtattcattatctgagtaacatctttatgtggcatacaagtgtggcagagtgaatgagtaacaattactgcttcacatcagtaggaactactggtaaaggcggaggagggaggagccctgttccattgttaaaagtggtttatatgtaagttgaaactctagtccattgattggaatgctgggttttggagctgcataaacagagccccctgattgttgtatgccctataatatgggaatgaatgtactaacatataaaacataattcctgaggaacctggcattgcttatgaacgttccacaggctgcttgtgggaattgtatattatcatttgttgaacacctacttcgtcagagtgtttttgggctttgcctcatttgattctgacaaattgaaaggcagggtaatattaatctcattttacagatgaacaaattgggttaggaaaattccaccagagaagcactggaaataatagagctagaatgcaaatgtaggattggtttgagatccctgaggcttcccactgtgttcaagatccagcctggcaccaagtttcagcatcatggtctcgaaagagctcaagcccaggggtcccgcagtttaagttctagtcctgactccaggactttggagctacatgattctgaagaaactgctaaacctttcttggcca

SEQ ID NO: 4819 - DNA, 1056 bp, Homo sapiens
actgctggcaagtagtagactgttagtgaatttattttctgtccttttcattaccagctacaaaacccttgttatgtatataagatcacacttggtgcaggcatatgccatttataacattctgccaatgtgccaaattgtattgcagtcctttatggcatacctgaaaatatatctgccgtcattttgttccatgataataaatggacaataaagataactaaacattatcttactgctcttaaggtataatgtgctatgtgtcctccatggagtcagtccatctgaaagttttagcaaaaggctgttttgtctagttagctaactagcatacttgagtttacagagcctaactatgtgccaataagcatttcaaggttttccctaaatatggaaagtaagaattaatcacaggtgaggggaaaaggtatcagtagtttggttcagttaaaaaaaagcttatgtgcccagcttcctgtgcatgattcatcaggtaagtttgtgctctggattttgcaagttacagtcattgcatgatataatcaagactgagcttttccatctttcttcctttagccaatattagtttatgggatttttagatgtggagcatggccatttagtttgttttagtatctgatagctaggttcattcattcattctaataattatttacttaatgctaggtatgctgttggtgttaagccatagcaacctgaaaaagattagattgcctcatggacttttgaaaggcccaacttgttggatcccagttgttcataacattatattttctcgatgccaaagacctctaaacacactaaactcaagtcgggtgcagtggcttatgcctgtaatcccaacactttgggaggctgaggagggtgaatcacttgaggccaggaatttgagaccagcccggccaacgtggtgaaaccccaacactattaaaaacacaaaagttagccggcatggtggcgcatggcacgcctgtaatcctagctacacaggaggctgaggcaggagaatggcttgaacccaggaggtagaggttg

SEQ ID NO: 4820 - DNA, 1020 bp, Homo sapiens
ttaaaaaaaaacctttatttatgatcaagtaataaagataatattctacttgtgggatcttacattacggaaatagtttgacgtttttgacctcaagagtatgtataatttgaagagatactttgtaactatgcttgggtgatattgagcagttcctaaagaataattcatttaaaaaaaaagaagaaaaaaaaagaagaattcatttaaataacctgatcctttcatttgcccttttcgaatttacagatactacttgtacatttggcataactagttgaaattggccattcgtaccatgaataaatctgatagtttccttgttaggaagagattgtaagtaaatacagtcattgcagtcagaacagtattagtgaaccttgtgtggtgttttcaagctctttaaaatggtacaatgtagcacatttgctttcatttctttttttatttttggcatttgaccttgtattctttctgaagctctatatgtgtttttattagtcaataatctggcaagtagcactttgcctgtgcagtttgctggagtgtagatgtacatatgaggatttcccgggaggtgcacttctttgaagaacttcctaaagtacctgtatagtagttttcatcttaatattcagtatttaatcttcagtttgtgctttgtaaactcatgacttaattggtcagaaactttttagtgtctttataaaattttgtatacatatttatactaaacacattgtgatactgtatttgaatgaatggtgaaaaaatatttgctattggaattatgtgcactgacaagaaatgttataaagagaatgcctttaataaatcttttcagcattagaattgcttcgtggtctatgcttttttattttactgattttctttgtttattttactcttcattcagaatagctctgccttgataatagctaggctagtgttgcaaatcaagttaataattaggaaacactaaacaaatattaatattgccataacaactattttttttta

SEQ ID NO: 4821 - DNA, 1034 bp, Homo sapiens
actcctgtaatcccagcactttgggaggctgaggggggcagactgccagagctcaggagttcaagaccagcctggacaacacagtgaaaccctgtctctactaaaatacaaaaaattagccgggtgtggcggattgcacctatagtcccagcttctccagaggctgaggcaggagaattgcttgaacctgggaggcaggttgcagtgagccgagatcaagccactgtactccagcctgggcgacagagtgagacttcgtctccaaaaaaaaaaaaaagaaaagaagcggaacattatcactagtagaaattaaattagttatcagatttaacctctttattttaatgaagaattgtataaaactaaagataaaatatttgttctgagatttagttggaccatgtaagttgaacaccagatccctaatagtctataagccaaaacatagtaaaactttttaaaattatatttttattatagaatatgtatttcagtggattatttagcaaattcataccttgtagataatctgtgaaatagaaagtttcacaattatataatcttttttaaaaactgctattcaaatttaaaatttttaattttgcaatggaccttggagcacaataaacaaaaatctaaagaagacggctgggcgtgttggctcacacctgtaatcacagcactttgggaggtcaaggcaggtggatcactaggtcaagagatggagaccatcctggccaacatggtgaaaccctgtctctactaaaaatacaaaaattagcttggcatggtggcgcgtgcctgtagtcccagctactcaggaggctgatgcaggagaatcgcttgaacccgggggcagaggtttcagtgagccgagatttcaccaccgcactccagcctggcgacagagcaagactccatttcaagaaaaaaaaggaagtcagctgtcttcttcacttgcccatgtttgtgcagtttactattggcaacatcaagaaacttaaacaaaacttgacatttgcttctatgatttc

SEQ ID NO: 4822 - DNA, 1033 bp, Homo sapiens
gggcagagttctctattggctctccagattttagagggatagtaatttgaaggtaaagccaggaagacatagataagtgtagtggaggcaaaggtctttggaatgatttcaaaggactaggaggctcagattttgcgtggaatgactatgtcattgaataacatagtgtaatgaatgcttaagagcctggttggccaggcatggtggctcacgcctgtaatcccagcactttgggaggccaaggcaggcggatcacctgaggtcaggagtttgagaccagcctggccaacatggtgaatccctgtctctactaagaatacaaaaattagccaggtgtggtggtgggcgcctgtaatcctagctattcgggaggctgaggtaggagaatcgcttgaaccctggaggcggacattgcactgagctgagatcatgccactgtactccagcctgggcgacagagcaagactctgtctcaaaaaaaagaaaaaaaaaaagagcatggactttggagatacattatttgaatttgaatctcagcttcatcactgcagtagaaatgtgatcttgaacaatttacttaatgtctttctgtgtttcagaacagaaaatagagattatattgacaatgtctttctcataggtttgttgtgagcattaaatgagttgatctatacaaaaggttttgaagagtgcctggcacatagtgagcccaactaaatgtggttatatcaactttggaattagccaggatggtagagaataatagtatgtggatgggggtaatagaaggtggtatagcgagcatgatggcaggagcctcagaggagaagaaaaaagtaggacctctccagtgtggccccagctaccttttccaatttgtttcccacactacattttcatttctaagtcctcctggagcctctataacataaaatactattttacataaaataagcattattacgtgtttattgaattctgacagcccccatccctgttcatagcatttgtcaatgaccttataattacttgg

SEQ ID NO: 4823 - DNA, 1062 bp, Homo sapiens
ctagaggaaggaggagagatctttagtagccaagagagacttatgattgaaacttacagtcaactgagtttgttaaaattagatatttgtattttatgccagctttatttagattggtacccccccaaatttgtataataaagatgtagatttggatgaagagtataggtagattatagtaggtgggatgggaaaaggtatagttcaagagaaaaaaaaaagaggaaaaaatcttgtaaaagtaggataggttttctggaggaatctgggattttccctttggtggcactggagcctcaggaaatatattttggaaacccactagaattatgtttgcttatctgcattttccacataaaactacagaattatcttgccttggaagattgtttaaatagttttgaggtatttattatgttctgtgagaataatacccttgatcattttagttacttgatttttttctttgtgcttctttcaagagagaagattgaaaaagcatcccaggtagtcttcatgagtgggaaagaaataactgtggaacaccctgacacgaaacaagtttataattttatttatgatgtttcattctggtcttttgatgaatgtcatcctcactacgctagccagacaactgtctatgagaagctagcagcaccactcctagaaagagccttcgaaggcttcaatacctgtctttttgcttatggtcagactggctctggaaaatcatatacgtaagttgtattggaaatgcaattatccagaagtgtttaaatatacttttgtgagaagtggcataggggtgatagaaagaatatagttttgaaatcacacagatcttggcccaaatctcatccattttatataccagttctgcaaacttgggcaatttacttagcctctgggcttcagtttatacatttaccttgatacaattcatcttgtaattatcattggccccattttactgtactttatatattttacataaactaaggcctagagaggttatcttttaagtattttggtgagaattaaaagtaaggcatctaagctaga

SEQ ID NO: 4824 - DNA, 2179 bp, Homo sapiens
gggtagccagaccctagcccctgggccttcttcctgtcccctgggcaatggcgtggagggcaggggagttctctagcctagtactagccctgggggcacctcggtgcattgctgaaacaacagatgtcatcaagtcctctgcctaagtgaggtcttgaagcctatacttagcatccttcttgagagttagaaatagtggaatggggcatggtgaggggtgggttcaggctgggaacctcccttgagctagctgtgtggcagtaactggagccccagcagaacctactcttcctggagtgcttcctttcccaggccccagggaggggcaggggccccatcctgcagatgctacagacactaaggcttccagcagacctggcacactgtgttcagctctgcagatgacaaggcaaggtcctcagcctgcagcacttggggaggcccagcctcccagtctggggaaggtaaggctttggggttcgttctttccatgtcagactttcaggatccaagacccttctggcttaccgtgccagatcttctctttttttcttcccactacaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctctgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttcttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctcactttctggtttttaagagatttagggaactaggaatttttcacaagtgacctggtaaatgtagtatcccagaggggacagagagcattgcgttttgctaggtccagacaggcagagccttgggaagtccaggcggccgtggcagagccagccacagtgcaatcaggccaaggccacggcttgctggaagtcctcctcacctgattaggaaagaggtgggtaggctggggcaaggagcacagggtgaactggcccttgggagttatcctgagattttacttcatgtttatgggcagttcctctgaaactgaacagtgcgtgattcatcctaatatcctacagacacagtaaatagcgctccctgcaaaacctgtaagtatccccaaatgaaaaccaacaggtatttggagaggggtgggtgggggcagctagaaaacgagctgccccatacagaaggaaatgccagcagcttcaacagggacatccaggggagcccggcactgcgtcagctccagtatggatgtgcggtgcagggcatgtccaagacccaggcagaggcaaggcatctagag

SEQ ID NO: 4825 - DNA, 1025 bp, Homo sapiens
gagatgaggaaggcggctgggggtagaaccctgggaacgttgatggttttggagccagccctgtaggcagtttggagagctggttttgatgtgtaaggggcatgggctgtgaggctgtgggttaggaagggtttctgccagcctaatcctttataagcccttggccctctctgggagcacccttcacctttgcctagcccctacctctcagctcccctggctacctgcttctctggtcttgaggctctaagacgtggtggccctgcctcgacagccctgtctctctctgttgtagcaactgcctgcacgtggtggagcccatgccagtgcctggccatgacgtggaggcctactgcctgctgtgcgagtgcaggtacgaggagcgcagcaccaccaccatcaaggtaacgccagggtctcaggaagccagtgggattcccacacgccattctccaatcgcagactggcctacacccacagtttttcactttattctggaatgtcccaatggctatgagactggcttctaggctggcctagtgcagacactgggacccacatcccacaccttcctggagccagctcccttctctgctctctttccagtagttaccattacagtgagaggggagagccctgggagagctgctggagactcctttttccctgcattctttacagtttatttcgttcctctcccttcttctattcatccagtaaatctcttttcggtgcctgctatattctgggcaagatgctgccaatggggaggttgggctgccctcctggagcttagtctaattaagcttccaaagtgactaagctcctctaaaaagcatcagagctgtggactagggctgggtgttgggtgctgggagaacatcagattggttcttttgtgttttcctgaaccaccttctcattgatcatttgggtgaattcaggaaagagatgatagacacagtcaccaccatagacgtcacgaggtgtctgttcattcctgcaccaggcagaacttcccgtgt

SEQ ID NO: 4826 - DNA, 1047 bp, Homo sapiens
cttcctgacttcaaatttagcttagctgcttgttaattgtgtgacaaattacttaatctccactgcactttgatttccttatctataaatagtggcagtattttctgtgttaagtatgtacgtgtttgtgtgtgtgttgtgcgtgtatgtgcacaggtcagtaactatagcacttagaacaatacctggcacacagtaaatgcttatataaatgttagctgatattaatgtatattatcatgccttactggtggccacatagatagtcatggtcaaacttacaccacagactgagaaaatgggctcctcctgaagcactagccttctacttaggagaattccaagtaacccccttgtatcttgtggttatagttcaaatagcatcagtaaaaacttagatgggctgtcttagcccttcaccagataacaaggctatatcccaaactccttatgcaggcagacacttgcaaatttaggaacactctctctgtcctggagctatagatggcctgaaaacccaaggttggatgcctgcagaggacggagtcctgtctagacctctcaggctgtagtttatctccttcttcccctcagaagtcagaattaaggggctgcttgatgaatagccttacatcaggaacctcagggcagctccattaagggtggtgggtgtaaactgaggctggaggaaagactccaggattctaggacccagtgacactgaccttgactgggagtcatcctgtgcttgcctggagcctcttaagggtagggtggggccttgacattgatctgagtacctcagtgctagggttagaggaggccagtttgagtgggtcttctggtctctgccacattttcactttgctgtcacgttggtccatgctaaagaacacttgcacccttctccttggttgtgcagagtaaagccagaatcatctgacatgcggtcctcaggtttaatggccaagccatgtatgttcctgtgtttacaggtatcctgccacctagtgttgagagattatgaccatatgtgcataaaaaggc

SEQ ID NO: 4827 - DNA, 1030 bp, Homo sapiens
gagttatgttactacaatttcatagggaaaagattgcttcttggacccttcaattttgcaatggggaatagtaagcctatttactttcttgaagtggccaaaagaagttgaacttgattacaacagcttctaataggtcagttcacttttaccccaagaagaaaatttagcaaagtcaagagggtggtatgttttcaaacactgcagcaacccagatggaggactccggagccttgatgtttgggctggatgttttgagatccggtgaaggattctatgtccataatgtgcgagcaggggttcctcccacccccaaccatgggagtcaggagactctagcttagggtttcaggttacttctgggttaggcaaatgaccacaagcagtctggccttgccaatcaaggaatgggccacaagataaatggagacagaaaccaggcagagagggagctagagaaccagtggacagtacaggagataactttattgaaacgcaaatggcattgaacagatgaatcttgctgggaggagacatgccagatggacagagggcccagattgggggtggcctcagtggtgatgaaggaaggcctcttcagctggctctggcatgaattttatttttaaataatttgttatttaaaatgaattactgaggggacagcccggctctctcttcatgattgttaccgcaactatatacaacagtttgctttccagattcaatttcgctttttctacattagatataaaagggggtaggttgaaagaggggagggtcaaataaaaaacataaacacacagacatacacatatcctggtttgggattttgcacccaataacttaaaaaaaaagtgttgcaaaaacttctgcccactctccacctgaggaacaccatgcatttgagaaacacggactctgtcacataaacggtgctgcctaaaacagtatggaggcggggaaggaagctagcaggggttggaattcattttgaaaaaagattgttttgttagaaaaagcaaaaaca

SEQ ID NO: 4828 - DNA, 1080 bp, Homo sapiens
ctccactggagagaaagtggcgtcagttactacagagagatgtaggttagacttgaggaagaattttcccctagtctaggcaaagagattgagactgtctgacaaaagcgggtcttttcacagggcatccccaggtgtaggcgggacacataggttggtgatagcccatcctgcctgaaagcacaggatgtgcaagagtaccccacagtgggaagtctaggaagctctggcctggcctctgcatggttctcgcagcctcttggtctgcggtgggggcatatcgatttttgcactgtttcccattctgagtcttctttccagtcaggacagttcaacgaggacatgatccccaccgtgggtttcaacatgcgcaaaatcaccaaagggaatgtgactatcaaggtgagggcccagaagcttggggggtgcagaggactgtttttgtgtgtgtgtgtgtgtgtgtgtgtgtgtgtgttggggagggcaacggaggcccctgggaggagcgagctgaagtggggcagaggccagggtccccctgctgaggagctgggaaaagacagtagaagacttctaaggtagacggagagcgggtggagacgggggagaactggagaggaagccggggaggcagaggagagtagggcagggtaggagggggcatttgagacccaagacacgttttggtggcctgcccactactgaggctatctcaccctcttcttgctcagctctgggacattgggggacagccgcgtttccgcagcatgtgggagcgctactgccgaggagtgagcgccatcgtgtaagtacacgggaggcatcgccagactccagccttacccggcccccctagccctgctaccttcgaggacctcagaggcgcagggttttattagacataatccttggttcatgacacagtgtcggtccagggcctgcgtttattttgcatgccacttgtttcttattggataaatgccctgggcactcactacccaatctaagaaacagactatagactattaaccagccagatgcacctgtgcatcctcttcattgacttgtctccctcccctc

SEQ ID NO: 4829 - DNA, 1037 bp, Homo sapiens
gagtcccaaattcccctgccagggtcaagagttcctgtgatatacaggaaaagcaccccatctccagcccacaaggtcccctttttaatcttaaatttgccacttccgctggcacattctaaaagagcaggcaagctaaattcccttctttagagaggcttcccaaggaaaaccaccccatgtgggctgcagttggaattccagtgtcccggtcactccagtgttttcagatcctctggggctaccacactggcattgctgcccaccccgtgtataatcacagttgagtgtcttccagaaagaaacgaagagttgggacccctgggctctgttcccatgcctaccactgaatttctgaattacctgtgcctgttcatttggcctctgtttgtctcagatctttcgccattgggttttttctactcaccctatgaggtctggctgtaaatagaaattgagtttagtgtgtctagctgctcagcaggttaatgtgagctggaaagaaattatatacactgcttctaagaacctgaaacatcagccgggcatggtggctcacgcctgtaatcccagcaattgggaggccaaagtgggggtttcacctgaggctaggagttcgagaccagcctggccaacatggtgaaaccccatctctactaaaaatacaaaaattagccaggcatggtggtggccacctgtaatcccagctacttgggaggctgaggcaagagaattgcttgaacccaggaggcggaggctgcagtgagttaagatcgtgccgccactgcactccagcctgggcaacaagagcgaaactccgtctcaaaaaaaaaaaaggaacctaaaacatcctttgagttctgaaaaagttgtgatgctagaaaagtgggagatgttttgtcctaggaaacaacagggtcattttcaaatatttaaaagtgtcaaagactgtcctatggaataactagtcttggagtgcccaaggggacttaggaacaatgggtggacattctaggaatgatagatttttttttctt

SEQ ID NO: 4830 - DNA, 1070 bp, Homo sapiens
ggccaagcgaagactttgaggaatgtattgtagatattggacctgcctaggcagatgactaaagactgtaatgcccttgtccatatcacagtgtagcaatgatgattttttacctaggctaggcaccatgcatgtaaaatgcatctctgaataggcacctttcattcatctacctatgaattacctcgtactctttactgagcagcagcctgccgtactgcttatgtggtgtttggactcatgcaaagacaacaagaagtatgaatttatgtaatccattaatgacaggtcatggcagaagctaaaaatacaaatttctaattctacagaatttttgaacccacttttcaaaatcagttactgtctttttttaaagcccaggaattaattctattccaggcttgtttcctatgcttatgcatacttaagtcaggtttggagttcctagataccgttagtatataaattaggatacttagagttgtgagtgaaattcaactcacactggcgataatgaaagaagttcattgccttactaaatagaaagtccaggggttgagtgaacatctgggttggtaaattcaaaggctcaacaatatcatcaagatcttggtctctccatctgccatccatagtatcagctttctcttaggctgtttcttccttaagtttcttcccctcctaggatgactaccagcagcagttggggttatgtactttctatccagccaggccgggaggctctactttccatgaaacaaaagtccctgtggactgccctgaaagcagtcactgtggccagggaaatgccatgtgctgattgctctgggctaaacccagatatgaagtgagagatggacttagggagtagttgtaggaaaagagcacctcctataggacaaaaccccttacacttctatcaccatgtctagtcagctctaccagctacttttccctacctctacttaaaacactagttcagctgccatcatctctcacctgcactttagccatagccttctatcttgtttccttccccattcttgacctttgacactccatgctcttca

SEQ ID NO: 4831 - DNA, 1045 bp, Homo sapiens
gatttcaaaacttactacaaagctacagtaatcacgacagtatggtcaatagtaggcaggtgctattaaaaaaaaaaatcagtgtggtattgccatgaggttagacatacagatagaattgagagtccagaaataaaccctcatatttgtggtcagttgatattttacaagggaactaagacaactggatggaggacagaatagtcttttcaacaaatgttatataccaaatggatatccacatacaaacgaatgaatgtgaaccccttccttacgccatactcaaagtggattgtagaaacatagtggaacctaatttctagaagaaaattaaaaattagccagatgtaatggcacatggctgtagtcctagctactcgggaggctgaggctggaggatcacttgagctcaggaggccatggctgcagtgagccatgatcatgccactgcactttagcctgggtaacagagtgagaccctgtcttaaaaaataagtggcttgtagacttgaatgtgagagctaaaactatgcaactcccataagaaaacaaaggagtaaatcttagtgcccttaggtttagtgatggtttcttggatatagcaccaaaaatatggcagcaaaagaaacagctaaattggacatcatcaaaattgaaaacttttttgcttcaaaggacaccattaaaaactgaaaatatgaccaggcacagtggctcatgcctgtaatcccagcactttgggaggccgaggaggccagatcaactgaggtcaggagtttgggaccagcctggccaacatggtaaaaccccgtctctactaaaaatacaaaaattagccaggcatggtggtgagcgcctataacaatcccagctactttgggaggctgaggctggagaatcacttgaacctgggaggtggaggtggcagtgagctgagattgtgccattgcactccagcctgggcaacaagagtgaaactccatctcaaaaacaacaaaaaaacaccacacacacacaaaatgaaaatataaccctagaatgagag

SEQ ID NO: 4832 - DNA, 1113 bp, Homo sapiens
cccttgcgtgcaggtgtagccagagtctaaactcagcctgagccagagcaccccattccttccttacttcctactttcctcccgccttttcctccacgttccactccaatgcactaagcacctactctgtaaaaggcacctgggatgtaaaggagaactcaaaataaccgtgtctcctctatcagcctgggcgctccccaaggccagggcatgttgtttctcctcctctcctgggtccccctagcccccaaagtggagttctgaagctgggagcattgatggtggctggtgcagagtgacagggctcccagatgctctccaaccccaggatagtcgcctgtcaacacaaggctttcctcaatcacaaagcttgcttcacttcctcccatcccctgcagagaaactagaagcccaagggcctcatcactggacagtctgggaccaggggaggacagcagctgggtggggagtcaggaaagctcccccgaggcatttgtcaggtgcctctcagtaaggcagggagtcctcagaccatggagaactctggcaggacttgccataattgggttgatacagtggctctggaatttagtaattaggaaatattgcaattagagacggaatttacccattactattccatgcatcttaatacagggtgtaagtggttgtaactgtgagcttggcactaggcatatgggaaaatagaagtgaatggagaaatgggatgaaggaaggaggggatgggaggagcttaaccctttccatacccgagtagactgaaggagcagcctgggggtgatgcagggttagggcgagcccagcagcccaccgcatttgtaagaggtgaccgaggcaaaaatcacaggctccctccggaccttctgcttctttagctcaggtaggatcagatgcagggcttggcaggggttaggagagtggtgatggaggccaagagggagaggctgcaggggagaagggctcttctcccagtttcctgctcagctgtggagaaacagaaaagagttgtaaccacctgcagtagtgtgcatgtgagagacaggagagggtaccttgtaccttcatctctccctccccacttgttccttcccc

SEQ ID NO: 4833 - DNA, 1034 bp, Homo sapiens
atttttttttttgagacagtgtttcactcttgttgtccaagctgtggtgcaatggcacaatctcgactcactgcaacctccacctcccaggttcaaatgattctcctgcctcagcctcccaagtagctgggattacaggcatgtaccaccacactcggctaattttgtatttttagtacagacagggtttcaccatgttggctaggctgatttcgaactcctgacctcaagcgatccacccgcctcagcctcccaacatgagccaccacacctggcctaggaatttgattttagaattctaaatacttatcattttctccaatcttttgtaagaattttacccacctaaatagacagttttacaactaactcaatctggtttttataaaaactctttacacactcatttcattggtttatgtaatagtcaaaacatagttactataacaatttgacctagtatatgattaggaacaaatactacttggtgagagcaggccacaggtgctcggcaggccgagaccacgagtatattttacagaaggaatgtagagggagagcataggttggtcgaagttgcttaagagtgtattagtatctggttgtgtgtgtgtgtgtgtgtgtggtttttggttttgtttttgtttttttgagacaaggtcttgctctttcacatagtttggagtacagtggcgtgatcatagctcaatgcagcttccacctcccgtgcttcaagcggtcctcccacctcagccttccaggtagctgggactacaggtgtgggccaccaagcctggctaatttttaaaaaagtttttttgtagagatggggtctcactatgttgtccaggccggtctcaaactcctgtgctcattgggggatcatcctgcattggcctcccaaagtgctggcattacatgcaagagagtgtctgtttttaaatcacttggtctgcctcttgcaagactttcttctttttttttttttttttttttgagatgaggtctcactctgtcaccgaggctggagtgca

SEQ ID NO: 4834 - DNA, 1035 bp, Homo sapiens
ttctttgtatgccacacatttttaatcatgcatccctattttggtaaagcttttttttttttttcagactcaagtactactgcatgtttgtcttgggctggtggattatattatcctttggaggtctctctaaagtatactttattctagggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttacaaatataaattgcggtaagtaggaagaacgattttttttcctatggaaaacagttgatccttactaaaagctcaatgataccgcagttctagggctgaaatgttaagtataaaacatctagttttctccaaagctacacgtctcaaagctaagtgtggtggtattatttccaggtataggtacacgctggatgatctctaccctatgatgaatgcattgaagcttcgagcagaatcttacaacgaatgggccttgaatgtgaatgaagctttggaggcaaagatcaacaagaagaaaagtatgtgatacagaaagtgacttggtgattggcaaattggggcttattgtgatgtagccaaattaaagtcaacaaaacatttcttgaaacagcctgacctcatccttggttagcccctctacatagcccggtttacagagcaccggcagagaaggttttaaaaccaagagtggataaggcagttgcccttacatcccagtgaaattttgttatatgagttgtgcaacatcacttacttaacaaaaacgatattgttaggaaacctttatttttgtctcagaaataaaaatttcacatttcttacaaagatgttgaaatctttaaaaaaacaaaaacaaaaacaaagcatcttgtgacaaaggcagcatgacactaaatcaggagtctctgaaatggtagtttatcacttcttagttcta

SEQ ID NO: 4835 - DNA, 1030 bp, Homo sapiens
cctgtagtcccagctacttgggaggctgaggtaggagaatggcgtgaacccaggaggtggagcttgcagtgagccaagatggcgccactgcactgcagcctgggcgacaaagcgagactctgtctcaaaaaaaaaaaaaagaaaaaaaaagaatataataggccgtaggccgggtgcagtggctcacacctgtaatcccagcactttgggaggctgaggcgggctgatcacctgaggtcaggagtttgagaccagcctcaacatggagaaaccccgtctctactaaaaatacaaaatcagccgggcgtggtggtgcatgcctgtaatcccagctacttgggaggctgaggcaggagaattgcttgaacctgggaggtggaggttgcagtgagccgagattgcacctttgcactccagcctgggcaacaagagcgaaactccatctcaaaaaaaaaaaaaaaaagaatagttaacttttctggatcaaatcaatatgtaggtttaagtagaatgagcagaatgtttaatatttatagagcgctattaccagtggtagatttattacttgttaacaagtaatgagtcagtttttaatagtatatcatatttcttaactattagaaataaattttatcattgtgttgctttgtactttattttgttcttcgcccagtctctgtatttctgcaaatgtgagggggaaaggggcgaatctcattagtgagattctatggtagtaactatgctcatagtgttagtgcttcaggaaggttgttatttccacgtatctcattccagatatagctgctataacacaccctagagggttacttttggaacttacttttacaaaggtttttcgtgatgttcctgggtcctgttatgaaaaagtagtgcttacctgaaattcatattagcttcggtggcaatattttgtcgtgttaatgttatattggcattaaataccctcctttagccagcttagaataaaactaaaaagaaaaaccaaagaagagatgcatttctgatc

SEQ ID NO: 4836 - DNA, 1029 bp, Homo sapiens
cactccagcctgggtgacagaatgagactcagaatgagactgtctcaaaaaataaataaataaacaaacataaaaaataaaaaatagaatgttgaatgtggaacctttttgcctcttatagtcagatctagatacagttgcccatagtagattaattttctcttcttgaactcttcctaagtacggaagtgatagtgaataaagggagagagagtccctttaatgatgctttgtgggttgtaacattttagaaacatgtcacttatatacttaaaaaggcaatgtagttttatggttaaaaagcacttaagtatttatacaatcaaggagtctgaaaggaataagcatttaaaggtacccttttgtaaacattgcatctacaatataggtagatatttgtgagggacttactctgtgccaagtatgttttaggaagtgatacacattctttgtagaaagtttaaaaacataggaaagtatggcaaaaataaaatcactcctgatccttccacctgttacttctctcacggctatttttatgcatacattcacaaattcaagtgtactgttcatatacatcattgcatcttaggtttttttactaatcatatgagcatttgctgtatcattgaatagtttttgaaaatgcaatttctaatgactgcggcaatccgttttttatagccagactttattttgatgtcttctattgtagaatgtttaggtcagttctagttttttattataatactatgatgaatattccttgtatgtaaatttttacacctatttctgatttttgaaatagttattagggagagaagaattgaagaacatatacttaagaaaaacagaggtgtacagtaaaggaattattgcaaaagggtgaagtagggtgtaagttaaatttcaggaagcttgagaaaagttgatgcactgttccagtggaacagaggcctcaatcttgcatcatcatgttttctaaatgttttaagggattgctctgtctttgggatgatgtgattatgg

SEQ ID NO: 4837 - DNA, 1512 bp, Homo sapiens
ggtaagtttgggggctagccttaacctgttttatcttactacttattggtacattgtcttttcagggaaatgaaaaagccttgattgtgtttggaagaccttgttttagaagaccttattttggtggggcgcggtggctcactcctgtaatcccaacactttgggaggccaaggcaggtgaatcacctgaggacaggagtttgagaccagcctggccaacatggcgaaacctcgtctctactaaaaatacaaaaatttgctgggcatggtggcgtgtgcctgtaatcccagctactagggaggctgaggcaggagaaccgcttgaacccggaaggtggaggttgcagtgagccgagatggtgccacttcactcaagcctgggcaaagagcgagactctgagactccgtctgaaaaaaaaaaaaagaccttgttttgtgttttttcctctagtgtttttgttctgctttgagagcagctatacttagaagtttgtttctggaatgagtaagattgtggaggaaatttttttactgtccaaagctgaggagttgattattatctacttgttacaactttgcattctctttaaatttaaagtagctaaagtattcctggctgtcatatgaaggtataagctgtgaaataacttgcctacctgttctcttctgccagctgagatttttgaggagattgtcagaatgttgatatggtaaaaggggattttataatgctacatagctaacgggttcctcttctagtaattcctatgtagccaagttcatttctgacaaaatggtatttgtgaaattattcacttaaaaacttttaggtaaaacagtactgtaaaagcttcccatttatttccaggccttggtagaaagaagaggggtgtcattatccattcacaccctttgagttattttaggactacagcagtgagtcctataactttaagaattgttttctgtgctgtagagaggtaggaagagaataacatagtttttgaggggtaaatcactaaccaaagtcctgtcctaatactatacacacacaaacacaccatctgtaatgcttaaatccagtagattttttcttccctctctcccttattgattccaggtgaacactttttagcctagaagaaagtagccaatctgacattcaaaacttttttttttaatacattatatgaatgtttagtgagcccatggatgaaattgtttagaatgttgaatgtgagccgggcgcgatggctcacgcctgtaatcccagcactttgggaggccaaggtgggtggatcatgaggtcaagagatggagaccatcctggccaacatggtgaaaccctgtctccactaaaaatacgtaaattagctgagcgtggtggtgcgtgcctgtagtcccagctacttgggaggctggggcaggagaatcacttgaacccaggaggcagaggttgcagtgagctgagattgtgccactgcactccagcctgggtgacagagcaagact

SEQ ID NO: 4838 - DNA, 1047 bp, Homo sapiens
ggtgaaaccccgcctctactaaaaatacaaaattagctgggtgtggtggcacatgcctgtaatcccagctactcgggaggctgaggcaggagaatcacttgaacccgggaggcagaggctgcagcgagctgaggtcacgtcattgtactccagcctgggtgacagagcgaaactctgtctccaaaaagtgaataaataagtaaataaataaataaaagatctatgctacagggtacatttttccttttttgcttttttcattgtattaaaatattaaaatgtacataacattaaatttttgcctttgtaaccatttttaaggatacagttcagtggcattgggtacatttacattgctgtacagccattaccattgtctacctccagaccctttcatcattatcccagactgaaacctattaacacatttttatacctttagctgttctcttgttgtagacattcatttccagttttctcccttcgtaggtaacaattcatacatatatgtgtgtgtgtgtatatatatatatttaattgtctgattacttcctcatgatggcagttcttccatgataggaaaattctcctctagagaacagttgtctatacgagtatacatattaaggacaaatttttttttttttgaggtgaagtcttgctctgttgcccaggttggagtgcaatggcgcgatcttggctcactgcaacctctgcctcttgtgttccagcgattctcctgtctcagcctcctgagtagctgggactacaggcgcctgccaccccatctggctaatttttgtagttttagtagagacagggtttcaccatgttggtcaggctggtcttgaactcctgacctcaggtgatccaccctccttggcctcccaaagtgctaggattacaggttgagccaccttgcccggccaaggatgacttttaaaattggatttggatgtcagtttttctccccctgacaccactgtagaatttaccctcaatttaataagaaaagttaaggtgggccaggctcagtggctcacactt

SEQ ID NO: 4839 - DNA, 1047 bp, Homo sapiens
ataacattatatatcacctgtaagtcttagttgttaaaattttcaggccattttgaaagtatgttaagactaaatatttgaacatttacttctatattctgacacattatttttcatatgcttttgatctcagcttaacccagatcaattcatttctgaaaaccaacagcttttataacacactggaagcaaagctctgagcaatataaaggcttcctgttagcctaccatagaatatcaagaagcagtgtgatttccttttgctaggatgtgttctgtataaattaaacacattactttggcttttagttattgagctaaacaaaaataaatcagactttaatctttttcacttgggatggaggtattttttaactttaacaaagtatagtattttttaactgacatttaaaacattaaccataaaaaggcagtacaactatgttaaacatttgaaggccttaccgataattacctttgctttttagcttaacattttatcatgcatcaccggcgggcatttttattgaagtctttgttatcactaaaacaaaacaaaatttcatttatgtatttattttagagctaggttcgtgctctgttgcccaagcaggagtgcagtggcacaatcatagctcactgtaaacttaagccccctgggcttaagtcatcctcctgccttagcctcctgagtaggtaggactacaggtttgcaccactatgcctaatttttacattttttggtagagacggatagagactggtctcaaactgctagcttcaagtgatcctcctgctgctgcagcccaaagtgctgagattataggcatgagccactgtgcctggccgtcatttttattctaaactaaaagcagtctataatgataagttccaacagcacaaatttgaaatgttaaaaaagcctcttttctccttattattgtgatattatttaaaatctgcatatgtaaaattcaacacaatgttattaggttggcgcaaacgtaattgtggtttttgtcatatgtatatgtaggtaatggcaaa

SEQ ID NO: 4840 - DNA, 1049 bp, Homo sapiens
gagattttgtggaaagaatagagtaggaatcaaaatgttgggtttctggcatgtgttccattatttccatgttatccttgagctcctaaccttaaggagggtcatgactattttcagagctttattctattaacctatctgtaaaatgggcagcttaaaatatcagcccttctttacatagtgaggcccaaagagggaaggaatctagcccaaatcctggtggagccagatttgaacttaggctgtgcaggtcctcagttactgctctgaactactgcattgccttttatataaccatagtaatgatacaattgtgatttcatgagatgattaatgggaaattatgaatctattatttttgcatatatactttgtatcctggtaggttcagcaaaacaaaaacaaaagcaacatatttgttggtttttgctgctaaggcagatccattttatagaaaaggaaacaaactgagcttgagagacttgacttgcctaaggtgacacagccttgaaaggacaaattggatgttgcaaaccatggctctttattcccaagttcagtgttcttctaatttaatatataatggctcccttcatagatcctagaaattagcctgcttctctctttcatctccccttacagtcttttttttttttttttgagagggagtctcgctgtgtggcccaggctggagttggagtgcaatggcacggtcttggctcactgcaacctctgcctcctgggttcaagcgattctcctgcctcagcctccggagcagctgggattacaggcacccaccaccatgcccggctaattttttttgtatttttagtagagacggggtttcaccatgttggccaggctggtctcaaactcctgacctcgtgatccacccacctcagcctcccaaagtgctgggattacaggcgtgggccactgtgcccggcctacagtctttttttgactgtggtcttctctctcttccttctggccacccagacttgaattcattaataacaatagtaagctgcatgtatacagttatcaa

SEQ ID NO: 4841 - DNA, 1030 bp, Homo sapiens
aaagcttttctgtccctgaatctttattttttttgagacagggtctcactatgttgccaggctggagtgcagcatgatgtgatcttggctcactgcaaactccgccttctgggctcaagtcatccttccacctcagcctccctagtagctgggactgggactacaggtgcataccatcatgcccagctagtttttgtatttattttaatagagacggggttcaccatgctgcctaggctggtcttgaactcctgagctcaagcagtccacctgcctaggcctcccagagtgctgggattacaggcacaagccactatgcccggcctgtccctaaacagattagtgagattaacatgttttaaaaggtagagctgttaaaaattatttcagaaaatttgcaggtgcatttgtgtgtcttatgtagtgcatgtatataggcaggagtttagtttggtgagatttgtattaagaagggtttacagtgatttaaatttcccctaatatgggatgactgtgacattgtggaagccacgcaaatagaaggatattgtacttactaacataatttaaataatctcaattcatgtctgacaggaggggtcaatagttgaagtctagtaattttgcaattatcctacttgtaaagtggggagaaaagtagaagtggcaggaaaaatgtttacctagatcttttaagaaaatattttaggacaagagccaccatcatattttattcttttatttatttatttattgaagttaattatatttagacttaaggaattaacaaaggagcagggagactagaccaggtcccaggatatcttgactccttggggcaggcccagctacagcaagcacagagggaaacataggggaggggcagatagcagatttggtcttgaacttggagggtaggaaatggatgatccccaggatggaagcagcaggaggaagctgtgtctgaggatggcctgggctgcccagaggggcagcctacccctggacccctggggctgttgcacagcgg

SEQ ID NO: 4842 - DNA, 1028 bp, Homo sapiens
aattttatttatttatttgtagagacagggtctcactatgttgcccacgctggtcttgaactcctgggctcaagcaatcctcctgccttggcctcccagagtggccacacctggcattacaggtgtgagccacggcatccagccttttttccttctaaagtttaaaaatttttaagtgaataccagagggataaggaggaaggaaggagagaggagtaggattcaaaccacatcccactcctcctaacaatatgtgaagaaaatcagtgtaaattttaggataacttcaaatgaaaggaagaagagtttttaatgaatagctgtacaggcgttgagtgtataacctgagaaaggatgttaactcataagcacttaacaaagggaattaggaaaaggttggcttgagagaatacaggtagtgctcacaaagtattaagaaacactacttagtaattgcctgacaaaatacttgaaatgtatagtaaggctgctgaatatattgtgttgaatattcttagaaagctgaacagaaaataacattgcaaatctttgtttttcaagatcccaagtctcattttaagagcagatttaaataaattatcttgatttattttttcaaagctcagttgtgggtgcatcactgtttattatataatttacacttacatgtatgcctgaaatatttcattatgaaaacactgttttaaaagtctttttaagcacaagttttttgtttgttttttgttttttttttagttagttctatcatcttagtgtagatattgctgctgaatcagaatgggagaggcgtattctgtgatggtaataactaccttttatgggccaggtactgtgctagtaattgttgtgcatatctgactcaccctaggggtaggtattaccatctcattttacaaatgaaggaatagggtttcagatattaaatcacttgcccaaagtcccatggcttgtaagtgctagaggtgggatttcattttatattttccaactctaaagcccaaacagtt

SEQ ID NO: 4843 - DNA, 1061 bp, Homo sapiens
gatgtccccagccagcaagcttgcactgggtcgaagagcttttattcctgggaaggagtggatttgttttttggttaagatgaggtaaatcaatgtgaagactggctaaatttttactgcctactctgtgaggcattgttcaaaatatattcttaaaacggattcttttctatgcaaggggcgcctttggaagtcatcaaaatatttcaatatgacagtaatatgaatgcctttgttaacacattaaatatacatgaatgatgagcactaatgtattttattaaaatttgtaatttctaagtaatgatgaatagaaacagtattttgagatacctgcagaactaatgtgtgagagtatctgatttctattggtgacaaagccacaagttctactaatactgtggtttgttgcttatgcttataattgaggaaaatgctcaatttacttagaggtaaatggaaatacaattttttccatctattccctggatcctgtccatagtgcatggatcctagattaagaacccctactctaaaaagatgtggtaagaacttagaatctaattgggggagggatgagacatgagatagaatctcctggagaggggcaaaggagggatctgtacgttttttaaaacaacgtttataatttttttgtttttattcagtatatcaattttgaaatttcaagtagcctaaaggaggttgtaccatatatatatatatatttttttgagacagagttttgctcttgtctcccagctgcagtggcacgatctcagctcactgcaacctctgcctgccaggttcaagcacttctcctgcctcagcctcccgagtagctgggattacaggcatgtgccaccacgcctggcttatttttgtatttttagtagagacggggtttctccatgttggtcaggctagtctcgaactcccaacctcaggtgatccgcccgcctcagcctcccaaagtgctgggattacaggcgtgaaccactgcgcccagcctggttggaccatattttcttaaaaggttgagaaacacttacctaaaactt

SEQ ID NO: 4844 - DNA, 1004 bp, Homo sapiens
ggctgggatggacactggggcctctcggggcatggggctttgaggacggggggacggctgggtgactctaggggcatggggctttgggacccgggggggacagccggctgaccgttgactcagtttccatgttcccaggggcctctctaacactgccctctccatctttcttccctcactccttacagttgctttctttttcctttctctttttctcttttctcccttttactcattatttacttggcaaatttgagctctgaaataggccaagcatgattctctcaccttctatgttctcccttccaaaggacttctctaaaaactgaatattcatcgtgtcccttctgaactctctgtccccttttccaccaattctctttcctccagaatgttcttctcttctctcccaagagctctgggatcagtagcaccaggaagtgttaagggaggaagcagcctgggaggtgccagctgtttgcccaaggtggggttggctgtagcatgggtcgctgggctgggctgggctgcagcatggacttaggtgcttagctcttctgtgttcttgttcttcccacgccttctgcctcctttcttcttcctgtttcccacttctggtacctacctaatgcaggcagaaaggcaacaaggcatttgatcagttgctgcaggtgctgcttggctgagatgctcattcctttttttttttttttttttttgagacagagtctcactttgatgcccaggctggagtgcagtggcatgatctcagctcactgcaaccttcgcctccttggttcaagtgattctcctgcctcagcctccagagtaactgggattagaggcatgcgccgccaacatgcatggctaatttttttgtatttttagtggagatggggtttcgtcatgttggccaggctggtctcgaactcctgacctcaggtgatctgcctgccttggcctcccaaagtgctaggattacaggcgtgagccaacgtgcctgg

SEQ ID NO: 4845 - DNA, 1055 bp, Homo sapiens
cagtacatggtagcttttaatctctcttgaaataaattgtctggaattgaacacaatactctagacattgtctgttccatgggaccctgatgccctccaacttgatgatatatttctattatgtcagactaaatttgcaaatcactggtgtttaaattgagctcattgtactgaagccctcaggttattttcccacggacagctgtcaggcttagatctcccctttgctgcataaaagatgtgatctgagttagagggaaggtcagggtcaaggggagcccaaagcctcccctcacattggttccaaacacacatgaactctcactgatgcagtcgcgtcctttttataatgctgttctgcgatctggcgttctatttggaaaatctcttgacccacacggggctaaaataaaattccctccccatgggtcttttctttctttcagtgggtctcttttattcttctttgctcattcattgcatttgcttatcaggtgagctgagcacttactgttgggaacttccttacctccaactctagctcctctgcttctccaagttcccaggctataggggaaaagacacagatgcccacagcataatcagagtgactgttttcacagacaaacctctggggctctctaaatccttggtcttcatggtccactagcatctgtatcatcagggagcttgctggaaatgcagaatctcaggcctcaccccaacatgctgaatcagaatctatgttttaacaaggccctccaggtgattcatatgcacattaaaagcggagaagccttgctctaagtcattcaatgtggagtaggaatgcggaaagcaagaagcctatctttcaaggccttgatattagtcctactgaccaggttcctggggacataaagctatttctgtactatttgatcacaagctatttcttggaatgctcataataaaggtttttttgtttgtttgtttgtttttgctatgttgcccaggctggtcttgaactcctagaacaattctcccgcctcagcctcccgaatagctgggactac

SEQ ID NO: 4846 - DNA, 1473 bp, Homo sapiens
aagaagcaattttgtatgtgaaaaggtctatcttcaatgtttacattattttgtatttgtagtatttgatttttttttttttgaaaagctagcattattagtgatgacctgaaacccaaagttttaaatcagttgatgtaaggtcgtcatgactactctttccagtggtagcctaaggttcgctgaaacattgtcatcgttatgaaaggcacttcattatgcaggataccattcatatccagttttctaagatggttgaggacattgttttttaaacttttctgttttttaaattgacaaaaattgtatatgtttactgtctacaacatgatgttttgaaatatgtgtacattgtggaatggtaagtcaagctaattaacatgtattacctcacatacttagcattttttttgtggtaagaacccttaaaatctactcttagcaatttcctttttctatttatttatttatttgagacaagctggagtgcagtggtgcaatttcgcctcactgtaacctccgcgtcctgggctcaagcaattctcatgtctcagcctcccaagtagctgggactacaggcgcgtgccaccacacccggctaattttttgtattttagtagagacaggtttcaccccatgttgcccagggtggtctcgtactcctgagctcaggtgatctgcctgccttggccttccaaagtgctgggattacaggcgtgagccatcacgcctgggctttttatttatttattttattttattttattatttatttatgtatttatttattttgagacagaaccttgctctgttgccaagctggagtgcagtggcatgatcatggctttcttcagcctcaacctcctgggctcaggcaatcctcttgcctcagtttcccgagtagctgggaccacaggctcacaccaccacaacaggctaatttttaagttatctgtaggggcgagatctccctatattgcccaggctggtcttgaagtcctaggcttaagtgttcctcctgcctcccaaagtgttgagattacaggtgtgagccacctcacctggccaatttgcaagaatataatacattgttattgactatggtcaccatgtcgtacagtagatctcttgaacttattcctcctcactgaaagtttgtatcctttgagcaacgtctccccaacccacttcttgttttttattaacttattaaagtataatttacaataagtttcactcattttaagtatgaattcaatgagttttgataaacacgtgtagtcatataaacaccaccactatcaaaatatggatcatttccatcacccagaaagttcccttatgttcttttgtattcggtccccttcccaacctccagcttttggcagccattgcttttcttttctttgtctttttttttttttttgacagacagggtcttactgtcacccaggctggagtgtagtggtgtga

SEQ ID NO: 4847 - DNA, 1776 bp, Homo sapiens
gtgatagtaaatgctgctttgagttaagccttcttttcttttttttttttttttgagacagtgtctcactgtcacccaggctctgaagtacagtggcatgatcacagctcactgcagcctcgacttcccaggcttaggcaatcctcctatctcagcctctcgagtagctgggaccataggtgtgcaccactttgctcacctattttttgtagagacagggtctcactatgttgcccgggctggtctcaaactactgaactcaagcaagtagcccaccttggcctcccaaagtgctgggattacaggcatgagtcgtcaggtccagccatacctccttttcttaatgggctctgaaggcaaaaaccagaggagtcccaggggttttgaaaaagacttatctggatatatgttctgaagtgggtgtttttaagaccgcattttatcatgaaagactagttcctctttggatctcaaataatcacctcaaagagccctctgatcactctatcccccaacccctcctttttctctcacagtaccttttaaaattatgttcactctgccctcatcttgttaacatttttacttgtttctcatctaccaccaccctcactagtctgtaaactccatgagaacagggatcttgtcgtttatgagtccagagcctagaactgtgtctggtatgctatagtcaataaatatttgttgaataacaacttttttttttttttttgagacagggttccactcccatcacccagactggagtgcaatggtgcaatcttggtgctgaacctccgcctcccaggctccagcgattctcctgccttagcctcctaagtagctgggactacaggcagatgccatcacacccagctaactttaatttttttgtagagatggggtttcaccatgttgcccaggctggtctcgaactcttgggctcatgagctgcctgccttggcctcccaaaatgctgggattataggcgtgagccaccacgcctggactcttttttttaatatatataaatagagatggggtctggctatgttgcccatatagcaactcctggcctcaagcagtcctcctgccttggcctcccaaagtgctgggattacatgtgtgagccactgggcctggccaagttaatagctttcccaaagtcacctctcttatcagctttattgaagtttcatccacacagccttgtctgaccagaaacaagtgtgccacaatcatcagatgatgtagaatcacagaatttaaatgtccttagagaaaagctaccgtaagctttaactaaatttgtagaaagtaattacaaatttcaatttggctaggtataccacatccattaattctagtgtcattattaatataagacacattgttaatttatgaatttaatatgcgagcaaatcaactgagaccctcctttcccagaattaataggctgcattggagtaccagagtattcttgccaccacaccaggggttttagctctttggcagaagattggctttgggtttctagtgatgctctgttgtctccaccagatggcgttatcttccatctgggagtgcctgatggacacctgttattacagatctggttgctattgctcccctggaggtgggtccctcaatgtgtaaacaagctggaaaactgccctgccctgcccattccaggcctgcctggcccagtgtgactccacctttttgtggtaattacccagaagtaggggctctttcttataggagaaccaagatttg

SEQ ID NO: 4848 - DNA, 1120 bp, Homo sapiens
cgcccggctaattttttgtgtctttttagtagagacggggtttcgctatgttggccagactggtcttgaactgctgacctcgtgatccgcccgcctcggcctctcaaagtgctgggattctgtgtgttttgtgcacctccactttaggtaatcatagggagcacatttacaggatggtctaataacatgaaaacaggctagtttcaagcaacagcaatgtcggttggaaagcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggaaaattgttccccatgggattctaacctcactaccaaatgagtgaaagcttgattaagagttcttccatatactagcctccttggaagaagtgatcagaaggtgataagaaggacagaaaggactattttaaagttggactgaaggagaaaaaagcaaaattcttgtttcatcccaattctagttagaacaaagttaaacccccgtaatcttaaagagaaaatctttggaggttttaattaaacattttatacatttaaagtcttgttaatggtgctttaagtgtcaatgtagcatgtaaaaggctttgtacagacaggtaaaagttccatttctgagtgatgaaatgtaacacttcttcatctttaacttgaaatcaaaactatcagattttatttttgtataatttaaggaaggtaaagttaggggactagaagactctaaattggcttctacagatcaataatttaaatgtaactagttgggattttatagttaaaattatatttgtgtatataacataactaatctgtaaattgtaataaatatatttgcaattattaaatgttaagtgatattttggttcaactttatattatatgtatcatagtattttacaatggttttggaattactaagcaggattagtataattgcaaacaacattttagtaatagaagaacttggttcttgcagtattatgagaggcccttctaagaaactga

SEQ ID NO: 4849 - DNA, 1029 bp, Homo sapiens
gcctgtctatgttaggctaaaaaataaccttgtgtatgctaccaacttaaagtgcattattttgtgtcacttttttttttcttgtaaaaatgacttggattgaaaatatgtggtagcctttttatttctacattaagttctacctaggatatttccaaggactgccacaaaacccatatgtgcagtactttactactttgggaaagctgcatctttctaccacattttaacatctaatatatttaatttctttgaagagggttctgtgtacgttattgtagttcccagtttaatatagttctttgtatctcttaacaggttgaagttattgcaaaacactctggaaagtaataattacatcataatcatttattttttaaacttaaaagcctagaaatttcctagaaagaaaataggagacatctcagagcaatttggttttggtgtatatgttctcaacagaaaaccagtgttaatgaatatcatgcctcagcactgtcacttttaaaacctgtcaggatcccactgtaaaattggaaatgggcagttctgaattttcacgtttgaaatgtaaaatataaacttcagtcaatatccaggtttattgtgtcctactatttaataatgagagaagtaatggcaaggcctttactttcaggaaaggatagaagtatagattaatgactggaaagttttaatatatttagcccaaaggttactttgaattgaagtctttgcattgactgtttgtgtttggtttatttgtttagctttacaaggtacacataagttaggttgaggggttgttaacccttccgtggtctgctttcattccgtgtgcttcctgtcacaggtaatggaaaacataagtagaataggtgacctcttagttttgaacttatttaagtgtggggatgaatttttcatcagaagtgcttacagggttactacctcagtttacaatctacctggtcattattttatttctatccagttctaagaactgcctccactgtttatatattcata

SEQ ID NO: 4850 - DNA, 1071 bp, Homo sapiens
caggttatatgcaaacactataccattttacataagggacttgaccgtctgcggattctggtgtctacggggtcctggaactaatccccatttcatgagaggggatgactgtacacacgtcagtgtgtattaggccatcaaaacgcctccgggaaattctcgggttattttgaaaacccctcccctccccaagacctttaacctagagggctgttggggcggtctcctaggagaccacacagaaacgactgcgcatgcgtgcattcccccccccccccccccccccccccccgccccggctgatgcaacctcacgctgccgtgcggctctacctcgagtaaggaagccgacagggaaatctggcaaaaccaatcggcggccacacggaagtgggcggaaaggcccgccccccggggattttgcgagtgacgttgggcggcgcggcgctagggacgtagacgcccaacagtcctgcgtctcttccggcgtctaggggggtgtcctgccggcgcgcgggccctgcggccattttgggcttcgcttccaccgcaccagccggcctacccagtccttccggtatcgcgttgctcaggggcttttcaaccctctgtcagtcggaaaaccatcgccgaggccgtggggggactcctatccatggtgttgaagcgtcgagccgactagggaacctccttccccgccaggatggaagtcgcatcagtcgccgcctattgcgcgggctgttcttccctgtgttctgccgcccgctgccgcattcgctgccctctgtggcttttctgctggctcgaagatcggcctggagcagcgacgccaccgctgggcaaggccgagactctgtaggcttcctccgaatcccgtcgacctccagccgctgagcgccgcggccctacctgagagactgtcaagaaaaaggagatggagccggggacaggcggatcgcggaaacggcttggccctcgggcgggcttccggttctggccaccctttttccctcggcgatcgcaagcaggctcttctaagttcccgacgcctcttggcccggaaaactccggg

SEQ ID NO: 4851 - DNA, 1047 bp, Homo sapiens
aatataattagcacctatatatccatcacctaaacacttaacattttgctatatttgcttcttctattttttatgaagtattttaaaataaataacatgccaggtgcagtggctcatgcctgtaatcttagcactttgggaggccgaggcaggtggatcacctgaggttaggaatttgagaccagcctggccaacatgtctctaccaaaaatacaaaaattagctgggcgtggtggcgcaggcctgtaatctcatctacttgggagcctgaggttgcagtgagctgagatcgccccactgcactccagcctaggtgtcagagcgagactccatctcaaacaaacaaacaaagtaaattacagacatcataatactgtaccccctaaatactcactatgcatctctaaacaataaagtcttgtttttaaagtaactacagtattattatattatccagtccatagtccatattcaaaatttccctatcatcccccaaattccttttactgttggcttgttagagctataatccacataagaactgcatgttgttggttgttatatttcctaagtctttttacatctggaacagtccccttcctttttgtattgggccattgtcttattgaagaatggccctgtttctgattctgttccagtgtgatttggtgtacaccttcttccacccactgccccgggatgagaaggctatgggcaccagcccagctcctaagtcctcaggtacagtatcttctctgagaccttactgccaactcctctgaactaccccaagggtaactgcttctgccccaacctcttctcagttctctctccttgacttgcctcctgttccttttcttactctctgggaaatctagtttcccactcaggccgtggggtccatagttccttacctgggttccccacagggtggatattcagtcgattatatccttagacccatcccaacccaattaactctaatcacattcagactacacttatgtagatgcctcatgagtatcagaaatctgacatggagaggct

SEQ ID NO: 4852 - DNA, 1017 bp, Homo sapiens
ggggttttcctgccctgtgcttcatctgtgctatgctctaccttccttccagtcagtcagaaaatcccctgtttgctgcccccggctttgcttccccacactgactatattagagtcctcatttgcagagcagcactgcaagctaagtatttgtagcacagattaaagagactgaggagggtcctggggaggccgaggatgcaaaataggtagatgaagaatctggagatgctggaagaggtgggtccttttacagatggacaactgggaaaatggaccctttctcatgcccttcacacttaggtaattcttagagcaataaaggtgtatatggctgggcacgatggctcacacctgtagtctcaccgtactttgggaggacaaggcgggataatcacttgagatcaggaatttgagaccagcctgggcaacacaaagaggccttatctctactaaaaaattattttaaatgagctgagtgtggtggcgtgcatctgtagtcctagctacttaagaggctgaggtgggagagtcacttgagcctgggaggtcgaggctgcagtgagccatgatcacaccactgcactatagcctgggcaacagagtgagaccctatcttaaaaaaaaaaaaaaaaaaaaaggacatggggtgtgcattaaaggtcctcaagcaaacaactgccaggacaggagaaactccttgcaggcagaggatagctgcattaaatggcccttgagttccaccattcccttgggattttttggtcacaattactgctgctgtcaagagaaggggtgccagcctgggcaacaagggagacccaatctctacaaaaaatacaaaaaattagccaagtgtggtggcatacacctgtggttccagctacttaggaggctgaggtgggagaatcacttgagcctgggaggtcaaggctgcagtgagtatccagcctcggcaacagagcgagaccctgtctcaaaaaaaaaaaaaaaaaaaaaaaaagggtgctgcacagt

SEQ ID NO: 4853 - DNA, 1050 bp, Homo sapiens
acatttttagcaaaattcatgaaacctccattgaatggtcaaagtatcctgatcactctagagtctgaccctcagttgcccttaagagcaaatgcaccccagctggcgataagagtgttatctggaactaaaagagaaaggaaatggattcataaaaaattttccattaaacttagcatggaaagctttgtcattttagaactatttgtactgttcaatggtgggaaacattttgcaattataagagaagtgtcaagaagggggtttctcagagctgctaccccactgcccccatcctggcctgcaaatttggagggctgggctgagtggggacagaggggctcttgagcctcagagcatgaggttcccaacagatgtcttcttgactactctcttctaaaggcacagtgagggttttttttcttcctgtacagccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcacctgcaactgtaagttagtgaggggggagaggatgtgagcatcccttgaagtggggtggggatgactgtgttttgactcgatttccacctcatcttgtggcccagatgaagggcagtgaggatgctcctttgggggtgaggggctggctatggggccagcattctagtacagtcactttcctcaactctgaactacttgcctgctttatctggttggtgatggtgctggagaatacttagctggaaagggggatcagggtggggaaactgagacccatctgccttgacatccatcatgattgctccccctaccttacccttcacaggttcctccactgtagacttgcttatctaccagaccctgtgctacacccatgatgacctgaggaatgtggacgtgggtgactttgtgctaaagccctgcgggctggaggagttcctgcagaagtgagtgaatgggtgggaggtag

SEQ ID NO: 4854 - DNA, 1050 bp, Homo sapiens
gatcttgggcaggaggcttaacttcttttaacctcagttttctcatctgcacaatggggataataatataatagagttttatgaggattaaaagagatagtgaatggcaagtgcctggcagagagtaagcccttaatgaaattagctaattgtattgcatctattttagctatacaaggcatatgtcattactaaattatatttatttatttacttactttagagacagtgccttctgtcacccaagcttggagtgcgatggtgcattcttagctcactatagcctcacctcctgggctcaagcaatcctcctgccttagcctctcaagtagcttggactacaagtgtgcaccaccacaacaggctaatgtttttaaaaagagttgttatagagacgggggtctcacttgttgcccaggctggtcttgaactcctggcctcaagtgatcctcccaactgggcctcccgaagtgctgggattacaggcatgagccaccatgcccggctattactcccattttagaattgaggaaactgagcccaggaggatgtttctctgtacatgtctggagggcagcaccttgtcttattcatctctgtgatcctgtacacaggattgggctcaatgaatctttgtagagtaaaagacgtgtcaccccttgctcagtggggacctggcactggaatgcacagctctgggctgctaagcctgggttctctccatcaagccaggctgaccagctagggaggttgagagagcccttatggcccaggagcctcctagaggcctatcgccctctccagagctacccagggggccgtgccaccacttgctcacaggggaaagactttcaaaggtgggagctgaggctgccctgccaggcgatggccatctcagggcagggtcattcagcaggctcacggagcccccaaaacccttccccagcctgggagcaggagcctgggggtggcgtcccactagccaggcagatgaacagcttctttggtctgggatttcactgaaagccctgaagccctgagccctgcttc

SEQ ID NO: 4855 - DNA, 1023 bp, Homo sapiens
tgcagtggcatgatcttggctcactgcaacctctgcctcccaggttcaagcaattctccggcctcagcctcccgagtagctgggattacaggtgtgggccaccacgcctggctaattttttgtatttttagtagagactgggtttcaccatgatggccaggctggtctcaaattcctgacctaaagtgatccatctgccttggcatcccaaagagctgggattacaggcatgagccaccgcgcccagtggctttttttgtattcagcataatttccttgaggttcatccaagtagttgcctatatcagtagttagtttgttcttttttgtcaccatgtagtataacatgatagggatgtgccacaattatttaaccatccacccactgaagggcattggcattacctcgttttgcaagtgagaaagctaactggcccaggatcacatgactagcaagtggcacttaataaatgtttagcaataagcacctaacaaacgtttattgtacaagctcaactgaatgagggtactttatgctcttcacttagcacctagcatggtgttttacacatagtaggtgctcaataaatgtttgccagtgaggatatggatgagatggcatttatatttacataacttgtatcatgaccaacttattcctatgcctagacattcacaggagaggaatatgtccctctcaatatcttacactttccgttttacttagaatatcaggaaaggaaaattggggcagtaaatatgaccacatacagggctggcattttattgcctaaaatgcccagagcttttggttccaaattaatatatgccatcttttcatagtattttgcatcgaatttgcaggttgctcattttatcaaaatgcaaagcaacccttccaactcctgcttcttcctgtaccaccaccctcccagcaggtgctgggtcaggctgtgccaacgcagtctgcagaaacaattggttgggttccgaaagtgtccatgctaagctgaaaagtctact

SEQ ID NO: 4856 - DNA, 1034 bp, Homo sapiens
taaattatcctggattatctgggtgggcccagtgtaatcacatgggtcctttaaaggtggaagaaggaggcagaagtcagcatctgggtaatgccatgtgtgaaaggctggacctgccagtgctggtgttgaagatggaaggggccatgggccagggcctgtgggcagcctctagattcctgtctaagaagctgggaaagtccaggaaacagagtctctcctccagcctccagaaagaaacacaaccctaccgacacctagcttgaagccggggagacccattttggacttctggcctccagaactgtaagagaatacatctgtgttgtttatagccactaagtttgtggtcctttgctcacagcagcatcaggaaactaaatacaaggcaaaagccaagcggtggaccagaacccagttggcctccttctgacctcccagccaccccggagggattgcttcagaactcggtggctccgagaagcctggtttgaaatacagcgtgtctgaaatgcaacctgctaattctccagacaatgaaatcgaggcccaggaaggagtggttttgtgtgaggtcatgctgagttagtggatgagccgggactgcaacccacggtccactcctgttttgtcagaaatcccagatgcttacatgaattctctcatgaactcgtccgttacaacaattgtatgtgtatatttttacattttcaacaaacgtgtgcatataaaggcccaagcactgtgctaagaactgggcagaggcgacgtgagcactggcgcaggaagatgagcagctctgagttccagtcctgacctcagccccttcctgggcctcagctttctccaaacatccgcagccagcccaggttgctcagatctgtccgtgttctttgtcctggaactggtcaccaggtgggctttctcacagccacctgctctgagtggagacacagctctgggaaaggagaggacccagcccactggcccaggctgcacctgccctcgtgaagcttatgcagcatttatcaccc

SEQ ID NO: 4857 - DNA, 1761 bp, Homo sapiens
acaaaggcagaagataaactgagaaacaaaaaacacttttgacaaaaatgaagtagctaaaaaagacaacaaaacaaaaccgaagacaagagatatgcaaaaaagacagcagcatgtgattagattgctgaaaggacgagtcagaaagatgcctttatctgttactttccagtgcggggcctgggtctccgtggcctacagctcagaggctgaaatttcaccaagttagcctcaatcaggcatttgcttattcagtcaacccatcttttctaagtacctactgtgtgcctggctctgtgctaggtgcaggggacaaagagacagatcagatgtccctgccttcaaggagttcaccgtcagagtagagattctagagccacacagctggagttcaaatccaggcttcaccacttctagctgggtgacattgagcaggtcacgtaacctctcttcgtctcagtttcctcatctataaatgggataataaaagtacctacttcataaagctgtcatgaggactacatgaggtgatacatgtaatgagcttagaacagtatctggtatatatatagtaagtgctatgtaagtaatattattattgttattattattagatgggggagtcagtcccatagacaataatgaaacaagtgttggactatagggataagcagataaaaaggcgactctcagccaggcttggtggttcacacctgtaatcctagggaggccaaggcgggtggatcacatgaggtcaggagttcaagaccagcctggccaaaatggtgaaaccccatctctgctaaaaatacaaagattagccgggcgtggtggcacacacctgtaatcccagctacttgggaggctgaggcgggagaatcacttgaacccaggtggcggagattgtagtgagctgagattacaccactgcactctagcctgagcaacagagcaagactctgtctttaaaaaaaaaaaaaaagtgactctctgtttgctgtttgcggattaggaaagggttgccaaatgatgtgatatttgaaccaaggcttgaaaaagagtcaaccaggcagagatggtgggtctggggacacaggtgatgagggtatttggggcacaggtatcgtgcatgaaaagataccagggtgtgtatgtgttcattgctctttgtgaatgtcaccatcaccgctgacacgtccctctcagcctctttttctccagagctgggagctgggcttccagtggggctggctggtcgcccagaacattcccacatgtcttggtgcaggggacctggtgcatccctgctgggggttagcctcatgaccttgggctcctgcacgttctaagcccgcatcaagcagactctgctccaaacccagagctgctaggccttgcactctgccttctggcacttcttagggacctgggagacgccttggcctgagggggctgccttttaggaggtgagtttaaccaggtttggtttggaattcgtttttttctgtgtgtttcttgcacccacaccttccctgctactcagcatttgatggacctgaagcgagttccaagataaagtgcagacagagggttcctggggcaataactgtttctcagcttctacctctcacgtggtaacaacactaattatgatacccagcatttattgagcatttactgtgtgccaggcactgtgccaactgctttacctgcattatcccattaagctttcaaaagtacccctattagataggtagttaa

SEQ ID NO: 4858 - DNA, 1029 bp, Homo sapiens
agaactctgatcattttgcttttcccccaaccctttgggacagtactgaggaaagtattggggtggggggtttggatttggattgttttttgttcaataaagagtaattgggagttggagttggttatgtattttcttaaaaaggggaatttcttggtccacgtgtgcttgtaatgcatcatccagcattcagtatttctgttcttacaagtaactggtctaaattgaagctaaaagaaatctttttgtgtctaatctctttagcaggaggagcaatctcagaactgttatgaagaccttcgaagttcttcattctttctcactttgccatcatgtggcctctggacactgtggtcagtcatttgaaaattgactttaatttaaaacaaaggcctgtgcctcccacccaggaggtgggagggtgaattttatgtttaaatgaagaagtgaattatggaagaagagtatacgaccttcccttccctttcaagcataagtccaaatagactctcaggaatgaagatttgtgaagacatcagataggaattttgactcatttaaactttgatgcttagttatgttgctggagaaaagatacttatgttttgctcatctaacttcattgtacccagcgtcattttgacatgtcatttcctatctcccatttgccttcggtcctcaatgcatgtctttgagtgacttcttatctgaaattttgctactggtatcctaggaaagcttttgttggatactctcattttaaacttctcctctccccagatacctcctatatttccatattgtgtgcaaaggatgggcagaaaagaaagtgcttgaaagatttcaaattttcagaaagggaacaacgaaggccctctcttcctctcataccacgttttgctcaagaagctgggctgtaacaattcagggttttcccttgttttcctctcattgcatgtttccctccaatattggttcattgtcatcaatcatggtttttgaagatagctagttttatccatctccagc

SEQ ID NO: 4859 - DNA, 1064 bp, Homo sapiens
tttctggctcttttcagggagaaactctattgaactttctgttgcatttttctattatttatttgagataacatttttcttttgcttttcttactttcagctcagtttctgttttacatcttaattttactttgaacacctttaaattatgtttgtaatcagtgtacttacaagaaaatttaacattttacctctaaattcctaaaatgaccaaagaaggcagtgattcaaaagagctacagttaataacttagcttatcttaatgtttaagatagaaaatacctaagctagtaaaacttacagatacccatttttttcttgtctgccaaatttaatctaagaattgtgaattcctttcatgctcacatctttcattttatcattaatgtgtagattacagattattgctttcacatatggttaagtagtatatcttgttgtataggaaaactggagtgcatttgcaccagacttcaaagaattggatgaaaatgtagaatacgaagaaagggaatcagagtttgatattgaagatgaagataagagtgagcctgagcagacaggtactatttctaaattgcagacaggatttcctaaagggaaaatgattgctttacttaatattcttcatttgtgttgtaaatttatttcagcacttcatctaaaatgcccccctccaccccacacttttttttttttttttttttgagatggaatttcgctcttgtcacccaggctggatgcaatgatgtgattttggctcactgcaacctctgccccctgggttcaagtgattctcctgcctcagcctcccgagtagctgggattacaggtgcctgccaccactcccagcgaattttttgtatttttagtagagatggggtttccccatgttggccaggctggtctggaactcctgacctcaggtgatccacccactttggcctcccaaagtgctgccattacagacatgagccactgtgcctggcctatgaaccactgtgcctggccttcttttttctttaagcttacacaatttccacagtatttggagagccttaat

SEQ ID NO: 4860 - DNA, 2022 bp, Homo sapiens
aactgtcaggaatgtctcccagctggaaagggtgttggatgctgatagctcacagccaagttcctctccacagattttgccttcagcagatacgagttggctctcacaaggtgttgcctccttgccaaaaccagtcaatgtccaatggctggtcattcaaggctataatggcctggccctctgaccttaatttggtatgactcggaaggagcattcctcctctggtgcttattgtggggttgtctgaggcctctgctgtggggcaagtgaggcacttgtttggcgtgcaaaatttaagggggcactccaaaactcaatacttttaaaagtcagaattaatgccaaaaagaagccatgatgaaaaaaaaattttaaataaagataggacctgtctgcatttcattttcctctgccttccctgatcggcttttgatctgtcttgattaactggattggtgagctgaactcagtgtgcaagtttggatcgcaattaatataagctaacacgtggctttgaatgtgctaggtattttgtctttatcacttataaaatgtacagtgaattagtttcaaggttgtgtactgtttttagataataacataaagtaataaaaaaaagcctaggatgagaattatagttcataaattgttcctgtggttgtttattgatcaacaattatttattgaggatgtatagtgtgccaaccactaatctagacacttggaaacaaaacagagtaggctgcttgccttcaagaagcttatgttcaaagaattgattaggcattcccttaagatattaatgaactggagagaaactcactatattccaattttcctttccttctagctaatagtcttttgtttcctagctccagaaagtttagtgtatcctggtgctaaagataaattaaggtcaggcacagtggctcatgcctgtaatcctagcactctggaaggctgaggtgggcagattgcttgagtccaggagtttgagactagcctaggcagcatggtgaaaccctgtctctacaaaagatacaaaaattagccaggcatggtggcacatgcctgtagtctcagctacttgggaggctgaggtgggaggatcaccagagcccaggaggtagaggctgtagtgagccgtgattgcaccactgcactccagcctgggtgacagagtaagacactgtctcagaaaaaaaaaaaaaaaaaagggataaattaagtgcttaataaagtgcttctaagaattttctttctttttcccctgacactggccttttatcttctatctatcaaagtgtaagactgtccatgtggctgcaaaatcctctacaaataaaagtataccccatgagtacacacatgagatcactttttcagttctattgttcatacaggcacaagcaagaaaaaatttgagagagaagagtatcatgatagtacaatcttgatccatgatcttgagaaaaagctgtctacatctgggatgccatctgcttctggagagaatcttccctggttagctttaccttaaggtttccaatcagtatacagttccaagagtctggaggaggcccttctgagttgtgagattatgagaccaaggttcaggatctcaaagttttgctgcattgtggatgccaagggcagtttttctgtgatgttgccctcagaagacccaatcgatctccaggttctagattgtgaaaggtttgattgtcctcagtcagtggactatgaaagttttttttaacctggtgaaaatacactttggcataatgcattaaaaccttgtagcatttagtcatatcagtatttagtagcagaagatacaagacgttctattattaggtgcataggcctttccagtgactatttatttcataaggggtcaacttccatcttctactggaagtggatctgattgtcatcaatctggtacacctttgaccaaggcaatctagtcaattcagttagctttgcctaatgttattgtatctgcaatccttttttaaa

SEQ ID NO: 4861 - DNA, 1032 bp, Homo sapiens
tacttgcaaatgataaagtaactgactcagtgtctttgggctctgcaggctttagccttgttttggtaggatgttcagtatattctcagaatttttaccacctatttagctatacttcaagtactctattctctgcactaacttactgtccttctgggaactatgatggggcttcaagggagtcaggtgtcaagaaaggaggggtaagtactctctacttgctggaaaatcattgtaagtctgttgtgtatgaaattttaggaaaagtcttatatagttccctttccagactgttttcttttgactctaactataatcataagtctgtgcttccattatgaaggtcacattcctagcattcttgggaagtattagctcatactctcattcacatatgggaggttagatttttttcctctacccagagtccctttttagtttaccccacggcttagtttgctgtcagataccagttctctagcagattccccaacagttttttccccagtggggagggtggaagggagggactgatataagtaaggagatgagtagttgtgttacagttcattttctttaaaaaaaagtattttgagaaaaggtgcaaaatattcttgaaagtctctaggccagccaaagtccacatatggatatttggggatgttatttaaatactcagcaggctgagtgcaggtatacgtgtgtatagagtgtgtatactttgcttttgttttataacattgtcagctaattttggctttgttctttggcatccattcttattataagtgatggaatgccatgaaatgtactgtattgtatattacttgggaggacactaggttttcaaagaagtctggcagcacttgggttatagagggctcagcatgaccaaagtcctaaagattttacctcccagctttggttgtatgtgttcccaagtggtgaggtgagattgtggctggaggaagaaaaaggatggcatgaaagaatgacccttattgtggtctgtccttctaatcaacataatta

SEQ ID NO: 4862 - DNA, 1062 bp, Homo sapiens
ctcttgggtttttctcattaatatgctagggagtgtgaaattttgcaaagatcataggatttggaataatgagcactgggttcaaaagctggctgtattacttcctaactgtactattcccttcccatgtctactttgttctctctttgaggctgtttcctgatctataatacccatgtaacaaagttattgtgaagatgaaattagattacatgtgtaaaatccttattttagtgcctttcaaatagtttgcacttcataaatgttgttcctcccctcctataaatgtgacataaaagctaacaaaattgccgggcacggtggctcacacctgtaatcccagcactttgggaggccgaggtgggcagatcacgaggtcaggagatcgagaccatcctggccaacatggggaaaccccgtctctactaaaaatacaaaaaatcagccaggcgtggtggcgggtgcctgtagtcgcagctactcgggaggctgaggcaggagaatggcttgaactcgggaggcggagcttgcagtgagccgagattgcatcactccactccagcctgggcgacacagcgagactccgtctcaaaaaaaaaaaaaagctaacaaaatcaacagtctcattctagacttattgcttcttatttattttttttttttgagacggggtctcactcccatcacccaggcaggagtgcagtggcacaatcacagctcattgtagcctctacttcctaggttcaagccatcctcccgcctgcctcatctttttactttttgtagagatgaggtctcactgttacccaagctcatcttgaactcctgggctcaagcaatcctcctgcctcagcctcccaaagttttggaattacaggcgtgaatcactgcacctggacttaattgcttcttctcaggatcttagctgcctttagtagttgagggttacgtgacccctgatcattgtgagagttagacatcatcaacgaatcatgtctttttgcagccatcatcatcacggtagttccatggttctgatttgggagatgactttatttagtg

SEQ ID NO: 4863 - DNA, 1016 bp, Homo sapiens
cgcctgtagtcccagctacttggtacttgggaggctgaggcacaggaattgcttgaaccagggaggtggaggttgctatgacccaagatcatgctactgcactccagcctgggcgacagagctggagttttctttttttgagctctgtctctgtcttttttttttaggccaggcacggcggctcatgcctataatcctagcactttgggaggctgaggtgggagggtcgcttgaacccaggagtttgagaccagcctgggcaacatagtgagaccccatctctattttaaaaaaaaaaaaaaaagtgagatttttaaaactactgaaggagggaaatccttgggtaccaggaacaagtattgcagtaataactctgttgagacctgaattaactttgaagtccatgttaactttatgagctgcaggagtataataaagcaaaagcattttctatttcaccaacttttgtagtgccttccctaccttggacatagactgtaccttaagagccttcagttacctttcacgagtatgtattattgattggtagtggctgaaaggtgtgatagatttcctcactcatcttgagggtcatggccaacacttctctaacaaaagacagtttaacaagagaaaagcataacaaatttatgtgacacgggagcctttagaaatgaagtcacaaagacccagggaaaactgtttttatgcttaggtttgatgaagaattgactgctttgtagaaagtgattggacagtaggacatgatctaatggtaatagactgagaaacccagcaaggctggtctgctcaggttattcttgggctctttatgtgcattccttcccccagggtgtgggatgtggcaggtcctctctggaatgagggtcttcagaggaaaagagagcaacctttctagttttatggcttgcttcagagaagaggattgctagttagttcctttttttttttttttttgagacggagtctcactctgttgcccaggctggagtgca

SEQ ID NO: 4864 - DNA, 1062 bp, Homo sapiens
ggcagcgagtcccgggagtccgaggaggccatgggactgtagtcgggtgtgtgggtttgatgatgtatgtgaaatgtgttcacaccaatcatgaggcagctctgtgaagaggggacattctctaaatagggttgggggtcgccagaggaaatcatatctgatgggtgccacggaattgccagagatgttgctcatgcttaaggtgaagaagagagggaagggatcattttggtcctgagccaatggagaactagctactcttgttctttcttgcatgattctttctaggatgtgccagaggcccccaaacacttaaaatcgtgcagtctttaatctttcctaacgtcttgcttccttttaaactgctgttggtggggaactggaggatttgttaactactgcgtctaattaggaaataactttagattggaagggagaagggactgacattccacgtagatagatatcttggggacaaaacagcaaagaagtctgtgggtttaatttagtgattctcaaactaaagtgtgtattaaactcaccccaggggcgtattaaaaatgccatgtctcgtgctctagctcataaattcctattgaataggtgtgtgaagtgggtcctaagaatctaatttaacatgaaaagaccctgaagaggccgggcgcggtggctcacgtctgtaatcccagcactttgggaggcagaggcggggcggatcacttgaggtcaggaattcgggaccagcctggccaacatggtgaaaccccgtctctaccaaaaatataagaaactagccaggtgtggtggttgaggcctgtaatctcagccactggggaggctgaggcaggagaatcgcttgaaaccaggcggcggaggttgcagtgagcagagattgtgccactgcactccaccctgtgcgacggagcaagactctgtctcaataataataataataataataatagtaataataaaagacactggggaaggtgatgcaggtggtccgttaaaatactttcagaaccatgaatttagatgctcatagcaaatttgaacacaagg

SEQ ID NO: 4865 - DNA, 1095 bp, Homo sapiens
gtgttattcatttaatgttcagcaaatattaattgaatgtaggtcttaaatgaaactcctgtgtgtgtgcaaccagtactgctgtctcagaagtgaggctatagttagtgctgttttgggggccacctttccttctgggcctttgtactgagcgtttagagcgtagatatgttcacccactgagagcggatggtgaatgcctgttcctttagtctttttgtgatgattttgctttttatagggaggacagagtctccgcctgggcaccttctcttaagaactggctttgcacacagccgatgcagtccctgggcactttgaaagcagtgggcaaaagggcaggtaagggctcagggttatgaaaattgctttgggactccccctgcctggggtctctagaagggagactattcttaggaggtgtctgtgccctgaaggagactttctttgctacttggcctgaaggacttctttttgaaaaaaagatttggactagaatcaaaatcctgaactgcaaagagatggccaattaggccgttgggctgagttccagccaaggagtcgggctctgcctttcagttccctgaacaggctggaaagagattcttggctcatggtcccatgacatggtgggatgcaggaagccaagttcacaatccatacccctctgctaatggagaaaccatgagtcagccgacccagctctcgcctatcttaagagtccagcgcagacaatcgtatggaaagcaggaagagaggaaaaggaagctgtagaaaaataaacatttccttgcattttacttggaacagagcagcgtttctggcacgttaagatccatagcatctcctgctcccccgctccccgaccccggctctgttttcctcctcttgtgtagaaacagatactttccttacctgatgggagtccagggtgcatcctgtggaaaaacaggagcaagatatagaaggtaaaagccagacaaccaaagatcacgccacagaccaggaaactatagctgccctgagcctggaatatctgccaaaggggaaaacacagagagacagacaattaaaacttcacgtggaaggtgtatc

SEQ ID NO: 4866 - DNA, 1041 bp, Homo sapiens
cattgatttttttttttttaaatgtatgcacaaacaatctggattttgaggagtacggtcaggaaaaaaaaaaaagaattagaggcccttgaaaggtcaaccgtaagcttcttagagttaaaatatgagtttaattttttcccacattttgacagttgaaattttgatagggacagtaaacctatgagcctctattaggctactggattttttttaactggaaaattccttgaagatttacatactatattacagattttaaaagtcaagactgacttaagtaaatcagaggtttggaattctggagctgtaactccaggctgttgatagtatcacttcagttccattcacccctgcattgtgtgacgtccagtctgacaacattgtttcatcctgatctgactttctactatgattcttaagttcttaaaggtgtccttttatgtttttggtgaatgtaagcacatttagagccactcagtaccacttctcaatacctctgaagcagtggttcagaaaaggagtgtccagcctttttgaacacacaaattgatcagtaagagttattgaacataaaaactttccctattaaaaattcatatgggtatatgttaaattatataccgctataccaaagtaatatgtgtgttataaaaaaatacacaaaaattgaagtgaaggatggcataaaaagtaattcttgagtagcagttatagtattttcttcccacaccccagttggttgtcttgtgcaccctccagaagcacacgcttttcctaaagactgctgactcaggatattctcattctaatctccaaacatatatgatgctctcttatgatatatggagaaatcctagagatttggagtttttcaggagagcttattgtcaacttttgaaatttcacattaattctttttgataaattcccaaataataatccattaccacatgttttccacagctttattcctattactttcgtcagcctgttgtctcttatcttcatgttaggtatgactctatttttattttacta

SEQ ID NO: 4867 - DNA, 1027 bp, Homo sapiens
ctgggaagatcaattggaaacatctttcggggcgggatagtaactggccttggaaggaaatagggatgttgttgactgaagtagtcaaaagtacacacttcactttttctccagctattgctatttgaaatttggggaatttaaataaagattctggagttctatgcctcatcagaatggtttgtccatctctttggttgatagatcagatcctctgtcgtcttttcccaccccctacaccccctggcttggaaaacttggtgcttcaatatttaggtttggcagcggtgttttcattaaaatgtagtatgattcaatattttcccttcaggaacactcttctctttgattttacttaaacattaaaactgcgtaagtggaatctgttcattcctagtgaggtagtgtctttaagttttattgtaagaatattgtaagaactgtgcaggatcctatacaaagagtattttttaggagcctgtgtagttaaaaacgtcatgttacttttggttactttttgacaacggtgagtattttgattcgaaactaggcttgatacattcataacttggttttttaagtagcaggctgaagaaaatttggagactttgtgtttttttgggtcttagctactgtctctgaaaaatagttgggctatgggtcaccacagcaactggactgtgtgtattataaacatgtttagggtggaaaaggttttatttaatagagacttcctttccttaatacattacttcaacatgctccctttcaatttaggacagggattggtctatctttgaagtgttaaaatagaatcaattatgttttcagcctttaccccctcaaaaatcaaataccttcatttggaccagttaagtgttttcttcctttgttataactttaaactttaaaaattgcaattgtggaaaactcgggattcctgtaagaaggaaaatcaagtaattagcctcttttttttttttgataggtaacaagaataaaaggttttgtttggttttgttttgtt

SEQ ID NO: 4868 - DNA, 1052 bp, Homo sapiens
ggagttcgacaccagcctggccaacaatggtgaaaccccgtctctactaaaaatacaaaaattagctgggtgcggtggcaggtgcctgttatcccagctactcagggaactgaggcaagagaatcgcttgaacttgggaggtgaaggttgcagtgagccgagaccgcaccattgcactccagcctgggcgacaagagtgaaactccatcttaaaaaaaagatgtgaatggcagtggaaagaaattgtaggaattgtgggcaggggtgttaggggaagagatagagtcggagaccaaggatgggccttgcctttatatccaggagttcaaagaacttgcctgtctgatacctctcttgttcacgacagggccaggccttttgagtggctgttacctacctctaagggtatgatgatgaattttatgtgtcaatttgactgggccacaggatgtttagatatttggtcaaacattattctggatgtttttggatgggatgaacatttaaatcggtagactgagtaaagcagtttgtcttccataatgtgggtgggcctcatccaatcagtaaaggcctgaacagaacaaaacagatccttgctctgagtaagacagaattcctcttgcctggctgcatttaaactgggatattgactttttcctgcctgtggacttaaaatattggctcttcctgggtctgtaactgctagcctttggaccggaactgtaccacaggctctcctgggtctctagcttgctgacttaccctgcagatcttgggacttgggacttgtcagccttcaataagtgtgagccaattctttgtaataaatctctttacacacacaccacacacacacacaaaccctattggttctatttatctggagatcctaatacaaggtgacagtgttttgatgggggcccaggggtttgggagtgcacagagggcccctaggtttatttactaacaccaaataaatcatcaatccttagataccagagctggggatcaaagcactctctcagtttacagatgaggaaactgaggcc

SEQ ID NO: 4869 - DNA, 1060 bp, Homo sapiens
acggcttctcatgggtgtggaacatctctgcttgcggtttcaggaaggcctctggctgctctaggagtctgatcagagtcgttgccccagtttgacagaaggaaaggcggagcttattcaaagtctagagggagtggaggagttaaggctggatttcagatctgcctggttccagccgcagtgtgccctctgctcccccaacgactttccaaataatctcaccagcgccttccagctcaggcgtcctagaagcgtcttgaagcctatggccagctgtctttgtgttccctctcacccgcctgtcctcacagctgagactcccaggaaaccttcagactaccttcctctgccttcagcaaggggcgttgcccacattctctgagggtcagtggaagaacctagactcccattgctagaggtagaaaggggaagggtgctggggagcagggctggtccacagcaggtctcgtgcagcaggtacctgtggttccgccttctcatctccctgagactgctccgacccttccctcccaggctctgtctgatggcccctctccctctgcaggcgttcggatgggcagcctggggctgttcctgcagtgcgccatctccctggtcttctctctggtcatggaccggctggtgcagcgattcggcactcgagcagtctatttggccagtgtggcagctttccctgtggctgccggtgccacatgcctgtcccacagtgtggccgtggtgacagcttcagccgccctcaccgggttcaccttctcagccctgcagatcctgccctacacactggcctccctctaccaccgggagaagcaggtactcattggccagtgggtggagtcagggtgggaggggtggtctgggtttttgggaggccaactagctcagaacctggtatctggcaagcaactttggagaatgcttctttgaatcagagaagaagcttatcctagccccagggccagaggcttgggctgcagaacagtgtagattagattctgggaatgacttcctggggtcaggactgtgtagcacttgaatggat

SEQ ID NO: 4870 - DNA, 1031 bp, Homo sapiens
aggagcagtagggcaggaggattttagaagcatctccaagactggagggtgtaagggagaattggaccctgtccccaggaggacaggggagttccgcagacttggggcaggaggcggggttccaacactgatctgtcacttgcaagctttggcaagaagcttgccctgaggctgctgatgggagtggtggccagaaaagtggtactgaaagacttcttgttctctgacctccctgagcctgacaactgagaaaggctgggctcctccgtttgtgctccagggaaggcggccctggagcggggatggcgagcagctggacttagtgctcaggagtcctctgtggtctccttagcccgaggaccctggaggagggatgaaatgacagggactggggcactggaaagcatgcaaggataagaaaagggggctttggagggtagtgtgtgcttatgggcttggaacttctcaggcaattccgggctgggaagagtaaagtctgggggtatcaagaggactctggacccgctgggcagagtagaactcaaacaagggaggacggactctgccaccaaagaatacaggggtgcttgaagcctgcacccttcctagtcaaatcctttccccacctggcccaaccccaagttaccaggtaaagaatctctgggtggggatggggggcgttggagaaaggcaccccaggaactgggaggctactaatgagctatctgggctgtaggaggatggtggggggcactcttctctttacctctttctttttgtctttttcccatgtgggctaagaaggatcctgctaattcctggggggcctgggaacttgattaagggaggggcaaggcaggtggggtgattaatggttgctggacagctgtggtttatttttatttttttattttttagagaccaggtctcactctgttgcccaggctggagaacactggcacgatcatagctcacttgcagcctcgaactcctggactcaggagatcctcccacctcagcctcctgagtag

SEQ ID NO: 4871 - DNA, 1050 bp, Homo sapiens
gccaaagcgaatccctcttttccagggcaggtcatagaaactagaagccttctccccaaagccagccatacagcctaaaaatattactctttctcctggctttctaggtaagaactggtgatcaagaaatgatctgacctgccttgtttgatagtaggtcataaggccctcattgcagaggggtcctaccccattcctgggaggaagaaatctggcaacggagaggccaagaagaatctggacaggccttgctgggcttcaccactcagtctattagcattagctcataccatttttgtctggtcacatttctgcatcctgtgtgtgcttcctcaaacctaagcataaaaatggatacttaggctgggcgcggtggctcacgcctgtaatcccagcactttgggaggccgagttgggtggatcagctgaggtcaggtgttcgagaccagcctggccaacacagtgaaaccccacctctactaaaaatacaaaaattagcctggcgtggtgacacacgcctgtagtcccagctacttgggaggtggaggcaggacaattgcttgaatccgggaggcagaggttgcagtgagctgagatcgtgcactgcacaccagcctgggcaacagaatgagagctagtctcaaaaagaaaaaagaaaagatacttcaccctgggtctttgggttttcatttctaagggctcttgtgtcatacaaaactatgatcaaataaatttgtatgcttttctcttttttttttttttttttttttttttgaaacagcatcaattttggatggcatctcgctctgttgcccaggctggagtgcagtcacgcaatctcagctcactgcaacctctgcctcccaggttcaagcgattcacctgcctcaacctcctgagtagctgggattacaggcacgtgccaccacacccagctaatttttgtatttttagtagagatgaggttttaccatgttgcccaggctggtctcaaactcctgacctcaagtcatacgcctccctcagcctcccaaagtgctgggattacag

SEQ ID NO: 4872 - DNA, 1127 bp, Homo sapiens
tcagtcagcacagtctctgggaggtggtttcagaaaacagtcagttggggactataggtgaggggggctggggagagaagttaccggtccaggaaacagctgggctgctgtttccctagagaggttactcatggagcagattccaggatgtgagggttctgggcacctttcctctttccactactggaaaggagagagagagagagagagagagagagagacccacagtggttccatggtctcttcaacacctacagtgagatggaagctggtcagctgggagcctggcaatgtgggattacacaagagaaaatctctggcctcttctctttcagccacccaccctccaaaaaacacaaaaatttcatactctgcctctctatttctctatcatacacatgaacaggtcaaacacaaacaagaaacagggttatcctgaaggttctaagagcttcccacctcccaattctcctttaaaaaaataaaatgccaaagttgaagagactgggattggggaaatcaggaagaggagtaacctgaatatatggtccttcaccaatcatttagcaatgtcttcccggaagaaaatcaggacagtcatttgttgtgcatcgatggcattcagctagataagagaaacaggcagaagaaagaaaccggaaacacagttgagagtacaagccctttgagggcaggagacctttcaagtcttttgtgtttggttttttgttttgttttgttttattttgttttgttttgttttgtttttgagatggagccttgctctgtcgcccaggctggagtgcagtggcgtgatctcagctcactgagggatcatgccacctctgcctcccatgttcaagcaattctgcctcagcctcctgagtagctgggattacaagtgtgcaccaccaggccaggctaatttttttatttttagtaaagacagggtttcaccatgttggccaggctgatctcaaactcttgactttaagtgatctgcccaccttggcctcccaaagtgctgggattacaggcctgaaccaccgcaccggcctcaagtctttttttgaattaaactttttattaagatcattgtagattcacatgcagttataagaaacaat

SEQ ID NO: 4873 - DNA, 1033 bp, Homo sapiens
ctgtgtatagtggcatgcacctataatcccagctactggggaggcttaggaggaagaatcacctgagcccaggagttcaaggctgcagtgagctatgatcgcaccactgcactccagcctgggtgacagaatgagaccctgtctcttaaaagataaaaagaaataacgaaaaatagattgtgaaacactggtgtttaccaagaagtgtgtagacagtgacccacactggatcctcattttgtggctataaattgggtctcttgtggttcactaattcagcctagaggaatacaaatactaaacactttaaaaatatcgttttacttctaaggtaatcaggaataatgatatagctaagctcttttataaggcactaaatgtctttaggaatcaaagactcaatggacgttctgtttagaccttggaacataatctggggcttcagtaacctgacttcaaatctaatgcatgccacatctcagttacaaaccccaagctccccctgttttgtcttttcctcctgcttctgacctaattaaccccatctttcttttccttcgtgtgtgtatgtgtgcgtgtgtgtgtgtgtgtgtgtgtgtgtggatgaacagttagtttccatggggttagcgtttttgaggcaaaaatattgtttatacatcaactagatagtcctagaggtggatggggaaccagctgttcggtagagagccacacagttggcctgagtacaagataaatagcattcctaagctctgttgtagggaatgctggtgtgacttgaagtacacaggatatacacagtatctagttcaaaagagtggtttttgtgctaaaccttataaaatcaccagtcctgggccattggcaaagcaagtcagtccttttctcaccttgctttcctttctcttgccatgcacttaagggaagcaataagacctctaatatttagctcttgggctactcttctctagaagtcaacaccattgcacagtcactgtgcaatgagagaagcagatggctctctctctgg

SEQ ID NO: 4874 - DNA, 5909 bp, Homo sapiens
atgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcagcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacatctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataacccagatgtgtgctctgtgtacttcttgtaataccttaaagcaaacacactaacttacacagctttgttaatcagctcccagttcagcctgactttgtgggaacttatttccctaataaattatttagaaactttaacagtgaccatccctgttgttggtaaaagataaacatgtcttggttcaaaagttaatacctcaggatggaatcaagaagcagtagacttaccagtttgattaattaagggagcactggactgggtgcgtaaggattcttaattagcattttttctcatgtttacatccaaggttatgaagtgttgtggaaagcaaagtttaacaatcatatataataaaagataatgtttatactcacagaacacacttgcattcaattccaaatacccataagaactacgctgaattttgaattaaagattacttgttaggtggacaatgtggtacaagatccctctttagaactgggctgatattgtagctattagggcttttttctttttaacttttcctcttgtttacatacttgccttgtcagccaaatactataattgaaatgcaaatttggctttgaaattaaatgctttgtgcatcctgttatccgtcagtgactagctaactttttaaatttctttctttcttttttttttttttttttttgagatggagtcttgctcttgtcgcccaggctggagtgcaatgacatgatctcagctcactgcaaactccacctcccgggttcaagtgattctcctgcctcagcctcccaagtagctgggattacaggcatacaccaccacacctggctaatttttgtatttttagtacagacggggtttcactatgttggccaggctggtcttgaactcctgatctcaagtgatctgcccacctcggcctcccaaagttctaggattataggcgtgagccacccctcccggccattttattctttttcggagatatgagagtcttgctatgttgcctgggctggtctcaaattcctggactcaagggatcctcctgcttcagctcccccagtagctcagattacaggtgcaggcacactgcccacatacatttatttcttaatataatgagttgtctcaggttaaagttgaatttggatgagcattaaccatctacttttcctcataatccttaagtattttatggataacatagacaattttatgtttcaggacagtgctgaagaaatgcagtctgatttaaaggatttcaaaaaccaacaagtggataaacagatgaagagaggttaaaacacacttggagctacctagactcctatccatgaacatcggtatacagtactacactgtagttgtgcaacacatattacctcatttaatttttccaacaactgtgagatcggcaagtgtttgttcttccaatattgtaaagaataacctggttcaggtaagatgaggttttatgtggtacctgatgtagctagtatgtagtacaacaagggtttgaatcagtgctgtgtgctttaagttatcacagttgttcgttctaaagccagctccctttggtatacatgggtcccttaagccttcttcctggtattgagcttttgagcattttgctgttctctcacatctcccagtaacagtgatacttgaaccagtccaatgagttacatcaaagatttaatggggaaagtcggaaacttcaatgagtaaggagatttctcattgaatacttcggtttgcttgaaaatcctggtgacccctagacacaaagcctcaaattatttaaaagcttttattttctgattatgtctcatgatagtgactgttgaggaaaatgttcgtcatgttgactgtatagcagttacagtctgccagtagagggcagtgtttgtcctccataggtagtggaatgcttgctctccccatctcatttttagatactatcagactaggctcaggacatttttagatactgtcggctaggctcagttgatattctgcaagtgtatcaacaccttgccacttacttgggttatcgaagccctgtgatcagtgtacccagttaacatcctaatgtatgtagcagcaatcttttctgaattttaaat

SEQ ID NO: 4875 - DNA, 1026 bp, Homo sapiens
cactggtatcacagtctcagcagccagcaaagacttaattgtgaaaatgcacaaacctagagtaatacgtttaagttccacgttctgaactctaccccatcctctgtgctatcagaataaaaccacacttgatgacatgagttgatttttttctgagccctaatggtttctcctcgttggagctagtttgttaactaaatcagaaatcaatttgctttttgtgtaggtggttttattctgttaggtagaactagtcattgttaaacttctgtttatcacttcctactgttaggaatgatggaactatcaaatgttatttgatggctttagtttctgatcagattaattcttttccttccgtctttttgacctgctttttataaacaacttttatcataaacaactgttagtttaccaagcaattaaggatgttgtgcatattctatagcatggtgcttcttctttacaggtattactgctaacatcatagagtgttggtaaaaactgatgggaaatactgtagcatagtgtagtaacttatgaccagtttagaaactgagatagatttacctagggatatatgtgctcccttgtgcccaccttggtttttagtaagttgcatattgtctttatagattttattcttacagattgttgtattttgtagctgacttttattaaagacatttttttctcttcccttccccaaattatttttctattttcagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatg

SEQ ID NO: 4876 - DNA, 1050 bp, Homo sapiens
ctcattgttcagctcccacttataagcgagaacatggcagtgtttggtcttttgtgcctgcattagtttgctgaggataatggcctccagctccatccatgtccctgcaaagagcatgatctccttccctttttatggctgcatagtattccatggtgtgtatgtaccacattttctttatccagtctatcattgatgggcatttgagttgattccatcattttgcagaaatgttgaaggatagaatttgcccttttacaatgaaataaagctgcagattatatcctatattggccactgtgttggccttttcagtcagttatgttttcagtcaattattaatcttttgcactatcttgtcaaatataaaattctttaatcattatatcatggtaattctgatattgcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagagtatgtgaagttgttttgtgtactttggttgtttggtcataattgtagtttgtgaccttggttactttggcattttctaggatgctaaatgttacaaccagtcccttaaattgggtagatactccgtgttaaaagagatgactgtattggttcctgttaatatttttaaaggttcagagattctcacgattgcccaccatttgtaatggttgcaccctttatttaatgatgtctgtgttcaaacactgaatgaacaatttgcttaagtaacagtcacattaggcattgtgattgagatttgtattttgccctggtggaggaggttgtagacctcttttcacagaaaaaaacatgttaataataaaatttaggtgtttcacaggttattcagattagttaatcctatgtatttttgttttgtgtttggttttcttgtttcacttattcataattggaccaaaaaggccctgtcagttcagttttgttt

SEQ ID NO: 4877 - DNA, 1025 bp, Homo sapiens
tttagtggagacatagccttttgtaacagtagccatagagaaagttttttttgtaaaaattttaacttaaattaatatgaattaatggggagtctccatggccaaataaaatgttcagtcctgatgattctacttgttgttggtatttatttttaaatttaatcttctaagaattgagatttttaatccatattacttccagccactttagttttgacctacattcccttgctgttgtctccctggatctccctttaaatgagactgctgtttagctaatacaaaggggagagacaaagttctgctaaattcactctgcttagctgttttgctttccctcctattcaagtatactatctggctacctaagttgaaaagaaactgtattaatcttttgcactatctggtgatcctgtgataatagagtatatgctttcagtcatttgccttgtaaatcctagtttgaatctcttacacttgctagtttattgagcacttctagataaataactctgtactagtattaagctaagcttctaccaagtgggtttagttttgggtcggccatgtcagctttattctgtttgtctctagatgagatttttaaaagtgaaagagatgacttgaacactgactatggcaaggctcatgggactagaagtgttttcagaaaagggctgtaggtagagactaaggcaaatatggtttagtctagaggcagtaggctggcagcctaccctttaaccaaatttattcacaaacacaactgtgtgttaaaaaaattttttttaggctgagcatggtggctcccacccgccatcccagcactttgggaggccaaggtgggtggatcacctgaggtcaagggttcaagaccagcctggccaacatggcaaaaccctgtctctatcaaaaatacaaaaatttggctgagcccggtggctcatgcctgtaatcccagcactttgggaggccaaggcaggtggatcacctgaggtcaggagttcgagaccagcctggccaac

SEQ ID NO: 4878 - DNA, 1100 bp, Homo sapiens
gaattgcttctatattcatattttgctttacactgattttatggtatttgtgataaatggcatatgagatcattctggctgttttcagatcattgaaagttaaaatacttcatatttcaacggaagggatagtctttcaatttaattttaaaatttaattgtttatataatgccaatatagtctacatggcatttctgtagttctgtttgttgaaaagtaggatagaaaaatatgtactaaataaaaagtatcctttttagtgtcttaggtttaaagtaacaagttacaggccaggcctggtggctcacacctgtaatcccagcattttgggagattaaggtgagaggattgcttgaggccaggagtttgagaccagcatgggaaacatagaaaggccccgtctctacaaaaaaaaaaaattgtttttaattagccaggcatggtggctgtgtgcctttctgtagttccacaagctaaggtgggaggatcacttgagctcaggagttggagactgcagtgagctatgactgccactgcactccagcctggatgacagaacaagaccctgtctcaattgttggatggatggatgggtggacggacagatggaagataggtaggtaggtctgtctagatagatacagatagatatacagggaaggaggaggagattaagttttcttctgttgtggagggcagttaatttttaatgacaaatgccatgaaaaacagtattgtgatcataatgcaatatgatcatttgcagtgaccattttctatattatattttaatataatgcctgccatttatgttatttattaaatattttatttattatttaatttattatttaaacatttaattttatagaatatcttttagatctgtcaagcaatttaggttatcagttccaacagaggaagaactaaggcccagagaaattacatgattttcttgacattctagaaccagaacccaggattcctagtacaaagagtccatactaattcctttcttgagtgtttctagtgatagagtaaggaagtagccattgttagcagacagttaaagctctttatgttgaacctacacttaatg

SEQ ID NO: 4879 - DNA, 1909 bp, Homo sapiens
atggtggctcatgcctgtaatcctagcacgttgggaggccaaggcgggcagatcacttgaggtcagcggtttgaaaccagcctggccaacatgatggaaccctgtctctactaaaaatacaaaaaaagtagccgggcatggtggtggatacctgtaatctcagctattggggaggctgaggcaggagaattgcttgaacccgggaggtagaggttgcagtgagccgagatcacgccactgcactccagcctgggaaacaaagcgagactccgtctcaaaaaataaataaaagataaaaatagataaatataattttggaggtaaagtttagcagttttctttaatgtggaactttcaaagcttttcacattaaaattcattttgaatgtttattggggtggtaatactgataatatccaactgataattaccagtaaatctttagaaaacctattttgacaacacaggttggacaattctgtaatgagataatttttaaaatacgatactataagacaaatgtatacttttaaaatacttttgattagctgtgtttaattttatgattcctgggaagattttatttgaacaaaaagtgtttactgctaaaaagtttaactgtcactgatttaaatgaactaatttccttttttaaaaatttattagagcaaaagaattctgtgaaaataccgaggttttatttcaacaaggattttgacagcttcacataggtccttgtaagatggagaaatacaggcagaatgatagctcagtgtgagggactttgcctgagcagccttacccggagagggctgacaaataaatagattgttaccctggaagactgtttgcactgttgcctgaaaggattctgttcttggcatatcttctaattaatgatatagatgaggacactgatggtgtgctgattaaatttgcagatgttaagaagttggggaagataaataatatgctgaaatggcaggatcaggataccaaacggtcttagattatggaaaaggaggttttagtcattggaattacaatatatagtccactgaatgatggaacagtccaaaagggaactgaaatcttggattgcattgaagtatagagtagaataggaagaggagggtcataatcctgatttgctccccattccccatctttttataatcatattatgtttcatcctgggtgctgctttagtatttactaaatccaaggtggtatggaggaaagcagctagagcatgaagcgagtacttgaaatatgaggaagtgttaaaaaggagccctagtatttagcttcagagaaaaagtgggaatagtcatataaatttaaggaatgctctgaagaggaggggttagatttagaccatgctaatcccaggaggtggaactagatagaaccagtgagtggacactagaggcagattcatctccttgtaaagaactatttaattattggaattttttttttttttttttagaaggagttttgctctgtcacccaggctggagtgcagtggcgtgatctcggctcactgcaaactccgttccccgggttcaagctattctcctgcctcaacctcccaagtacctgggattacaggcgcctacaaccacgccgggctaattttttattttttattttttagtagagatggagttttgccatgttggccaggctggtcttgaactcctgacctcaggtgatccactgcctcggcctctcaaagtgctgggattacaggggtgagccaccacacctggcaattactggaattttcttagcataggctgccttggagatcatgagaagttctcagtcattctcttctagggatatttgttaacaggatacaagctaaaggttgaattagattgtctagggtccagtagctcta

SEQ ID NO: 4880 - DNA, 2028 bp, Homo sapiens
cacttagtagaattagcaattactgagcaactcttagatgccaaataattccaccaggtactttatacatatttcaaaatcatgcacaactcttaaaggcatatgttatcctcatttcatatgttaggcctgaggttaggataaaaaaagtaactacacagttcacctaactattaagagatgaagcaggaatttgtatcccactgtgaacaacccaaagccagttcgtgatcttttcaatgtgacattgtcacagggtacactttgtcacggtgttagcacattttgtcttctttggagcaagttacagttcataatagaacttttgttgtggggaggcctaattttctagggaggaagaggagaaaatgtgaagagattaaggggagatacacctgacaggaggaaaaaccagtggagtatttagtgtgaacctttgccgagaaaaaggtggcattgttttaagtttatacgtttcaaaatatgagggcgtttccccttaactaggtgattccaaagccacctaaaggacaaaaagggaatgaggggctcattttacataaaaatatggatgcaaaaatgctaaacagacaattagctaactgaaaccaatgagtacactaactcactgtcatcagtaggctcttggaaacttctaactttaagcaacatgatatacagtaaacaggttttttaataatgttgtgttacaaggtcgatgagaaaggtctactgcaacatttcacttaaggctccactttccaagagcctatcagtgacgttaagtgagaactgtattaaaaatatatgtgatcaagtagggtttgtcccaagaacaaaacaatctttctgtgagtcaatgtattaaaagactaaaggaaaaaccattgcatttgaaaaaggtttaacgcctattgtaaaacttaatgcattaaaattagaaggaaatgattaacttgactgaggttacaaataggttaagtggttgagtttttagtgttttaagtcgattagtgattaattattggggagagataatcctggcacaacaaaagaagccctgggtatcaggaaacggatttcagcctcttctgggtttatatagtggagatgttgaactccattggagtaatagtatcttgcagtcacaaagcattttacaattttcaaaactttttctcactggcttcctccagcccaaaaaacaccgttagttaagaaagaaagctaattttgaataaaagtttttggtttttggggtttttttggcctgttttttcccaaaaatgtaacagtcaccatactgtgtaacgctgggatactgcgcctacgcattctacatgaaggttgtccctctagagttgtatgacttacagtctgcatggccaaatgggttactttgcaaactttgaacttaaaaagtattgagcatgctgaaaagtgttaaatttgcattttaaaaacaattcctagctgtaaaaggaatgtgaccgtattactctaaattcagaagtagctttttggattgttgagactggagactgcacctaggagactcacatgttgtggacaataggaggaaaccttttatttatttgtttgtttatttatttatttttttttctttgagaccgagtctcgctctgtcctccaggctggaatgcagtggagcgatctcggctcactgcaagctccgcctcccgggttcacgccattctcccgcctcagcctcgcgagtagctgggactacaggcgcccgccaccacgcccggctaattttttagtatttttagtagagacggggtttcaccgtgttggccaggatggtctcgatcccctgaccttgtgatccgcccacctcggcctcccaaagtgctgggattacaggcgtgagccacagcgtccggccccaggaggaaaccttttattttttagcacaagaccacttcggtcaaactgggcgcccctttattttgttgggaaaaaattattgctgtctagattctaggaagtgaaactaatcgttat

SEQ ID NO: 4881 - DNA, 1070 bp, Homo sapiens
tggttctcgttccactctcacccgcgtacgcgtctcgggatatttttgtaaccctcttgtccccgagtgactttagtaataaaagggctaggttcgggtaaccatcagacttcattctcggaatttcaacaagtttgctattcccccagctgtcggtggaatcgtcctatgccattctccaggctattgtatggaatgtgccatttatggaggggtgtggtttagtccaatctgttgaggccttaaaaaggagagctgttgcaaataaatatttttaatgtaaggaattggcttctttgcatagtgtgttttctaaataaatagataaaggcttagtttttaaatgttttaacagtcgttgcttccccttcattccaagttgtgtgggaaacggaagtacctttaattagagttctaaagagaggtttgggaccctggcaagggttttgttctacaccgttctgtctccagactagatcatcctccaactggtggtggtatgagactgcgtactcctacacacggggtgggaatgaggagaaagctgctgttagctctgtttcaatcagcatctgtggtaactcacgatctctactctgaaagttatgctggccttttggcaaggagtctggatagctctttcagagtatagtttgcgtaatttttttggcataaaacttgaccaatgtatccatcaactcacgtagaatattttctttaggatcaggtaaaataataaaataaagatttattttacctggattggatcttttgtcttctggaagtaattactgtgtggtcaaattaggtcaaattaggaaaaataattcctctaccttttaaattttagttcactaagttttgatgactttattttattgtggtgacgttcttatctcatctgcctgaatttgttttcccagatttaggtattggaacatgaacagaacatttttactggaaaacttggattttttatgttaccatgtggggatatatatattaagcacattctatcagttttttggaggcattgggacttctgcacaacttttttattactcagtatg

SEQ ID NO: 4882 - DNA, 1037 bp, Homo sapiens
gttgttgggtccttcttcgggtcaggaagtactgtctgggaacctagatggtgtaattgccgggtgtttggtttacacgcctctcttgagtttcccgttagattttcccaaactgagcccactgccaggagaaaggtaagagcaaaggcgtgaagatgagaaatagggaagggaggatgaggatgagcaattgctgtttattgcaggcgtactgtgaacttaagtctccagcctttcagctgtccggcaaatctctccaatcagcagaagcagctgagatcctctgtggggcctcctggttaggtgccggctggggctgtagtcctgcccctctgttgagggaggaaccgcaaggtgtttaacctggcttcagtgggagaacgcaggaagcggaactggtctgaaggactgtagctttgttgtggggctgtgggtgggatggaagacacaaaatccccgaacgagccccttggctacgcagtcagatgcccatgagggctgatgagctgtgtttttgtccgttgattgcttaaataaaggtaaccaaggaattcttccaagaatgtgaaatataccacttctctgacctatcttcccaccacttttttcctcaaactggagaaggtagggaggaaggggacaccgagttcattcatttctttcccgggtgtggcctttggactcaactattttttcagaggcagaaatgccttattgttaattagaaggtatttagctaggaagagctggtgatgggggagagtaacttaaaattttatttctctctgttaaaagaacttgtttcaaggggggaaaactcgtaccaatggaaaaattgaaaatgtgtgctcctgttcatatggaagtttaaaaagaaattaacaaacatttacattgcaattaaaacattctccttaagaacccccagtagggcccagtaccgtggttcatacttgcaatcccagcactttaggaggctgaggcgggaggattgcttgagcccaggagttcgagaccagccatgggaaacatggcaa

SEQ ID NO: 4883 - DNA, 1028 bp, Homo sapiens
aggcaagagggctgagtttctgcaacaagtaggatttaggtcaggaagctccttgtttggtaaacttgggagcagaatataatgctgatgtgggtgaccctgggtcgtagcagcatcttcctttctaaagagctcttattgtgcctgttgtctgctcaaagtggtaattgtggggtggagaaacacagagaggttgctggggtggaaagaggaagattaaaaagtaaggattatggccagccaagccctgtgatgcactgaatgggtctgatcatgtggcctctggctccccctggagagagaggatggctataggctgggcccttttgtctccccaggtgctgattctcctgtacatcgcagactggatggtgcactggatgtggggccggggcctggacccggacaacttctccatcccatacttgactgctctgggggacctgcttggcactgggctcctagcactcagcttccatgttctctggctcataggggaccgagacacggatgtcggggactagcttggtcactcaacattttccccatccctctgcactttctatttgaaatttttcttttgttcccctgtccctcctccaccccacactcccacctctttctaggacttcactttgataccaaattctcattattttcaatgggaatttttatacattgagccaagtttgtatagcaagaatttgggaaacacagatggcctgagataagcagtacaagtaggtttttgagacaatcaccaagtgcagtttcatggtgggtgcctccaggtgatgtggactggagcaggggagttttgtctggaatctggggacatggggtttggctttagcaacctgtcttggccctaatgagaaaccctttgtaagtgggctctggatttttggttttgttttctttttatctgttttgttttatttttggttttggttgaacagagggacagaagaataagtaacactcccaaacacagacatacttttgtagaagtggaccaacttcaaagc

SEQ ID NO: 4884 - DNA, 1048 bp, Homo sapiens
attcccagctaggttaagacaggtccttattttaactcactactcacctgctaaggatcttgaacaaagtagatcctgctgtgtatacagaagtctacaacgatgaaagtgcatggcaagcgtggccttggggaagtagagtgggaaggaagtattcctcctgtgcctggcctgctcctgtggccgcagcatccctgggcgggacactcttatctgcttcacttgaccaccccttctgcttttcccatctctgtcccctgcctgctgtcagggacccatttgctttgctcctgctttgtcctgcaccgtatatccaggtgttgccctaaagccctttcctggacacctagaggatgccttttggaaaagcctcagacaggtgaagcctggggttactgtaatctcatctgacccagtccttaccctaaaagatcagctccagcccagcttctcccacaggagcccagattctccccagcctggagcctaaagcttgtatctgggaatttaagtcttcttaatgtcttgattcctggctctgactttcttccctgctgctaccctcctgaggtggctcaggccagaacccttgaaggcaggtcagggtcagtgtatgagcttggattggagtaggtgaaggatggaagaggcgcattggaagggcaaggaagaggtactggcaggaccactgaggatcgagacttaaggtgattgctgtgcctcaggattcattttggctatgggggaggcagtctattccctcacctgcagaataccagggatccatgagcccctcacaccaaggttagagaaggaaagagatgaggagctgcatttctgagaagtagttaaaatctagatgctcccctcacctccaagcagggcagcacttcctggaacatgccctttttcatccccatcagagcaggaaggcgtgggtggctgcttggcagacgggtgtgacttcaggggcagatactcctagcctggatgaacaggatggggctgaatttggccaaaggaggaagaagagctactcactgtctgc

SEQ ID NO: 4885 - DNA, 1059 bp, Homo sapiens
actgggtggattagaatctggattaattagcgttatcttctgaagtgagcaagaataaaagttcttagatggggtagggagggacccccgcatacacaccacacccctacccatcccacacacttagattccaaagtttctgatgtgttgccccatccccactccaggcccatgagctggagacattgagaggcctgggtagggaacctttggagctgctctcagtgtggcacctcagctcacctcagagctagggtccacttggtgtggatgacaatgacaggtttgtccatgtcctcctcccccagccttcctgctacagctgggctggagcaggccctgcagatggcaacagtgagatggcaggagggggtgagtgcagagggaccgagacatgggaccacagggagattgttattccacatccatgggagtaaaagggggactgacaatctcagattcaggaagagcgggatggtttctaaggattcacacctatattaccccttcataagctaagatggacttcagtaagagaatctgaaagtgccccaagaccatggggccatctggagaagctggctatggagtgtccccagcatcttggagcaactgagcaggagtccatattgggcctggttcagatgtctccttggtccagggcccccatctttccttgctgctgtagaaaacttggtttctttttcaccaacgagatgcaaaaaaaataaaaataaaaagttgaattttaattttaatttaaaagaaaaagaaaacccactctcttcctagaagggtcatttctgcctcctcttatctgccctcccgtaaatgtgcacagcagcatctgcagtgaaataaggggctggtgctggcccaaagtaggaaaaggataaatggacctccatctgctctaacttcccaaccatggctgaaagttcctgcagcatctggaagggaagcaggctggggcctggtgttggcttctgaagggggttgggatatgggagcctcctcactgcaggagccttgtgcccatctgcccagtttggtcctagg

SEQ ID NO: 4886 - DNA, 1053 bp, Homo sapiens
ctatctctaccggcatgagcatatgaaactaggaaagggatttccagaaattgagcctaaacaggatcctgttaaagcctttggcctgccagagtctgatctgagggattatgatctgtatagtagtaatgaactatggttccttatgtgaatacaagtaaaatatagcactgtgcaaagttctttcacaaacttgatttgttttgcacgatcttgaagggagtggaggctaagaaaggtcatgtcccgccttgttgatctctgctgaagacacaaagccagtaagtggtagggctgggtctaaaatgaacatctacccttaattgtggtttgacccacaattctgccatgacacagtgctgtccagacctgtgcattgagtggtttttccagtaacggtgacacatttgcattgagtcatcttccctctccccctgtgaacagcatagggacatattcaaaggcagagtagagccagactgtgtaacaggttctttttcctatgtgctaagtcaaataatctgtatcaatgtcaaacgtacaactttgaatttattaaccctatgctgtaaccatatgagattcaatgaaaagcagaaagtgcttcatttttggactttggcaaaatcattgaaagatacatttcttgggggtttagatgaacaaaaatgttacagatgtgccccattcttgggcagttttaaggatgcttgttggacattcattcattctttgggccccatgtattgcattctatgtgatcaatactggaaggcagcaagaatttctttttaataatttaatgtggttatttccatgattactgagatgttcctttgatgaaagtcagagaactcaagtgaaaggactgtttgttttggtcatttgatctagcccccttcctccaggtgaagtgatcttaaacttttaaagatctattcctttctaccttatttttaaataattccagaagtagaagaatcatggctcagctcagtagcctgtcctggtgtcaaatcacccttagctccagaaggcccttctctttcccac

SEQ ID NO: 4887 - DNA, 1066 bp, Homo sapiens
gtgctttccacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacaggtatgacaacaggacgaagatggccattaccattaggtagttcttgcctaacatctgcttctctctgtttcttccattgtctcccataaaataagcaagcacgaaatctcccaataccatccccaaggatctttatggacctggtgttcctagaattgggtctttcaattctaggatgcaaaaggttttctcttatgcaaaaccactataggagggattaaaaaaagggctgacatagtaagtaagggtggttgcaaagggaagttctgagatgaaggaacagtggctgagaagtttacagtgggttgactaggaatagagcagaggtcttgaaaaggatggaatttcagggcatgtcttcatgagacagagtcttgctctgttgcccaggctggagtgcagtggcgcaatctcagctcactgcaagctccgcctcctgggttcacaccattctcttgcctcagcctcccgagtagcaggaactacaggcacccgccaccacaccttgctaattttttgcattttttagtagagacgggatttcaccatgttagccaggatgatcttgatctcctgacctcatgatccgcccgcctcggcctcccaaagtgctggaattacagacgtgagccaccgcgcctggccaaaaatatatatattttttagagacaaggtcttactctgtcacccaggctgaagtgcagtggtgtgatcgtagctaactgtaacctcaacctcctgtgcttaagggatcctcccacctcagcctcctgtgtagctgggactacaggcatatgccaccatgtctggctacgtttaaaatttttggtagagacaaggtctcactatgttgctcgggctg

SEQ ID NO: 4888 - DNA, 1072 bp, Homo sapiens
gttggacactgatactctgtcaaattcctttcaaaaatgactctttagtctgctgaaatttagcactagtactttagtgttctgatcctggaaaattcaaggtgaagctttatttgtggaccatctgatttaattattgaggattaaaaacctaaacctttgctcattctaaactcaagcttttaagcctcacagaatttacaggggtttgctttttgtttgtttgttttttcattttttactgtgcttattaaactcttggaattagttattaaagggagtaaattctcatcttgggaattttgaaaatctatggacttacaactttcaggaggattaaatgtcttaagttttgtactagagcagaatgaaatctttcctattcattgagtttttgcctgccatagaggaatttttttaaaaattaaaatgacagtttatattagtggcaaagtgaataaagacctcactttcccaccccacccttcttcctttctcttacttttctttggattaaaggtcaggtgtagtactatgaagattcactcctgaataaagtgatttcagaagctaaaatttaacatacctggaaattttgtgatgtgttagccaagtgaagacattagtgtgttccatcttttgctaatggttcatggttgatttcttcattgtttcccatgaaattagcatagtcaagtggtacccttgacgcttgactgctggtcagtttgaccctgtttttaacaactaatgtagtcatgccgcttgattattccatgaagtcccagcaaaataataatgaggaattaactaacattatgttatctatctaatttgtctgtgtccctaaatgcccatgcctaacttgcttctctagtttattccttctgtggagggattaaaacgtgggtgttgcaagttgccctaagctaaacatagttttcttacatctttttgggaaaaaaaatggaatgggaagtatgcaagattaagcaagagtgatttttttttttttttgacaaatcaggtggccttcctaaacatactaagaattatgttctttcatgtgtgg

SEQ ID NO: 4889 - DNA, 1034 bp, Homo sapiens
gttaatcttggctgggcacagtggctcatgcctggatccccagtaatttggaacactgaggcaggcagattgcttgaggccaggagttcgagactagcttgggcaacatgcgagagcccgtctctacaaaaaaaaaaaaaaaatacaaaaattatccaggcatggtggtgcacacctgtagtcccagctgttggggaaagctaagttgggaggatcccttgaacccaggaggttgaggctgcagtaagctgtgattgagccactgagctccagcctgggtgacagagcgagatcctgtgtcaaaaaataattttgatttcacggaaggagaagaggactagtcttataccatatcccaaatgaaattgaaaatgtcttctgggaatcacagcaatgactcaaacttctgaatagtgactaggtttgagctggtaaggaagggattgtcaaatgccgtgacagtccacaggagggcagcagtgctccgatttacaaaggattagtcatactagtgtaaccttttctgagtgagcctagaaattctgatgaaaacagtgtagtccaggaaaaaaaaaaaaaaaatctgtatgtacaatcactcaattttgaatcatttctggaagttattagactccatgttaaatcctacttaagtacaagtatgcaaaatttaaaaatatgcagaaaagctcattcttggttaaaatgttagctgaaagacattactaagttttagaataccatagagttgactatttcccacaaaccctaaaatctacttgaacaccacaaattcatattccttctaatcccaagtcccttcagcattcttacagatttattgttagttaccttacaaagtaactaactgtccccatgtattttatcccaatttaaaaaatacattacagtctcaaggtcacataagattttccaaaatgctctattcatagtcaatataattttcaggccgggtgcggtggctcatgcctgtaatcccagcactttgggaggccaaggtgggcggatcacct

SEQ ID NO: 4890 - DNA, 1064 bp, Homo sapiens
ggaaaagctgcagttctgctcttgcaacacaaggagcagactggagaatttagatctgcgtcacagagctgagagagagagagagagagagagagagagagagagtgagagagcgagcgagcaagcaagctccgtcgataggtctgctagcaacagccgtgctgcagcagagagagagagagaaatcaagaaacaagtcatagcaacaccgggcaccaggttctgccagctcacttgctgagcgttcagagatctgtcagggccagaggcctctgggtagcctaggctaggagatgacacgcaaggtggcacgggcggttcccgtggggaggaggtggggtggtggtggggggcaggggtgggagcaagaggttgtggggcgacggtggagggtttgatgggaccaaattctggaacattcgggactgcggcaccttacggcgggaccaagatttgggtctgcgcaggcggcgatgggtggtccgacgggcttcaggacttgatggcgtaacccccttcttcccccacgtatgtatttgctgggatcaggggcgctgtctctgtgtatgtgggtgctctgtctttctcaccttctttctcgatttttgctatttatttctctgagggagggttttttcccactttaatttcttttccctagtgtcagctgctcaagcctgaccagggtagaggtgagaggagtgaaccatcccctgcttcccacctgacctcccagcttttaccctatttccttctagtggacagacagactggttctccaagttgtttgggtgtcagcgtccatctgtctgtccgtgcaggtcttatgtggaaggtaagggagtgagaagtgccgaaaggaagacagagggacagttttttcccaggggttgccttattgaaaggtctggccctgggattctgaggctggtggggagccgagtggccagggtggggtgtgggctgggagaagtggggtaaagctggtaggtttgtcactgcgtagttgggaaaagtggggaatggtgacgcagtcactgttgcatctggttaggagctctatg

SEQ ID NO: 4891 - DNA, 1034 bp, Homo sapiens
cttagctagtgatgctatttctttaccagttcttgctcatcctattcattctcagaagcccaggctggagttctcttctcagactatgcatgtccacatcaagctggcttctcacaattggcccctcagtgtattttcctaaaccttacttgtaaacatgttaaaatgaccagatttacaattagtgatctacaccgtaatagcagacctatttgtttgtcttatttctaccaaagaaatggaacagggagctcagaaacagacctatatgtatctggacacctgatttatgatgaagaaggcactgctgggcagtggggaatggatggttattttaataaacagtgctggttcaactggatatccacaggaaagaaatgaatcttgatcatatacaaaaataaattccaaagcgatcatcaatctaaatgtgaaaattaaaacaaaacttcatctacaagatagcatagaatatctttataactttggggtagccatacatttcttaaagaagacacagaaagcactaactctaagggagaagactgataagttggatgtcattaaaatgaggagcttctgattatcaaatgacatcaataaaagagagtgaagccaagcagagaggagaagatatactcagtacctatacctggcaagtggattcatatccagaatatataaataactccaacaaatccatcagtaaaagaaacccttccccctggacagaaaaaagttccatactgaacaattgtgagttgtatgcagttttcttctcccagtgcaaggttctaaccagtatgtcctggatcactggcacagcctggtggctggccttgggaactgtctgatctggtggctcttggcattttcttttgtgtatggactgtgggcccttcctttcccatgtgcttcttcacttgctattggtttggccacaagaggctcctgtctcatgaatgcctgtgtctcttcctcttttcctttggcttgttaacttttgatcagttatttcgagaatatttctctct

SEQ ID NO: 4892 - DNA, 1030 bp, Homo sapiens
tcctgctacaccccgggaaatttaatagtgtctcccagtctgctcatgggaagcccggaggcctacagtctttcccctagttctgctgtgagctagctctgggaccctgggctactccagtttcccatatgtaggagaacaagcttgaatttgagcagtagtttccaaataaataaataaataaataaatatatatatatatatatatatatttttttttttttattgcagtggaacactttcttcaagcaaggtattaaggataggtacagaatgtggaacagttaaaagcagaagtgtatattttccaaaaaatggaaaaaggggaaacaaccttagggcagtcagacttctctatgaattcctcccagagcctgcagggttctgctgcatatgcactcctgccccttgggttgcctttgctccttcattctcatggaaggctttacattcttcagagcctccctcagcttccatctccttcgtggagcatctgcctgcagtgacttctgcccctttctgttcctgttatacatatttattagctatttcaatcattgggctcccctatactgcctagtgatgggcttaaaaaatttataacacatataatatttacatatattgtgtataaattagcatatacttatatatttacatatatgtgtatgtatgtatatgtatgtatacgccacacatgcatacacacacatcctttaaagagagaccatgtctgtatgtcccccatttcctggtacataataaatccctaataaagatttttttaaaaaaatttttatttgctcacatgctcttgctcagacaatacaagtttttaatcatggggattatcttccttgtcctcccacatattttgccaggtcagtactcagtaaatagtagtgttaggtgattgtacaatatggtttattttgttcccaggaagtcctggatttgaattttagttctgccatatactagctttatgtctataggaaatatacttaattcttcttatttataaggtaga

SEQ ID NO: 4893 - DNA, 1496 bp, Homo sapiens
cagtggcccttctcactctgcatgccacctagagggcagagcctgcttcagagccctggagacctccaactggtttctcacatcttctgctccctggggcccctgacttcagcggggaagggagagggtcacatgagggcagatctcttctggacaagtcccattcctctctgtctgtccctgactgaacctgaaatggacacgaagagcagagtcgtttgggtggctgggaacagcactaaatttagcaaaactgtagctggtggggggccggcccagagtgagccaaacccagccctgagtggactagatttacagtcagtaacacagtcagcatcatctctgcttgggaaagtgtgtggttacacaggatcttccgttttccaaagcccagaagcttgtcagcctgtcccacaggcctccctgactctgtcccttgaagacttggctccacccccaccactgatgctgtcccttggacttagtcttccatccatctgtctgtctctcccttgtgtgtctggaatttccacttcagtaccttcaccttcttttatgcctcttagccaatgctgccaaccttgactcccaaggccctggagggcaagaccctagcattggtagattttctttagggcatctggcaccaaggacacctttcagtcaaggtggacaagtggaggaaagccaggagctgggatggttagtcgaacaagtgttgagggactgagatgtactttccctcctcccagaaacttagccacgtagatggtatttgtatacccaacaactgaagtgaattatgatggggacacagtggctgtgagactcttggacagttgggagtttctctttggttggctgagtctctgccctggtgtcgatgtatcttggaagaggtgggttttgtgggattaaagagtggaggtctgtgggtgacaggacatcttcccctgctggctccctctcccactcctcagatctgatggtggtgacttgtctggaggagcttctgttttcttaatgccctgggagataatgaccaggctaaatttactcaactctttacaaagtggatgattacactgagaggccaggactgggatcatgcctatgggagtgaaggcttcagggctctggcagccactggaaatttaagccttggattttgctgattgggaactgtgtcatctccttggtcttcttggttttcactcccttcacccaggactaggatcaaacatgatttgttagtgtagggcagtgggtctcaaccaggggcaattctgtactccctagctctggctcccaggggacagttggcaatgtccagagacattttttggttgtcataactgggctgcaggaagggtgttactggcatctggtgtgtagaaaacaggtatcctgctgaatattatacaatgcacagaacaactgtccctacaacagagttgttggtccaaaatatcaatcgtgctggggttgagaaacct

SEQ ID NO: 4894 - DNA, 1057 bp, Homo sapiens
cagaggtaaataaaagattcacagtttgatctggaaggtttatgggcagctgaaccaattttaattccatctgcactggatcacatgcttcaagagagcatgtctgtatctgtcttgtcctttgctgtcaccccagtgctgagtggagagcttggcacacaataggcctcagatatttattggctgacccatccttgtttgatctgtcctggaaatgtgcaggaggaatctgagtgggtaagtggaggaagagaggtgcttaacgcagcaagtgtgacaaatttgggggaagatggacatacttggatgtatgacgatgagtgcctttaagtgactgcctttaaggaaaagagaagggttaaagctgtatgggcatgacagaatccattggcattagggccatgagaaggaaggaatataacctggctacaaaggtgggttagaggtagtcaggatcattgggtatagcagagggccaccagaattgtgaagaactaaccagcggcagagaagggaagagtggaaggagagtaggagccattgtgagaggaaacatggagacctcttcaggcctaggatgaaagcagaaatgacacaagtgagtctcagatgaacatgatggcagggataaagaaaagatgggactctcagctctgttctgctggtctcctcagaaaccactgtgtccatgtatgactaaaaatgcctctcagttattttccaacagtgcggcaaatgcgaggaaattaactatggtttgacattatggttagtcttttttttttttttcaaatttgtcaatggaaattttcacaggtacacaaagatagagttagcgtaatacacctcaatgttcccatcccccagtttttcgacttgtaatcaacacatggcttttctcatttcttttataccttcacccacctttttcttactcccttcttggattattttacagcaagacctagatcctgtattattttatctataaatactttttaatatatctctaaatgataataccttttaaaaacttaaccctagtggtattattaca

SEQ ID NO: 4895 - DNA, 1050 bp, Homo sapiens
actcttgaaagccttccctgatttgtacttcccttttgctcctatagcttttaccatgtctcaatcatattgctaatatttcattatagtttgggaggtgtgtctgtcttcctgacaacactatgagtactttgggatcaaggttgtatctgtgcattctgtgaacttaatgtctacacagactgtattgtaggtgtttaatacatatttattaataataactatcagctatcagcaaggtacagggcttagcattttctaacccatgccatccttcatgtctaagaggcggtatggtgtaaaagttgagaacatgggctctgtagccagcctgcctgagtgcgagtcccagctgtataacttactgaatacatgactttaaacaacttcactgagactctctgttcctcagtttcttcttcagctgcagataacttttatacaacttatatatatagcagtctggtggatgaatggatggatgaatggatgaactcagcggatagactaatgattgagtaaatgaatgaataaacaagcaaatgcacaaagtatatgtgcccggtgtatttctaccacattcaggttgacttggtgataaatcaaatatatcagaatgcagattcacaaggtcacgccaatcaacccacactgactaacccctgggtacaaagcactgaggccatgtggtcattgctgcctccatggaatggtcttgatccaactgaccagtctataaaggttcccaaaccaacacagaggcactggatccagcaaagcctaggagctttcctgcctcatatcaccaccttgccagagttgaatgaatgaatggcaggaatgaataaatgagctctataccaaaaggaaattaaaatgttccaatgtaagtataggagactcttgtttccccttaggcagagatttaatacatattcttatcctccatctccctcccgctccctctatccttccttccctctctcgctctctctctctttcacacacatacacacacactcatctactcactcactgccttctaggaag

SEQ ID NO: 4896 - DNA, 1034 bp, Homo sapiens
agaagtgacatctaaattgttcctttggtcccgctattttccataggaaattctttctctcctcacccccctcccccttttccctttaaatcgcgtgcataaaatatactaataacaatcttcggtgtctgtgcatgagtgacagctgaaataagaaaaagactaatcgtacctcctgcagccctgtcacatggagattaaatgagtctctctccccaccctctccctgctccccaccccctcacccccactctctcctctctcttggttctcaatgagaatcatgggcatttgaataataatattatagacgccatcagagtgacagtggggaaaaaatcagctcaaacccatgattattccttcactctaataattatttaaataccagataactcctttcactctaattgaggactttcagccgtcggcattacccggggcttttgcgttcgccctcttgctcaccttgtgctacccaacgtgcctggactacctctaaggtcggtgttagacagagcgatgctcagaatgcttgcacgtacagctgcacaagggatatgaagacaggtccttcagtagcattccacccacggggaaaagatggggcctcagactctcacatttagacaattttattctcacagaaatcttaaaccaaaaggagccttctgagatcattgggaccaatcccctgcctctaggtaaactgattcctaggcagcttccaggaaaattcaatatcagaaaatttcagaatctccttggcaggatgctctgcagatcctctctaggcagaatgtcccccttaatatctaactttaatcccttctgctgtagctctaactctttgggaagaaggagctttctgtgcatagactaaatctgacctgtccgtggggttgtggcagaggacaccatagcccccaagttacagcataggtgacggtcctgagtgtgacatttgcctgggcctgcctgggcctagaagaggacagaagcaatcattctccccaagggggaaaggagccatt

SEQ ID NO: 4897 - DNA, 1050 bp, Homo sapiens
aagctcggtagaggtacacaaggcctctctgtactactgctgcaacttcctgtaaatgtgtaattgtttcaaaataagatgatgctaaagataacaaatcgtactccaagtcccattatacaaaaagggctaaaacgagtttccatggttaacccaggatgggatttagaactcagctagcatggcctctacttcgccccctagtggtagcaccaaaggcacccggtgaataacaaggtgtggaatctcaaggtgatgactcaacatctcatttgcatacccatagtaccctgcacatagtaaattatttaaagcttaaaagaatatttcttttgactcaacatttctaactatgggaagattaaagaattctttttgtgcaaactgtaggcagtaattctttttgtgcgaactgtaggcaccatcggcgtactaggagttgcggttactgcaacaatgagttgaactaatttgtagcattacactggtttctcttcagatcgaataaatctttcgccttttactaaagatttccgtggagagaaacaaatcagttataagctaattttttgtaagccttgccctggggaggcagatcatgttttataaaaaaagacttaaagaggaaaacattatggtgcaactttaggcttaagtgattcattgtcactgtttgtttaaacattgtgtaacagaacttgcaaagacagttaactcttgttttccatgtcaaaggtctgaatacttgcatgataaaagtctgtgtaactttccctggtgacatctgacttgctaattagcaacattaacattggagacacagactggcttagacaatttggagactcccccttaagtgatggcctttaagatcctaaactcagccacatagttgggagaatttctggttgcctgtctgcaaaaaagccccaaatccatccttctctagataacattctattatctatctacctagtaacaaattcaatgcaaggtggtgatgcaagctccttaaaggactccatcaattccactgatcagcttggtgta

SEQ ID NO: 4898 - DNA, 1040 bp, Homo sapiens
gaactaggctacatgagagcaagggcttgctgagtacttcactatttttgtgaagtaaagttcaaaagtgatcagaacattcaaacagctttagagctaacaagaagatgtctgattgatgacagagacatgcctgtgaaagtggaagctgccattgtccttcaagtatttatcagcaatcaagaaaaatctaaagaatgtatcacagcatttatcagacctgtaatgcaggctcttcttcatattataacagaaacagaaaatgatgaccttaccaatgtaattcagaaaatgatctgtgaaaatagtgaagaagttactcctattgcagtagaaatgacacaacagttggcaatgacatttagccaagtaatccagacagggccagatgaagaaggtagtgatgacaaagcagttactgctatgggaattctgaatacaattgacacacttcttagtgtagttgaagatcataaagagataacccaacagcttgagggaatctgcttacaggtcattggtactgttttacaacagcatgtctcagaattctatgaggacatctctttagcgcatagcctgacatgtcaacaagtgtctccacagatgtggcagctactaccccttgtatttgaagtctttcagcaagatggctttgattactttacagatatgatgcccctcctttataattatgtaacagttgataccaagacacttctgtctgataccaagtatcttgaaatgatatacagtatgtgcacaaaagattcttccagtagttgcaggagaagatgcagcgtgtcatacggcaaaattgttagaggtcatcgttctgcagtgcaaagggcgtcacgttgaccagtgcattcccttattcgtggaagcagccttagaaagactgccaagagaggttaagacaagtgaactttgaactatgggtatgcaagttgcaattgcagctttacattataatgcatacctattactaaataccttagaaaatcttcacttccctaataatgttgaaccagttacaa

SEQ ID NO: 4899 - DNA, 2067 bp, Homo sapiens
gcaaacaataaaataggtaaggataatattagttactactgtgatttatggagtggactaagacaaaatataaatggataattcaattagctatttatgtctatatccatttaaatgtggactagatacatattttgactattcttaaatttcctctagttcttttaaaatggtgtttcttaatttgccttgagagtagaagtctctcatattcacctctgtattgtcagtgcctagtctatactaagcactttcatttgtgaatggaaaatgagtgaatgaattatgtatgatggagtgtattggaacaagatcattgccttttttccattataaatttcaagataaagtataagctaaaaactttgaggttctgtttttatctcaggagtaatttaatgtgttttttaagtttcaaaacaaaataaactcttaacaccttccactttcttaccctttttccctgtataggaacaaatgaatcgcatgtcctacaatgagaaatcagatatctggtcattgggctgcttgctgtatgagttatgtgcattaatgtaagtatgatgaagacagattcctagtctaaggtttgtactgtttgtcacatttcactgggttcagttttttgagcctctgtgctaacgaaagtatattcaagtctgaaagaattgtaccctgggtaaaattaaggtagatagatgaacaggctaaaagaaactattcacaaattaaaactataagccatgaggctgggtcttgactgttcaagggtcttggctggttaggtgctttcttattagattgacacttagctcaagggagagcacataggtcaggcaggtaaggtaaagctactgtaaggatgtggaagaaatgaaacaagactcgggtagaggtctggggatctgtagagcagggaagagctccaattcttttcctttgttcttcttttcattttctttccctttgaaactattctgtagagcagtgattctcaactagggataagggaagcaaatttgcctcttatggggcatttgatgatgtttggataaatttttagttatcacagctggggagtgcttctggcatctagagggtagagggcagggaggctacaaaatacctataatgcacaggacagccccccacaacaaagaattatatgacctcaaatgtcaatagtgccaaggttgggaaacttacttataagaagaaaatcccagaagtagaaacttaaatacaaactggagcttaagctgtgcttttgatttagttcctattgtatattttcatttttacaatttgaaaatgtcttcgtcgtcttcttcttcttttttaaccctaggcctccatttacagcttttagccagaaagaactcgctgggaaaatcagagaaggcaaattcaggcgaattccataccgttactctgatgaattgaatgaaattattacgaggatgttaaacttaaaggtaaagatgataagatgatatattgtctgtttctagctgtcagttaagtgtcagagcatacattctctcttgtagatcaatggagactgaagaaacgttaaatatactttcttagctaaatttactgtgttaacacaagtgaaaacatatgtaaatttggcaaattgcacatccttgctggcccaccttctgcgctttctttatttctcctcccactctgtcatgctaacagatggtcggtagcaaggaaagattgcaaaaagaattcaaattctcgttccccttgtccttgcctacctcacagtggcaggtagtgagggaaggggccagaaataagagtttattactctgcctctagctctaattgagagattaaagaccagaagaaggggaggggtgatggagggcggacggaggacagctaaaaacagagggaaaatcaataaagagattatgtggaaaaactctggctatagaatggggaaggagatgttctggggaccaggctgacataagagaagaaggaaaatgccgtaggatcacagagaaggatacagatgaagtgacaggattgagagtcagtgagagagta

SEQ ID NO: 4900 - DNA, 1041 bp, Homo sapiens
agagctctaagagtggccctctcaggcacaagaaaggggcaggactaccagaacccgaagctttgtatctgcagtcagactccctcaaaatatccattattaggattattggattcatatttcccaatgtatataggtagaacttttacagaaagtaacattggacaggaaactgcctggctgctgatggagggatctttaccaaggtgtctcatcctgggaaaacacgactggggtggaatggggcagggactttgaccaccttcaccccaattttgactatagtaccttttagccaacttcccactaaccaactgagggtaggggttgggggagtcctcatgtgcctcattcccgtttgtctccccacaacatacatttactgcttagaactggaggaagattatggaagtaaactcacagctccttaagttcattgaactaaattagataatgaccttgattgtaggatataattaaaagggaggtaatttgttaaatcttggaactttcattctttgtttttgagcataatgagttcattcataccttggaaattcttatttcagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggtaagcataatcttttaaaaatgtaagctgaaattggtctagtttcatttattttaagcatcttgttttaggatcagtaatatggaagagtgtatttgtatttgtttggtaggtccacagtactttagaaaattcctggtgaatcaacacccatattttatatcaaaataacaatttataggctgagtgtggtggctcacacctgtaatcccaacactttgggaggccgatgcgggaggatcacttgagcccag

SEQ ID NO: 4901 - DNA, 1875 bp, Homo sapiens
ttttgggcaagcaaacaaattcactgagaattccaaaagtatattaaaaaagaagatagctatgagttcagatctatcttattggtctttaatattacaaccaatccttaactttccactataaaggaaggattactagattgattactttctggatagataatctggtaataaatgataggtaaatcaaaaattacttttatttaggagtttgaattcttactctcatcagacattttttttctagggacgcttactaattaaatgatttaagttgtttcttaggggttttttgcctatatatttatgactgtgttaatgagtagtgaaatgatgcggaaagacagctatcaggaagaggaaatacagaagcctgaataatctatgggttagaaaagcatccctgaataatcaaaaattggcagtattggcattgttctcaagcctttttatgaaaatgaaatctgaaatcaccaaatgtaaacctgggaacattattctagtgttgctgtcttggattcatgttaagaagcgtcttcattctttgctcatgttgcccacttcttgtggatttgtctgagtgttttttgacaatcacttccttaaagactcttctgaactagttggacctggttaatcatagagagtagcctttaatcatggatagtcttcttggattatttttatatttgaaaagaaaatgttttatttgcactactgagtaggaagagttaattgttttctttgttctttttttgaagtcattacacaggacttcactccagagttaccattatgagtgtgttcagctctggtccacagaggatggataaaaatggtttgttatgtttttttgctctgcagtgctatgagccttatatctgttaatatgaaggacaaagtcaaaagcagcagtggatagcaggaagggtagagactaatatgtttgggaccaaaaccatctaagttagagatttccagatcacagaggggctgggcattctctggagcagtcattggttggtgctttattgtaatcattttgcgccaatccccaacaattaggaactggaccctgggaataagctgagggtgctgaactgttggggaagggtgactgtagccacatggaagataaaatatgggtttttctgcaaaatttccatctgagggtttttacatttaatatttttttaagacagtttaaagagcaaacgttttttaagtgtattctagttgcaaagtatgcacacatatcttgaatggctttatttttattgtgtaaaactgttgaacacatgactgtgatgcacaaattctttacgtgtaaggagtctatgcattttacagtaacttattttatgatcgggtgatgagacagttatactttcaactgccattatttttattaagtgctttcattttctttacagttattataaaattgtatttattttatacagatgggttttcattttcctgatgctgtaatgtttacttcagcttgttgacctttctttgtgttatctgcatgttgtaacgtgtgataagaatgaatgtaaaggctgtggcaactgtaattaatttttgtaaagggctggtcacacgtggatctggtttatgaatgcatttgggatgattttggtaaccagatcaccttttcagaaatttagatgtgaacaccaaaagaagcattttctcaacaaaaattaatagctggttctattttttttaaacctagaaaaaataaagttgatttttttcaattaaagtgcttttaattcttagcagtggggatggggcatgtgtgttttaccagagctatttgggcattaatatctgcaggcaagtacttaaagcacactgtggcagttg

SEQ ID NO: 4902 - DNA, 1070 bp, Homo sapiens
gtagactagtaaatgtttgaattaatgcataaattaactctcttgtgtaatcaacaatttttaataaccaagatacctgaaaagctgaagaaaccaacccttgttaaagcaaaagatgacaacacaattttattcagcttttcatcataagttgtggttctgaatgattttgacttctgaactaaatagtttttgttcttttcttctaacccttaataggatctttccaattaaagatgtacccctggagactgatgaccttaccacttggctctatcagcggtttgttgaaaaagaagacctcttatcacatttttatgaaacaggtacacagtaacctttaaatagttgctaaattatagcaacagtaatgaaagcctcttttaaagaaagctgtttgcatattagatcttgaaacttgaaaatgcactctgtaaattgcctgtgagaagcaaatcccctcatgaatcagcttaccctggggattatcagcaaggacaaagactgcttgaaatgctgatgagtgttatcaagatgaccttaggtaatattgctgtatgaagttatctagcattcctttccagaaacgaatttaaagacatctgtttactttgtatttcttttattattaagatacatttcataaagcatattgccttttaaaaataatgtcagtgttatacaactacttttttgacaaaaaatttgtaaatagaggaatcagcataaagtgtgctatttcagaaattatttcatgtcaatctcacataatcctgggtcctgatcactgtgggaatctctagggatccagcagagacaaggcagctagagtgcctgctctcatgcagattatattccagtgggagacatggcaaacaagtctgcagaaagaaagataattgggatcatgaccaattggaaaaagttccaggaaggagataaacagagatgggagggggaatatcttttctgatatggaaaggatgcacatgagccagctattcattaagtggaggaggacagcattgcaggcagagaaaaggcaaaggctcagaggcaagaaggggcta

SEQ ID NO: 4903 - DNA, 1072 bp, Homo sapiens
gaaggtgaattgggaagtcccaagcattaggaatagtttagtgtaggaagaagaatgatagcctcttatcagcactacattattttcttgacttgttactagtattatatgctttattttcaccagaatggataactgaaatatggtatgtacgagcttttatgcatgacaataccacagttatttggtgtttacatatttaacaacctggattgtgccgtgctttgcacataattattacttaatgaataattggtgaatctaattaagccttttccaagaaccacaaattcagaaataagctggaattgagtagagaaacttctaagttctgtgaaaataagtgtcacaaaacacatgtactttactccagacagttttatgtactggacattatatcatttcattttggaaacatcctttgttcttctgagcagagaaacaaatataagcataccctggaaccacaagaagtggcaatggggagtggacacaaggtcaagacaaaataaactgatcaggacaacttaacaaagatcctagtgtaatagctcagagaaggcagcggaaccaacaattagaaagcttagcagtctcagggatccgaaaagctagctgagcaccttacctcatttccagctttaggaaataattgaatttacagtgtagtgtaacagttgattctaatgatgatcatcaggcatcaagaagaggggctgggctcggtggctcatgcctgtaatcccagcactttgggaggccgaggtggacagattgcttgaggccaggagttcgaggccagcctggccaacatggtgaaggcctgtttctactaaagatacaaaaattggctgggcatggtagcatgaacctgtagtcccagctacttgggaggctgaggcaggagaatcgcttgaacctgggaggcagaggttgcagtgggccgagattgcgtcactgcactccagcctgggtgacacagcaagattccatctcaaaaaaaaaaaaaagaggctaaattatactagattatcggtgtacttttagataaaagttgaaaattaggtactcc

SEQ ID NO: 4904 - DNA, 1034 bp, Homo sapiens
aaaatagaatggaaagggaagagagaggatggggaaaattgagggaggggttatgttaattccttagggctgccataacaaattaccacaaagtgggttttacagcagatatttattctttcacagttctggaagttagaagtcttgaaatcaaggcgtcagcagggccatgctctctcgaaagactctcagggaggctcttcccttgcctcttccagcttcttctggtggttgtccaccatccttggtgtccctcagcttgtaggtgcgtcacttcaatctctgcctctgtcatcacgtggtggtctccctgtgtgtctctctgacccacattttcctattcttataaggactccagtcttattggatttaggtttagggcccaccctaatccagtatgacctcatcttgattcacagattttggggggacatgaatttttggagtatactgttcaacccagtacagagggttccaaattcaatttatgttttcatatttaaaccagtcacacttactagatttatctgatttatataaagcaaacaggtaagatatattttatgtaaaaacttattcttatttgcagttatattgacatatatgccttcccactgcatgggcctaggtatctagtattttccactcatgtagcacagattgcgttaaaggactatttggtgatgagacatctattaatacagatggagagccagaaaactgtccacattacctcttaatagcccactatttatagaaccaagctagacttttcttgagttttaactgctgttcactttagaataatacttgaaatgttcttacttattttatatccacaacacctaaccatgcctgatgctgatttattgaatgaagattgtattaatgaaagaatgttgtgcatgtgtgtgtgtgtttgtgtgtttgtatgtccgtgtgtctccattggagggttgtcaacaggggcatatggggagttttcatttggttagtatattctctgtcctttttaaaaacataactaggctggg

SEQ ID NO: 4905 - DNA, 1867 bp, Homo sapiens
cataaatgttagctattaagattattatttatatatctatttaataatatctgctactattattattttagttatgtaacccctccaaaagctacctcttgagccttgctttctcaaattttaacctcttaaaatttaagagtcaaagggacactgaccatgatttcctagtgtgtacaatgtacttgcttaaaaaaaaataaaattaaacttatcagcacttcaattccagtggttcttatttagaagtatgtattaggaggtttttcaaaagtctgggccttcccttgggaagcttgactagaatgttatggagatgggggtggcatcagcatctctatgtatgattgccctccctccctctcttttctaggtagtcagctgtttgtttgcaaggctgcttttcctcaccagtctccactccattaatcagtactttaagccactctctcatggccacttttaatgaactaacaccctcccttggatgaatccaatcctgtctgcctcaaacctggactgctgaaagccacagttctccagctatgtgaaattcacttatggattattttggctctctaattttttatttgttttttgttgttgttgtttgtttgtttttagagagagtgtctatatatgtcaaccagactggagtgtagtggcatgatcacagctcactacagccttgagcttctgagcccaagagatcctctgccttagcccctagagtagctaggaccacaggtacatgccaccacacccagctaattttaaatttttttatagagacagatctcactttgttgcccagactggtcctgaactcctggcctcaaggggtcctcctgcctcggcctcccagagtgctgggattacaggtatgaggcactgtgcccagctggctctttaatctttactattagactgattttcatatgacacagtaggcatagggctcttttagttactagtgattccaaaagtgactttaatcccattactcaggatctctatggtactgtcaattagatcttcctcatttttgcaacatgtttacgtagcattaatgatattattgtttcataagtgagaaaatgaagacacagaaggataaaatagtttgttgcatcagcttgcgggcataataagcaacctttcttctctctgttaattctgttttgtaggccagtataatggctttagtgtcactgttgttaaggagtttttgatgggttgtttctattttctttttgagatgtgaactgtccagattaattctaatctataacttttgggaaaagtatattgatatacatgttagaatgtgtgtgtgtatgtgtgtgtgttgtgtgtatgtagtagatgataacctttagctttggttttcaataagaattttaaaatttattacaattagaaaatttttcctccagtttttattcagttgtcctttttccctttggaaatagtggacctgacccaattcttttttgagaattcatttcatagagcagcgtgttagaatatttttgttcttctaatcaagtgcagtgtaagaactgtagacatccataatttcttttctatcccttggttaagatattagctttattactatatttactggtcctggaatagcaaggcataatctgaggagcatagctacttcatctgtgtaataaattgctctttcactacaaacattttaatactgattttgttggtcatttaactttctaatagtggtccttaaattatgctctaaaagaagaataccatatatattggaaattaaatttgttgttgaataaaattagaattattataaaattcaacacgaccttattgctacctcaggataatt

SEQ ID NO: 4906 - DNA, 1076 bp, Homo sapiens
tcataaaccttccttcattgttaatgtcctctttctttaactttcataaaaactcttgactttccaattacttttaaagaattggaggatatggtagcctgggtctgtgtttccaaatatcagcaagagactagagctgaatagtgtctccccactttgggtggtgaatgttctctttatttaaacacagtcccactgctccctattgtcatataggaagcctacttccctctgttgtcacctgtgtggtgataaaacaggaattttgtattccctggcctaaagtctagtatctgacttttaaaagtaatcctataatctgaatttgtatttatagatataatcttatttcctcttcttctcagtaccagctgtctccccaggaaggttactacccgggcatgttctcgctgtcttttgtatctcttcccttcatatttcagctcacaatgacttcttttcctagcttctgtggtacgtacatattttcgtgtgtattgtattatttcacagtttgttttttattcccaataagtgagcaaacttcttgaagacagggattgtattacctcaattaaaaagttgacttaagttttatatggaagaaaacatacctttaaaaagcaaaaatcacacagctaagtgagatgctggcatgatgatgggcatatgagatgctgacatgatgatgggcatgagagctgaatatgacagggaacagcatattcaagattccagtctatctgtactccagggcatacatctgttgactggaaaggcaggcaaattgtgtatactatttaaaatgtttatctgttttaatttttcttttttccttccaccctctatcttccgtcacgttctactttctcttgaattgcattaattacttcatgatagaattctagtatacttttatgtcttctgcagtggtagaaccctgtgtctctctgaagaaaataaaaccagttgaatgaatgaacatatcaattagtgctttgggggatagtgaacaggaggtggtgtaaattaattatatttaccatctgtgtttttcttttcaactaattcattca

SEQ ID NO: 4907 - DNA, 1048 bp, Homo sapiens
gtgctgggattataggcgtgagccatcgcccctggcctgttttcacattttctttagtaggaagtgctgtacagatatctcacgttgaggaaatgctttatattgcctttgtcttaatatttcaagggcaaaccaaaagagatactagcttaactaatgatccacttctgcatgctttatttggatctaggataaatcagtaccccaccccccggagtttaagtgatgattggtaaatgtcagagaaagatttcataccaaacaaaatgtattctatttatttaaaatagtttatttttattttcatttacttattttaataaaggaattgtcatccaaacacatttaattaaagtcttagccaggtacagtggcttatgcctgtaatcttaacaacttgggaagccaaggtgggagaatcacatgagcccaggagttcgaggttacagtgagctgtgatcatgccactgcactccaatctgggcgacagagacctgtctcaaaaaaaaaaaaaaaaaaaaaaaaaagaagactgtgcatgaaatactttaaaaatatttactgttaatagaaactccagaatttttatttttatatagggtgagagagagtcatgggccaaagtctggctggaagggagctgaaatgccaggggacttgctgccaagctgtttttacgtagcaaacagttttccttaaattggggcattatttggggggggctttagggaaagctgatggagattacgtttagttacctcctgctccccaactgacagctgccctgtctttctgggttatgtgattatttgatagtgtcctgcttttcggggagggatacatattcattgtgtgacaaaaagtaatttttaggaattatttctgactttgaaattctacggaaagtttcaaaaatgtatttcgagagcaatgtcttgtaacctttgagccgtaaaaccaatttagtatgtgaagatgaacattttaagaatgtgaaataaaatagaattcaatagaatatatcagaaatgcatgtgtttatactgag

SEQ ID NO: 4908 - DNA, 1054 bp, Homo sapiens
gagacacggtgcggggacggccaccgattactgaatgggaattgtgttatcatttgctaaatatattgtgacatacttcgtgcctcggtgaacagctcccttgaccttgtgcggctcctcctccctcgctctctgtccccctctggaatttcccctgagagatcaccgaggtactacacccggaaagcttcgaccctcgctgttttattttgtgctgggggcgatttctatgttggtgactgtttagatgtatttaatgaattttcctttttaagtgaatttttctttcaccccagaaagacaggacggagtccagtgtgagaatggctataactttggaagaagctccgtggctgggctggctcttggtgaaagcactgatgaggtttgccttcatggtcgtcaacaacctggttgctattccatcctacatctgctatgtaattatacttcagccccttcgagtgctggacagtaagcggttctggtatatcgaaggaatcatgtataaatggcttttaggaatggtagcttcctggggatggtatgctggatatacaggtaagagtgagaacacttttctttaatgcataagaaaaaatttgtcaggaaccatgattaaatgtatattacactttgggttgaggatgctttcatgtcttcactattgaaaaaaataaaaagaaaacagttctattgggtttctcttcagaatctcaggaagaccaatgttttcagaagtataatttcataattatgtattggtaaatttcttagtgtttttattgtgattgacatacatttattaaaactggtctgcaaaagctctggtagaggaataggagtgcgttgtataggactcgagagcttataaagtgaagatgtaagatatttcatctatttcatggaagatgcccataaacattggaaatttagaaaaagaatgggaccatatttgtgctaagatagtttaataagtttcttcatcatttaacgtgatattgtactgttagccttttgagcaagcaaaaatggctttcttttctcttacgta

SEQ ID NO: 4909 - DNA, 1027 bp, Homo sapiens
agatctttccgagcggccctttccctcagtatgttctggactcactgaggtcctggccgagcgtccaggtagccccgagggccccgactcgctggcgcaggggtagggggagcgggccaggcggggcaagcgggccaggcagcggcggcggcgctttcattagagggcgctgtgggagcggctccgccgcagtcccgactcccgccgcttcctcccgccgcccctccccgccagtccgggcgaacgcggccgggcccttggggaccgagtctcggcgccgccggggaacgggcgcgggccgcgccacagccggagcggggcagggccccgccaccgccttcttccgccggccccgccgccggccatgcattcttccggctcctctgactcccaaagccccggctggggcccggccagcccgaggtaacctccggctccgcggtcgcaggccccagagcggcagcggagccgggccaggggaggcgctgggggcggggaagggggtgtcgtcgtcgcgtggcccggggaggcggcagcggcctgagggacgagggcgcggtaggccccggggaggaggcgggggcgcggggcatccgcccgcctccccgggacccgcccgggtgacaggtccggcctctgagtccccgccgtccctctgtccgcaggcagccgcgaggggagtagggcgccagcgcgcccgctcgcgcagcgcctcgggccgcttgggccgccaccgcgtccatgaccgcgacccctcggcgggggacacccgcccccgctctccgcagccgcccgccgtccgcgcccgccgaggtgagcccggcgcgcgggccgcgcccgccgccacgacccttccacatccgcggaaaccgctgcaggctccaccggctccccgcgctgcggtcgcctcttctctgcccctttcatcatcccctgcttccttgccctctggtcggaaatctcattctcttcatccccagttccttggcttttacctctttctggcttttgctcccttccccctact

SEQ ID NO: 4910 - DNA, 1107 bp, Homo sapiens
tcaaaggagaatggagcttaagataaaaaataaaaaggggttgttgttttttttttctttcttgtcatgcggcctctgggactgagaagtgatttgcaacttgggtctctccaagattgcttgccttcatgagcacaacccattgtactgctaacagccagaacattctcataaaatgtgtacagatctacagtgtccacggttgaatgacatctcttcagatgcagcccagttgtatgaggttcacacaacctacacagtcatctcagcacctgggaacacgtgcttaggaaaaattgccagagcagtgcagaaccccttgttcttttaccaggtgtggaaacagctgaatcagaaagcctgggtttcactcttggttctggtgaattagctgtgtgaccaagcaagtcactttacctctacatcttaggggtttttttttttgtctgtcaagtgactgaattagactggttttctggattccagcctagagttgtattatcaagtgactgaaagactaaaaacaaacaaaaacatttcttaaattggagatcttttttatttgtaattaagtggctattttcagggttaaagtttacaatgtggatttcaagcttctggtgccattcaaggtagatttctccaaaaaagaagcaaatcttgtaagccatcaattccctttgagaacttcccaaatgttatgttcttaaaagataggttttgatagctatgtttatgaactttttaacttggtgtattatgggctcctggcacaaactcagaaaggaattttttttttttttttttgagacagagtctcgctctgttgcccaggctggagtgcagtggtgcaatctcagctcactgcaacctctacctcccaggctccggtgattctcctgcctcagtctcccgagtagctgggattacaggcatgtgccaccacgcctggttagtttttatattttttagtagagatgggtttcaccatgttggccaggatggtcccaaactctggtgatcgcccgtcttggcctcccaaagtgctaggattacaggtgtgagccaccgtgcctggccaggaattattaaaataaaagcaagtcc

SEQ ID NO: 4911 - DNA, 1050 bp, Homo sapiens
cctaacttaaatttgcttagtgttttgttctttttcagtctcttaggttttaaactctctggaacaggtgatttcatcctatttcttcagaatatctcttcacagtctaaaggaagatagggatttagagatggggttgagtaagcaaggaagaaaggccagcatgtgaaggggctgtcaacggctctgggagctcattctactcaagtagagtgaggagcatcacttagtagttcagagtgtaggccctggaggtagtctgcctgtgttcagattcctactccgttcactaatcatgtgactttggagacattacttaacctgtctgccttagactcctcatcggtgaagcaaggatgatagcagtacctaattttttattgtctgcatggtctaaataagctcttagaacagggcctaactcatagtaagcactgaagaaatgttagccattgttgttagttaacaattgtttcattgcagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctc

SEQ ID NO: 4912 - DNA, 1028 bp, Homo sapiens
ggcacagtgccttatgcccataatcccagcactttgggaggccaaggcgggtggatcacgaggtcaggagtttgagatcagcctgaccaacatggtgaaaccctgtctctactaaaaatacaaagttagccaggcgtggtggcgcatgcctgtaatcccagctactcaggaggctgatgctggagaattgcttgaacctgggaggccgagggtgcagtgagccgagattgtgccattgcactccagcttgggcaacagagagagactccgtctcaaaaaacaaaacaaaacaaaacaaaaagcgttaacgtctttctgctggtttactgatcatgatacgtaatttacatctccagacatcttaatagtgatctgctaatacacctatggaggtcaatacccaaggggctgttgacctcagaggcactccacacttttccaagagggtattgcaaaatctgcaccattcttttaaaaggcaaaatggtgactttctgcctgaaaacagcctgaagtcccttgtggtcctctgagtccacgcttcaaagatgtttctctccttagacactagtgtggcatcagaggtccaccaaaggtggatgtctctgcaaatactttccaaattacttgttgcaggaagctgattaatgctattttaacagttaaatctgaaaaaatagaaccagtgtctttaaatctgtgttgtgattatctcaggtaatagacttggcatttgtactatgagtctgttgggcacaaaatgttcaattgcctgaacccaataaggaatggatttttctggcttttagccttaacacccaactttaaaaaaaaaaatgtttacagcatgagcaactaggtgacactctgcttgaaagcaggagcctagagggacagacagcataccacatggtgcatgcagcagttttcaacctgtggtgttgggtttcaatcaggctggtgggaaaaatattagagatagttatagaaatagacacaaatcttcttggaaggctgagaagtttgcc

SEQ ID NO: 4913 - DNA, 1034 bp, Homo sapiens
gggcttctctactgtaaattacaatagttacaacatgaaccttgcattccagaatttcaaatgtgaattttaaaaattgctgcaatctatagcatggaatttaaggtataaagcagaagagtataataacaggggcattagaacatgactgataagttttatgaacttaatggcaagattcttaaaattttggggctttgggctttgattccacctgtaaaaatagggtgtgttaaatcagatgatcccaaaattctttccagctctacaatcacgaattcatatgaggtataaatgtgtgtcagcaatctgagatggaaaaaaaaagcaaatttaaatttttttctcttttctctcctatcttgaaagtatggttttgtctgacaagaggcctataatgatacctgttttaatcagaattcatttgaactcttaggatagttgttttggcttttgtactgttagtcaatttttattaatattttttaagaaattatacgttgattttagatcttagtcattacgaaactgttggcacatacctatttcaagtaccttaatggagagaaatgctgatatgtattgatagtgggattgtggtaggaaattttgttgaagtttattgttagagacttttctcaaaaattaagaaaattgaacctatgagctgaactgcttttgaactatttgaattacaatttctactacttttctctgcttttttaggaaatgtgagttcttctcccagatcttctgatttagtcaaattagcccaagagtgctgttaccataataacaggggcattgcagctcatggagttagagtcctaactaatataactgtttcttgtcaagaaaagggtaagtttgatcaggactgatattacgtataaactttggtttagaccttggacagaattctgtttgatttttttttaatcccttatttttagcctgtgtgccttgatctacaaattgactcctttcaaagtgttcttagagcatgtgttcttaagactactttatccttgtga

SEQ ID NO: 4914 - DNA, 1045 bp, Homo sapiens
tcattacaaacagaactttaccatcctttgtatctaactcagctactgacagtgagaagaaaatgaaacaatccaattactgtggattttttcaacccctttgccaacacatatacgtaagcacacatctctgttccttctcacctccatcctcagctatgtctttccccttctctgccctgtgtgtcccttgacccgtttttcatatcaggcttttagaaaagtaaggctacatgagccacactgccagctacttagaattatcccttttggcgttgtgtttgataggaaaaggatttctagagcttcagaggcagttctttgtgtgtgtaagagggtgaaggggaggagggagcagatgaaggagggatgtgttctatctcagttagaaatgttaattaattttcccatagaaacatttattataaatggttattaggttccagagtactgtgagtgccgatagtgctattattttcctatgaggaaataatgttctaagtactgaataactaacatgagtgcattacggaacatcacccattagtaaatgatagaaattacctatgcagttttactttgtggttgtcttttgtatgaaacattgtggcaactaggaaaagccttcagatttcctttgtctttttgttttttttggagacagggtctctgtcacccaggctggagtgcagtggcgtgatattggctcactgcaacctccgcctcccgagttcaagcagttctcatgcctcagcctccctagtagctgtgattacaggtgcctgccatcacgctgggctaatttttgtatttaaacggggttttaccatgttgcccaggctggtcttgaactcctggcctcaggtgatctgccagcctcggcctcccaaagtgctgggattacaggcatgagccactgtgcctggcctcctttgttgttttttttaagaataatcaaaggttactggacagagatattctaagatacttattcctgtgaggacataatcagcattttgtgactggtaaaatactaaacagagac

SEQ ID NO: 4915 - DNA, 1035 bp, Homo sapiens
aacagaagggtctaaaattctcttaatactaatacgtagtgaataaggaaggcaaagtgttatggcaaaaggtaataagaattcagctgaggctgggcatggtggctcacgcctgtaatcccagcactgtgggaggccgaagggggtggattgcctgaggtcaggagttcaagaccagcctggccaacacggtgaaaccccatcgctactaaaaataaaaattaaaaaattcgttgggtgtggtggcaggcacctgtaatcccagctactcaggaggctgaggctggggaatctcttgaacccgggaggcagaggttgcagtgagccgagaacgcgccattgcactccagcctgggcaacaagagcgaaactccgtctcaaaaaaaaaaaaaagacttcagttgagaaactatgtgttctacatttaaactctaaaatatgacataatttctccaaccccagctaagattttaatacataaaacattcacttacttaattcttaaaaagaacaaaaaaacctgacctaccttcctaatatttcaagaagttcagcaacaccattgaaatgttctgtttcatatataaacctgaatttaaaataaagacaagatgtaatcaaaatcaaacttcagaaaactaagagaaacaggcaggagggtgaagaaatcaatccaaaggacagctattagaaacacacaagcatgttttgggtcttataagcagttttgccccaaacagttaattcatatcaatcttaaaaaagaagatgtttcctactgaactacatatgcctttgccaaaactcgccatatgtgaagataacagattgtcatttcacctggaatattcaacttaataattaataagaaagataagtttcctcaaagaaatactttttaaaataagaaacctctaattatagggaaatccaagagaaaaagacccatatgtaataaagccatttttaatcagaatttctttacacctctaactatataggctgcatagctttccaagattagggctgccttta

SEQ ID NO: 4916 - DNA, 1048 bp, Homo sapiens
gtcattaggcaacttcatcatttaaatgtcacagggtgtacttaaacctagatggtatggcctactacacacctaggctgtatggtgtagccttttgctcctaggctacaaacctgtacaggatgttcttgtactgaataccgtaggcactgtaggcagttgtaacaatagtatttgtgtatctaaacacgaaaggtacagtaaaaatatagcattataatcttatgggatcaccatttttctttctcttggaatcacatttctctctctctctctctctctcaacatttctctctctttttgatgaggcctcactctgttgcctaggctggagtgtagtgacatgatcagaggtcattgtaaccttgaactcctaggcttattgtaaccttgaactcctaggcttaaatgatcctcctgcctcagcctcccaagtagctgggactacgggtgtatgccaccacatctggctaattttaattttttactttttgtagaaacgaggtcttgctctgttgcccaggctggtcttaaagtcctggcttcaaccaatcctcctaccttggcctcccaaagtgctgggattacagacatgagcaaccatgcccagttccatttttattttttaagagacagtccagacttgcattgtcggccaggctggggtgcactggtgtgatcacagttcactgcaaccccctaggctcaagagatccccctaccccagcctcccaagtagctgggattacagtcctgagccaccacgcctgtctgggactgacattttatatgtagcctgttatttttatttatttatttatttttgagacagagtctcgctctgtcacccaggctggagtgcagtggcacgatctcggctcactgcaacctctgcctcccgggttcatgctattctcctgcctcagcctcctgagtagctgggactacaggcgcccgccaccaggctcagctaattttttgtatttttagtagagacggggtttcactgtgttagccaggatggtctcgatctcctgacctcgtgatc

SEQ ID NO: 4917 - DNA, 1037 bp, Homo sapiens
tgggcacaggcaagggaagggcacacagaggtggtaacactgctttctctcctccacatctagacaagtgtggttaactacattgaccagaggccagctgccaaaaaaagtgctcaattgttttttgtggtctttgaatggaaagatcctttcatccagaaagtccaagatgtgagtatttaagattatgatagtattatttaagattatgatagtattatttaagattatgatagatgtattatttaagattatgatgctgccctgaagtcttttggctcattcttgtagactgataagtctacctacctgtcctcatcttttttcatagcacaaatcagcttgtaatttatatttatgacatcaatgttatatattctttgtgtttggtcttgtcttcatcactagactttctctgtaaaggagggggactttcattttgctcaccataatttatctgggatatagtggagtgcttagtgcaaagtagctgcttagtagtaatgttcgttgaataaattgagtagaaagcattaagttaccactatacaggttactgcagttgcaagttattctttttcttaatggttccctgtaggataaatactacttgtagtaagaacataatggtacaaataaaatattaacaaagcattaattaatgccatattttaaaaaaattgatacataatatacatatttatgtggtacatgtaatattttgataaatgcagacaaagtctaatgatcaaaaatcagggtagttgggttatccatcatctcaaacatttataatttccttgcattgggaacattcttctagctattttgaaatatataatacattcttgttaactataattgctctactgtattatcatgtcatctatcttactgtatttttgtacccattaaccaatttctcttcatctcctgcttcccccaacccttcccagcctctggtaaccaccattttactcgctacctccatgagactcatttttttttaagctcccacatgagtgagaacgtgtggt

SEQ ID NO: 4918 - DNA, 1037 bp, Homo sapiens
ggctgagatgagaaagaattgccttaattccttttggacaactagagctgctgtggaccttggtggcttagctctcagctacccattgggtttccccagttctcacttatcctcgtacctgtagagtaaacctccactgcccacagtaacctgttccttaaaacctaaaggggcctcactgacagttctggaaatttgcatttctgtgtaaagtgaaaaccttctaaagtattttgccaaaaaacagcaaggaacattcactggtttatagttttacatgcttgattgcactaatattctctgatggattgagttagcatggcaagacttagttcatctattatttaggttatttattcattcgacaaacatggaaacattacattcctactatgtgaaagatactatattctgccctgcctccattttattttcaatgtatatcttttcagatttatttttcaaaagagattatagttctatgatctttatttttgctattttcataaatgagcacttcattttttgaagggtagagggtacattctgtttctttggtaccagtaattgttaccattgagcaggcactgtgtaatgcattttgcagcgttctgtcatctgcttctctcaaaaatcctgtaaaatggaaatgattattttctttttacatgaaaaatgtaaggctttaggagcactgagtaacttgtctaggatcatggagtagttagtagcaaagctgcagctggagctcaaaactctgactctaaagctcatgctcgtaaccactgcacagtatatctgctctttcagtcagaaaataaatgaataatggaaaccaaattatttcttccttaaaattctccttgtggtttaggtgcagaactaacatgaccccctccacagagtctttgctgataactgcccttctccctgtgcttcccattcttcctgcagttgaaggaaacctcatgttttatatccttatatgtttctgaattctgtagcactttggattagagaccatcagtcctccattt

SEQ ID NO: 4919 - DNA, 1058 bp, Homo sapiens
ctttcccactggttgcttttcttttctttcttttttttttttgagactgagtttcactcttgtcactcagactggagtgcaatggtgcgatctcggctcactacaacctccgcctcccgggttcaagagattctcctgcttcaacctcccaagtagctgggactacaggtgtgcgctattatgcccggctaatttttgtatttttagtagagatggggtttcaccatgttgaccaggcaggtctcgaactcctgacctcaggcgatccgcccacctcggcctcccaaagtgctggaattacaggcatgagccaccgtgtcaggccccgcacctggccttttcttttgtgcttcgagggctttaaactggagattttgcctgattctaaggggcaggagtggagtcgtggagagggagatagaagaatagattcgtaagagatgtttttcacttgtctcttggaggtgagtttttaatgaaaatgtctagaaaccttaaaaccttaaacactgatgctgtgaacctgacaaagtgcttgggaaagctgtcccctctccctcccaattcagggatggcttctcttctaagctctggtcttgagctctcttgccctcctccttaatcctacagagacttgttgattatcatggtatcctttccgtccttcttcccttctcagtggtataattttccccatttgacaggtgagaccactggtgaagtgaggttgaggttgctggctaccaggctgctgattataatcagcacctatccctgtggtggactgcctgcccttcctgctgtgttctgccatttgcagcccaagtcagtggacttcagccagagtgccagagagagctctgacaccaccttcactgttccctcttttctctcagcagactctaagccgtatttcctcttcctttgggaagtggttaagactatgggctttggaactagaccaacttggattttactcctgccatatctttccctggctttatggccatggaaaatattgtgggttgaattgtgtttccttaaaaaagatatgttga

SEQ ID NO: 4920 - DNA, 1021 bp, Homo sapiens
agaacctttctcggggtttcagtttttcagggtttcagaagctttctcagggtttcaaaacaggcgtgtgccaccatgcccggctagtttatttgttttagagatggggtctcgccatattgccccggctggtcttgaattcctgggctcaagccatcctcctgcctcagcttcccaaagtgctgggattacaggaatgagccactgcacctggcctatcacagtatatttcagataagacttactattctctgtttttggctgataattctagttttggtttcttcaggtttttttttttttctcccctctgaccatttgttttgcaaatagattatattatgaaagtctctgaagaaaaaaatatctctctagagaaccactgaagggggttcttggggattttatatgaaaggatttgagaaaattaatgttatattcatttgaagcttcaggggtaaagaatcccttgtaattcgttgctgtgtctctacattgctcatactttgcccatgggctgtaaactaatattcgttgaatgaatgagttcatattgcaaatttctaacttgtcggtttccctggatcacaatctcacacattaatggcttgtggcatttatattcattattaattgaacttagaaggtgagtgtggggaggggagaggtaaaaaactgaggacagatcactgggaaactgacctgaattaggactccagagtctcctgtctactagaactacgtctactagaactaagtctaattcccatatccctgcaggacataagagcagaggatggcattgacatccctcagtgacatcactgtgctagcaggtatagttgccttctgatcaccttttcctttggtcacatcccctgacttctgggtggcctgggatagctagagaagaaaattcaacttctccctgcaggtcttctgctccagctgactcctgtgcctgtgtaaaagattgggcatttctatcatcaccttgactagccttactcagagaatggct

SEQ ID NO: 4921 - DNA, 1021 bp, Homo sapiens
tctcagatatgcaaagcgtcaaaaaaaattacctccaaggcatcccgtttgggggttctaccaggggctgtgctctattccaaagggtaaaccaaaaaagcagcagccatgggatctgggaaactaaggctcccaaaacacagcacactcgagtctacaggctactaactaatcagcagatttggagactaggcagaccaggttggaataagactatgtaggccgggtgcggtggctcacacctgtaatcccagcaccttgggaggccgagacaggcagatcacctgaggctgggaattggagaccagcctgaccaacaactaaaaatacaaaattagctgggcgtggtggcgcatgcctgtaatcccagctactcaggaggctgaggctggagaatcgcttgaacccaggaggcagaggttgcagtgagccaagatcacgccatcgcactccagcctgggcaacaagaacgaaacttcatctcaaaaaaaaaaaaaggactatgtaggactccaaaagagatattttcagaaaaaaataaaagtgacaacacgagtgataatgttaactatgcagaaaattgtataaaggagatgttttgtaatatgattaagatgttcaaagaaacaaaaaataaggcagttattcactacagtagaggcagaaagctgtacaaaaaaagaaatgtaatcatggttacaaattagttctccagtgaacaatatttatatagccataataataaaaaccctgaatctgaattcagtaaaaaaaaaaaaaaaaaattgggacagttacactgggaggctaaaggatgggaattagcaattagtacagcacaggcactgaacagttagatggacattggttaaagcagtaaggtggggtgtggaggcccttatagctgctgggtcctggggcagggtagggtgtcccaggacatggagctggagcagccagagtggcagggatagtgaggaggcttctgtgccaaccagtacaatccatatgtttgtaacag

SEQ ID NO: 4922 - DNA, 1055 bp, Homo sapiens
tgggccctcgatgcatagtggttaactgagtgaattaaaacaaaaaccaaagagaataaaggacctcaaagaaaacagatacatacaaagcaaaatcccagaatgatgactgtactcccagaaagaagagaaaatcatacattttttggaaaatcggaatgctattaaataatgttcagtaaataagaaaaagtttttgaaaattaaaaatatgaaagttgaaataaaaattcagtgggagggctgggagataaaatgaaattttcccaaaaataaaacagaaagattaagaaatggcaaattagaaaagtaagaataaagagaataagttcataaagttcaaagtctaatcgatacccattccagagatagcatgcagaaaaagcagcagagtcaaaattatcaaagagataatgcagttaccatatggcccagcaattttactccacgttctaaacctaagagaattgaaaacatgctcacacaataacttacacacaaatgtttgtagcagcaggttgaactttcatgaactgatgaatggataaataaaatgtggactatccactcaatagaatattatttggcaataagaagaaatgaggtactggtaaatgccacagtgtagatgaaccttaaaacatgccaagtgaaagaagcctctcacaaaagactgctgaattttgtagactccatgtaaatgaactgtccagaacaggcaaatctacagaaacaaaaaatagatctgtcactgcctaaggctggaaagatggagagggtggaaggaataggaagtgactgctaatgggtatgggatttttttttttttttttttgtgaaacaaggtcttgctgtgttgcccaagctggagtacagtggtgctatcttggcttactgcaacctctgcccccgcaactcaagccatcctcccaccttagcctcccaagtaggtgggactataggcatgcaccatcatgcccagctaatttttgtattttttgtagagacggagtttcgctatgtggctggtctcaaactcgtgagctcaagcgatc

SEQ ID NO: 4923 - DNA, 1050 bp, Homo sapiens
tggtgagggctgtcttcccgacttgtagatgaccacctccttactatgtcctcacatggcctttcctcagtgcatgcatgtggagagagggacagagtgcaagctctctggtgtctcttcttataaggacaccaattgtatcagatcagagccccacccttatggcctcatttaaccttaattatttccttagaggccccatctccaaatacagctataggcacatgggagttaaggcttcatcatacagattttagggggacacaaacattgagtccataacacaagcccacagaaaatcttatcctagacctctttccctggccctttatggcttgggctccgtagaggacaaagtgaataaaaccaaattttttattgcttcaaacagtatgatttcatcttgtaagatgtactttttcttttctaaggctgaatttgtttgatttctggtgaacacctatcttctctatccaccttcattcatttattcatctgttcaacacatacagttggacacctactcggatcaaaagtcagagatcttaagagcacagcctctaagccagatcatctgagttcagatttcagttctaccattattagttcaatgatattggacaagttacttaacctgtctatgatcaaaagtcagagatcttaaagagcatagtctctgagccagatcatctgggttcagattgcagttctaccattattagttcagtgacattgggcaagttacataacctgtctatgctgcagttttctcatgtgcaaaatggggataataattatgcctacctcatagcgttattctgagaagtaaatgagttcataatgtgaaggccttagactaataactggtgcatatgagtactctatgatcactgttattacttcttttgataaaggaaatgaaaacactcaggacaagtgttgccttcaggaaggtcatattccagtgaagaggatgagtgtgcaaacaatgataatgccatgcagcaaatggtatgatagatgtatgtgtggaacttaggggagtagtca

SEQ ID NO: 4924 - DNA, 1099 bp, Homo sapiens
tcaaaatatatatcagattaatacactggcaaagtgtcattgtgttattgaactatttcacatttgaagatgtttatatatcaggtatataatcactgggagaagtctgagaaaacgatattggctttacttctaacatttaactatagtttcttatagctcttattgtgtgtcttacattatacagtgtaggcagggccatcaaacttaccaactgtttccccttttgatgactctgataccttcattcatttttcaaaggaatttactgatcatgaggttggaaaatctgtatttctcttgcttattatgtattaataatcataaatgtctagattcaccagaagtcaccagaaggtctgtctcagtgaagaaaacttataaagccactttgttgcattttgtgtttcagtgttacagtttgagatctgtatatttgtacacagctatgtgtttttcattgaaataatgtacaaagactgatcttgatgctgtgtatttttatgagttgtcttaggcattcctgagctcagcttcagttggatggtgggtcagcaccctgcgtttctgaacatactagacttcagtttaaaactgttttgaggctgtataatatgttgctgtttttacagtgctaatgtttttatagtattaaaattctgtatgatttgtttcacttcagaggtccccaaacaaaagagttattgttaattctattagattatataagctacttgcattttgattatataagaacatggtccctcccttttaagagaggtatattgtgctacatagagtttttaaatgacatgatagatttgctctgaagtattcagcagagaaacaaggaatcgattaaggaaatgtgacaaaaatcctgttaatgttgaatctgtgtaatgactatattctactttgtgttggaaatttttataagtttttaaaaaatggttatattttaaagtccccaggcagacagctgagatttgaaatcctcttgagagcccaaagttttactccatagttatagcagagtttaaaatagaaataccactgggaaagacagtacgtattagcattattaactaagaaaagc

SEQ ID NO: 4925 - DNA, 1039 bp, Homo sapiens
agcctgggcaacaaagcaagacttctcaagaaaaaaaaaaaaaattagagtactgcatccatctttgtctgtttgtgtttcaacctgagattaatgttgaatattactgtttgtttgtttgaagtccttgcctgcattaattgaacaaggagagggattttcccaagttctcaggatgcagcctgttatccacctccagaggattcaccaagaagtcttttccagttgtcataggaaaccagatgctaaacctgagaactttataacacagatagaaaccacaccaacagagactgcttccaggaaaacctctgacatggtactgaaaagaaagcaaactaaagactgcccccagagaaaatggtatccattgcggccaaagaaaattaatcttgatacatgagctctttctgtttattttgggagttgaaaataggcaccatcaacatttagattacagcctaattaatacctagataagacttcatttgaaataagaaataactcttttactagtgattcatttatacagatatagtatctctgtgcggggatatgatataatattgtatttccttactgttttatctattgtaaataaaaagcattttaaaaagtattgacacaaagcccatcagtgggcattaaaaatattaaaagtgcagacttttactgtccttaagtgccatcaactctcagctcccttgtagcttttgtgggatttaacaagtaacaaattctgttgtgtttccctggtatacatctttctaggaaaaaaaaaaaaaagagagagagctgtataatgatttttcgtttacatgctgaaaagtaattatcagttctgcacagcagcagatgcagggtttttttttaaagatgtagtttgatttatcaaattaatgtgctgatgataatactggctttgactttgttactccatgttcagctaatttaggtttgtgagattaactttaggattttttgttgtgtaagacaatgataactattatttgtgcaacattactctttgaaataaaaa

SEQ ID NO: 4926 - DNA, 1074 bp, Homo sapiens
ttcttgtaaaaaaaatcaatagtatttcatatttgtatttttatgactatgtaagtgttcttcaatctgagtcaggtaattattattttgttcctgagtcagataattattactacgagtatattctttcttgaatagctttctaccccttttggaacaataattgctttattattattttttttcgtttgaggcagtcttgctctgtgactctggctggagtgcagtggcgctatctcggctcactgcaacctctgcctctcaggttcaagccatcctcccacctcagcctccctagtagctgggattacaggcgcccgccaccatgcccggctaattttttgtatttttagtagagacagggtttcaccatgttagccaggctagtctcgaactcctgacctcaggtgatttacctgcctctgcctcccaaagtgctgggattacaggtgtggctcaccatacctggcctatttttctgtttgctttgttttctgttgtgtctaacagaactgtaaaattcatctcaatatggcaaacacttaaggttatctctcagatccatttttaaactttatcttttcctcggagatacttctctgggaaccttctgtcctcctattccagtctggactggctgctgtctaggcctggtgcaaaattttcatcctgcctgttcctttcatcatcgtcctgggaatttcccttccttctctcatgttttaaatcgtgtttcctggttcctgttttctactctttcttgatttattctcttgtctttgatgtatcacatcctctaccacccacctcctcccagctcacctagccccaaatcctctattaaggcaactttcttacatcacctgtgaagatttccctctcccttcggttcccttgttagattgatctcaccctcctttgtgcctccatggcaccctctatcatagccttggtccatcatgactactgaacacctactgtacacgttaggcactctgttcaacattagggattctgagattaaaagaatgtgtttcctgttcccaagggagttctggaagctaaatgagaatg

SEQ ID NO: 4927 - DNA, 1024 bp, Homo sapiens
gctttggctattcggactcttgtggttttgtactaattttagggtttctttctttctttttttctttttttgagacaatgtctcactctgtcactcaggcttgagtgcagtggtgcagtctcagctcactgcaaccttggcctcccgagttcaagtgattcttgtgcctcagcctcccaagtagctgggattacaggtgcacactaccacacccagctaatttttatttatttatttatttatttttgttttttggtagaaacaagagtttcaccaggtaggctggtcttgaactcctgacctcaaatgatccacctgcctcagcctcccaaagtgctagggttacaggtgtgagccactgtacctggcctaggattgctttctctatttctgtgaggaatgttattggtattttggtaggaattacattgtattcgtagattgctttgggtattatggttattttataatgttaattcttctgatttgtgcacaagggatgtctttctatttgtatcctgtactagtctgttttcatgctgctgacaaagacatacctgacactgggtaatttataaagtaagagtggtttaatggactcacagttcaacatgcctgaggaggcctcacaatcatggcagaagacaaacggcacttcttaaatggcggtggcaagagagaatcagagagccaaactaaaggggttttcccttataaaaccattggatctcatgagaatttattcactgttacaagagcagtatggaggaaaccgcccccatgattcaattatctcccaccaggtccctcctgtaatatgtgggaattatgggagctacaattcaagatgagatttgggtggggacacagccaaactatatcatattctcttcaattgcttttaatagtgtactgtagttttccttatagaggtcttttgcttccttggttaaatttatttccagatattttattttttttatagctattataaatgggattgacttcttgatttcttctttag

SEQ ID NO: 4928 - DNA, 1075 bp, Homo sapiens
tgttattgtcatctctattctaggttaccatcactctagccaggatttctacaaatgctctcttagaaggtcttcttgtttcactcttgctctcttccatttcattctgcatacatagggcagtgtgattattttattcttcgaaatatttcacatatttgaaagaaatatagaaaataaagaatgcaacataatgaacatctctgttcccaccacccatatttaagtgttaatcacattttgtcatacttgtttcagacctttttaggaactaaaatgttcagatatagttgaaactttctttgtgtcttccactattccattccactccctctcttacctcagaagtataaccaggatcctcaagctgtgtaaatccttgctattcatgtttttatacttaatttatagatacatatccataaacaatgtatgggatttaagtttttatataaattgtatcatactgatcatatcattttgtaacttttttctccatcaacgttgtgtacacgcagagctctctattcatttagctattgtatatagtattctagtttatgaatattccactatccattcctttacagggggactaacttagattgttcctttttttcttgacatcttgttctaggttcctttttttttttgaggcaggctgaagccacccaggctgaactgcagtggtatgatcatggctcattgccacctcaatctcttgggctcaagtgatcttccagcctcaacctcctgagtagctgggacttcaggcatgtgtcaccatgcctggctagttaaaaaatttttttttgtagcgatggagtcccactatgttacccaggctggtctggaactcctgggctcaagtgcttctcctgccttggcctccaaaagtgctaggattacaggcatgagctactgcaccagcctaggttgtttttgtttttgtttttttttttttagtcttttcagagagtcagcttttagttttgttgccttctctaatttttttgtttgtttgttttctggttccttgatttctaatctttattatgatcctcctgtttttgtg

SEQ ID NO: 4929 - DNA, 1029 bp, Homo sapiens
tgtttttgtcttgtttcttctcggtccatgatgccagttgaggtcatcagtacagcgaaaccaaactggtgagatgggaacaaattattctgtcacttttctagatctttttatttatttttttatttattttttgagatggagtctcgctcttgttgcccagtctggagtgcaatggcgagcctgggttcaagaccagcctgggtaacatggcgaaaccccttctctaccaaaaaaatacagtatttagctgggcctggtgcatgcctgtagtcccagctacctgagaggctgaggtgggaagatcgcttgagcccaggaggtcaaggctgcaatgggctgagatcacgccactccagcctaggcaacagagtgaggccttgtcaaaaaaaaaaaagagagagagagagatacaagccttcagagaccctcatattaacttcatggtaaatctgcctctgctcacccctcccacctgtagcaactaatatcttcatttccagatttactctgaaaaaactgtgcaactgcttcacatgtttcctcttgattcactaatttgtaactcacttactgaaactctgatgaaagaattgagtcaaaaaataaatagacctccttcccagccctggcttgttcagagcatctactacagaggagtcttaagggttttgtatgcttagagttgagagaccaaatagctcctgaaaactgtagctagaggaaatgccatatggagacaggccacaaggagaactcaagcccctgtaaaccaaaaatgaaatattctaagcccccaatttactaaacagattcaacctcccacttcagcctcccaaatagctgggattacaggcgcatgcaaccatgcccggcaaatttttgtgttttttgtagagatggggtttcgccatgttggccaggctggtcttgaactcctgacttcaagtgatctgtccacctcaccctcccaaagtgctgggattagtgagccactgcaacagccctctaacacttatttctgaagtt

SEQ ID NO: 4930 - DNA, 1120 bp, Homo sapiens
tcactatttcaaacatctgaatacatgtggccaagaggctgcgaatgggtttgctgtgtgtagataaacagagctaactcattttaaactctgataatactgttcttaaagagattaaactgataatttttaaccctgtgctacattttaatctaatggagatgtatacttggtcttgttcatctaaaggacattcgacttctttaagaaaacagtacttttcattaataatactgattttcagggtgaagtaagctcttgtgcacccttttgctttgaagtccttttgctttccctgtcacccccagaaatcttgtaaagaattggtaaagaatctcaatgagctttttttttttttaacttccttcctataaacaccttcagtcaaagaaagccagaggagatgcactgagactgaaataacatctgttgactaccagacttcactgaaatcggccgtctgctctcctgagttggcattgttgctaagataaagcaaatgaaattgaagctgtactcttgatatttacaccatacaagactaggctgttagggttgtcctgtgtggtctgcagccagaggttacactgtaactaccatatgcaggccagacattcattctgtgcttagggactgaattacactataaggtgtaacactggaccgaagacttttccattaaaaaaaaagtgctgcttttctaattctttatattttccaatactcattcctaaaatgtcatgaaatggtacctaaaagcaaagtactggaagataatcacatcatgtcacatttggtcttaatataagacatcagaacacatctttaacagtgagtcctcccttagtttgattcttggcatccttcagaagaatcaaagcctgcctcagtttaaaaatcagatgaaatgtgaacagaaaggttttttggttctgaagacctgctgatcactcctggtctctgcctgagtgtgttaatgtcagaggtaaatccagtaccgctaaatttgtataatagtacgtgacctcttgtgctttttgttagagtctgcaaagtttaaatgttagtgacagaacatagactagcttctcaatgtgatatttttgtttcattttgaaaa

SEQ ID NO: 4931 - DNA, 1083 bp, Homo sapiens
ttgcagaatacagtttggtaaacattgttcagaagtatcaggtgagctgtgttttgataaatatataaaagcagtcatttgttttaaattcatttgtttcttgtaggttatcactgtgaatataagatgcggacaggaaggaaacctgatggctgtgctatttgcttcaaacattccaaattttcactcttgtcagtgaacccagtggaattcttccgccctgatatttctctgttggacagagacaatgttggattagttttactcttacagcccaaaattccatatgctgcctgccctgcaatctgcgtagcaaatacgcatctgttgtataatccaaggcgaggtgatattaagctgacgcaattggcaatgctactggcagagatttccagtgttgcccaccagaaagatggcagcttctgccctattgttatgtgtggtgactttaattctgttcctggttctccactatatagtttcataaaggaaggaaaattgaattatgaaggacttcccataggaaaggtaagtgctttcttcattgttattagggagtggacatagttgctctgctcatgataatgtgaagatagtcattacatggctatttgaaaaccttggatgatccagtaccctcactttatcaaactatgattttccatgactttttttttttttttttttttttttttgagacagtctcactctgtcgcccaggctggagtgcagtgtcatgatctcagctcactgcaagctccacctcccgggttcaagtgattctcctgcctcagcctcccgagtggctggggttacaggtgtgtgccaccacacctggctaatttttgtatttttagtagagacggggtttcagcttgttgaccaggctggtctcgaactccttacgtcgtgatccacctgcttcggcctcccaaagtgctgggattacaggcgtgagccactgtgcccagcttcttctagtaagtaattattttcacttggttgatttatatctttttcatctatctgtggcaacatactgcttggaggaattaacaggcagcaaaaaaaaaaaaagtattg

SEQ ID NO: 4932 - DNA, 1049 bp, Homo sapiens
ttactgtggtccctgaatcatgggggctgaatttgatgtcttcatccttgagatgagcctgctggcttagctgaggaatgtcctgctgaggtttcttaggtttccttgggttctaaggatatactggatataccatcttttagcaagagtatctggtagcatttacagatagcatagacattggtatgcacttctttccccagataggaagtaaaggaggatttagttgcatgaaaaaaggatgttaaacattgattacataggagtaaagatgaatgagctgcaatattcagtcggagctaaacaataagatcagggaaggtaaaaatacctatgtggaatattttgaatcgtaagcttttgaggagcttaaattgagagaattttacttttaattttgtagattgagaagaggaaccgctttttaaaattatagctaaactgtcattgttttcctaagagtcacttggccatctctggccccctctttcatcagcctgaagagagggtctttgtagactgctgagggtgggccttgtaggacttgaccatggcttacacctacttaacctttatcctgctttctttcagcttgtgcttttcagttataaactccagtgggtacagcaggctggccttttcatccagctgattatttttccagcttaatatagattgacccatatgaaatttccaataatggaccatattttctgcaaatagacagtactcgcatggatcacctatatcttccccctgatacactgtgggtcccaacaccagatgtcatttctccagagcagtgctaatgaacacaaaaggtataccctgggtggcccagctcttttcacgaacgtgctgccctgctcatagtgatccttgcatcacttggtgaatgggccatctcctgggacatggaagttgcagaggtagatagtgcactgcagcttctcttaagccggattggccatcaggcatatcactctggagtttttagctgctgtcctttcccgatgaacagtctgtattagctgacctcagcctacttg

SEQ ID NO: 4933 - DNA, 1031 bp, Homo sapiens
taaaaatatgttgcttcttagtctggaaaatatctgatcaatgtttgtaaaatgtgttatcttaataaaaagtatctttatatggtcacactaaaaatattgtatctattttgtattttcatttgactggaagtattttaaaaatattttttcttgcattttttttaaaaactgtgaaagattttacatatatacaacagtagaaagagtacaattttttaaaatccatgtaataatggtgatatttttcagtctggcttatttccctcagtctttctatagaaataagcctccattggtttaatattactttgtaaaatttattctaaaagtatccttatccgaacattttgaaaataaagaaaaacaaagcaaatcaagattgttcttagtgttaccacccagaaataagccacgtttatgttttgatataacgattaccagtcttgtttattctcttcctctccttcccttgtctatctggtctttttatatcaataataataaccattctcattttttcacctcttcatgtagacagtcaaattctccaccccccatcagacgccagcccacctggagccgatcctctctggtatgtatagaagctgcagtgatcaagtgatctgactgttgagcattctttgttattaatttgaggtggggggatgatgagggcatcatgatgaggtgaaattttgtgagaacacagaggcgtcattctgtcaagcagatgcgatggacacccgttttgtcccccttggacccatccatgcccaccactactctaagtgtggctgaggctgagggtttaccctgagagtaggtcttattccaggcctgtgggaccatgttccatcagcatacagcccatggtgtgttttcattcccttgctcatctgttctggttgttgtgtgaagatacatcttcagttacgagctccacaaattcctttgtgttcactgccgtagagagagcttaataaactagtgagaaaatgccttctaaatgagcaaaaattgaacggatc

SEQ ID NO: 4934 - DNA, 1106 bp, Homo sapiens
aggatgtgcagagctatagaatttttagcatacatttatgtctgtgctttccagttttaaaatatattgatttttcagattttaatgatttgagatgggatgtttttcacagttttgaggtgtacatttttaggggtagtgttttcatccatgtaaagttaagttggagatgaatctttatataagtggtattttagaatcaaaggaatggggcgtttggtatgatttctgccaaaacatcagtccctacctcccatcctagtaggatgagcttcaggtacccatcagggtgtagctcagagttccttctgacatctgctctggaggtcacaggaaaatggtgcccatctgtgaccctcttggtgcttactagcctggaatatgtgggacctgctgcccaggaaagctagaggcagctggcttggggcttgagccccaggccaccacaggcatgagacaaactctagaatctctacctctatcaatttctcaagaatgcattgcttcggtctgcttattttggattattcctcttgattccatctcaccatcctaagcagtgcttccctggccagtgtttagcaagcctatttctgtgatgtaaatcctcccactgtggtgttacggaagggtagttgggaaaagatgtgtgtaatcagttcttctgagcccatagtagtcagcacatcacaggttccaggggcctggggttcagctggtagagatgctgactagtcagctacgcaactgttgccttacagagctctctggagatgttttagccgtcatggcttcctctgcccccgtgaccatcaagtaacatcagaatgagcctactctgccttcagtggttttgaattcgtttcctggtatacagaaaggcctggcacagtcccttcctaggctcaacttttgaagggatgatggcctggaaactcattggcctataccccaatcattagaaatatgtaagcacacgcaaagcattttttataaacgtacatctgagaggcaggcggatagggaagaatgaatgaaaagagctattccctggcaccacagaacttacgcggcaacccaaaatatgcctggaaataacctgttat

SEQ ID NO: 4935 - DNA, 1050 bp, Homo sapiens
ttgggtggctaacttccagaaaagcattcttttttacccactgggtgtctctgagtcagtaaatgatcataatgctttttgtgcaactaccaagtctaggatcatctactgagtctgtgaattgtagaatagagagaggtggttcccgccttcaaggtacttctgggctagtagggtgctaaatagagattgatgggctggatggacctggtggcccatggctgtaatcccagcgctttgggaggccgaggcaggtggatcacttgaggccaggaattcgagaccagcctggccaacgtggcataacctctgcctctactaaaaaaaaaacagagatggataggcatgttatcattacaaatgcataaaatctttaatattaaattgctgtgattggggagaggctgaacatggatcatagtggccacatggaatgtagggtgggcgggccgggcacggtgtctcacacctgcaatcccagcactttggaaggccaaggcatggagatcgtctgaggtcaggagttcaagaccagccttgccaacatggcaaaactgcatctgtactaaaaataccaaaaataaaaaataataaaacaaagttagccaggtgtggtggcacacacctttagtcccagctactcgggaggctgaggcaggagaatcacttgaacccgggagatggaggttgcaatgagccaagattgcatcactgcactccagcctgggcaacagagcaagactctgtctaaaaaaaaaaaaaagaaagaaagtggggtgtcccactcaattgtctcaccacaggtccatgctatggaaattaaagtcatccagcaggatctccgaattatctctcatattgctgacttctgagcagatagcccctattttgctatttctgataaacattccatccagcttttgtgtttgtttgttatgtctgtgttttcaaacgttcttttaatatgggttacttgtgtggtactctgattttttttttttttaatagagtctcactctgttgcccaggctggagtgcagtggtgcaatc

SEQ ID NO: 4936 - DNA, 1073 bp, Homo sapiens
aatagtaaaataaatcagtgttcttttgtaatatcacttggcataacttattatttattgtaggtgtcctataatgaagaggaaactcagaatttcaaaaggaaataaatcagaggcattattcgtatttcaaaaggagtcttcatgtaatgtttgtgttctttaatgcatctgagatgtttgattgagatgctttataaagcaagatatgcttatacgtatgttttagccattagaaaaacaaagtttaccaaaaaaataggttgagcatccctaattcaaaaattcaaaatctataatgtaccaaaattgaaaactttttgagcaccaacatgatgctcaaaggaaatgctcgttgaagcattcaggatttctgatttttggatgagagatgctctactgggtaagtatagcaaatatttcaaaatctgaaatcccaaacacttctcgtccctaacattttgcataaggggtactaacctgtttagtatacttcaaagaagtgataattttattattacatctttaaatcacatggttaatgtgttagtatttggtctatttggaacttttctcaaaagcaaacaaaaataatgtgctattgagctattttgaaaataagttcttaagcagaggtattgatttttatcctttgtgaattccttgattttcaaagatacattcattcatttgttcattcattcattgattccaaattgttctttattagtgttacattgcaggactgagaaagattaaacaattgaactcatgaaataataaagatttgtaatagagcatgagtcaaaatgttaaaatagtctactttttctaaagcttgagtagaatacgatgatgccacattgtagtgtttacctttaacaaaggtgtgaaaagaagggggaaaaacaacagaagctatatgaagaggtgttttgtcatgttgaagcatgcaggctgtgccttatgaatttttaagagacatccgcttcccataaaggattctcaagattgtaggggtatcattacaatgggtgggattgagaatggtgtgtcaatttcaaaaatggatt

SEQ ID NO: 4937 - DNA, 1044 bp, Homo sapiens
agagtcttgctctgtcacttacactggagtgcagtggcacaatcatagttcactgcagccacaaactcctgggctcccgcaatcctcctgcgtcagcctcctgagtagctgggactacaggcatgtgccaccaagcctggctaaattttcttctaattttgtagagatgaagtctcgctgtatttcccaggctgtcttgaactcctggcctcaggtgatccttctaccttggcctcccaaagtgcttatttttttcactttcgttctttccttttttttttatttttatttttaaatcaaaaggtattgtaagtagatggcataattgcaaacagaggccgtgagttagcttacagcttgatccaaaaaacctagtgttcagtttttcatgtgatagacatttaaagcactctgttgcataccattgctccctgttttcaagttgattcacatatccaagttcttcctgtacaaaaaattattaactcctcaaaatgtgatgatttccgttggcttttgaatcctccttgagtactttacacggtgctaggaacacagcattaagttaataaatacttgctgattcttggctctcggccattaagtgcaaggtaatgagtgatgagggtgaaacatggactagaaattagtgtatattgaaaaaagttctgtctgtaagaaaaatgaagtattgttactctagacagacctatcctgtaaggcctattggtgagaaagagcagttgaaataaagagggactcagaagttatgctttatgaagttaaaagaaaaaggttgtttaagcttagaaaaattaagtcggccgggcgcggtggctcacgcctgtaatcccagcactttgggaggccgaggcgggcggatcacgaggtcaggagatcgagaccatcctggctaacaccgtgaaaccccgtctctactaaaaatacaaaaaattagccgggcgtggtggtgggcgcctgtagtcccagctactcgggaggctgaggcaggagaatggcatgaacccaagaggcggagcttgc

SEQ ID NO: 4938 - DNA, 1030 bp, Homo sapiens
ggggaaaagtcagcactatcccttccctgcgcgactccccttacctcacatgggcgctttggtatctgcaagcacaaacagtagtaatgagtagggatactgcatctggatactccatgtatgttacagtagtgtgtggttgtggtttcttttgattagtcccaaagttatatgtcaaagctggatcttatatatgggctggggaacccagggtgggatgcagcatgctggagtctcgtttcttgtgtggccttgggatgcttgtggtgagcatgaactgatgctattttacccttttatctagacgcactactttggcctttggtttctcagcaagagccagcaagcacgatgggtggagctggagaaacctctgaagaaacatctggacaaattcgctaatgagcctttgcttttctttggagtcatgttctatgtgccaaatgtgtcatggcttcagcaagaggccacaaggtaggtgcattttccccctgtgtgccatataagggtgttgactaactgtgaagcttccaatgaagtagatgagctggtagatttaggggtgtgtgggtgtgggtgcgggtgtgtggtgggggagagggtaaaatagttgggggttgtttactcattgctttgcagctttagagttttggttgaatccatgtagctaaccccagcagttttctgtaatgctggtaaggtagtagggatcctgagccaggcagaatttcatctctagcagcgtggaaatattcatcggagactgtgggtaaaataggcatgcaagaatttaataaaaaattaatgacctggccaggcgtggtgtctcatacctgtaatatcaacactttgggaagctgaggtgggaggagagcttgaggccaagagtttgagaccagcctgggcagcatagcaagaccctgtctctacaaaaagaaaaaaatataaaaactagctagacatggtgttttgtgcttttagttccagctcctcgggacactgaggttggaagatcacttgagcccagaag

SEQ ID NO: 4939 - DNA, 1570 bp, Homo sapiens
agaaatttaaaaaacaaaacaccagtgttcaagttccactcctagtgggctttttaatttaatttaattttttttgtttgagacagaatcttactctgttgcccaagctggagtgcaggcatgatcatgggtcactgcagccttggcctcccaggctcaagagatcctcccatctcagcctcccaagtagctgggactacaggcacacgccatcatgcctggctaatttttatttatttatttatttttttgtagagacagggtctcattgtgttgtccaggctggttttggactcctgggcttaagtaatccttccgcctcaacctcccaaaatgctgggattacaggcatgagccaccacgcccagcctcctaacactttcttgagtggacagcattgcatagtgaaaaacgcatgtgaactgaagttacgtagacattggtttaaattctggcattgccatttacactgtgcacctgtgaatgaatgctttaatctctttgaatcttcctttcttcaactgtaaagtagcttttatcgtatcacccttgtaagataaggcatagggcatgggctctgccaagacacttaggaactccagaacttgcagcttatcaaacctgagtgttgatctgtttggcggggtgggggggggggggggcttctgtgtgtgtggaatatggtaccattgataggtcccttctggagcatgaccatggcatttcttttgcatttacagctatcttccagagggccacactgggcatggacacccttttccctgcctggaggagcacaggtgatagtgtaattttccagtcacgaaactgctaaggccatctcaggggcgtgtgcgccaggataggcgggcggcgtccgaggaccacatagccatgccttttggtctgaagctccgccggacacggcgctacaacgtcctgagcaagaactgctttgtcacacggattcgcctgctggacagcaatgttatcgagtgcacgctgtcggtggaaagcacagggcaagaatgcctggaggctgtggcccagaggctggagctgcgagaggtaagaggggtgtgtctgtgtgcgcatgtgcgcgtgcatgcgtgttgggtatgtgaaggagaactcaccgaagggaccagccatctgttttttggcatctgttgtgttttttggcctaagcgacgatgtgtttataagaatcctgttattcttagcacggctgtgatcttatccatcattggatggggagacttgaacaccgcctagagctgcatggcgtggcaggtttccttttatttcagctggggaagaggttttgggggagttgaaaatgagagactctccccaccaaagtcatcttctctctttaaaacaattgagtgggtagctggtattttggcattctggctgcacattaaggagaaaaaacgcccacatacggatgcatgcagctgccttttttttttttttttggttgtttctatattttcctctaaaaaaaaaaaaaccccaccgaataaagagaaaaagcatttagagtgagcatgaccagtgaggcttt

SEQ ID NO: 4940 - DNA, 1047 bp, Homo sapiens
taggtttttaaaatgacagatttgagcaacttttcacttaatttttctaagatcttctgcaaaaactgagggaagcctgaatacatcctatgcaaataattgacataaggataacacagtttcatttatgttttccctatttttttctgtgatattgttatttttaacattattgcgctatattttattatggaacacttttttacacaactaaatcactctgtctttattttgatcatttgttccaagtcttcaacattttttcgtaacgtttaaatgctaaaactgtttagttggcctcgcacagtggctcctgcctgtaatcccagcactttgggaggctgaggtgggagggttacttgataccgggagtatgagaccagcctgggcaacatagtgagatcctgtctctaaaaataaataaataaaaaataagttgaatgaatattacaaatatttttcaagacctgctgtgtgttgcacactatttgcatatgtttttcttgtttaccactctgagctgtattgtattataggacaatgaagctattttgcatataggaaaacaggtttataaaatgcacatcattgtttggctagtaaagaacagagttgggttgaacacagatctctctctgttaatctcaggctcttaattatcatggtaaaactttttcaaaatgaccctaccgccatcagtaggatggtggaatagggggtccagccctcttccccccttagaagcacctatttaacaaccctccagggatgaaaaatctttatgagagctcccaaattcagttctatgcattaaatatatgcaactttttgtatgtcaatcacaccttataaagtggtttgaaaaataaccttttttttttttttttttttttttgagacagagccttgcaccgtcgcccaggctggagggcagtggcacagtctcggctcactgcaagctccgcctcctgagttcatgccattctcctgcttcagcctccccagtagctgggactacaggcgcccaccaccatgcctggctaattt

SEQ ID NO: 4941 - DNA, 1079 bp, Homo sapiens
agtttatagcaactggccctgtgatggatgccaaacagagaattatagaatctaaaaaaagacagaacacttaatccactcagcataatatcctcaaggttcatccatgttgtagcatgtatcaggatttccttccattgtatgtatagaccacaagttgtttatccaaccattcatgtgttgatggacacttgggttgcttccaccttttgcctgccatgaataatgctgctgtgacatgggtgtgcaaatatctcttcaagactctgttttaaattcttttgggtctatactcagaaagagaatccatagatcctaagggaattctgtttttaatttgttaaaggtactgctgaactgttttctgtagcagctgcaccattctgtattcccaccaacagtgcacaagagttccaatttttcccacatcctcgccaacacttgttattttcttttctttctatttttttttttttgataagggccatcctgtgaggtgatacctcattgtctcactgtggctttgatttctactgatgattagtgttgctaagcatctttcatgtgcttattagtgatgcttttgtattttacaatttggtagtctgtgtttttaaattgagtcacacaatttaagtgtgagttttgaagagttataaaaacgtattttttattagtaccttttgtagtacgggaaagtcttctcaaggtgattgcttttttgcacagagaggcaaaaggttatccattcagcctaacttcagaagctgttaaagaatcagcaactagcagtggcttatgccttgtaatcctagtgacttggaaagcaggaggatcacttgacaccaggagtttgagatcagcttgggcaacacagcgagatgtggttttaaaaataaaaaaaaaaaaccaaagacttagtttggcctggtggcatgtgtgcctgtagtcacggatactcaggagctgaggtgggagacttgcttgagcccagcagttcgaggctgcagtgagttgtgattgtgccactgcacttcagcctaggtgacagagcaagacctcatctcttaaaaaaaaaa

SEQ ID NO: 4942 - DNA, 1022 bp, Homo sapiens
acatctaagagtattttttctcccaaatgctgaactcagtttttaaaaactccattaactaatgtgtaaatttttcattgtctttaatcactgaaataaggcttttttctacttacggagggatttctctcctgatttattgatagttgactggtcaaaaggcatggaaaagctgccattccctgggctctgttgccatttgatttatttagaagatgtaataggaggaagaatttctgttcttgctgttagtcctgctcggtcacggcagtggatgatggagagagatggatgcttgtttattgtcggctacaggaggggagctgccaggcgaccgaacaaagttctgcttagtatgtgacttgtaccgatgcctccagtgcctgctctggtccacatgctgggtttaggggctctcagattctctgctttgttcaattctctcaacagttcttatttcccttctaaagaggaaggactggagggcacactgcaagtctcttttgcagccttaaatgtgtggtgttgcacaaagtggtttgagctggggtcatggggtgaaggcttgtttggatgatggaggagttggcacacatcctcagtattattttcagtagtatggggactgcctgagtcagccccgcccgcctgcccgggagcacattaaaactcaggcaccagcaccatcgaggggggaccccaggctcagggaatcagactgtctagtagagagagtctgggaatctgttggcaatctgcacctttacaaattccctggtgccttttcagttgtaaaaccactggttcatactttcctatccatagaggactgctctaagtctatatggcaaatttggaaaatcttccctcaaatgctgcatctacgggatggtgggtgagtggcccagagcaattcttatgcatcagtaggacccatacatgcggcatgtcttaaaatcatagtcgtggcttcatgatatctttgtagagcgtttgagggctttcaagcactaggtttattg

SEQ ID NO: 4943 - DNA, 1045 bp, Homo sapiens
ttttctgcttttcttcccatttatctttttagtcacacttttctctgttgccacatattcttaatatacttagaatgttaatggatgtatagctcattgagtagtatgttataattaacaatttccatttgttgactatttgggttatttccaggtgtttgtttggctactataaataaaataccattaacgtctttgtacatatagtgtctttttttctttccagttattcctttgggttgaattcccaggagtaggtttaatgcatgaaataaaataacatatacatttttatgttcttcgttgccaaaacttctcttccaaggattgcccagtttacatactgccagattttataatttgtaaggctgtatttagtcactgttttgttttatacatgaatattaaatatttattaagatatcgatgacttaaagttagagtgtcttattgcaatattgatccttggtaggtgctcagtaacttttgactttagagaggagtgactttagagagaagctgtcgagagaagtgcttatcagtgttactattttcaatattgtaaccattcttctttctgtgtatcttactgatgcttaaacattccttacagacttttagtaaaaaagctatgaagagaaaaacattttaaaaccaccagactgcatttggctgataggctgcaagttcagcttacctactttctctaccaccttacagatttttctacttcattgtgtttgactaggcatgtgttcctcagcatgcatttctgccttagtctgagatccagtccatgttttagccacatgaccgttcagaatcttggaagcaagaggaaacactgttatgtcaatagaagtttttggttaatagaaaggaatgctaaataggaaattattaaaaaatatataattaatttttagagaagactctgaaatagcagtggaattactgatgcatgcttcaagcctatcctcctttcattataatggttagggtgattaaatccctttattcagaatttttgaattctgaagtgatt

SEQ ID NO: 4944 - DNA, 1095 bp, Homo sapiens
gatctggaaaccagagcccctggcacgtgcataggctctggccacgctgttgaccagctgggcggctggacagagcccagggaccagtaattggtggagaagttggagcaagtggtgaaactcatgctgtctggggaggagaacgagaggacaggacccaggctttgccaacgacctcagtatactactacttcaatacatatttattctgacattaaaataagacagtgaaaaagtaaaaacaaaacatacttgatacaaggttttataacttttatctcaatcaaatcatagtaattatcactacagaattgaacaagtggtcaaacctgctcagattgctgagttttgtttcatattttaaagtcttaggagggaatttatttattgccctgttgcctaatattggatggctttaattccatggttttcagaattgcctattgccatatggtttacatacaaaataccacctgaaacataagaacgggtctttcctacggctttccccccacaaactgtaaatgaaaactttttattactgactgtatcctctcatttggtttaacttacaagtgtcatgttgcctgctgttacacttgtctttggcgtctgctcagaaataatggtgtctagacagacccataaatatcctgggttatagttcctcatttaaggctctgagacttcacagcaggggcaagaagacttgcagggcagatacgagaaatcttcaggccacttaattcagagtccattggcagaataggcagagaatgtgtgtgtgtgtgtgtgtgtgtgtgtgtgtgtgtgtgtgtgttaggctgggttgtagagatgggttttggaaatgatagttgggtcttgaaactactattggagtgcaaatgcctcctccctcatttggcggagaaacgtcaaaaatcctcagaacggaagaatccattctctttattttgggacacagcctggtaaaacttgtaagaaattatgacagctctgtgggaagcaagtgcaagtgtgggagaagcaagttgatgtgtgaagcagacatcagtgtgtgaaccagagtttatttgaacagtagtagttgct

SEQ ID NO: 4945 - DNA, 1058 bp, Homo sapiens
gacatgtgatactgttttgtttcctaagctgagtgatggaaacgtgtgtttattacattctcccttctaaaatatttcatttaaaaactgcttatgattaaagtacacactctctagcagagcactcaaggctctgcacagctcttttttaaaaatgtaaacagaaagtctcatttatttttgtctgaagcacacaggagctcactcagcacaatacaataagcgaatcatacaaatattgagaaaaaatattcccatgaatacatatgtatatattcttaagagcagcaatcaggagtttaacaacaatgtaaagtggttttctctaaataatgctttctgatgggcttttgggtaggaaatggacaggtaaatcaccatcacgtaacagatgagctaagaataacatctgttacccaagtcactggaaccctgtggcctgcgaaagccctcttggagtttacatttaattccgtcattggcctggttgacttccacatttcactaaatttggacaagatcaagaaactaacccctcaactctcaatctctcatactcagggatgtgggagggaagggcaggtgagatcaggtgtgaacacagtcagggctctgcatagctcttgatcacacctaacttcctagccttgtctggcctctcccctaaacatctcttggctccctgtgaaccttctccaaacatttctcagggttgaaaccttgttgctttgacttatgctgttattgttactttctgcccccactgcaattcttttttacatctgatcacataatctctttctgattctttaatgtgtatatgatttttatgtcctttttggaggttttatctgatgttccctttttattattagggataataatatccctaataatagttatattatcattgccatcttctctgccttcctataatactgtactgtttgcttattttcacacctttggagacatattttgtaatttatttatacttgggtttatggcatctgatgcagagtacatgttcaataaatgtttagggaattgatgagtaa

SEQ ID NO: 4946 - DNA, 1066 bp, Homo sapiens
gaggggagcggagttttcctgccctctcactaggccccagtggtgccaccgaactcctgggcgtcgaggctcctacttgggtggtcgagctggctcgtagaaaaaaagctgtggccaaacaatttcagatcaggtcttcacctcaaacttccaaagttgtaggtattaacagcctctccttccccacgtgacccccagatctcaggtttgaatacttgtaaatggggtttacaccttttcgtttggagagagcagtgaggtaacgctgcccctatctccctttccctctcacttccttgggttcttgttctccaaccttctcatccccacctacaatttcagaaattgtggggtttccgcttaagtctagggactggctgtcgcaggttctttgtgaaggtgaggaatctctagactgcaggtgcgggcagttacagagtttccaccaatgtgttaacttcttgaaatggattagtttactcattcatccaacaaacccagcttctactctgctaggaacaggatagaaagatgctaaatgagatcacagggcaggagtctgcagcctagtggaggaaacttgaaggccggtgaagaatgataatacatggaagaggggttctgtgagagtctgaggcgagcttggtcctggtgaagggtgcactacacttagaggatagaggttgtgctcctctggagggtgtattccaggcagaggaaacagctcgtgcagagtgaacacaagaaggacagaaagtttccctagccatctgggggcctgaggggcatttatggccatgttggtgcagtgttgctgggatagcattctctccacccccaatatcagaaataaatctagaagcacgttagccacttatgggaaccacaagtagcttaccgaggagccaaggcctccctaattggatacacctccatgcctgctgctgttttaccacaagcagctgttgtatgatcatctacattttaattggcccatgctcggtttcattaaaatggtattgattcttcttttttgtcccccacattcaagcaatgattccttttt

SEQ ID NO: 4947 - DNA, 1051 bp, Homo sapiens
aaaaaaagctcagcatcactgatcattagagaaatgcatatcaaaaccacaatgagataccagctcatgccagtcagaatggcgattattaaaagttaaaaaatgacacaaatttttaattcctcacttctcttaatcagaacatagtctaacactgtgtccatttcctgccatcaacaactcactgattcagggtgacatttaccacatttacaacagtatcactcttgggcttgctacaacattcactactatgtatatccttatacatgggcgacatcactttggtgaactacctggccttgaaagactcggagcttcttaacctcctaaagcaaaactgatggatagattgagacactagaagctagaatacatttttaattattctgagtagagaaagaccagctgttcattgctatattcattgttaactcctatttcttttacccctttataaaaataaaaactcacaaataaccgaaaacaactcaagaaaatctattagcaaagacactgtttactctgagatgaaattaaagccatgcttactttttttttaattacatttttgacatctaaaaacatttaccttggggagcctcactgattctcctctgcactctttgaccaggaactccgatacatttttgtattgtactggcaattttaaggccttgactttaatgtatgatacataccataaatacttcactcatagagaatacttttagaatacttgtcgcatttctttccaagaatgaaaaaaaagcagtaaatgcttaatttactaggctcactttagaactgatttagggtgaaacaaatccaaaagcctagatgctattcattaactttcatacaaagttaaatatttcaaagtagaaattagaaatacatggtattgaacttgcatgaatcattatatatctcacaagttacaaacatgttatttataaatgtttaatttcatttgaataaaaaatagccactgttacttgcatttttaagtaaacttttaattttgagataattatagatttatatacag

SEQ ID NO: 4948 - DNA, 1046 bp, Homo sapiens
tatgtttggattgtttaagaggtatttgcctgcagaaaggaagggaaaaggcatttcacacaaaggtgaagaaatatccagtgcacagaaatacaaaacagcatggcttgtttgggaaagggaaaatgatagttggaacacaggaagacaaacagtgctgcatggtggttaaattctaagttctcaaatggcatcggtacaaatcatacctctaataattttagtcaggtgacttggagtgggtttgcacctcagtttcctcaaatgtaaagtggcaaagagaataatgtgttctccataaggttttagtgagaatgcttttgactgccttactcctatcccatacctagtcagctttcaaaatacaaatcagatcctgtctcctttttgttcaaagcccccagtgacttcccatctcacttaaagtaaaggctgcaaaagtttgcacaaagttgcaaagcctttgtgacatgcctgccccattctccagtcagcaccatctcctgctactcctctccagctgcactagcctctgtaaaattctctgaaccaaaacaagaaggctccttctttggtatatgtgtcttttccattccctctgcctgaaagttctagtgttctagtccgtttgggctgttacgacaaaaataccatagaatgggtggcttataattaacagaaatgcatttcttatggttctagaggctaggaagtccaagatcaaggtgctggcacattcagtgtctggtgagggtcccctttctgtttcatagatggctctcttctcaccatgctctgttatggagaaggggcaaagggagctctctggtctctttcataagggcactaatttcattaatgagggctctgttcaccttcatgacctaatcgcctcctagacaccctccttcctaatgtcatacctttggcgataggatttcaactaagaattttagaggaatataaactgtcagtctatagcaccctgatagacaaaggacttgctctctcacctccttcagatctctgctcaaagctcaggtacc

SEQ ID NO: 4949 - DNA, 1027 bp, Homo sapiens
tctaagccattctctgtgaagacgtgcatgtatgcagtgccccagtatggccaagaaagagaaagagtgtgttaatttggggcacatactgaaatcttggtagatataagatgttataattcaaaggataataaatataattgtatggatggactatctgatctgaatgtcttttctctaattatgctctcctggcaactcaatatctgctgatgacctgtgacacttgtccctttatttctttatttatttgcagaaattgtcctatcacaaatggaggaccctccccaatctctcttggttctatttgattatctcaatgcaatcaatattcatacttttccctcctttccaatatttttctcttatctatttctctttcttttgagttctgatataaaaagttcttttccatcactgatcttacggtatttaaaatttgcaactctctgattttctttttggtcttagccttacctagttactgacatcacttttgttcattttctttcttctctgtaaaagttatttgccttctccagtgtaagttgctaaatagcatgtgaagaacatatttatatgaccttggtgcacctgctacttatttcggtggcacttgaaatagtcattgagagattctagtttgtcttgacagatttgtcatgttctatacagttaaaatttagagcttaacatttggcagtaccaatcatttggcctgctaggtcccttatttgcatggagaaaagcaaattctttggaatcttacttaataaacactctcatttgaaattgacaaaattaaaatttttactgcattatttacttaattattttaaatgtgttgggtacctttacggtaattactctgcaaggcaatatacaaaagtaagtagggtagatgggggcacactttcctaaagcttagagtctattggggaatacggacgagcaaggaggcatttataacagtgctctatgtgcactgatggagtagcccagcgtactataggtgtaccatggtgga

SEQ ID NO: 4950 - DNA, 1027 bp, Homo sapiens
caaagtggggaaggaaaggagaatgagaggaagaatggcttttctatgtattttcatgtcaaagcatatattaactcttggctatgctctctcctttatgacatggtgatatggtttggctgtgtccccatccagatctcatcttgaattcccatgtgttgtggaggcaaccagtgggaaccaatttaatcatggattcaagtctttcccatgatgttctcatgatagtgaataagtttcatgagatctgatggtttttaaaaagaggagttcccctgcacaagctctctctctctttgcctgctgccatccatgtaagatgtgacttgctcctccttgccttccaccatgattgtcaggcttttccagccacgtggaactgtaagtccaattaaacctcattcctttgtaaattgcccagtctcgggtatgtctttattatgacattaaagcatgttcctgggctgctttggtggcccagtttctgtgctttctttacctactgtatggtaacttgagttcaatttcacagtctttcatttattcagccagagggactctgaatgctaagaggccagccatgaagcccctgtagagggaggggatgcctcatgctgcccagcagcaaccttcttgactgatgagggcactgcaatgacaacttccaaggggattccaatctagtttcctcaatggcagcagagatgagaggctttgtagagtgagtttttgaaatacatacattgagagaagccagtacttctgtcagaggccttgctgaagtgatttggcattgacaggaattatggaataaccattgacttcagtaggtgtacacatatgactttcatctgttgctaacaagttcatatgtttactgtctctagctgcaatgatactaatattctggtggtctaggatatattgctggccatccagtatgtgtcatgtcctgtttaaagattcattttttcaccctatgtaatgtgctatttggcatatgggcagttcttcataatatgcctgc

SEQ ID NO: 4951 - DNA, 1058 bp, Homo sapiens
gcagtggcatgatcttggctcactgcagccttgacctctggagctcaagtgattctcttgtctcagcttcctgagtagctgggactacaggcccatgccaccatgctacttttattttaattttttccttagaaatggcatctcactatgttactcaggctgttctcaaacacctggccccaagtgatcctccagtttcggcctcccaaaggactaggattacaggcatgaaccactgtgcctgggcctacgctttagtttttaattttgatttctcgtctacctaatactgtgatgtgatttggagcaagtccattcatctctaagagtctccattcctgtatcttcaggggaccagttagactatattctttcttaacccttcaaatctgaaattatatatattttattaaaaatgatataatgcctatagaaacattattccaatatatgacaccaagagacttataattacaatgatgatgatgatgatgatgatgatgactatatcaatgaagctggaactaccataggagctctggtttgatagctatggataatgagatgttctatttgtgaattttgtcttaactgaaaattcttctaatgcttttcatcttcctaggggagcaagaaatatgttatttttttcaaagttaacagacgtgagagttgaaggcacagtagagcaattaataggtatttaaataagtaggaactgaagtattgattgtgtatttttgcctgtgtgtgaaaaacttttgctttttatttcctcacatttccttccagctcttgtcaatatattgaagtgcagtcagtatggttttatttctgtgggcatctgaaatctcaacacagattgctgtgattgctaccagtcagattttatttgaagtttgttactttttaaataaaaatattgacagcagtaggaaaggagaagagcaggcttatataattttaaatggcttctaaatatttcctatggaggaaacaataagttattaaaacaagcaaaacaaatcagatagttatgtgttttattgatacccatt

SEQ ID NO: 4952 - DNA, 1073 bp, Homo sapiens
gcctgtggagggttcccccatctcgggccctgtgtgagtgaatggcccataagtacacaaagtggtttttgaaatctgagtaagagctcagctatcatctatgaaattgtggatcatggagtagaaattatgaagagatcctgtttttcgctttgttttattggcaagcatcctgagtgatactgactctttccataataaactgtcatcggacacaattgtttcagaatatggtctcggtgtttgattgcagggtctgcagactcagacagtgggaatgcaatgcttaagcttcttcacttattgcctgctggtgtacaaatataggatttggcaatttagcctaaagccttcgtctctcccgctacatccacccgctctgggaggctccaggaacgcaacttgccacaggctcccaggcaagaggaggcccatagagctgatatcagagccaaggtgtgggcctgcctcatgtataatccaccctcaaaacacagtctgatggaccccttgctagagttgaactttggactccccaccactgaaataaaaaaataaataactgccaaatcctcataaatgctgaaaagaagcagctggtagccactttaataataggaataaaaataaaactaaagctgggtacaaaaaagcttatatctgtaaaaagagaattaatgtaaagaaggggatcaaagccacgtttgtgtcatgccactttgtcacagaggcaggcaggagaagggaaggcatttcaaaatcagaaaccagcttgacgcccaccagataatagcacaaaatgcaccttaaaatccctgtgttaacatgctctgttgggacagggatggagttatttccatttcctcttacaggagaagaatccccctataacaacaatattgatgggatagctttctttgtacagaggcatccatgttgaccctgcctggcagcggagtccttcctgaattttgtttaatccaaatgctttgctagtaactgaattcccaagtccttgatcactgggcaacctgtctatctgctgagcctaaggtcatttttatggaacatgg

SEQ ID NO: 4953 - DNA, 1039 bp, Homo sapiens
ttataatatatatctctttaatattattttcctctattttctttctactaacttatataatcatttaaacatggccatggaaggaaaaggaggaaaggaactaaaggaggcatatgttacagactgaataataaataacaaggagagagattataagaatgtaaattcctaggaattcaagatgccaccagttgtgctttttgtttggtttggttttagttttggttctgttgaatgtcaaggtcatgggcaaatgtgagatattacaatataggttggtgattttctgaataatccataaggctaacatggtaatgaaaataaatccattagtagagtactttatggtttactgagaagtttctttacatacatgatctcatctgtcctacaaagttctgtgagataggcaatgtaggttgtattatggctgtttcacagatgaggaaacaaaagcccagagaggctgaatagctcaccctgctgtgaagtgctagaattgaaattctaaacaagatctttcttccattgttctctcaactacaaaaagtatccaaagatgaatacgcaaccccctctagtacctggttgaaaaacaaaacaaaacaaaacttaggagaacatcgttttcatagcctaatatcttcacctgtgttcatactgattaatgtgtgctgttgttttatcatttcaggatttgtaggtgaaaatgcccagccaatcctagaaaataatattggaaaccgaatgcttcagaatatgggctggacgcctgggtcaggccttggacgagatggcaaggggatctctgagccaattcaagccatgcagaggccaaagggattaggacttggatttcctctaccaaaaagtacttccgcaactactacccccaatgcaggaaaatccgcctaagaaaagcaaagaagaaatgttttacagactttattcactatgtcccattgttctaaaatgataacatgacttctgtttttgaagcaaaaatctacattgcctcaaacacatcactctagcttcc

SEQ ID NO: 4954 - DNA, 1112 bp, Homo sapiens
aagaatcgagtagaaatttgagattattttattatgaaaatatcttaaaaactgtgcaaatcactgaatgggttatatgacagattagatacagctgaaaagacactgaattttaggcgagatctgaagagtgatctctatgctacataaaagcagcacagagagataaaatgattgaaaatataaaagaggctgaaggacttaaggacaatgaagttcaacctatgtccaatagaacttacagaaggaagagtagagagaataagatggtgcaatattcaggaaaataagaatttttagaatggaaggaaaacatgaattttcatattgaacaagtacgagtctatatcaagaaatattaaatataaataaagtcacattgtaataaaacttgagaacaccaaagacaaggagaatgacttaagagcagccaaggagaaaaaatataacctacgtaagaatgaaattgtaccggtagcaaacttaaaaatagcagtacaattgagaatgtaagagagaatatttccaaagtgctaagacaaaataaccaagtgaacctgagttacatatccagctaaattattacccaagagtgaggatgaaataaagtcatttcggataaagactgaccactactaaattttatacctcttgtagaagaaaacagaatccattaaaaacgaatgaaattcaggaagtaatggtgagcaaagaaattgttgagcgtgtactaaaagctaaattaatattgactgtataaaagtaataatgatggtgacagtgaccatgtagatgattaatttggatgtgtaaaagtaagatggacaataatatgtaaaatgtgagagaataaacaagatatgcatgttgacttttaaaggtcatcacttaaaaggatagaaatattgcatatagtcttcaagatagtataagcaagcaataaattccagaaaggaagaaataaaaattcacagaaaaagcaaagctagtagcattatataatatagtaaaaataaatctaggtatattagtaatcatgataaatgtaaatggagaaactacatctgttaaatttagggattataatggataaaagaagaaaactcagtata

SEQ ID NO: 4955 - DNA, 1025 bp, Homo sapiens
ttccaattgaattccaccaataagcaatagtttaacctaaatgcaagtaagtttgcatttacatggtaacactgtctgacatatttcaaaatagaaataacttcttatatatttcaaaagtttctgatattctggcctaatattaagacatttagtcttatcttctcaatatggagataaaagtagcaagcacatttttctttgctctttagtagtcctactcagaaaatgtacattatagcatatagaactgttacattatcattaccatattactttgcacgacaagcaaagtcatgggacacgttgcagaaaatcaaagctgaattcagtcttcagcctgtatttgccaaatcaattatgcaagtaaattgtagactctcttgaatgagtggggactctcaacttcaagagttagcttggaaatggatccacatttgactccatctctgcctgagagcaacttccagaattgtgtctatagagaattatggagcggactttttccattgaattcaatttgtcagtatgattaataaactgcataaattaaataagtttcttaaggggaattttcaataattgtgaatagacagatttatagaatttactaaaacttgatgtgtgcagagaggtgtcatctcctcccactgctccatatgtgccaactccagttatactgagttgcctacagagcgacacagctatggcacgtcacgtgcacatctgaatgcctttgtgcctctgcaaatgtgttctctcacttaggggcctagaatgcccttatatgctggttgaggattctctttgaaaattggtttggaatcatttttcccacatgatcaatagacttgaacccctagaaaatgaacatcgtatcttttttatttctcaattaaaaaatgtatttcctgtctgatggcatagggcatggcatacattacgttttcagcagaagtttattaagtaggttataataaagtacgttggatgatgtagtaaggtacgggggaaaagtagttcct

SEQ ID NO: 4956 - DNA, 1045 bp, Homo sapiens
actctttttgtctgaagtttattctctagttttttcctctggaagtgctcattcaaacaatatttcctgagttcttgcttgttattagcagtttatgcatgaactgtatatttaaaggtcattttggccagatatgcaatccatggctcatgtttttcttctcctaactatcttaaatatgttactccaatgcctgtataaaacgttgctttctatatctgatatagtctgattttcttagacataaaagtgacttggttttgcctagatgctcaatgtgcattttccttttctttaaaggccaagagtttgactagactacattctaatgttgataattttaggtgatttttcccagggatgaagttatccttttttagtagctagttgttattgttttatatattagtctgttttcatgcttctgataatgacatacccaagactgggaagaaagagatttaattggatttacagttccacatggctggggaaggtctcacaatcacggtgaagaatgaaaggcagttcttacatgttggcggcaagagagaatgaggaagaagcaaaaccagaaacccctgataaaccaatcagatctcatgagacttattcattattatgagaatagcatgggaagactggtccccatgattcagttacctccccctggtccctcccacaacatgtgagaattgtgggagatacaattcaagttgagatttgagtgaggacacaggcagaccatctcattttaaaaataaatttcaagatgttctccaattataatgttttatatttgttttgttttgttgctttgactttgttgttttaaaaatttgtattatacttatattggatcttctttgcctatcttccgtagctatcactttcttttaatttccttttaatttcactttctaattcactttttaatttatcactttccttttaatttctttttttaattttaaagtttttattttttgccttttccatttttattgtattttcatattctagttctccatcatatggctcactc

SEQ ID NO: 4957 - DNA, 1047 bp, Homo sapiens
ttgatatataaattccccttctccagctctctcttctatctctctttctctttctctctgtgtgtgtgtgtgtgtgtgtgtgtgtgtgtgtgtgtgtgtgtgtgtggttgtgtgtgcattccttgacattttttggttgaagacatcaggtgtttggcccataaagtttctcacatattggaatgttgccgattttctctacatggtgtcttttaacatactccactgtcctctgtgtttcctgtaattggtatttacatctagagaactgattagagattcaggtttggtgttttgttttgtttggcaagattgttccaaaggtgatattgtgtacttccctcacttatatctctttccgtgatttatttgccatgatgattattgcccagatttattcactaagggttgcaaaatagtgctgtgttaattcttttaatatgttctagttacttctgttgaaaacttcctcctccccaactatgtgattactttaaggtacagatcatgtagggaaagcaagagaaatacttgattctttccccttattatatgccagttttcaaaatgaattggttcctaacattttccaaaggtgaactcactgatttaaacacatttgatatgtttcgtccattagttataattctaattgatgctaaaattgtcccatctgtggccaatgggagattatttaaggtaattgtgtgtttctttgctgccagtctttgctttctgatatgtttacattttctaggcttttcttggaccttttctggcttagaccaggagtcacccacttctccaagaagtgctgattcctttactataataggaaataggtttagaaaccacagtctggatgttaggaatgtctgtgtttctaggccttttcagataaatgagttaggatttttttttttaaagaaaaatcatattgattcatactgatagttccagttcaaattcaagactttattgtttatactttctgtcattgattttaatctttttccaaccatattaaaaatattacatctcaatgac

SEQ ID NO: 4958 - DNA, 1026 bp, Homo sapiens
cccatctactcaggaggccaaggtaggaggattgcttgagcctgggaggcagaggttgcagtgagccaagattgtaccactgcactctagcctgggcgacagagacagaatgagactgtctcaaacaaacaaacaaacaaaacaagattggtatacaaatatttgtagcatctttattcataatagtaaaagcaaaaaggaaacaaccaatatatactaaaacttcgacagagagtatatggataaacaatgttggtatatccatacagtggaaagcaattcagtcaccaataaaaaggaatgaagaattgatacacataacacatttatgtaaaattctaggaaacataaactactacatagtgaaagaaagcagatcagttgttgcccagacatggggtgaggaccagggggatgtgggaggaaagggctacaaatgggcatgtagaaacttttgggatgatagatatgttcattatcttgattatagtgatggtttcacgtgtgtatgaatgtgtcaaaacttatcaaattgtatactttaaggatttgaagtttatgtatgtcaggcaccaggatgatagggaaactgtcaaaactcttcaaactatttttttttaaataaaatctttagtggctttctctttcattccaagtaaaaactgaagtcttttctttttggcctacaagactatatgtgatgtgactcaccccttgtggcttcctccctgacctcatctcctcccacttcaactcttattcaccgtgagctccagacacactggcctcttagtggttgctccagcacaccatccacactcacatctcagggcctttgcacctgctgttacctctgccagaacactctgtctacaagtacccatatggctttctcctcatttccttcaattctctgctcagtgtaaggtccactgtccaccagtaccatcataccctgtcccctctccctgctttatgtgtcttccctattgtctctatttttcctctttttaagcttcgtgaata

SEQ ID NO: 4959 - DNA, 1024 bp, Homo sapiens
catattcttgatcatctaaggaaggtctattccttctcaaggacagctaagtaaactaataattgattctaagtgatgtaattgaacagttcaaagcagttattcgtcattagaaattattgatactggtcagataatacctactgagagctagtcccattaattttcatcataattataatcatagcatttaagccatattatttctcagcatttcctatgttccagttttatagcactgaatattttaaatggtttatattacttaatactcacagtagctttacaggtagatattattgttatttccattttacaggtggagaccaaggcttagagaagttaagtactttgcctaaagttacacaggttgtaaatggtaaagctattattggaacctagtgactttttagttactggcccagctgggattagaacccagctctatcctgtattattatttccaagacttttatttttgttggggttaattgctaatattctgtacaacttcgttttagcccagtcttgcatataatcatattttctgcataaataagataagctagagtttgagtgagcacatagtgaagaatattgactatttgtttttttctttccaattagttagggtaaagcaagtgtaaagggaagtggatggtaaggcattttgaggaggcaatcaaatatgtttttttctaattatatatttccaagccaataatttctttgaagaagaatgttttaagcgtgtttctttaccatgttaggccagtaggtacagagaaaataatattagctctttatgtcagcataggtaacaaagccttaaaaaattcacagctgaatgcaacagtgaaggccgttgacaagagaggttgcattacttcaaccagggctactgcagtgaaccaaaaaaagaactgagttctaggcttccatctccaggctacatcttaactgactaagagggcagtttagctgtccaggaagaactcgattgctaactctcactgataatttt

SEQ ID NO: 4960 - DNA, 1116 bp, Homo sapiens
tggtggaatttgacctgcctagaagcatcactatcactatctatgagcttgagaaattctatattaaggcctaaacaaggcctattaatgtagaggctgtttgttcctggttttaataccacagaggctagagaatgcaaagaagtcttggagcgtcccaggagatgtaaaccctttctagccccttgcccttctgcagcgtggtgtggtgaaaacacaccttatgcaagtaagctaacattttgagccctcatttctgtatttggaacatgagcctaaccttgtaaggattttatgaagatgggaaataaaacatgtcacgtgcttagtacatagaggtacttggtattatggttgttgaaatcataaatagcattaatagtaatgttagtatcattccctgtgatcgtgggcctttagtgattgatttgccataatacctctctcaatctcctagtccttgatgtttacagttagtttttttatgcagaataatgccagaggactgggcgcatagctaatgctaacaactcccgtggaaaaggtattgccagatacatcggtattaagagtcccaggggcagctgaagcaaaatgggctgggctaggctatgtgagaaggcaaggctttgatgatgcagtgacttctatatttttaatgttgttgaacttcattctcagccagaatctaggttgttataactgtggagggaataggtccaaggtacctcagctgatgctgcagaattcatatcaagggctttgtgtattgctcctgggggcatagctagataatgtaatattgttgtatttttaacattttttttataactccaacaatcaaagggtcataatgtgttgtaatgatgctataattaagttgtggtaaatgatagcatttgtaggttttataaccagaattgattcataaaatgaatacagtcccagcagtttatgttaacataattaaatggaaatgtaattctaactcagtttgcttattaaattgaaaattaccaggttatgagcacttttacagttctgtcaaaattggtctaagtctagaattacatgaaacatccattaaaataaagcatatttaaggctgtgttgctg

SEQ ID NO: 4961 - DNA, 1004 bp, Homo sapiens
tgctggcacttagcacactttttttttcctcctggaattcaacgttcttcatctgactgctacttgagaaactcccctggctactcttatatataaccatcacccagaactaatagagctctgaaattttgaatggtatgataccattttcttaccacaacctaatactctttcagcttttttatcttatgttcactacctgtgttctttaggctcattaagactgctatttaaatttggataaacttatccaaatatactttcactcccctttttcttagacttagaggaaaagatctctcttctcctgtccaaggctaattcataacacctatgcttttgattgaaaggttttttttcctttccaaaagtttctttcatcatccactacattttgtaacctcccctttaattttctttaatgtgttttctgtctctcatactttgaaagccaaacttctagaaagaatagattacagtatagtcccttctgctccatcctaccatgatattatactcctgatttcttcctacgtcactttttagaaacttctctggaaaagttcaccagtggcccctccagttgtgttttctcagttcctgtcagacttgatttctctatatttaacaccagtgaccactcccttcttaaaacgtttcttcatggcctcagtggtaccactgtctcttggttgtttgctgctctgaacatttatttttattcttcctacccaaattccactagaaagaagaaaaaagatataaacacacaatgacaaagaaggaacacttcagcagattagagatttcagccaatttctagagctagaaagcacttggagatttgtacctaaacaggcaggtagaataaatataaacttaagagtctgatgaaataaatgctgatttgtccctcacaggccctagaaaatctgaaaacttctaaatagggtggggcatggaactgaaatagtatgtctcagtcaagaaagtaaatctttctt

SEQ ID NO: 4962 - DNA, 1022 bp, Homo sapiens
ttcagataattttcatatgcaccactgtttttagtatttttactacctctctcaagtagtcatagcaggtattagaccccattttataaataatttgacttttctaaagttacacactacacatcgctcaaccaaaagtcaattaaaaagacaaatgtattaagcctctattaattgttggttaacatgctaaacctgttagggtataagtaatgccctttagcacttgtttctttatagacatttagaaattaaaaggtaattattgcatgttaaaacttatggaataaaagtttacatattactatattccactgtactgttaggggaagaaaattaatatttattttaaacaccatctgccaatttattagtgttgttttaagtcttacaaatactgagagtggttaattttattttatgcatgaggaagaaactgagactcagaaaataaaataatttgtcagaattcacctaaccagtaagttccagagcctgtatccaagcttaggtctttctgatttagtaaccacatcaggctgaacttcctgaatttacattagcagtttaatacaagaaataaagtttagcagggcctcttgagcataattttagagttgactttttgttacatacaacatgttattgagtgaggaataccgttagcatcctggtcttctagtccatagaacataagaacccaaaggaatcttaaaagatcacacagcccagtgttctcattcttttaccttcatatagaacagcatagcaaccatagttgatgaaactccatcctgtatctcaagtcattcatttgtccattcattcagaagatatttatgagggtgtactaggtgccgggtgtacagtagtgaataggatgacatgatcacagttgttgtggttctcacattactcacagtgtgatagaggtaatagagattactcagtaagcacacacacaaatgtataattatatgctgacacataaatgcattattatatactgagctaagtactct

SEQ ID NO: 4963 - DNA, 1030 bp, Homo sapiens
attaaatgaaaatgagacataaaaccaactttttatcttttaagcaaaattataaaattggtatcaatacatcagggacaaaaagaataagaaaatgcttttaatatgtcttataactttgagagaacagacattttgtcattgataattgatcatttagcagaatttccaatatattggtacatattgacctcctgaatcgatagtggtacttgtacaactattgttaaattttcatctcttgctactacattcttatttcctgagactgataatatttaaacaacagcaaaatctaagatccatgtgatcttttagaattaggacacaaaagttatgttatctagaaagcatcaattcctttctaactttcagtttacttcttaagactttgtgtgataagcgtctaataaaaagaaatatatctgctttatttcagattgtagtcgttatttatatagtaatatttaacaaatgaatcataagaattcagggcgtgtaatgtgatgtctaagtttatcaacactaaatattggctaattacataaatgattgtctccagagttttgtcaattataagaattggattgtggagatactgtttctcatgaagaacagaatacctgtttcctgtctaatcttatggaataaaatgtatttttcttactaataaactttactatgtgaatattttattagatatttaaagtgaaacaacttcttaaaatttgtgatttctaagacagttctgaaatcactaaaattagcatgtgttttggagaagaaaacagtcaccatacttaattatatgctagaaattaatactttgatctgatgtttaaaactgcttctttaatttttgtaaagattattttctatcttgaattaatgataagacagaaacttttagaaagaattccttaagtatgttccttgaagttttataatattttgaagtagtctcctaataatcagattaaacatgttttaaagtttaaaattcactgaaacttcagtataacactgcttt

SEQ ID NO: 4964 - DNA, 1017 bp, Homo sapiens
cataagttgcctcaggcctagtgaaggtgccaaggcatgggtaagaggataggaatccagcctgccatcatagtaattcacttagccttaaggttccaagcaagatttttattaggaaaattttcctgccgaaaaagttacaaaataatatgctctactccatgtaacattattcctagacctctgtttacacctgtttatgaagttaataaacccaatgctgtgttttaaaaaagggaggggggcattccgtgttaatttcagtagtatttctaagccacttgtctcctccccaagcactggagtacttttcagatcatttggaattgctaaggttgatcttgactgctggggcactagtgtggtgatagttttcttgcactgcggggctttggtggtagaaaggagaaaagttgtatgctcaggtatgttcagaacttggcatgcctgattgaagagagatattcttccttgaaattccagtatacctgcttgagaaaacacaaactagaaccagtccccagagagaataatttttctatccttaagggcttgccattgcctgttagagatcctttgggtccgttcagaagcaaggcaggtacctaatcataccctgcagaggagagtgtctgtgagctgtgtaccccatgtttctcctctacttcttgcacttgtcaagggatgaaaacagtggtgatgatctggtttctgaaagtctgtaggtcactcagactttcagtgagccaggctctagataaccacatttatctcagaggaaagtggggaaaagaccattggcagaagaggaaataccgatgtgtgaagacaccgttttgaaaatgaacttggcacaaatcaaagtttgaaaagaataaacaggattattttgtgcagttaaaaagagaaggagtttctactgaatatggtgggcttgcctaaaatgcattaaatacacacacacacctcgatgacaaacgtcatcatacatcttctcgctgcttgaagtgtcaccta

SEQ ID NO: 4965 - DNA, 1061 bp, Homo sapiens
taaaataatacagttgtccatgcctgtttttgctcatcactattatgataagtgaaataaaactcctggaaagtattgtttttcttttcaggaatttccttaaatttcgtaaagaataataactgtttattttaaaaaattgaatttctctacttaggaatttttctgtattcagttacaaatacaaatacaaagtattaagttttctttttttctcttaatgtacattgactataaataaatgcacttgcccttatacatttgcatgtttgaaaatcagtattttatatatagatttaagcgttggactaaaggaattccagggacttgaggttcttagaacatttagggccttttgtattgccagtagtgaataattcagtgactaaaatctcaaataataaatcattagtcaaattagcattaccttttagagttgaatgtaaaatttgttgatcagcctattcatgacaacacaggagcccaccagttcctgttttttgtgctcagcactgtttaaacattctgcttcttctttttcaactctcctcaatgatgtctagtttgagaggcagaacaaaagtatttaatgtaatatttgtaaaggaaataaatgagatcgcagtcattttttttagactatgatatctaaaaacttaacacttagagccagcagcacgtttttgtctttcctaaagtatgcattatggaaatgtattaataacttaatatatggttgtacccaagttaggatttcactgatatttgtttctttcttgatttttcttaatgaaagaagcagacacttctgaaatagattgtagccatggggaatttcgtgtccttggttgttcaacacacatacacctgctgtattatttggccataaaccagaaaaaaagttgtagctgaaatggaaaaaaatgggacattctgttgcattttgagtatgttttcaaagagttgctggaaggtaagccttgactcggtgatgtaatgtgtggagtcaaacggagtatttgccgtgccggagaaaactaatggaaacattcacttggggt

SEQ ID NO: 4966 - DNA, 1059 bp, Homo sapiens
gcctcagcctcccaaagtgctagaattacaggcaagagccaccgcacctggcctaaacttctaatatttcacactgttctcttgggaagcactccagagctgggcagacctaggttttcacatgtgtgcacattcacctattcacaaggacatactctcttacgtacatcccagtgagaagttgggggaggtgggactcagcaactctggctttgccttgcatcgtatattggaatgagcattgatctttggagtcaacatgagacacagtttcaccatgcaactaattagctatagaaaccgtctaaatccttaacctcttttagcttcaacttctctgtcatcttgcctttgtcttccaacttgtcttttattaagggccttttcttgtaaggtcttgtgctaggcattaaagtttatttctagtttatctgtaaaatggaagttttgaaatcaatagtttttaagatgcttactaaccttattaacctgaggaccaatgaaaacatataaagggtaagaacaagagacacagaccgtgaggctagaaatcctttccaccaagtgtagagcggagatgcttaaatttaatctcccagcggatcttggggctggtgggagtggatcttgttaaaatgtcaattctgatttaataagtcgtgggaggaacttgagattctgcctttctttttttttttttttttttttgagacggagtctcgctctgtcgcccaggctggactgcggactgcagtggcgcaatctcggctcactgcaagctccgcttcccgggttcaacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggagattctgcctttctaatgggctcccagaagatgctgatgatgctggcctgggacccactcttagtaagtagcaaagcttgag

SEQ ID NO: 4967 - DNA, 1708 bp, Homo sapiens
acagctgtgcaatgtatgttttaagctaagtgttattacaagagtcaaaaagtgaagaattttaaaggttgataaagttaaaagttacaataaaccaaggttaatttattattgaagaaagaggatattttaaaataaatttagtgtagcttaagtgtacaatatttataaagtctacattagtgtctagaagtgttctaggccttcactttcactcacctctccctcactcactaacccagagcaacttccagtactgcaagctccattcatggtaagtgccctatacaggtataccatttatatcatattttttattatagattttctgtatttagatatgtctaggtacacaaataccattgtgttagagttgcatatattattcaatacagtaacatgctgtagaggtttgtagcctggaagcaataggctataccatatagcctagttataataggctatatcatctgggtttgtgtaagtatactctacgatgtttgtgtgtgactgtgacattgcctaacgatgcctttctcagaatgtatccctggtgttaagcaatgcatggctttagtgctacatatttgtgcaatctctaagcaatcttgtgagtctctgtattgttacaagtttctggctattacaaacattcctgctgttctttttttatattgttattattttttgagagagactcttgctctgtcaccaggctggagtgcagtggcgtgatctcggctaactacaacctctgcctcccaggttcaagcgattctcctgcctcagcctaccgagtagctggaactacaggagtgtgccaccacaccagctaatttttgtatttttagtagagatggggtttcaccatgttggccaggatggtctcaatctctcgacctcgtgatttgcctgcctcggcctcccaaagcgctgggattataggcgtgagccaccgcgcccggcactgctgttcttattcatgtcacttgtttcactttttaccaattaatattagaatatattaataatagatatatttctactatggaattcagcagtggaatgaactataactgcaaacattaacatgaatgagtctcattgagagaaaaaaaaagcaaattgtagaagaaaacatagtgtaagatcccattcttataaatagtacccaaacagacaaaattaaagacactagtgtttgaagtggattaaccttcctggttaatttaacttttgttttatttttaataatgcttttaatattatataaggtctattatgcattatattaacatatctgccctcatctttctttagtttatattttcctggtattattttttccacccttttattttttctacctttctgggtccttttgttttagtatatcttttgtagacagcatacggttggatttttaaaaatctaacatgttattgtctaccatataactaatgctttcagattattgtgatttctgatatatgtggacatgtatttatatcaactccatacttttatttttctaacattttaaaagttttttttccttctagtattgacttgttgctctcttttctttttcgttctaattttctcctccattttactagtttggaagctaggtatctaccctggttgcttccatgcctctgatgtctttgaaattttgctgtgtgtgtttaacagcttttaacatcta

SEQ ID NO: 4968 - DNA, 1026 bp, Homo sapiens
gaagccatctactttcccaccaatttaataaaaatgtgtttgaaatcaacgtgttttgaggcttggtgttaagcctatactttttgagttataccaattaaaattctaaagtagaaagtgacattaactaatttgactcaaactggtaacttattggcaaattgatgtagttgctataatacaagatgccatatgattaagttagcagttaaaaaatataacttgtgtagccagaatagacggagtagaattaattatttgggctacgtacatggcaaggaaaagatacattttctaaggcaaagatcagaaattaattccaagtctttcttgttcatcaaaaaatagttctttctttaagttgtgaacttgttcattttttttgatatacgaagtctttaatataaaatatattactcatttggacttgccaaattaatttctacattaacaaattataggttttaatacatttagctagctgtaaaaactttaaaaataatctgacttatgtgtacttcctgattgtttttcccatcacattaaatataaaagtaaatcagatcatgtttctttaaataaaaaatgataaactaaaatgcttatgcctttcttttaaaatactgataatagatttcggtgatttcttctagttatcttatagaattggttaatacagagttcatgtattgctaaggtttagggttttctctattactgtcaatagtgtagactaacaataactgtaatgtcacagttgtcacctttgcatggttagaactcagttttttgaaggacaacagttttatcatactcacctttcaaaagaggaagttatgatttggacagaataagtaactcacataataagatattagccagggtttagttatttctggtccttttgtctgtctccttcatctgtcttgctaatctttctagctgaatgtgaattcatcctagagacagaaattttgtcaatgcttttaactaggcttttaggaattaccagggaaattttactat

SEQ ID NO: 4969 - DNA, 1020 bp, Homo sapiens
ataaatgatattgaaataaataatttaattcaagccacatatttggcattagcccctttcatatatactaatatcagacctgttccttcttcagtaatccttcttcctcatatagcttctcaaaactgtgcttgctcaacttttggaattgactgtttttaggaaataccaattaatctaactcattccttgactgaatgtaatctcagagtcaccctctttccttaacatcttactgtaatcatatgtttgttactgaaatgcctttactttcctttggcatgctccttaaaggtgccagctgtctagctgactggatgcgttttctttcatcctatttctcccaatgtataactcccagctccacagtgtagcactgtgaaggacaaggagggcaaagcaggcactttatatatgggaaaggtacctttacacacatgtgcacacacaaacactttctttttagattatcttatttctaataagtaatccttgatttcatttaggaggacataaacttatttttataacaattataatcatgaattttttaaaaagtgaattaagatatgaatatgtatgaagaaattagatgttctaaccatgaatatatagcatcactgtgtcttgagtgaattacagactttactcatttctgggccatttgttttatatatagattaaatatagataattactcatttgacaggttactttattactttgatatatctcaaagtaccacatgaagttacagtgtgattattataataatttggaatcattaataaccaaaattagcatttcatataaattaaaatttaaaagttggaatttgattttgtttaaagtcagttttacttctgttggttattttgatttaataataaaatatactttttttaaacagcagttgttaattatttttaagctcacatgttaaatataaaaatgttttgtaactgttctaaattatacttagaaatattagctcctgtagatgaatcaattcatttttgc

SEQ ID NO: 4970 - DNA, 1031 bp, Homo sapiens
aaataaaaatggacatggagaaaattaagcagggtaagtgttagagaattataggatatgaagttgattggagagaatatgatttgcaggctggaattttcagccttggacagccttggacagtctagtgcctttcttctaattgcccttttaacaactggggaaaggagcaagggtgttcattattcattattgaatgaacattattcatacctgttcattcaagaagttggtgggatgggttttagccatctctcctgattcctgatcagattgcccaaagcttttaaatgtcagtatggataggcctgcgaatagcaaaaaaggcacttttgtttaccaggtacagctttactactaatgcttctgaatttttttttttgcctttatgtttatttttttaattgagacagtaataattatacatatttatggggtaatgtgatattttgaaacacgtaagcaatatgtaataaatcagattaattacgatgtccatcacctcaaacatgtatcgtttctttgtaacttttgaatgattttttttaaagaaagtttacagatgctaaatatttatatagcattttggatgttccctttagatttcatcataatgtatgtcctgaaatttaatatgtaagaacttcgctacagaggttaccagtttactcttctgctttcatggctacttaaatattatgcagtacaactagtctttttattagctttttaaaaatgcatgaaataccatgctttctgcattttatttttctcactttagtatttgcatacaaattcttaagtcattcctttattagtaaagaaatggcttattttactgttttgttttcgagatatatgtgatctatggactttttaatgaatgtctttaaaaacattgaatttgcaaatgtaaggttttctaaaaatacgtcttagactgtgatcatcattttaaaacttttcttttttgtatcctaacaaacctttgaaaattgttttaaaatgctctttctttcaaaattaaggct

SEQ ID NO: 4971 - DNA, 1049 bp, Homo sapiens
agtactaggattacagtcgtgagccactgtgcccggccagaaactgacacttttttaaataacttattttgagataacttgattctgtatcttagaaaggtacaacttaatagaattataataaatatttcttttacaaaagacattttaatacagtctctttgattcaaaattctctattttgggccaggcacggtggctcacacctataatcacagcactttgggaggccaaggcagatggatcacttaaggtcaggagttcaagaccagcctggccaacatggtgaagccccgtctctactaaaaatacaaaaattagcagggcatggtgatatgtgcctgtaatcccagctactagggaggcagaagcaggagaatcacttaaactcaggaagtggaggttgcagtgagcggagatcatgccactggactccagtctgggcaacagagtgagactccatctcaaaaaaagtaaaaataaataaataaataaataaattctctattttgatgtcatttacaactgtagattcgatatcataaaaatttaatatccatagttatttgaaaatatgacttgaataatttttcattcagttctattaaatgatgtctgtcttgatatttttattgtattatgctttattaaaagagcagatatttacaaatttaaatagtgccaatacagtagtatatttgttcatttaattaacagtattttaatgtgtattatattctccatatttagtcttgaaaaccctttaggaaaaactatataaacaggtgttcaatcttggtattttaatgttaccaaaattgacaacatatttttccatatatttaaaatattggttcttgcttctctgataacttagtcttcgaattggcttgacttcatagacttcattgtcatttgggtttgtgatgcttcagaaatatggaaccttgcaaagtgaatgttagtattttggtaattagacacaatgatgcttacttactatgtgccagacacttttctacaggctatttatatatattttttcatta

SEQ ID NO: 4972 - DNA, 1259 bp, Homo sapiens
tcttcttcttctatgcttcagtgatcatagaaaacttctaaattgagtactttgattttacaggtttccaagctagactcagtcgccttcatggaatgtcttcaaagaatattaaaaaatctggagggactccaacttcaatggtaggcatactttttctgtgtaattgtcatgtttggaaatgtttccatttctatggaataaaaagccacatcctcatcctttattcatattctaatgttaaacttaaaaataatccatttttttgtaggctacaaactggaccagtgagattcccctataaaccaaatcttctaatgctaataaattagttacgttttgaacatctggggaatgacattcgagggaacctggctcctgtcctcttccctggaggaatatcattgaagtgagagcctctttgatgaaaagatggggctgtttttgctggaggactggtattcttccttttagtcagaagtgaacctgactggggaggctttctagggatttaggttggcccagggtggatagaaactactgtaaattatatatttttctcttttatggttttttttttacattgaatccatttatgtatacttgctttgccaaaatgctaacaaagctagaaaattttaaacttccagatcgacaagtattccttaatgtttatattgtgactgattaagaattaatttttacatatctgactgttgtaaataaaaatcatgatgcattgacatttatggttcatttttagagaagtcttatataaccagcattatttaaaatatttgcattttactcagggtattttaacaagggctaagatgagtagtaggtaaggttgataatctttgctggagtttgtattttgttcagcttcctttctacttgggtaatctgcttgtattgcaaactcattgtattttatagtatagctttcattgtactgcaaaaatcatcctcgttttaaattagccacagtgataactagtctgcactagtagaatcatttaccttttaaattatctgctttgtctgatacctgaaacacatcaaaattattattttggtttagagcttaatgaaacatgtgaaagctggtatttttaacaaatgctgtgtgattctgaatcatattgtcatgtttaaaagtgagagctgcttgtacatctttagaatggcagaccatatgtgtcactgtgagtgtcagaaatacttgcatgagctcattttcaccaactggggggaaa

SEQ ID NO: 4973 - DNA, 1022 bp, Homo sapiens
gaagaaagctagagagaggtctaaattcagaactccttggaagaatgtgcctcttaagaaattcctatattcttcattaatatttattttttaagaaatcgaacagaaacaaattatattcagaaaatgtatgtgaatttagatctcatctataattttaatcctaaacttctcaatttaaatattttaaaacaagttaggatgccttattaaaaaataagattatggaattctacatattaatggaaaaagtattttaattaaaaaaagggatgatttcctgattggttaaaattaagaattacagtaaaaataaaatacatgagaatttttaaagaacatcactaaattttctttaaaagctaagcctctcattatattatatgactttgttctcctggtattttaaactagactgtcatataagcattacttctattagaatagtaacagtttgtttatgttattcaaatatctgctatttgttttatttgtatgttagatttgactctggagcttctgtgggaatatatgtacacactccctccttaatatttgtaatattattttttttttttttttgcttaaaagtgaccttaacttcgatataatggattatcaccgttttaaactttttattccttgcaaactaatagagttgttgtgaattcttaagtaatgtcttctccagaatatttgtaaatgtggttatgaaaagtaatctcatcctagtcctttgtatttcatgtgctgaggaaaggcttagcctgcttttgattgagacttttcccattttattgagcagtggtgttccaggctcaagctgaattgcatgacgtaagaaaggagcagtgagcatttgatgaaagtacatgataaaatgcatcaattgtgtcagcatctcgttgcagtcacatctggcttactgtcagggtcccattagattcctgtggttttatgtgccaaaaataatatgctctgtagtgaatggaaccaggatattagcagtttgattaaaaaaa

SEQ ID NO: 4974 - DNA, 1045 bp, Homo sapiens
ttaatggtataactagcatagaatgaaatgcacaatttttacaggcttaattttattagttttggcaattgcatatacttatgtaaacaccacacaaaacaagataatggatttgtccatcaccccacagttccctctcaaggatacctgtcttaatgtttcactgttcattatcttggttaagtcagggagacaaaatgtcctatgtagattggtctgctcttcctagggtgctattgatttgtagggtaggtgactacatcagaatgtgattgattctctcaacttcttttacctttaaaatcatggttaggtactgagagaaacctccttcaattctctttaaaggctcgcttgtcatacaactcaccatttcttatggcaccagagtataacaaagtggtagcacttagtatttttgaatgaaattctaaagtcattcctgttctgtcagaatgaatatgttccagaaaactggatctttattttctagtctatctgtatgactatctgtatgactatctggaatgtaaaaattccagatttcttaatggaattttcttcttcattaattgaacagatatttactatataagtatgtttgatcccagtaataaattccagtcccactgggaatactgctactaagcagttaattaggtgccaggttttacaaatatgtgtcatctcatgtaaatcttttgaggtaggtgtatcattctttgcattttagataaggtgacacagaagcaaagatggtttaagtaactggcctaagtatcatatttgcaggatgattccagtatacccccccaaaattcttaaccacttttatatgttgcctatgtgtctgaatgagatataatatctcaaggaatatgtaacctagcagttagatgcccaaatttgttaaccagtctggattttctgacttatttagctcccatcttgactttttcaacttctccagtgtggacgttgctgtttcaatttttaggcaccaaatgggtaaatgtggataatttctgtattcaactatggtatt

SEQ ID NO: 4975 - DNA, 1023 bp, Homo sapiens
ttaacttctcttctttgaaattctcttccactttccatcttacctcttcaatgccactttgtctggatctctgactcctcttcttccctgacttagaaatttggatgttcttaatcatatccacggcttgtctctgtttttttttttttttcacctatatttttttctttagtgatcccttttatttcctagcaccatttcttaaattatttcattttacatgtaattcattcattttacatgtaatttatcagtactagaaactgtaaaccgtcattgatatgtatgtaaacactaaatctataatctgtagtcccatcctctcttcaaactctgatttcacacttccacttgagatgtccttttggagaggctgaaatcttcaatctcattttcgcaaacctaacccatagtctttcttctcctcaaacttggcttttttttttttttttttttttttttggttaatgtgttctatttctattacacatcctaaccttgctacttaggtgtgatctttgactctttccttgctttttcttactctatatccagtcaatctccaactcctatgtattctgctgctaaaatgtcagtttatatctagaaaactctcactaacacttgtctggactaattgcaatagtctgttaattgacatagtctttgtaaaatccaatttcctttcattggcattatcttattcatgatctatcttcaacttactttccagacttctatcttattaattttctatggcacagccaaacataattattcatctttccttaaaacatcccaaactttgtgtctctttgttcatcatttacttttttctttaatgtgcccaccacccctttaccttgttgaaatacaatccatcttcaagctccatcttgaatactaccacctccctggagataattgatttcttgatctcatgatttcttctcactctgaattcccacaggaatttgtttctactgctcttattttgtacattttcaagactttcattccata

SEQ ID NO: 4976 - DNA, 1048 bp, Homo sapiens
taatccggcttgtgtgtttttgcttttgttgcctctgcttttagtgttatatccaggaaatcattgctaagatcaatgttatgaagctttccttctatgttgttttctctgagttttatagttttaggtattacacttaaggatttaatacattttgagttgatttttgtgtaatgtgaaagatgagtccagtttcatttgtttgcatgtgggcatccaggtttcctaaattcatttgtaaaacagactatcattttcccatctgtggtcttggtgcccttatcaaagatcatttgacccactatgtaaaggtttatttctgtactctctattttcctctgttgtctatagacttgtctttatgccagtaccatcctattatgattactctacctctgtaatatgttttgaagtcagaaagtgtgaggtgtttttagctatctgggttttctttttttgtggtttcatataaattttataattttttttcctatttctgcaaaaagtactattgggatttttatggtagttgcattgagtctgtagatcactttggctacaatggacaatttaaaaacattaaattttttattccatgaacctgggatatcttttcacttatctgaatcttctttaattttttcatgaataaattgtgtttttcagtgtacacatctttcatttccttgattaagttttacctaagtattgtattcttcttaatagtattgtaaatgagattgttttccttatgtcctttttggatgtttattattaattaatagaaatgcaactgatttttgtatactaagtttgtattctgcaactttgctgaatgtgttcattagctctaataggtttgttttggtggacttattcatggtttatatatataagatcatgtcatgtgttaataaggacaattttatttcttcttttacaatttgcatgcattttatttgtctttcttgcctaattgctctggctatgactttcagtactagaaatagtactgaatagaagtggtgtgagtgggtatccttgactt

SEQ ID NO: 4977 - DNA, 1071 bp, Homo sapiens
tagtcattagccacatgtggctattgagcatttgaaatgtgattgtggtgactgaggaagtgaatttttaattttatttactttaaattaaattcagccacatgactactatttggataatgcagttatagactgtgctgttttccagtcacagttttgcacaattctatccctgtttatcataatctttataatttcaatagttggtgtaacacctaccccaaacccctctgtccccaaacccctgtctttaattgtgtttgcagatctacttttaaactttggacagatccttttgtagttcctaagtgtgatggttgggttttcacactcatatgtgagatatgcctccctcaaaccttatcaccacctgggcacattccccgtgtgatattggcggaaaaaagaaagctttgagcattgtatttgtttaagtgtgcttagacaatgacttgagttaaatactgtcttctctttttcctcttttgttaaactaaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggtaatgaatcgcagaaacttcatttgaagcaaagcagtgaattaattcaattcttaatagtttttaaaacaaattttgactggtttaaccatcacattaagttagagaacgctaaagctacaatgtcagcagatagcatttattgattttccatttagttttaaaaataggtaacacgtttgtttggttcaagaatctcagaatgtaagaagttcctgtgcatgtttcccatctttccggttttccccaccaccgtaatcagtcagtagccactgttaacagtttcttctgtatctgttgagcgatttt

SEQ ID NO: 4978 - DNA, 1030 bp, Homo sapiens
tacctgaggacaaacagtaaatagtagagttgggattcaaatctgaccctcgtatttaagccttacgccagcatgcctttcacctaagtctattacatgcttcttgcatcatatttcatatttatagcagggaaattatttcttctggaatgctaatcaagttatttaaaaggttttttgaggccagtttatgaatgttaacttttaaaaatgtgataaattgaattgtcatttaacacttcaccgtttcattgtgtgtcctcaagtagtgaactttttaacatatctgtttaaaatgggagtattttagttagtggaaactgcttgcattttagagttattttactactatgattttgagaaagtgtactttggtttatatcatctttacagcatgaagagctaatgctaggggatccctgccttaaggatttgaaaaaaggagatattatacaactccagagaagaggattcttcatatgtgatcaaccttatgaacctgttaggtaagtaaatgtaactgaacgtctaaatgaaaatgcttaaagttgttatagtgagtaatattttagaaattgaactttcactaaaataacgtacctaacagttttctttctcagtctctcagttttattttatatttaacattttagacaagtaatttattttaacaagtgatctttgaaacaacacgcacattgaacattaataaattattcatttctgaaattaaacctcttataattaactttcctgtagcccaagtataaagaacaaaatttcagtctgtatattacctatctttgggtgaaaattattaccattatctttttctttgtagtgtattttcactagataaatggtacaaacagcatacatttagagggaagaaataaccagtatttgtatttttttttttaaccatgaagtaataggattattagaaggagaactctatgtaaatttttgtcccttttttttcttttctgtttgtctctgctatttttttaagtgatatctctgtaactgt

SEQ ID NO: 4979 - DNA, 1050 bp, Homo sapiens
tatatttcactagaagtaaacttgaaagtatttatcgagttttttttttttttctaaacatgcttagcatgaaataaaggcaaagttctaattaatactgcttgcccttaaaatcatgttgttattgttttttagggctcctcacgttcagtcgtgaacatggagtgggacaaaatctgggcgtttaacaaaaaggtatgtatgttaactctctgccttcttttctcatgcttaagtcccaaataatgtacaagtagaagtcattactgtgctcatggtagagaaaagtttgtgaagaatattaacattttgcagactttcaggaaaatggaatgttttccttttttaaatacacgaagagcattaattaagcctattaactattccaaataagtaacaatgattgaaacaaacaaacttggaattatggggaacagtaatatttttttccttaaattttttatgaacactctgcatttcatttttctgctttcaagctgcgagctctctgtaagaaggtattacttaatgcttttatttgccttaaacatagcttttagcatattacatgttaaaacctgagatgttatatggctttgaagcacaatcacatttatataaaagacttgcttatacaaacgcattgaaaatgcattattcctagtgttaaaaaccatgtcctctggttttcttagtgccaaggggaatattgggataactctattctaccccattcccttgtgtgctgagaggacatagaattctaaaagtatgtatttcattgagttgtattaaagtttcattaattacagttcctttgtcttactgaatccagcttttttttttttaactgtttcttaactgaaagtcaaatgaggaacattgcctattgacattgttaattactaattggaaagcagatgcttggacactataataaggcaaatcattcaaatgccatgttttaaattatggtttctgtgattgtgttctgtaaattcttatttgggattgctgcttgatggtgctgatgtcttgcctcaagatata

SEQ ID NO: 4980 - DNA, 1038 bp, Homo sapiens
cagagtgagactccgtctcaaaaaaaaagatgttcaaaagctaaatttccttaaaattattacatgtattatttattgcttcctactatgttatacattggccattacagaaatattatgattatacaatttgccaagccaatacctaattttgtattagattgcaaatttgcttttttgtttgactgctaagttgacaactgactcattgttctcaaaggctgataatgttttgatacactttgagtattaagtcataaaaccttttggtttttaagaatctcttaacttgtaaagaattacattttaaattagtattgttgtttataatgcttaatctaagagggaaagggtaaaatgttttgtttattttattttctttttttctagtgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatggtatgtttaatgttacttagaattgacaagaagtaaggacatagtagatcagtgatttttaaactgcttgagagatagggaaggtgattgggaggagggggaatgggtaggcctatagaattcctgattcttatcttcttctcagccagtgcattagggcttccccttcttgttttaatgccacaaataatggagtgcccactggggatcatggaatgaaaaacacacatgagggcacatcctctgcaggtcttagcatttaatagaagaacagttttgactttctggttcttggtatatttggttactgatctctactctctgctgaggctgaggtttttctttttggctaggtcccaagaaggttaaaatacccttgaatcgaagtgaagatgtaaaagtttatcttgagct

SEQ ID NO: 4981 - DNA, 1033 bp, Homo sapiens
tgtagtatcagctacttgggaggctgaggtaggagaatggtgtgaacctgagaggcagaacttgcagtgagctgagatcacgccactgcactccagcctgggcgacagagcgagagtccgtctcaaaaaaaaaacaaacaaaacaacaacaacaaaaaaaactgtaccactgctgccatcattataatttgaaactaatacaagttggtgaaagctgattaaacttccttgcttcatgccttgtcagcccaatcaactgtatttcaacatagtggtgtaacatattttcttttactcatgtacttgatagaaggagggtgttgatgtgtgatattatcaacagtgtctctgatctgtattcttccttacaattgtcagctgctcacaggaacagcagaacagtgtttttgtagattctgattcattgagtgttggtgctgatgagacctttgggattatttagttaaaattcttttatttttaatctccgtgacatgagtttacctatataacaaaacttcacatgtacccctgaacctaaaatagaagttaaaaaattaaagttaaaaaataatcttttggctgggtgcggtggctcacgcctgtaatcccagcactttgggaggccaaggcaggcggatcacgaggtcaagagatcgagaccatcctggccaacatggtgaaacctcgtttctactaaaaatacaaaaattagctgggcatggtggcgcgtgcctgtagtcccagctatttggggggctgaggcaggagaatcgcttgaacccaggaggtggaggttgcagtgagctgagaacgtgccactgcactccagcctgggcgacagagcgagattccgtctcaaaaaaaaaaaaaaaaacttttattttggcatctgagaaaaccaaagcctagagaagtaaagcggcttttactaattgtcatgtgctcttttcatttagtcatcacagtgacagtctcagaagagcttctctccagtggcataggtgggcacccagttctcagtagtagtagg

SEQ ID NO: 4982 - DNA, 1046 bp, Homo sapiens
ttgaactttgatctgcatacagttaatttaatttagcccttatttatagcctttttttttttttgacacagggtcgctattgtctaggctggaatgcagtggtgcaatcatggctcactgcacccttgaactcctgggcttgtagtgaaccgaggttgtagtaactgagattgtgccattgcactccagcctgggcaagactccatctcaaaaaaaaaaaaaaaaaaaaaaaagaaaagaaaatgctaaataaaattaatattaatcagagaaaaaataattttatatcctttagttagttaaaattgttctgtagtcttaaatttcaagtgaattaaaacttaacctttatggacactcattatttcatccagaatttattggctactattggataaggaagcaaaaggcacttaaaaataactagaaaaaccacaatccaattagccactaacttgattgattgattgatgtttttctataggcaagttaaccgatatccatgggaatgttcttcagtaccacaaggatgtgaagcatatgaactctgcaggagtcctggccacactgaggaattatgactactatgcaagccgagttccagaatctattaaaaatgcacttgttccttaaaggaaagtttcatttggccgggcgcggtggctcatgcctgtaatcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcagaggttgcagtgagctgagatcgtgccactgcactccagcctgagtgacaggagttaagccctgtctcagaaaaaaaaaaaacaaaaacccaaaaagtacttaaagtttcatttacttagctaggagaaagacttggttctcaaaataatacattttaagattaattgggtagaattagagttcca

SEQ ID NO: 4983 - DNA, 1045 bp, Homo sapiens
atctggggattgctgagaacaataataagctgaagtatggctcacagaatcctaacacaaatcattaagtctctagttagatttgttatcctaaaatttttcatagaattttaaaatctaattctgacttgtatggttaagaaaagcagttaaatattttactacttatcaagggcttttaaaataaataaatctgattgataggaagaaaggcaaataaatacctatgtagacattctataataacaaagagccatagatgataaaggaattagattttaatgtagaatgggtggtttctgaaacaaaggtatgtggtactttgtagttattgatgagaagccagtaaccagtagtgttttcctagatatatgcccaccctcacacaactttcttcattaacaaacattaaatatgcatttgtatcttattaaattatattgtataatgctgaaggaaaacaaaaagtgttcaaataatcataacttctacattacaggttctgtttagatgcagaactagaggggccagggtaaatgtagataaagagatatatagcaccatgcttcttaatgcttcatacttttgcaaacagaaaaaaaaagttttacttttattataaaacttcatctatggtcaaagtaaacactgttacatttaaattgctttttaaaaacaattgcgatctaaaaagtcaaaaatctgaaatttaataatatgagacttacactgaatataatgttcatttagaagttgctgtggtccacttcatttataaggaacaaatatttttacagtacactatagcaacagcaaaagccctctctcaccctgataggaatgggtttgctgggtgtctagaagttagattcctgctgaatagaattagccatccttaaaagattttaatccaatactgaactgtttataaaatgctttctctattgtaatgtactgtaagtagtgaaattctgtatatactgctattttctgtctgttcattgttgtgaacttcttatgtatattagtgaaataaattttcagc

SEQ ID NO: 4984 - DNA, 1061 bp, Homo sapiens
actggtggagcaccactccatcctgtgctccatcttgtatgcagtcatgaggttttctctgaagaccgtgaagccactttcactttttgacagtaaggtaagtacctcacaggatttcagagctattttggagttgcaggcttagcagacacatggattttcatatttaatagaagctgtccagtacttttgtgactggtataatttggtgtgaggttccaactccctcattccctgcttgattccgttctttttatttaccttctgtactgctccccttggagttttgccctctcagctgtctgctcttctcattctccatattattcctggacagactcattttctccctcttatatatctctaggcctgaccaatccctagagtttgaggcattcatttcttttgaacttctctctttgagtgtcttataggacttcagacacctcatatctaaaatatatctgcaaaccaatacccacatcctgcccctaacctaaatttgctgttccttctgaattccctgacttggttattttattaacgatgtcatcatttttgccctggcaaaaactagaaactttgaagttatctcaccaattccttacttcaagccaattttcttcattgtaaattcattcttgtaaattctgccatagatcatgcctgtccgtttctctccatgactataaccctagttcaggcataatcatctttccctcggctattacaacagccctttcttaatcacgctgcctccagtttctctctctccagtcccatgctgcaagagctgtcttcctaagagacaggtttaattgtattagttctatacctaagattttttttggctcctctgcaggatcaagtccaaatttgtgagtagaatatgtttttacatattctattgtaaccttcacagtttagctgcagtggatagtaaaatcctttccttccccacgcaggtgtcaaattttgagagacaggacaaactgttggagacaaaaacgtcaacattattacttagctttttactgatagaagctgggttagagaacaca

SEQ ID NO: 4985 - DNA, 1048 bp, Homo sapiens
tgatctaaaagaggcttcctgatttaacaggatgtgaatttaaagatttacaacctattaaatttttatttgattatcctgcagcctaacatattactgtgtattggctgaggtgcaagggtctcttgagcccagtagttcaaggctgcagtgagctatgatcacaccactgcatccagcctgggtgacagagtgagaccctgtctctaaaaaaaaaaaaaaaaaaacaaaacaaaaaacaaaacaaaaaaaaaacagtactggccattttaactacttggaaaagtgctatttataaaggggcaaaacaactgatagtaatcaccacttctgttccccaagcagctgactactatccctgagtgtaatgaaggcagctgttctgtatctagctttccaaggaaagagggaatcaatgatagatgcagaacagctgccttcattacacccttcacagatagtgaaggaaagagggatggatttctcaggactgcaattcttaataaaaaatcttggtagccaaaagcctaataagattagactgtagcaactatcttgtgcgtcttataatggatgtgaatattctccattagctgccttggcaactactgatgcctccttgaaaaaatattgaacttgtaaacagattccatttaatagatagatgggtttcattataggaattgaggatatcagcactaagctagttagtaaccttagtaaatgatgagacttggtgttaggctgggtaagaggagatatcaccttatgtctctgtaataaattctagagaagctatgtatttttcacctctatcacatgcttgcaggtgacatgaaatccagttgcagaaattgtaaaatatcccattttacttgaagagaacttgaaaattacttattcatctcttagatcttaccttcatcctatatatatatatatatatatatatatatgtatgtatttatatatttaccttgactgatttagaaaatatcatgtttagattattctatctttattgataaaattaagttactgccggacg

SEQ ID NO: 4986 - DNA, 1029 bp, Homo sapiens
aaggaaaaggatattttggataaaccacagtcaatctgctgtcttcataccatgctgtccctcctgagcaagatgaaaggtaaacaaagtttgttgctctcgtcaacaaagtttcgtgtttgaaatgtcacaaaaagatgggagagtggataggatcccttaacaaaaggagtctgtagtgtacaaaacatttcaccgtagagattcttttatgtattaatagaatactcttaatgcatttgacttatgctttaatttatgaaattttatattttgtatcatcataaaaaaataacatgatttgaacaatacatcttaactcagtaaggcaaatggaatggtcttcggggaaggcaatgtttttcttgttattttttgtatgattatcagaatattaatctgttaaaatattcaacagttttcagtaatgatgaaatattccaaataaggatttatattgattcagaacaaagatgactaaaagatcataaataaatggaatataaatgttctgaataaaatagattgttagacttccacttcattgagaaatacaaaaacacatcagtaggtaacttagttttaacattatgtttaacataaatggttagtccaaaaaattgacagggtaagagtttatttttctgttttctcctatccctatagtggccatcgatgagacctgggattctcagtctgtgtccccatggtggcagcagatgcgcacagcctgtattcagtctgagaacaatggagccgctctgttgtctgcgcatgttgggcattctgttgctgcacagatatcaaacaacatgacagagaaaaaagtaagtgggtaaaggtatggctttgatctgtacacatccagtaggctaaggggatgctttccttttctggggtttttcggggggttttttggagcggggagagggatgagaggtgctccccttaatttctttattgagaatgatgccgtggatacttgaatttagcagttgtcacatggcagtgtcctactgtgtttttttc

SEQ ID NO: 4987 - DNA, 1032 bp, Homo sapiens
tgagtcctgggctgagagatatgggtgagtctgcctctgggtccttatgcaagcaactctgagctgggacctcagctaaggaaggtgagagcagcaccacaaggctactttccagcccactgctgagaccagtgctagcgggcagactagcctttctgccaaaacactagtgtgtacagttctttctggaccccatggcaaatggttttggtggcaggatcatgggcaaacagggaagtagccaagccccttgtggggactgggctgtttctgggcttcaatctggaagtcagttcagggggacagatcaaccaccttattgtgagagaatataagtaggttgccttctattccgccatcttggtgacctcaaggtttctgttactcaaaatctattatttagacatcatctggttatatgtcaatatataacatatttatatgtgagataacagttaatattttaatatgtgaattcataatataaatatattatgaataatgtaatgtggcattctttgttgtgactgttagaatatcttattttgtatttactagttatggaggtagttacctttatacactagactcttctcctgttatatgtgtccatatatgtgtttctatgtggtaacttaatttatctctgtattcacttctttatttttcttctttcatcttaatgtttcctgcaatttaaaatatctatattgcttataagtgattctacaattatatgattatgttctgatagtttctttggcatcctctattttatactgatctcctatatacaaacaaaagcttgactgtttggaagttttaatgtttatagaaaacaggaaaaacacactctaggttataaacagagactacctgtagggtgggaaatagaaggaggtaacctagggagaaataagaagcaaagttaagcagagcaggttttttgtttgtttcagaattttattacaagtgatggtgggtagaggagaggttggttggagagaaaagtggaattcatagtgtgaagag

SEQ ID NO: 4988 - DNA, 1035 bp, Homo sapiens
tggtgtcagcaggatgtcatatcttgcaaaaaagagaaagattaagaagaagaatttaaaatagacaaaagatgcctgtgtgggagcatattctaaaatttagttgatggtgaggacattgttttctgtgacatgccttttaatcaaatatagttatactttatattctctaaaggtatagggttgtgggtatctattgaaaacctacataggactgtggttttatttcttttatgtattttatattacaaatgtcagttgtgattaataaattaactattaatccaggtaaaattcatatttctttatataaaaacagattcagcctatttcatttatgcatttcgttattctgttatatgtttctgaactggaatgtgatttgagcattttattttcttttaaatatcagatttggacttccagattctagacgccatggtgaaagcatatgtctgtctccatgtaacacactggcagcagtaacagatgatttcggcagagttattttattggatgtagctagaggaattgcaatacgcatgtggaaaggtacttcttacaaaaatccagaaaaacaattaattcactttttaccccaatagttgagcaatgttatcatccttcagcttctggatgataactctgtttaattcttcatgtttacattttctttttttgacatgaactcagatcagcaaccacttggtccagtagtcagttgatacatcttttaggtttgatcacctcatagccatgtttaacctttgccttttgcactttctttcaattctcactgttattgtcaatttctgagttcagtttcttgcccctgctacatttattccccttcacaaagccattcttgagccaaatgttctccccaaatctataatgccaagtctttcagatttaagatagcaaaacccatcttcactgacttgacttttatatccatatgcttgggtcaatccacctggtgtgtcaataagtatgtcacttaggagtttccttcagctattattaacagacctg

SEQ ID NO: 4989 - DNA, 1236 bp, Homo sapiens
ttgaactcctgacctcacccgcctcagcctcccaaagtgctgagattacaggcgtgagccactgcacccggccaaaatttattcttatgtgaaaaaatgcattgcctttagtgagacatctggaagttagttcagattcagatcatcataggcatatatctttaaaactgggcatgatggctaacacctgtaatcccagcactttgggaggccgaggtgggtggatcacatgaggccagaagttcaagattagcccgacccacatagtgaaaccccgtctctactaaaaatacaaaaattagccaggtgtggtggtgcacacctgtattcccagctacttaggaggctgaggcaggagaattgcctgaacccgggaggtggaggttgcagtgagccaagatcacgccactgcactccagcctgggtgacagagcgagactctgtctcaagaaagcaaaacaaaaacaaaaagaaatggtagcagttttaataaagatttaattatgccctcagccacagtattgtacagttttaagtcactcactgtttgactaatttttctacagacaaatttggtctatataatgaccatataaatcagtcttaaaaatgtaaccttggtcaagtgtggtggcttgcacctgtaatctcagctactcagaaggctgaggtaggaggatctcttgagcccaagagttcaagaccaacctgggcaatatagcgagaccccatcgcttaaaaaaaaaagtaacctttaaactagtaaaatatagataaaagcagatttcttcttgcagccactataagagagcttactgtgttaggtactgagggtatagagatgtaaagacatgcttctctgttgtctgaaagtgtgagtctaggagcctggttagaagaaacacatgagaatggctacaatactacaacatagtaattgtaacagacaaggggaccagctgtagtgggagcagaggaggacacacttattgtttctccagcacaccatacacttttatccctagatctatgtgcatgtgggctagaatgcctcctctgtgtttgttcacttggtcaagttctactcattctatgcaaactggacactgggagagaaagagcaaggagaagaggaaggagagtgactctaaagaggctaaggatatctgacacacaggccatctttctatttactgcatagctcttacatggaatactctgtaataaaaacctatt

SEQ ID NO: 4990 - DNA, 1067 bp, Homo sapiens
caacaatgatagactggattaagaaaatatggcacatatacaccatggaatactatgcagccataaaaaatgatgagttcatgtcctttgtagggacatgaatgaaactggaaaccattctcagcaaactatcgcaaggacaaaaaaccaaacactgcatgttctcactcataggtgggaattgaacaatgagaacacatggacacaggaaggggaacatcacactccggggactgttgtggggtggggggaggggggagggatagcattaggagatatacctaatgctaaatgattaggttaatgggtgcagcgcaccaatatggcacatgtatacatatgtaacaatcctgcacattgtgcacatgtaccctaaaacttaaaatataataaaaaaaaatcagtgaaaatattagtagcactaacttccccttttcttttgggattgagtagaggagccttaatggccccaaaacaaagtttaactttggtgaaaaattaaatggctgataataccgaatataaaataattgtctatttctagtttattaaattaatggacttcttacctacggaaaattgccttttgatatatagattaatgatgagtattttaaatgttctcaagataatgaagcttatggttggctaaatttaaataatttaaaagattctgaaaataggtataaaaatttaaacaaattctgacctagtaaaaaagcatttactagaaaagaaccacatagccaagacatcagaatttttgccaatcataccaacctgctaaaaaagacagagaaaaatttttgattgcaatatgagatgctggatttagactaggtttagaaacaattttatgaagcagtaaacatatcctaattagcctatgttttcaggaagccgtctcaaccatttaggagttaaactttgttttggggccactaagtctcctctactcaatcccagaagaaaaggggaagtcagcgccactactcatattttcactgattataagacttttcttttccatattttaacaactgtaaaattgggatctgaaattattt

SEQ ID NO: 4991 - DNA, 1070 bp, Homo sapiens
taacaggcatacaaggttcctgctttcatggggcttacagtttggggatggtagagggaaaccaacagtaagcagctagagatatcaaggtgattccaatctctgataggtgctgttaaggaagtcatgttgataagatagtaatgtgccaagagaatatgtatgttgtttgagatggaggttcaggagcagcctctctgggtaactaacatttgaactgaaacctgaatgacaggaacaattaggcaggtgaagatctgagaggagaagatccaagcacatgcaaaggtctgagggtaatgatgacctctcatatttgccagatgttgcagccatggttaatgagttcaggttttattctaaatgcagaagagagtcattgaagagttttaatcaggagattggtttgatctgctatgtctcaccaagagcacactggctgtgtggagcatggattgtagagagcaagagtggaagcaggaggccaaactgaatgtccgtcaatatgaactggttaagtaaaatcgggtacatataatgaaagactgtgcagccacaacaaaaaatgatttgttcacttattgaaatggaaaaatatcattgacatactattgagtagtaaaaaacatgttaggatactatatgtgctatagccttatgcaaatgtgtatgaatatatttggggatgtgtattgagacgtgtctgggatttcaggtgagttttcttctgtttttacatactgtttgtatctgtgcaatgagtatatttactttttatgaaattgtaattctttatttactctcagcatctttgagataattattcaccatacacaaaaggttatatttgaaaagaattttaggtctttggcaaaaaggcactctcaaattaattttttatctatttttactgttcttctgcctgatattgctttgggtgttgggtggttatgttacattattcgtgaaattcagtataataaaaagtagataagcttatttatctattcaagaactttttttttttatttcttaaatagaatgaagagttgagtatcttatatccagct

SEQ ID NO: 4992 - DNA, 1136 bp, Homo sapiens
cgggcacggtggctgacacctgtaatcccagcactttgggagcccgaggtgggcggattgcctgagctcaggagtttgagaccagcctgggtaacacggtgaaaccctgtctctactaaaatacaaaaaattagccgggcatggcggcatgcgcctgtagtcccagcaacttggaaggctgaggcaggagaattgcttgaacccaggaggcggaggttgcagtgagctaagatcttgccactacactccagcctgggcgacagagcgagactccgtctcaaaaaaaaaaaaaattgttttgaagaagaaattaataggacctggttattgtgtagagatgtacaatttttttaaaatgagctaaagatgtctctaagatacttatcctgaggaatgccattgtcaaagttggaataggggactacattggcagtaaatgttattaaatgaggttttgcacatgttgagtttgaggcgatggtaggaaataaaatcaagttactgatatcatgtaatgatacaaaactgttgtataggcacagagactagattggacacgatggttgaagtcatagataatgaatgaattctttcaagtaaagagtgtaggaaaataaaactgcaggctgaagacttaagtcttagtaactaataatactcatcgtaaggagataggagaaattgaactattaaaggaaacaaggaacagctggaaatcaaagaagataatctgtgaactgaaaataactttccagagatgtttttcatttttctaaaaattgactggatgacgaagctttttaaaatacgttaaatttggtcatgtctgtaatactcttttttagaactggtggaaaaatataactaacatttaaatatttccttgctatttgctgtacaaagcaagaaaatcatctcaaaatttttatcaagaaggaagtctttgttgttactctgtatgctacgttaaacagctctggatctgacacgtcaatttatatatcaaaaatatcttctatttgcttctttttaatatactcccagatttgtcagagatcacagaagcacatttcctctaattcagctctaggagcaatgagtgtagtacgggtgacagcaggtcattcgtttcagga

SEQ ID NO: 4993 - DNA, 1240 bp, Homo sapiens
tagtaaacagctagtggttaataggtggtaaatgggtagtggttactggatcaggaatcacaggaaggttctgggtcaaggtcttcagttaaggtaggcagcatggaaaatttccattcaaaagagcctttgaaatgtgctccatctgttttacagaaactgttataacagtttagagaggcaattatgatttagcagattaacagggtgctggtcagatggaggccccagagaattgtttgtttacaggctgagaagtggaatatagcacgacctgattggagattcctagaacattaataatctgggatgatactggaaaatgttttgccttatttcattattttcagtagactctcatgccacctgccacacaggagacatgagcatcagactgaccagaggcggaagaagaacacttacaccataaggatatgccctaggttatcctctgaggctgggcaagggtctcctcattaggctgtttcttattaggactttggactttggattgttagaaacactcattttgctgaagatcttcctctctacattaatacaagcttagtctagcctagtgattctcaaccatgggtgatttttgcctcctcagtggatatttagcaatgatttggcatcatctagagacatttttggctttcacagcttgaggggggtgcatctagtgagtagaggccaataattctgctaagcatctttcaatgcacagaacaaaggattttctggccccagatgtcaatagcgctgatattgagagaccttggtttatttagcccatggctcttaatgtaaccctcccagtctgtcttttttgccttttccccattttgttctccaaaacttcttgaccttcagagcatttgatctataagatcattaatttaattttagtagagtttggtgaagtgatttgctgttgtgaaaagtgcagctaagtaattgccaggaaacaaaagttaatttaagttcttcttggatctttggccagagcaacaagttgtctaggcttggtctctgtggcattatttatgcctaaatgcttaagctccatgtagtcagctgcaccttttcctttctcttgtttataactgttaattttagttcaaatctgcgctccttaggcattcctgcagagtagcttctgttaagtgagttttggtttggtgattggggcctctggtcttctaccagggatctggctgggtggtgtggggaaagg

SEQ ID NO: 4994 - DNA, 1094 bp, Homo sapiens
tcataatgtgccacagacttgctttttggctcatctaaaatgtgccttcctaagggtgtgccgctttatggcattataacctaatgagtagaaaagaaggaaaatgtgctatgcaatggggtcagagaagcaagtaggcctgatataaggctttataaatttggaatttattctaaacatgatcagaaaccacattatctgatttctggtttttcaagctcaccttggctgctctgtggaatagatgcagttagttttccttgtatttttttcttaattagctatattattcttttattttcttcttaattagctgtatttctcatactcatgagggtcgtgtgcctctttattttgcagtatttcattttgatgtgccactattgcagctgattctgagtgacgtggacaatgatagcatagttagaatgcataagtgttaacacatttcctttatatctgacctgtaaagcatgtcttcttttttcagcaaggatatactaaatctagggataacctaaatcgagggatctccagggataaatgtaaggatcttttaaacaatgtagttaaaagctgaaagatgcttctactcattctaaaaacacataaaaatactgacatgtagaacatttcttcatttggataaaatcggaatatttacaaatggccctaatggatgagagtagcttggtgttctttgtcttgatagatttgctcatactgtgacttgacaaacacagcaagtgaaaattgttgatagacctcattcacaaccattttgggtgtaccaattatttctagctgttcttattatccatttttgaacccctgtaccttgtcatgggtcatgtgtacatggtgagggagaatgcatttgggtgacagtaaaggtaggcaggtacaatgaagttcagaggttatctagttgttcaagttatcctggttgttcaagagagcctctttgaatttggatcctttccttaaaagacatctttgctaaaggagactggtgggtgggaacaaaaacggcactatggtcagggtaaggactgtgacctctcccttgaacagcagcatcaaccagaactttc

SEQ ID NO: 4995 - DNA, 1068 bp, Homo sapiens
tatttggctttacttctgggttctttattctgttccagtggtctaagtgcctatttttacatcagtaccatgctgtttgggtaactatagccctgtagtataatttgaagtcctgtaatgcgatacctccagatgtgttctttttgcttagtcttgctttggctatgcgggctctttttttgttccatatgaattttaggattttttttctagttctgtgaaaaaatgatgatggtattttgatggaaattgcattgaatgtgtagattgctttgggcagtatgatcattttcacaatatcgattcttcccgtccatgagcatgggatgtgtttccatttgtttgtgtcatctgtgatttctttcagcagcgttttgtagttttccttgtagagatcttctgccttcttggttaagtatattcctaggtgttttatttttttgcggctgttgtaaaagtgattgagttgctgatttggttctcagcttggtcattgttggtgtatagtagtgctactgatttgtgtacattgatttggtaactgtagactttactgaattcacttatcagatccaggggccttttggatgcatctttaggattttttgtacgatcatatcatcagtgaacagcaacacttttacttcctcttttccaatttggatggcctttatttctttctcttgtctgattagtcttgtgaggacttccagtactatgttgaatagaagtggtaaaagttgccttgttctagttctcaggggaaatcctttcaacttttcccattcaatatgatgttggctgtgggtttgtcatatatggcttttattactttaaggtagtcccttctgtgcctgtgttttctgcttttgggatgttgtatcaaagtttgctttctgggtagtaacctaattaatatttgtaaatagactttgggcataagaaaaaactattttctgtaggggacaaaggtattttctgtatagctctatagctttgatctccatagcagcacctcgttgtattgctgtttaacgtgttatgctaatagagactgtgagtggactc

SEQ ID NO: 4996 - DNA, 1062 bp, Homo sapiens
ggcactatattcatttgggctgctttaaccaaatgccgtagactggatagcttaaacaacagaaagttattttcttatagttctggaggctgtaagttcaagattggggtgccagcatggttgggttctggtgaagcctttcttcttggcttgcagacagctgtcttcttgctgtgccctcacaaggcagagaaaaagagacagcaagctctgtgttgtctcttcttataaaggtactactcccatcacaggagccctaccctcatgacctcacgctggggattagggcttcagcatacgaatttgtgtgtgtgtttgaatatggggaggagagatacaatcagtccacagcagccacaaaaaatgcattcagaaaaggaaagggtatgaattttgcccaggatttggagtgtatgtaaattacaccatttggtaaatcagtgcgttctctctctctctctctctctgtttcttttcccctcccccctcttttcttttcaaacacatattgatcacctgttgtggactttggaacactcaggagcttcccactgaactcagaataaaacctgcctaagaggccctgtgaggagggtccctgcctcccttccttcccctctagcccttctcctcacccgcctcttgcccagtcattgtgcctccccacatttggctcccttgagtcactcagaggttccctgagttccctgcctttcccagtgtggtgttccctccctatgttctcctggattccgtcccctctcatacctcagagaggctgtccatgaaccccaatctaattagtcccctctcatagcacccaggaactggacagcgtcttccgttatgacttatcttaatttgtgactgccttctggaatctgtgtttatggttgtcatatgtttcctcctgatggagtggggaggggcagggaaggggcctctgcagcgtgtcactcacctcctcaactcccagaatgtttggggagggtttgatcttaaatacaagagattataacagtgaaaaatgtgttaatgtaactggcatgtctgttaacaaat

SEQ ID NO: 4997 - DNA, 1045 bp, Homo sapiens
cccccttatgactaaagtaataaatatcaatcatagaacttttataaaatacaactatgcaaaaaaaaatatattatctcttactccactgcctgaaggtaagtgttctaaacatgttgatctttctttgcctggacttctgtgtacaaatgtgtgtgtgaattatcattttttaaaaatttacatgatcaatatgtgtgctcctgcatttcacttctgagaaggtaagaacagaaaacacaaacacgtgtaactcatttctttttaatatctgcaggtaacattcataacaactttgaatctttccctataccagagagagtggcccacttggcagggaggccctcgcatttgtgatggacggatgctggcagatgtctagtgagtttagcacttagctctagcttctgttcaactccacagtgcccaggagataagacaaaattggtagaatgtaaaatccttgacagcctctgggttttaggacttagcatgtctttatcatcaagtctgtttacaaagaaaagtcttctgaaggttttccccatggaatagagttatttcaaaacggcatgtggtgaaaagttacatgagcttccagcagccttgtccgctcctgacaggttacagggagaaattgttcttggcagcccaggttagccccttgaagtaagcctgttaggtccctggctctgtcgcagtgttagctgtgtctgccactgatggcagagacagcaggagcgagacactgaagcagagtgcaagtccttggatgatgagagcggcaaggctcagcacccgcctttcctcggacgtgaaggggtctgtgtccttcccttaacatggagccaaatgtctagtgttggcctgaaggagctcaaactagtgcaataaaggggtatagagtctccaactgtgaacctgaaaatctagacaggtcttagttaatttagcaagtttattttgccaaagttaaggacatacacgcctgtgacacagcctcaggaggttctgatgacatgtgcccaaggtggtcggggcacag

SEQ ID NO: 4998 - DNA, 1025 bp, Homo sapiens
agcactcttagtaggaagtaagaggtgcaccccctgggctggatagtgggtggatcaagagccttttctcaggtccatctgctgggtgttgaagaagggattttctcccctcagttcacgttcctcttgctgctaatacagagcagttggttgacaattaaaacggatcgaggctgggtggggtggctcacacctgtaatcccagcactttgggaggctgaggcaggaggatcacttgaggtcaggagtgtgaaatcagcctgggcaacataaggagaccttggttttactaaaaaaaaaaaaagaaaagaaaaaaaattagccatgtgtggtggtgcacagctgtagtcctagctacttgggaggctgaggtgggagggtcacttgagcctgggagatagaggcgtcagtgagccatgattgtaccactgcactccagcctgggcaaccaagtgataccgtttccaaaaaaacaaaataaaataaactggattgagatagaagctgctgccttccaatggcattttagccaataatcagcctgaagagtttttgtataatagagataataatatcatatagggtgattgcacaaagtaaaggacataacatatgtgaggtgtttagaatgggacctccgtaagtgctgctggtttttattgtctttacttagagtgatggcttctttgatgtgtcaattcggctaggctacagttctcatttattcaatcaaacagtaatctaggtcttactctgaaggtattttgcagatgtaactagtgctcttaaccaggtgattttaagtaggggagattactcaggataacctgggtgggcctgactgaattgcgtggaaggtcttaaaaacagggctgagtcttccccaagtaaaagaaggaattctgcttatggaggacaactttggcctgtgcacatgaccttgacctgagatcttccttcctgactacctgccctgggaatatcagacttgcttagccggcctccacaactatgtaagcaatttc

SEQ ID NO: 4999 - DNA, 1104 bp, Homo sapiens
cagtcctttgtgtgttgtaagacttatgaacagcaggtggaacttctaatgagcatgaggcacctctgtgagagctacatggtctccaccttgctgctctctacatggctagaatgaatagataatgtttgaccgtttctaacctatgatttgtttattctaatccttcacatcctaagattttctacagagaactttcttactgttatgaacgtaactttggctgatttacaagctaacattgagaaggaagctatacgaatgtgcttttggagaaggctcatttaatatgtgactgtatataatatgcctgtcaccatcactagggtgtaggaggaagagtagaaaacaagctaaagtctatgctttaattatggtggattagaaacatctttatatataggaagaaatatgtttcgttgggcacagctgagaatatacttatgccatattggtaatacaaataaattttgtatataggaacaaatgtatttcattgggcacagctgagaatatgcttaggacatattgataatacaaataaatctattttcataatcattagtgtgctaaacttaaagcagaatttttaaaatgtagaaatatacttgaaaaatgtgatgagtattaaaactttttattttgcttaactttttaggttgtagatatttccggtatattttaaagcaagatcaccaaatcttagggaagaaaattaagcggatgaagagatctgtgaaaaaatacagtattgtaaatccaagactctgatactgaattttagttatttcacagttgtagctacacagtaagtagcttggtagatagttattgaatgtatttatgtagtgtattaagaagcttatattactacaaaaaacttatttttatatatttttatatttttgtattatttatagctagagaaacaatattactgcctttgctctttgtaactatgtctgttttcttttttgtaatgttaaatgttacatttgttaaggaataattcttcaaatgacaaactaattacagaatatagctctacagcagttattgtttgcaaatactttgcctcttgctattgtgtaataaactgtaact

SEQ ID NO: 5000 - DNA, 1035 bp, Homo sapiens
ggatatggagatggaagagaacaaaaaaggatttgctttcctgctgttgccaatcatgtgttatgccttggccatattgagaatttagcttggaagcatcttccttgtcatctttctgtagactctagttaagtctaaattctgataatatagatttgtttccatcattgaccctctcttttgacatttttcttttccagaaaccaccttgcgtgggttcaagaagagtggaactccaggaaaaactggtggccaggctttcatttcagctacttttgggcaaaaagtgattggaaggaagatacagctttggcctgtgagaaagcttttgtggctggtttactgttaggaaaaggtacagtttttattttcgttttatctagacacagctttggctgattttgaaattatgaagtatggccttcatttagagcttacctaacatggtacctaaaaatattaggtgcttaagacataactgctcaatggaagagtgaatcctgagttgggactatgtgcttagattagaagcagtgatttcatattgattgtgaacggttttcatctcctgacttgagtgttgttagggggccattaagatacatgatacagagttttcacaataattgaccatttggccttgttttatagaaagtttactgagattttcaagtgtcaaaatattctttattgacctcactgttctttaatagcttcatattatactaatatttacttacctgtttctgtaagcgtgaaacatttcctccacttaagagaaagaatacctcctactagcatatgaaaaaaattctcttcaaagaaaagggatattgattttttcttcaaagaaaagaaatattttgggtggtaaaattcttacctgctttctgccactgaaattattaaaaggtggccagtaccgaaatgaaactaccacagagtatgtccagaaatgaagaaaataaatcttacagtgaccactagtaagcagtccattgctagggagcttaaggtgtcctgaagagattctcc

SEQ ID NO: 5001 - DNA, 1027 bp, Homo sapiens
ccatcctcactggtctccttgttcttacttgaatgggccaggcatattcctgactgattgcctttgccttaaccagttcttggaaagctctttcttcagctatcactgcagctaccctccttcaaggccccttttcattgaggcctactttgactatttaaaattgcaattgccttactccaactgcaacctgcactttctgaatggcactcctgatctccttgtcctgctgcattcttttcctctaacagttgacaatttaattatatttcttggttattgtttgtctctctacatagaatgtaaatttcacagggcagggttaaaacagtgcctggcatatactgctaaatttcttcagtaaaagacagtttacccacaaataacttgacatgagtgtctcataggttttactaacacagtcaccattgcatcaattagttatcttctagagcaaaaaaaataaaaaagagaagctgaaaaaaaagtttaaccattcattgaaaatttaatttatggacttaagttacatactcctgtaaaacattgaacatgttacagcctcttgttgtccagattttgttttgtaaaatgaaggaattggatcagtggtttttgagcacttctttggctctctttggatcacctagggctttcattcaaagtataaattcctttactccacccctgtctattgagtcagagtatcttttatttgtatttttttattttttgagatggagtctcactcactttgtcacccaggctggagtgcagtggcacgatcttggctcgctgcaagctccgcctcccgccacgacgcctggctaattttttgtatttttagtagagacggggtttcaccgtgttagccaggatggtctcactctcctgacctcgtgatccacccgcctcggcctcccaaaatcctgggattacaggtgtgagccaccgcgcctggcccagaatacctatttttaactggtgtcccatgtaattactgtgtacactggtggtgagaatagct

SEQ ID NO: 5002 - DNA, 1051 bp, Homo sapiens
tggacaatccagcactctctaaggatggctccagcccctcgaggggagtcagcaccctctgaatagcattttcaggcctctcccaggaagctggggcttggagtgggagtgtccccccaggagagtggcagaggcaggatgattcagggtcagcccaaaccttacagatattccccgaggtggccaacgcaaccatgagcaagagccgaggccttagccaacaagacaatggagggcagctcatatgaagggcaaagcaaaggccaaagtgagagaagtaagcgctgtgacatggagaccagctcaggataggatagatggctcaggaaccaggctgttaaggagagaatactcagcatttctgagaacacggcagttcgaggacccgtgctggtctgggcccgctcccccagcccctgatgggggcctgtgtgctctgcaaagagctgtgccctgtgatggggggtctgtgacctgggagggaatacactcaatctcacatgggttgtggaagcctgtgctccccccacagccagggaagatcatgagctgctttgtgagtgtgagacattacagatacaacagccaattgactcaaacaaaactattgcaggaaagaaaaggctttctgaattatggagtgctgtgggctgagttgtggacccccaaaatttatatgttgaagtcctacccctagtgcctcagaatgttcctttatttggagatagggtctgatagagtttagttatttgtccccccaaatctcatgttgaaatgtagtccccagtgtggaaggtggggcctggtgggaggtgagtggctcgtggaggaggatttctcatgattggttcagccccatcctcatggtgcagtcctcatgacggtgagtgagttctcgtgagatcgggtgggttgaaagtgtgtggcccctccttctccttctcttgcacctgctttggccatgagatctgcctgctccacttgccttccgccctgagtaaaagctccctgaggcctccccagaagctgagtagatgccatagccatgctt

SEQ ID NO: 5003 - DNA, 1042 bp, Homo sapiens
atggaaaaaaatgtaccctgctaacagtaatgaaaagaaaggaagagtaacaactgtgtatttattccagacagaacagactttatagcaaggaaagttatcaatgataaagaagagcattacatagaaacaaaggggtcaattccccaagaatacctaacagtccttaatgtgtatgcatttaacagaacatcaaactacatgaggcaaaacctgatagaactgcagggagaaatagataaatccactattatagatagagattaacacacctttattggaaatggacatatccagcaggcagaaaatcagtgaggacataactgatttcaacaccatcaatcatcaaacaataattgacatacatagactacttcatttaacaacagcagaaaacacattcttctaagtccatatggaacactcaccaaaatagtccactccacattctgagcataaaacacaccttaacaaatttaaaagaatggaaataatacagtgtctgcttgtagatcacagtataattaaacagaaatcaacaccagaaagataataggaaaatctcaaaatgcagacaatgtacttctaaataacatgagtcaaagaagaaatctctggaaaaattttaaaaatatttttaactaaatgaaatgaaaacacaacttgtcaacatttgtggggtgcagtgaaagcagtgcctagatgaaaatttctagcattgagtgcatctgttagaaaagaagaaagatctaaaatcaataatctaacttttcaccttaggaaactagtaaaagaagagcaaattagatacaaagtaagcagaagaaaagaaataagaattagagcaggaatcaatgaagttgaaaataggaactcaatagagacaatcaacaaagtcaaaagctgattatttgaaaagattaataaaatcaataaacctctaaccaggctaactaagcaaaaagagaaagaacataaattgctaatatcagaaatgaaagagtggacatcactacagatcccatggacattaggaggataa

SEQ ID NO: 5004 - DNA, 1073 bp, Homo sapiens
caaaaatttcacaagacttattttaatgacaatgtagcttgaaagcgatgaagaatgtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggcccttggggggctcacctgaaggctcgaaggcactgcacacttgtatattgtcagtgaagaactgttagttggttgtcagtgaacaataactttattatatgagtttttgtagcatcttaagaattatacatatgtttgaaatattgaaactaagctacggtaccagtaattagatgtagaatcttgtttgtaggctgaattttaatctgtatttattgtcttttgtatctcagaaattagaaacttgctacagacttacccgtaatatttgtcaagatcatagctgactttaaaaacagttgtaataaactttttgatgctagctgtttactggtttttgtttttgatgtcataaatagaccttgtttaatagtcacaagccgttgggatatcatacccagctgaaaaagaacaaactgcttaacataagtatatgtatcgtaataagagttttttaccagctaagtgattcaatgtaagtggtttttaaaataaaatactgtagagatcatggtgatagaagcctactttacattttacctagagcctctaatagactgttttagtgtcctcattgatttatggggtgaaaacttatataggcaaaatctccacatcattttattaatatgttaataggtttgtgaattgtttccaaacccatttgcttagtggaactactttagtagaagatacaaatg

SEQ ID NO: 5005 - DNA, 1042 bp, Homo sapiens
ttgagattttagtatatacatcttacctatttattaaatttatccctaagtatttcatatttttgatactataaatggtatttaaatttaaaaattttaaatttctaattgtttctaatatattgaaatgcacttgacttttgcatattgatttttttttttttaatcctgcagtcttgctatgtaacctatttatctggtagcttttttgtagattccatagcattttcttcatagatgattatattgtctgtgaaggcagttgaacttcttttttaccaatctggatgctgtttatttctctttcttgttttattgcattggctagaacctctaggacaatgttgaatagatgttgtgagagtggatgtccttgctttgtttctgatgactcaatgtgtcttgaattttttagtgctaaagtatttttaaatgatattccaatgactaaattctaggtttgctgccagtgcctcaataccatgtttaatatgatcaaacacttctgttgtaatataaattacagaacaaggtaattctgaattgttccatttatgtccctgactgttgaaactatttaattttaaacttgcaacttaaaataaaagattattgtatattagtgtgttttacattacatcttaaaaagtcaatgtggtgagtattaatataagaattaatggtctgcttgatattatgaaagaaaaatcgctaaataattttgtcatagttggttcatatgaagcttttacatagacctttgagggcggaatctctgtggtagttttatagtaagctgggattgtgtttatttgtgtttttacttgtaggttaatagtcctaggatggatctgactcttgctgaacttcaggaaatggcatctcgccagcagcaacagattgaagcccagcaacaattgctggcaactaaggtagtatcgtcctttttttttggagatgaatgctcactctgtcgcctaggctggagtgcagtggcacgatcttggctcactgcaacctccgcctcctgagttcaagtgat

SEQ ID NO: 5006 - DNA, 1896 bp, Homo sapiens
ataagtatttggcaaacaacatgaataaaactggcaaaaacagatttaatttgaactgatgtgactgtattctagggtcaccaagggttctagagctactgccccatggtaggggctgggctccaggtctccctcaacccccagtccacacctcacctttggccgggtgacagccagactgttctgttgtacgtttgcacttccaactgagattttgtttggagaaaggaatttaaggtgaataccacattaggcagacagtaccagtaaccatgtgtttctctcttaatttttagatgtttcttaccgtgtatctcagtaacaatgagcagcacttcacagaagttccagttactccagaaacaatatgcagagacgtggtggatctgtgcaaagaacccggcgagagtgattgccatttggctgaagtgtggtgtggctctggtgagagacgctgacagcctcgtgctttagttcttctgtcttctattaatgttggtttgtagacgtggcactgtgtgaatgctcatgtttctccggggagaaactggagaatagcacgtccggcagaaatagtgttcctgatccagctttggtatgatacatgaagtctttttcggttttctttttctccaataaaatggagacaccacaatataaaatacaaaaggtcatctgggctgttgtggtccagtggatggtgctcaacagtgtctttgtatgtgtaagctttacttaattagaaatttgaggcatcctaactggtttgccttctctcaatttctgtaggtttttagaggaagctactcagtgtcgaggaactgtagtggcagacagcagtggtgaactcgtgggcattattgtaagccttgaaatcaatccttctgtatggttctttggagctctaaaatgggatagcctggtttctttttggctccataggaggtggtagatgtgggagtaatttttcatcatttctgccttgttcctacacaggctggatgaactcctgctggtttcctttttcacctctggggatgccagatatccccagagcaagtcacacactgtgttaattgagttcatgccattcatgatagctaacttcagctgagcccccacttcttttcaggcaagtccttttattcatctttggttaacttttctacagttggatgttctagaaggtcttctgcagtctccgaattactttcttttctgtttacataggaaccagattagaacaatcacatgaagaagcccaagggatcttttgaaaatgaaaattagataatttcactttcctgcttaaaactagcgacttctcctccacttagaataaaatccaaacttttaatattaggttgtgaagttctgtagattctttgtctttgctcttatctggtaccattttcttctctgcttcttcctgcagcttttaaaatatttctcgaatatgctaagctcattcccaccttagagtcattggtgatagccattcccactgtttgtattgctctgtctccagatactgtcattgctggttccttctggattgcagctaaaatgttaatctccttctggagaggcttttcctgagcaccctgccaaaagtagccatgaagttagttctcagttacatcatcctgatgtaatcctctgcagaaggcccgtcactctttgtgtgtgtttattagtttattgctccttttatcctgatagccccaaacatatgcactagaatgtaaactatttaagggtagagaccttgtttatcttgttcactgctgtatccccagctcaaggggagtgccttgtacctagtagatgctgtagaaatatttgcagaatgaggaaatgaacttctagctgctcctggtaacctccttgcattta

SEQ ID NO: 5007 - DNA, 1051 bp, Homo sapiens
gaagcgtgaaccctgttgtgaactgtgcacttgagggacctaggttgtaccctccttatgagaatctgatgcctgatgatctgaggtggaacagtttcttcctgaaaccacctcccctgaccctgtctgtggaaaaattatcttccacgaaaccagtgcctgagcctaaaaggttggggaccactgctttaaaaggaggccactgcagttagttgctacattctttaatctcttttaagcgtggaacatttcttcaggtttgacttttgacacttgtgaaggtttcaggccagttactttgtaaaattccttgagtgtggatgtgtctgatgttttccttgtgattagactcaagttatgcatctttggcagattacaaagtgacactgtgcgcttgtcatgtggcatgcgatttcagtttgtcctgttactcatgatgttcactgtgatcacttgaggtagttcttccaggtttctcacactacaaagttactctttactctttttttttcactttgtaatgtatgtgtattttatgggaagttactttgaaactctataaagtccattcctcatcaaagtcaagtattactatttttaatatattatccattattatcattatgatattcaaactgtcccagatttgactctcctttggcctctatatgtttgatgagtccctaggcaatactttgtgaagggcttgatttttgttgtgttcaactcataatttacagtgttgctcacaatatatccggaagttatatatagatgggtcgggttacctacttttctttcttcttaaatttttacttcacctcattctacaaaaatttttaggctacttttaagaatgtggaccagtcacagtggcacatgcctgtaatcctagcatgtttgggaggcctaagtgggaggatcacttgagttcaggagttcgagagcagcctgggcaacatagtgagaccccccacatctctacaaaaagaaaaaaaaatgttacaaggccaggcgtggtggcttatgcctgtaatcccagcactaggcc

SEQ ID NO: 5008 - DNA, 1045 bp, Homo sapiens
cttgaacctagaaggcagaggttgcagtgagccgagattgtgccactacactccagcttgggcaacagagtgagaccctatctcaaaaaaaaaaaaatgttcatcacccttaaaaaatctcatgcctgttagcattcagttttccttttctcatctccagccttaggcaaccactaatctactttccttttttttttttttttttttttttaatgtagagacagggtctcatgttaaccaggttggtctcgcactcctggcctgcagcatgccccctgccttggcctctcaaagtactgaggttttaggcatgtgtcgctactggccatcatctactttctgtctatataaatttgtctattctggatattttatgtaaatagcattatacaatatgagggctcttaaatctggcttctttagcataatgttttcaagatttattcatattatagaatgtatcaatactccattcctttttattatgaaataatatcccgttgtatggatataccacattttgtgtattcaccagttggacatctgggctgtttctgttttttggctattatgaataatgctgctatgaacattcatgtatgcatttttgtatggacatatgttttaatttctcctgggtctatacctaggagtggaattgctggatcatatggtaactccctgtttaacattttgagaaactgctaaactcttttccaaagtggctgcatcatttttatattcccactagtaattttgacattaaaatatatgacagttctgatttattcacattcttactaatacctgttattgtctttttttattatagttattctagtggatgtgaggtggtatttcattctgatttgatttgcatttccctgataactgatagtgttgagcatcttttattgtgcttgttggtcatttgtatgtcttctttggagatatgtctggtcatttttcaattaggttatttgccttgtcattgagtagtaagagttctttgttctagatacaaatctaaaatcagatatgtgat

SEQ ID NO: 5009 - DNA, 1028 bp, Homo sapiens
ttgttatctcctttgcatggggaaatgtattatttttatgtggaagaaaatgggtatttttcctttgtattgagagctgatggaaccagatttatgtctttttagacaggggcaagtgtccgagtggtgaatcagctacttacagagatggatggtctggaagcacgccagcaggtttttattatggcagccactaacaggccaggtaagaaataaaaatattgtaacacagatgaatctaaaaacttacagcatttccgtagaagagattcagataattaaaaataaaagtaaaaactagtagcatttataaacaatataattcacatgcatcctaggaaaggaagattaaatttgggcaatccatttttggttctgtgaaaggaaacttcatagttgaaataaaggcttagaaagcttttgcataagctatagtaaaaagtatagtattactgcttggatcccatgagattgcttttctgtgtcggtgcttagaaagctctttttggctgagaacagttgcagcatacacttttttttttttttttttttgagacagaatctcgctctgtcacccaggctggcatgcagtggcatgaccttggctcactgcaacctctgcctcctgagttcaagtgattctcctgcctcagcctcctgagtagctgggattacaggtgctgccaccatgcccggctattttttgtatttttagtagagatggggtttcgccatgttggccaggctggtcttgaactcctgacctcaggtgatctgcccacctcggcctcccaaagtgctaggattacagacgtgagccactgcacccgaccagcatacacttttgaccacaaaagtattttcagaatttgtgttttgtggtttctctctagcttataggaaacaaaaacgagactcttcactctagtagaagttaaagatagatttttaggattttatgctggagccatgcccctatatctgccctgaataattactgaaaattgttttcaaggttaagcattctt

SEQ ID NO: 5010 - DNA, 1072 bp, Homo sapiens
gcataggtgatatgaaatagttggcactgtaggccgggggcagtggctcatgcctgtaatcccagtattttgggaggctgagtcaggtggatatttgagttcaggagttcgagaccagcctggccaacatggtgaaaccccatctctactaaaaatacaaaaattagccaggtggtagtggtggtatgcctgcaatcctagctactcaggaggctgaggcaggagaatcacttgagcctgggggcgtggaggttgcagtgagccgagatggctccactgcactcctgtctggttgacagagagaccctgtcttaaaacaaaaataataataataattggcactgtaaagatgtttttggattccatcttatttggcagtttcattaagaaaaaaactgctctttcttaatcatctggtttgacattttacaagaaaaatttcttatgcctaagctaaaagtgaaataatccttacatgtagcttttcatattacttagtcctaatgttatagttgcttgtgaattgctatatttcttgacttatcttaatgttttatattttgatttagatttcaacatagagtaagccattatgaaacctgttaagtgcctagttggctcactttgcctcctctgatgctgtatgacaaaatagttattcctttatttagtaagacgacttgtgtaaaaataacaataaaacagtaatttgacttgtgtgtatgtaaaatactgttgaattaatgaaaattactgctggatattttatatgcacgaggcttacaagattagttctaaagtgcaattgaattttggtgattttttttgagctagagaagaacttacgtttcacttaagtcttcattttataaataaggaaatttatagtaggcttaaatagtagctaattttattaagttgaactatatgcagttggctattacaggtcaaaaatggttaaatatcagcaattgtatatggttcattctgatactttctggactttgacacataaaactagtttatgtcacataaaactgtttagtatcatttgacccaaaccacaaagttg

SEQ ID NO: 5011 - DNA, 1032 bp, Homo sapiens
taagggcctctgacagaaccctgaaagattcgaacaattaagggataaagaagcaagatctggtaaaggagaccgaaagtgcttggtcataagatggagaacaccccggaccttctaagcctgaaaaccaagggaagatgagtttttcaaccttgtcagtgtgactaaacagtataaaagatagtgagagtgggacttgggatttggtaattagaaggtcattggtggctttagggaaaatatgtttaataatgatgtttgcaaaagccagaataaaatggttgaaaatttgatggccaataaagattttgagataataaatgtaggatctttacttgaaatgttgcatatgtttcaaataaaggataagatgggcttttcatttatttacttatttttaatcactgttgccttgttaagattaagtaggttttaatatgtcctcgttgaaactttaggtttacctttccctaaattaaatttccttttacctagctaccttggtttaccatttccaaagtcactttgccaacggtattgattgttctcttctattcctatctgaaactttatgtctcccagccccctgatatgccttcttttacaatagtactgaatattttgcttcagcattgcaagtatagtttttgctgaattcgattttccaggaaagtctactatatttgtacactgtttattatatttgcacactgtgtgctatatttgtacactgtgcaggatgttatgacagaaaaatctgaataggactcctgctttccaaggactttgtaatataatatagtgagggtagaagagctcaaatgttacaataatgataaaatctgaatatctgaataggacccctgctttccaagggctttgtaatataatatagtgaaggtagaagagctcaaatattataataatacaaagtactttaagagcaaagaaatactttgggtttggtttcggtcaaatgatagtaaaacagttttatgtgtcataaaactagttttatgtgtcataaaacta

SEQ ID NO: 5012 - DNA, 1118 bp, Homo sapiens
tgaggccaggcatttaagacagaccagcataccaagaccctgtctctaccaaaaaaatttttaatgtaatttttttcaagtatgaggtttatgagataattggaaatgttagtgcttactgaatattttatattaaggaaatactaatttttaagtgtgatatgacattttaaaatcatattttagagatactgaaatatttataaataaaataggacatctaggattttcttcaataaaacaaggaaagtggccaggagtatagatgaagcaagactggtcattaatcgagttgataataattgaaggtcagtgatgggtacatttgaagtttataactgttatatctctttagttataagtttggaactctccttataaactctccatggtataaagcaaaacaaacaaaaaacccctttaaatagtgtgtattattttgcaacttggtttggttgagttttttggtttttgttttgttttgttttttgagagagagacagggtctctggaagtagaggttttgctgtattgtccaggctggtctcaaactcctggcctcaggtgatcctcctatctcagcctcccaaaatgctaggattacatgcgtgagtgactacacctattcttggttgttatttttgttcaatatttatttataatacttatctctgttgatgtatttttagtttattaactttttgtgtggcatttcattgaatgaatgtaaccatactttaaaaatcagttttttttctgatgaatttttaggttgaatattatatatgtatatctttgcatatatttgtgagatttttttccccttagggtatatacccagaaggagaattgctgaatcttagagtatgtgcactttcaaaaatattaggtattggctgggcacagtggctcacacctataatcccagcactttgagaggtcaaggcaggaggattgcttgaggccagtttgagaccagcatgggcaacatagtgagaccctgtctctacaaaaaaaccccataaaattagccagatgcacacctgtagtcccatctccttgggaggctgaggtgggaggatcacgtgagcctgagaggtcgaggctgcagtgagcta

SEQ ID NO: 5013 - DNA, 1027 bp, Homo sapiens
aggccatgatttcaagaccagcttgggcaacatggtaaaaccctgtctctactaaagtaaattacaaaaattagccagatgtagtggtgcatgcctgtaatcccagctactcgggaggctgaggcacaagaatcacttgacccaaagaggcagaggctgcagtaagccaagatcacaccactgcatgccagcttaggcaacagagtaagactctgtctcaaaaaaaaaaactagttttttttatttaagtatgtttattggctatatttctttgtgaattgtctattcatatcctttcctatttttctaatggcatacatgtgattttctttcttatttatatcacttcatatattaagatttgttatttataaatgttgattagtttatcttgactgtaaccatgtttgacaccttgagcttttttggtttgatttttatgtgggcaaatttctgtctttttgtgcttttttccccattggaattatgcttattagaactgtcttccctatgtgtaaagtatgttatccatcatttttagtgtctgtataatattacatccataactaacccttatcaacttttaaaaatattttgaattgtaagaaattgaaataataacatttttaataagtacaacagcaaccaaattatagctcctcagtaaatatcaaatatccatagtgctgtgtgtaaaacttacttttatttatactactaattttccttgcttaatgctttcagtactcttaaaaggcattgctttcagagagctgggtatggaggtagaagagaacaacacagtcattgatctacaattttttcacaatagttttggaaaaatatagccagaaagaaggttctgcatgctggtgtgtgaattctccaggtcaatgcacttccctttcatgtgtgtcctatagtgtttattatttaattagttacatctgcctttgagtagtcctgttcacagcagagaggaggtagcttggataacttgaaaagcatatatagtactaaaacatca

SEQ ID NO: 5014 - DNA, 1025 bp, Homo sapiens
cgtatcttcaggcctcacagtcatgttgaaaataagcctgagaagctgggcgcagtggctcatgcctgtaatcccagcactttgggaggctgaggcaggtggatcacctgaggtcaggagttcaagaccagcctggccaacatggtgaaaccccgactctactaaaaatacaaaaattagccagacgtggtggcatgtgcctgtagtcccagctactcacgaggctaaggtgggaggattgcttgaacccaggaggcagaagttgcagtgagccaagatagcaccactgcactctagctgggtgacagagggagactcaaaaaaaaaaaaaaaccataaaatatgtatctggaaataatttgaacctgcagtataaaatggacatgtaatggatcgccgtttgtatcattatttccaggcaccagtacgcaacccagaccagttcaaagctcttggattggtgactccagctggggtcctccttgctggtcctcctggctgtgggaagactctgctggcgaaggtatcatataagttcaattgcatgtaatttatttcttagtatcagataggataatatgaacttaactttaaatattacagtgaggtaagtcttatgcataatttttatcagaagtttattttagcaaaactgacaactttcttcattaaagtttcctacttttttaaattacaaaggcacatgattgaaaaatgtttatatcaaccataatcctatcaattttaacatgcaattattatattttctgtgtattacattttagctttttagtgagtattattccatagttttagtttttacttgacttagtttcctgctttggtattgttattatttataacttaagtattttcctctatatttcttgtaattattttctaaaattgttttttcataatagaaaataaaaataagcaaaaaggaaaagcattgtgtgtaattctctcactgccacctactactattatttcatttcattgtcaatccttcagatatttttcta

SEQ ID NO: 5015 - DNA, 1073 bp, Homo sapiens
tctgttttattggcatttaatctatagaatacttatcatttatacccacgatgtttatcatttcaaaaatatgagttgttttatgtttagtttattttaataaattcattttacaataatgattatgaaattctggaatggggttggcagactgtggcctacccacccaccacgtgtttttgtaaattaaagttatattggaacacagccatgttcatttgtatacatgttgtctgtttctgctttcgttcttcatggcagaattcacacaggagtctgcagcagagaccgtggcccacaaagcctacggtgtttacagtctaaacctttacagaaaaaggttgtcaacccctatttcagcattggcatttaattatatctcctggttaacttttggttaggtagattacagtggtctgttgacacaactatatccatgtcggtagctgcaaacagctctggaggacagtcatgtgaataataggggacagttatcagtccaagatcggtattaaattttttagttttatgagtcatgaaaattcaatatatatatcatttcatatagcattttatagcttgcacagatggcttctgtatgttatataatttgatccctgtaaccttatataaatgtcattttccccattttataatcaaaggcactaagcttaagtggttgtgatttcctcaagcccatacagcctctactttatagagcaggggcttcaatccagatcttttgttctcagataatttgtttttttcttagacatttgaaactgcaattaattctgtaaaaaataacaaactcattccttttataatattgcatataaattaatattttataaattgaattaattggttacctgttttttagacttatcctttcatcttctccacaaagcaagaaatctgccttttaagtttaagatttgatagtaataggaaaattgccttccctctacttagttgataaaccatcaaggaaccatattaatgaattatactacctccagcataagtgttttaatttcatcaggattcaactgtttcttgaatatttataa

SEQ ID NO: 5016 - DNA, 1050 bp, Homo sapiens
acaagactgaaactctgtctcaaaacaaaaacaaaaacaaactctaactgaaagaatctggaaaagaagcggcattcaaatgttaagatttcttttttctttttttttttttccccatatgggatgcttcacaaatttccatgtcatccttgcacaggggccatgctaatctttgtatcattccaattttagtatatgtgctgccaaggccagcaccaaatgttaagatttaaactgagctttaagggaatgaggagaaggactttcacaatagacagcatctttgagcaaagagattgggaatagttaacagaggtgaaagtgctagggcaggaatgaattttctttacaatgcccctctttaaaaagtaaaacaattattggcatagaattttaagcatggcatatttaaatttattttctttccaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaaggtaaggtgtgagtcttgttggtggcagtggtcatgtttgcagtgagagaagcatcattctgtcccaagctattttgcttgagggaccttctatgtgcagaaatgtttaccaggaaatatttctatatttaatggacctttgtttacttaaagactattcattataattatgagttactactgaatcattaatcttttcatctcctcatttttgtttaccagctaaagccagggggttagaattccagatctccaacgtgaagtttgaagatgtgggaggcaatgatatgacattaaaagttagtgcaaattctgaattttacctcaaatggatatattactaatcagttatgaggaaaaagcctacctctttgtttctaatatgatctgggtgtagaaaaggaaactgggaaggttgagaagggcaaacctgacctgtaccctttagggcattgcaggagaaaagatgcatactattttgaacttttc

SEQ ID NO: 5017 - DNA, 1050 bp, Homo sapiens
cctctgggtttgtgttggcagtggcagccctgccttcttttgagcctcctgaagggtcgttcttcccttttcttgaaggataacttgtgttcacaactggatggttttattggccctgtcctatagaatcctggaagtccaacagccttccttaattttgtccccatctcggtcccttcagtccaagctggcagtgtttctgttgctttaaccccatgtctattcctggcttctgctaagatggctgactggatccataagtcatatgctggtaatcgctttagcaaattgttgtccccccacacccttgatgttctctttagattatgctttttcattttttacaatatggataaactgagaattttccaatcttcaggttctagtttcctttttgttgaacaattccttctttatgtctctctatactgtaaaattttactataagcagcaaggagaaatcaggccacacttcaacactttgcttggaaatgtgagtgaaatatctagattcatcacttacaagttctacttttaaaacagtaaaacacaagtcctctgccacttcgtaacatggactgcctttcttccaatttccaatatcctgcttctcatttctgtctgagacctcaccagaagcatctttaacattcatatttctaatagcattctctctctgtgtgtatataactatagaaccttcctgtacagctcttctcttgtctttctgagctcttaccagaattgccttccgtgtctttttttttttggagatggagtctcactctgtcacccaggctggagtgcagtggcgcaatctcagctcactgcaacctctgcctccctggttcaagcgattctcctgcctcagcctcccgaggggctgggactacgggtgcacgccaccatgcctggctaattttttgtattttagtagcgacagggtttcactgtgttgcccaggctggtcttgaactcctgagctcaggcaatctgcccgcctcattctcccaacatgctaggattataggcatgagccaccacgccctg

SEQ ID NO: 5018 - DNA, 1414 bp, Homo sapiens
agtaaaagtgaggcacattttacaagaacataactcctattaaaacggagtaacaactatgcaaaggtttctatagcagctaggtgagtttgttttccgggtctgtcttaactggcagcttcctgtacatactggtacttatttgctgtaaacgtctgtttcatacatttgccatgcagtgactgtgctcgaaaggtgaaatcaatggtaaagaagcctaggattttatggtatgagaaactgatcgcaggattttctgatccatagctattaattgaaaacttctgatagtgctgtaggctctatagtaggcttaagagtgagtcttatactatgaagccagccacaagatactaacaaatgtataaattgaaaagtaccaatactttttgcacatagatcaaaatagagtggagaatttgggctccaaaaatcaggttagtaggctcatttccatgtgcttaaaaatgtttttgttgttatgcattgattaagggctagagcaaatataaaattaaatgtctttttcctccaaataattggttattaatggtaaaatgttggacttggggattactgagattagtatgtgggtagtaaagaattggagtgggagttagtggggagggatgacaaagcttcagctttggtttttgtatttttttagtcttcataacagctacatttctgttgctcttattggccagataaatgtgttatattaaaccaggtaagtattttaaacagagaacattttatttgcatatatccctacaaattggcccattttattgggtggggggataaaaaagggattccctaactttaaataatcagaatatcctgcaattgaaaggagaaaaaaatccaattttgtcagtattttcttagtctgaaaaaaacagcagtagtaatctggtgaatgttattattaggagtgttctgcctctacagtggcatattccatgacattaatagaaaacccttctttcccacccctccccatcttgacattttcttttttaggatgttggttcctgcaaacaagaactgaccctatcacctctgcctcacagtgggtaaatatatcatacatctcttgaaagggaaaatatccatgtcagtttctttcacagtagaagaatggctgcttttgaatggggaggaaagaagacatttttcttaatatcctttttgtcccatctctaaaatgtataaatattttgatttggttttactttaatttctcattcataatttcgcaactgtccttttgggttgccctccaacacattacttccatttcagaaaccatatctgatttaatataaactgctaacttaagaagaggtgaatttgcatttacacttagacactttctaaaaacagggtgaacttaattgaaatttttcag

SEQ ID NO: 5019 - DNA, 1044 bp, Homo sapiens
tggtctaagacatgatacagacattgttttaatgagtatgatgaaagtttcaagaatttgctttgattttttaatgttagtataattttgtaatgtcataatgctaattttgaaactttctaactggtaatttttttctctccttcccctcttccctcccccgcccgccccccatacatttcatcttgtcttcattcagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgcccgttgcgcagtatatactgatccagatgataaaccagtgaactatgtcaaaagcactctcaatattacatttgacaaaaagttttgtacttttcacatagcttgttgccccgtaaaagggttaacagcacaattttttaaaaataaattaagaagtatttataggattaaagtgacttcatttgtatacatttggaatctaaaccagcttaaaaacagtttcctcaatgacttagatacacagtataactgatgctcttctggaataccacatgagacatggtcag

SEQ ID NO: 5020 - DNA, 1055 bp, Homo sapiens
agtaagctcttgagcagggctgcctggatttgaatcccaactttaccatttactagctgttaaccataagcagaccacttaaccataacctatgtttcaatcaccattaagaggataagcaggcggggcgcagtagctcatgcctgtaatcccagcactttgggaggctgagatgggcggatcacgaggtcaggagatggagaccatcgtggctaaaccccatctctactaaaaatacaaaaaattagccgggcatggtcacacacacctgtaatcccagctactcgggaggctgaggcaggagaatcgcttgaacccgggaggtggaggttgcagtcagccgagatattgccactgcgctccagcctgggcaacagagtgagactccgtctcaaagaaaaaaaaaaaaaggataagcagaatacccattttatggggtagtgatgaagattaaataatatgcattaagtacttgatacctagtactttgtaagcacccaataaaggtttagctgtcatcttcatttttgcttcagtattcaatttggatacattgcttttctgtcacttcccatttccatagaatttatcactatctctatcctggatttgtttatgttcaaaggccttgatttataattcttcattactcatgtattgacagaatattgcagatagtttttttgtgtgtgacttgatgagagctgatcacctttaacaggaaaaaagtgtatatttgatttaaacattttttcataaggtaacatgttaaactattcatggtatatttattttccctttaagttctagtaaagagtcctgtgtgtagtgaatgataaatttaagatcagttagttggttttattaatgtaaaacttttttctgaattactatatgttcagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggac

SEQ ID NO: 5021 - DNA, 1042 bp, Homo sapiens
ctgtgtctcatattacagactcacatggtcccagtatgcacgtccacattttttttgttgttttttaagagacagggtcttgctctctgccacccatgctagagtacattggtgtgatcatggctcactgcagcttcaaacttctgggctcaaatgatcctcccgccttggcctcccaacgtgctgggattataggcatgagctaccacacccgaccccagatcaattttttaaactaaaacaagataataaatcatttaatttagctaaaacaggttatcagtttcttttattaagctcgtttggaacacatggattttggtgttatattatctcaatatggttatgaattgttcttaattccctgcgtgcaagatgatcatgtatgtttctgctgagtttgctgtcctatactgtgttaagccatcaagatacaggattatctaacttataaaatgggaagggttgttcctctcagaactttggatattcaatgagataatgactataagagctttgatctgtagagcacattacaaatttggtaaatttttgaaaaatgtcattaacagattcctccagtctgtatgaagctgtaaaatgttttagaatctttttccatttcacaactcctaaatattaggacaaattccagtatagtgaattttaaaggaacgtttaaattgtttttgaataaaagtaagaccttacttggaacttagggactgtttctttctttgtgttatttatgcatggtgagttattgaagggaagatagagctacaaagtgtctctctgctttcccttaagtatggttgtaatgaaatttgaactatattcaaattttcatggttaaaaacacttctagaacaattaggttgagatcagtctcaggaaaaaaaaaaaacctgttactaaaagatattgtgaagggagtcttttggttctttatttgctttctgagtgctgttgagtaatgaagttaatagtagttttttcttactcaggacttagatggtaatctccttgactcctgggaagg

SEQ ID NO: 5022 - DNA, 1024 bp, Homo sapiens
ggctcaaagctaaactcaataaatcttaagactaaagtctaaaacttactgtttcttcccacctttagtcaaattcttacttcctctatttcttgtaaacatccatccctatcccctaaaccagaaatctggaggttgtctttgaagattttttgttattttctgtcatgtcatttttatctccacaatatctttttttctttttataacagggatctccctatgttgtccaggtcggtcttgaactcctggactcaagcagtcctccagcctcagcctctcaaagtatgggcatgagccatagtgtccagcccaaaatatcttttgattctgacctcttttagtccttaacatcttacgttagggcctcattttttgggaactgactgtgaactatgtatggctcattatggttccattgtccctttatggttgccttatcctgtgtctttctgattcatcttccacattgttatcctagttctcttcctaaagccaaatatcacactgtatattccctagcttacaaattttaagtggcttttcacacacagggaaaatgtaaccccttagcctacaacaaacatgtcaactcttgcagccttgtcacttgccacgtctacatttgcacttcacagttcagcttgcatagcatacaatatgggcttttaagtgaggcagcccagattcaaatccccattgcactacaaacaggcatgtttctaacctttctaaactttcgtttctttccctataatatgagagggggtaatattctagatttgtgagaattaaatgaagtattgtttatgaatagtgctagtagtggttagcattaataagtggtagctttgctggtaggattgtaaaatggtgcaaccacttggaaaacagtttggcagtttctcaaaatgttaaacagagttagcatacgacccagaaattccactcctatgtatatacccaagagaaatggaaacatatgtctacacaaaaactcatacatattcataacagcattatt

SEQ ID NO: 5023 - DNA, 1032 bp, Homo sapiens
catttccactgtcacagaaagttctgttggacagttgatatagaggttggaaaagaatgatttttttttaaatgagtgcttaatgaaaatagtcatttaagttggtaaaccggatcataaatcacaaaatgctttgcccttgatatataatattagctgccatttatgaggtactagctaagtgtcagattcagtctaaatggtttatagtcattttctcttcctcttatttcatccttgggtaaggaattctgtaaggcagataccttaatctttgtttgatagttggaaaaattgagatttagagaggttaatttaatatctcagaatcatagctaagtgactgagccaagatttaaatctaagtctgtcagactactgctcccattcttaaggctttgctcttaactactgcactccttgccatatattgcacttctcctgtgcatccccccaaatattattaatcacatttgagtatctcttacattccagaaattttaaatgtatttctaattcttacaagaattctaagaaccctgttaggtagatactaatctccttttgtagatgtgggaactcaggctaagagttgttaaataacttgccaaagacattaaagcttgtgagtgagaaggacctaaactcattatctggagcctattctgattttggttttggtttgtttgttttttgaaatgatctcactccatcacccaggctggagtgcagtggtgcagtcataactcactgcagcctcttaactcccaggctcaagcaatacttccccctcagcctccccagtagcaagtaaaaaaaaatgtagctgggcctggtgtcacaggtctgtggtcccagctactcaggaagctgaggtgggagagtctcttgaccccaggcggtcagggctacagtgatctatgattgtgctactgtacaacagtacagagcctgggcaacagagagaccctgtctcaaaaaaaaaaaaaagatttacaaatgcattcacttcttatttttaaagttagtgat

SEQ ID NO: 5024 - DNA, 1713 bp, Homo sapiens
agccaaaaggccaagaggcgatttttagagcagtttgatgggaactagaacttaacctattgcaacatttgccaaaattttgctatttgttaagtggagattttacttacacctggtctcctggtacacaataatatctaatattcttttcattgttgtcttctttttcttcattttgttgttgttattcctcacttatcctccctgcccctagaaaatccacatataaagtaaacccctcccaccaaatatatccaattttatgagcagcatagctattgctgctgacaaatattcgtaaagctcacgtatcgcataacgcagaacttctctatttaaggaatagatactattggggtaggaacaagtacagcagaagatgagcaaatgtcttaaataaaagtttacagtttattattatttctcttttttaaaatatcttctattaaagcctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggtaagaggaaaacttcctatattctgaaacagcctaacattttacaaaattttagttttcttttttagagtcttatcctgtagctatataacagttcatgtctgatttagcatttgttcacgagtaaagctggaactatgaaaattgaaaattatgagaaatttctgtatgtttacttagtaaccataccttgagaactgaagttgggaagccagtttttcgttatctataggtttggttacttgtttcctgtgtctgacaatttaactatgtcccaaattatttactgcacataaagatcatggtaatacttttttcttaatgaaagttctgctttttagtagaagacaggctctaaaaatggctagaacaacagctattaacttatggtttgggttttttttaccatgtgtacccatgtccataatttaacttgtaagaattcaggcttctctttcgacattaggagtattttgagtaaaaatatacctactattttaatggtctctaaaattaaagtatagctttattttgttcttgatgtttttgttggtttcttttttagacacagcctctctgttgcccaggatagagtgcagtggcatgatcataggctactatatagccttaggctcaagtgatccactcacctcagccttctgagtagctaggactatataggcatgcactaccatgcctggctaattcttaagtttttttgtagagatggggtctcttgccccagctggtcttgaacttctggtctcaagcaatcgatacttctgccttggcctcccaaagcactgggattacaggcgtgagcctccatgctgggcctaaagcatagctttaattttaagatatcgaataacaaattgtgaaatatttcagacttcaagaatgaaataatttgaatctggtgaaccaaacaaaaaggagaatagagaatagctgcaatgcatgtgctcagttgcttttaccagtgatatcaaagaactaatgaaagtaacataaataaggacaaaaacatattaagtatgaggactttggaataacgaggaacttctgaataaccgtaaaaattgtctatatatgcatatctcta

SEQ ID NO: 5025 - DNA, 1875 bp, Homo sapiens
aacttttaacattatattgataaatgaaaatatatgaggtcttcatttcatagttgcatttttttcagaagctaaaatggtgcgaatatccagaataacttcaaatataaaattcttttatttttagattttttttttttttgcattgtttagtttttggtttctgtgacctgatgaatgacaaagttttttcatttaacatagaaaggttaacttcaggctgtatgtacagtaatgtacttttcagagcatcttggtaattaatgtatttctgaaacattcattagtcattctaaatttatatgtaaaatttgataagtgtaattttcccagagttacaggagtgtctcagtttgaatttttttctgttccttagccgtatatttaagatgagatttgtatcaagcaaaagaaatgtatcttataaatttaaatacatgcctaacttatatgagagggtttattattgcttactttctctagaaaccacttttataagcttacagtttatatctctcttctaaatactccttgatagaaaatcttgtagagcagtttattatactgttaattctgcaaataaatggtaatttctccacagcatttcgtgacagcagtgtatttttttatggttttaaagtaagcattttgggccgggtgcggtgtctcatgcctgtaatcccagcactttgggaggccaaggtgggcagatcacttgaggtcaggagttcaagaccagcctggccaacatggcaaaaccctgtctctactaaaaatacaaaaattagctgggtgtggtggcgggtgcctgtaatcccagctacttaggaggctgaggcaggagaatcgcgtgaacccaggaggcagaggttgtagtaagccaagatcacgccactgcactctagcctgggccacagtgagactctgtctcaaaaaaaaaagaagaaaagcatcttacgaagaagaaaaattgtactttaagttttaattttaagtggacttgagatctttaccgctgtattccttggagtctctaaatatgactaacatttcctacctactgatgtctctgtttacattaattggcttgctcaagctccacaagtagcaactatgatgaaaaggtccctccaacctgtggtccttaattaggtttaaggtttaaaagaagtttcaaaatgatgtttataaatatcccttttctcttgtaaaaaactgctaagattgtgaccacgtggtttcaagttaaaagtaaaataataaagtagcatttaaaagtattaaagtcaaaaacacagttcaggaaaaaactaaatgtgaaagtgtctcacagctggaaagtggtttattggtttaggggagaaaagagcgaataataatttcctgtgcttcacttttaaatgcatcagtgatcagattgtcagaaatacacaagtacaaatattgaatctttttaaaaacctttaagttcaaccatctaacgtagacatcccttaatagccgcctagaagagagtgagtgcatcaagcttatgcttgtccacgttagttgtaggaaattcaatactttgcacaccaacttgtagtacatttgttggacagctcttaacttttgataagccaaaatatacttttctccttctcctgagtgtgtctagttctgatttctggtctacttattccctctttcacattgtgacttaaatagttcatttgctatttttttctctaatcttttcaaaacttgttgcataaaaccccccagtgccctagttataaagtcatacttcttaaaaagcaaatttcaagtacttggaatagttctaaatttttatacaagaactacaattgtaggagattgctttgagaggagaat

SEQ ID NO: 5026 - DNA, 1033 bp, Homo sapiens
ggtcaggctggtctcgaactcctgacctcaggtgatccacccgcctcagcctcgcagagtgctgggattataggcgtgagccaccgtgccgggccaaatcagcattttttagtttgggttcaaatatacttcgccatttctgggcaatttggatgggtatacgagaccaataatagaaaactttttttatgtctagaaatatttggttattttttaatataatggaaatatgcttaagaaaaattggcatctataattaactagtatattttaaagtcaaataggagttttgagtgccaagtttagatataatttatttccccttttctctgagaaatcatgatttaattgataagatttggttatgaccttactccagagttagaaccattactgaattagctaggaggccgcccttgagaaccagactttctaagtatcgtaatttctgggtttttctttcatgttgagttcagtttaataatatgggagcaaaggaaggaataaagcaattcagtattgggtggactaggggagcaacagcagaatttacgacgtgaaactatcattcaagctatcctagtcacttaacaatttcaaatttattagatattaaaatggagaaggagatcttgctgggcccagagatggtaaaaaatcattagagaccagaaataatctcttaagagatctagttgggagttggggaaagacataaaggagagtttattttcctaatctttttttgtctttatttcttcaagattttttaaaaaatataaacattagtagagccctgtccccatctcagcaagctttaattttgtctgatttttacaatgttttcagtaaatatttaacattatttgttaattaaagggtctttgctttcttgaggttatatttacatttttgtgctttaaattttgggaggtaaaatacagttttactccccacccttatcgtatgtgtcaaatacttcaactgattttttggagaataaacattttctttcaaacagatctctagctgt

SEQ ID NO: 5027 - DNA, 1070 bp, Homo sapiens
tcatttgttgtcaaaagcagtttcctgtctgggggtggggagagaaagaaggcaaataggaagtgaagtagagaaaccagctgtttgttaaatattagtaaatgactattacattttgatttttttaaaattgagtcaaacattaatcttttctgcctttttctataaaaataaggccttgtgtttttttcttttgaaatcttattacaaaagagttttcaaactcagtataattctacacaataatataatcctagagaaatgggcttcaggtgaattaaaggtgcaaacaagcaagaataaatgcaaattcatttaaattgatgatgtagtgtattatttttattctttcattaaatacttaaaatattaaaaattttaaactactgttgactaagatgattggtaataagttaacttataaaataattctgtagtaaaattgaaaaataaaaacagaagttaaaatagttaaacatctatattcaaagggattggaaatttttcgttaactaaagtttcctcagttggtgtgtttggggtttaaaaaaaaaatacccaagtacattttattgagcagttctgcataaatttttgcttctgactgaatgagctaaaataaaaacagttagatggccaaaagaagaattaaggttgctttcccattgggcaagttagcactacttgtgtgttgacaataaagaacttgcctgtggactggtttaaaatgtgtgtgatttcttggaggttgtttaagcttcgcccaaattatatctgtaatttagtagtaaaaaatttaataggcttacttcctatttttttcttatttgtttatagtaatttgagagttctgtattggatttcgattatgactatctcattagaaaccttcattagaggcagcatgtaaactgaagaaaggtagttatagataataaggaggaatcctttctttttacagcctgttcagtctgtagaacattctaggatctaataaaagatgaagattaaatctctggctgagcctcatgccatcaaactgtttaggtatttataaaaagaaaagggtt

SEQ ID NO: 5028 - DNA, 1891 bp, Homo sapiens
tggcttagggctcaagtaagtatcccttaccgccagctggtgatggacagaccgagggacggaggctccaggggggtaggggaaggggcggaggggggaggggggcttgaaagagctcggtcaaagagaatgagtgctgggcacgcaggacccagtacacaggaggacgcggctcagggcgaccggggaggaggagcggacctgaaaggaaataggggaaaatcaatcagtctgacaaattgtgagacgagacaggcgttgaggggttaggaagggttaggagaaacccaaagaatgacttctccccacgcaccttcagagcttaattgtctgtcaataaagacagatgcgggagtgtgtttctgtatgtgttgggggaggggtggattagagctggtggaaataatgaaccttggaggatttgtttttcaagtgtatcttggaggcatctttgtgggacacctccccacccccaaccgtggcagacaacaacccaagcaaactaccaatcaggaaagacaatcacctacaagtgtttatgggaacggaggggctgggatcatttggaaagaggttgttgaataaatctgatgcgaataatgaagatacagtgttgatgtcgtttaaaggcccttgtgtgtgtgtacaagaggcctaaccctaactagtctgaaatctcagtttaataccaagaagatgatcgcctctgaaaaggggacatctgatctggtgaaccatttgttttcaaatacaatttaggtggccttgtatacctaacatagggtgaaggtagacagcgaccttggacaaaaaccaccgttttgtatacacacaaagaaaaactaagggggtggaaggtaggattggtgggagtgcctgatgaaggaggtgcaagagacggagtcagaatgaaatgaaggggggaggacgtgcagcagcagtcagtttcctacattcagagtgtagattaagctctcaggctagccgatgtgtacttttgcatttatggatttcttggggagtggggaggagaacagaactttttaaaagtggcacaagtatttcggttttcaggcagatcattgcactgtttagctaaaaattaagttttaaagctgaataagaaagcattgaaacataagcacaaaaaatagactgataaatgaaggttcttagataccagaatacatgagggaagaaaatacagttgatgaatcttttaagtgctcaaagacaaatatgtggtaggaagaattcactttattccctagggaaaaggattagtatgaaaacagattttgtaaatgctaacagaacatattactgagacaagaagcaagctgacagcagcaggaggaaataactcgtgactgtttggaacctacaccatagtaaatttgctatttttagtatagagagaaagggaatgatttttgatgctggatttgttttaattttaaagattgacctagtagaatttctatgcaatataatacctggatatataagctcttaactgatacggtcatctctgttaaccttgtgtgaagctaataatttttatctttcaaaatgtaacgtagtatgttgattctggtttttcatttatttgactagttggttacagcacatttttagaaattttatactttatgcattaaattgaggcattaaatggcaaactaggaagaacttacattgattctggtttcaagaaaggtttttaacttgactaggaaaaaatgtaggtgtcagttttaaataaagtttgtttaaccaggcacatgaaagctatttttttcttcatcatgaggctagcttaaaaactttgcatctgttttcatggacattagtttatttgaaggattaaaaccctaaaattggtcaggtc

SEQ ID NO: 5029 - DNA, 1125 bp, Homo sapiens
tgtttacttagagaagccaggggaagtattccaaagatctattctacatgtgtatatttagtttattgtatataattttataaaccacttttaccaaaaagttcataaaggcatgccctgatatcctgccaggtgctgtggtttttactgttaggagagtcaaatttgctgtattccgggttgtgctgacctgtactagagcccaaccacagggacattgcacagtcaggtctcatgtacttagaataaaaagcagctgcaagattcccctctgtgttgaagttttcatgtacaaatgaaatagactgcacctgcccagtctggctgaacacacaaatattttataaagggtgttgactacatgtgaatgtcttgaaacatgtaagtctgattagagtcaaaaattaaaatggtttgatatggacatttatttttcattcttctcacaaagcaatgcaacccgcattgtgatccagtgactaggaggtttcttcgttgataaatacactgatgttaaaaagtttgttggtaaaccggtagttgccaaaattcttgacctctcaggtgtctggtaaactgggcattcaaaagcatagagttctgaatctgtctggttggaagcatttggtgttttggtagaaatctttaaaaaaaaaaaaaatccagtagtcaaattgcatagttcaagtgaatcagtagctcacattttctgtatgctaggcttgagggatttgttatgaattagatacatttaaggttaaatggttaatgtaacagcatgtggaaattatacctggagaatttaaagagtattatggctttatagtacatattattgagaacatgggatgtaagtatagcatctactttagattttagtaatattttgggagatttaaaatctttgttgtctgagtatattatcacatctcccttgcaaaattgtagggaatgggaataagagtggtttgtatattactgaagcaacgctcagaggtttaggacttcaggataatagcagggtgattacctttgttggcaaaaagtatatgtcgggaaaatcacagcacatctccagaggcagcgagtcttccagtattttctgttcacgattccatcttgccc

SEQ ID NO: 5030 - DNA, 2225 bp, Homo sapiens
gaatggattcatcagtctttgagtagcttctaatttagatacgaccttctgccactttccagtgggattttacagacttgtttaattattctcatcattattagagaaaatgaagtaccttgtggttccatttttagagaatttgggggaaagcaggaaaaaatacattgtagtgataataaaaatatctaatactgtgtactattattatccacaggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccatttaaagtacatttatgttttattcagtaagagaatagaattttcatttgtttttctttaaatcctttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtttgcctttataaactgttgcaaatagaaaaaaaatagaataagtatatatttttggagtaacatcaatatttaaacatttttacacagatcggtgtttgaaaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttttaagtttgtttttgacatgtttatttggcaaattttataatgaagttttaagttgaaaataaaatgtagcaacattttgatcactttggagccttttttttttccctttcttgcttgaaactgagattt

SEQ ID NO: 5031 - DNA, 1026 bp, Homo sapiens
attaatctgtccatgagggcagaaccctcatgacctaatcatctcttaaaggtgctacctctccacactgttgcattgaggattacgtttccaacacgtgaactttggagaacacattcaaaccaaagcaggaagtaaagttattctcttactagtttattgaggatcgactatataatagttaaatgtcagtgatagattgatttttgacattctgaaatttggataaaattaggaacttatagacttaaagtgggattcagcatgtatttaaagtgcaggatgttttggtgctgattctaagctagtgtttgataataaaatgtttgtgccatggccagtaggtataactaacagatgatatagcttgtaattttgattacactgaactctagtattgattttattgtaatgtaggctatcttagattttatctctttcatggatgtaactatatttgttttgccttcagagcgtttcctaggtggatgattaaagtagtgtgatagatttcggacgggttaccatctttttacatagtgggatttagaggttttgagttgttcttaagaatcaggccaggtgcggtggctcatgcctgtaatcccagcactttgggaggctgaagcaggaggatctcttgagcctaggagtctgctttggaaatttcctcagagcatagaaatcatttttaagagaaattacagatgctattaagcattagagtataactaagttattaacataggaaaatattttaaaattgcagtttgtggttatgtaatcttccgaggtgcaaattctcagaaaaatgcattccggaaaaatcccagtgatccaaagcttgcacgtaagtattgatttatgtttatattatatatattacatgaaggttttatttttctttttgtctcgacatcattaaaaatgtacttttatttttatatagatttaaaaaccattcatacttcaacgggaaaaaatcttctagtttctggatggtggggctttgttcgccaccccaat

SEQ ID NO: 5032 - DNA, 1049 bp, Homo sapiens
gtgagccgagactgtgccactgcactgtagcctgggccacagagcgaggctccatctcaaaacaaaacaaacaaaaaacaagagaaacgagaggttacaaattggttgatgctgacctgaagtatttcaatataaaaaaatgtcgcctatctaaaaaaaatggagtgtaaagtcctttgggggggcccccatgattttggttaacttttttaagaaacctgggcccccggctcccccaaaggctggagcaactgccttttcagtcgggcaggcatctcctggttccgctcgtctgtgccgtcctgtctgcctctcaccaccagagccctgctcagggtcttgcaggcagtggaattgtgagcctggatagtgggcggcagtgccgttgtaaagcctcctgactgggtttggaatgctgtttgggtaaacacttttcctttctcaggaaatgctgtctatgatttcttcattggccgtgaattaaaccctcgaattggtacttttgatctcaaatacttttgtgaattgcgccccggattgattggatgggtatgtctggttttttttcttctaaatttcaattcaataggtctaattaactgctagaaagaaatgtagaccattcaaaaataagcagtgggtggtatatttttagggataattatggctttccataaatctatcaaaatactttcttgtaagtattttccagaggtttaagatgccctgttacaggttatgacaaattaaataacttttctttgctttatttttattatatcagtttatatttatgtaggaaagtgatagtgtggatgaattaatgtaagaaaaaatgcattttcctcctttttaaattttacctagttttaggcttggagttgcagatagagagcaaagagttcccttccacccttcattctgtttctcacaacattaaccttggaggaaaccgtagtgtagtgatgaagaacagcagattaacatagtgacagcattggttaccaagtccacaggcctcagtcgagttcaccagtttttccgctgtt

SEQ ID NO: 5033 - DNA, 1030 bp, Homo sapiens
ctcatataaataacagctacctcttttttgcttttgaccgtttatccaaatggatttgatgactttttaggatcacagctctttgaggcactcagctcctttgaaagcaaaactatttctttagccaaaagaaaaaaattggatcttccagtgagcctttctgtgtggctgcaggactagcccggaacgagagttctgtggagcgtcacagggcgggtgctttttaacttggcattgcacgtgaatgtccccgcctgctgtccctaccccccaggtactcgcagtcccctgcctagcctcgggcatttgtgttgtggcatcttttctgcgggtggcatgttaagatctctgttctggatgatagagttttactagaatcttttgaaaccattattggcaacttggttaagtataaatatttataattttgtaactaccaacctggctcggtgcctgacccctggtaggtgcataataccctccccttaggtaatggcattagactttaaaatatgtgtttggcccagctctgttaataattagccatttgactttgtgcctgagagtttggattgtgggaattttcaggttgcacttcttgtctgttttcccttaattaaaagcaaataatgaccatttgaactgaaaaagaatcaatatgttaaactatttggaaagttctacaagagataatggtatgtatattgaaaattatacctcagacattgcttatttgcatatttgtgtgtatttagtctgaataatgaaattaagactttaaaaatgaacattgcattgtttcatagtggcgtaagtttcatgtgagccttgggttaatattaattttccacttccttttttttttttttttaaaggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttg

SEQ ID NO: 5034 - DNA, 1063 bp, Homo sapiens
agttgtgagcttgctgggcagctcaataaatggatagaccttgctccctgtgggtccggcatctcgcactgtaagagcatgtgctgagtgcttcagtccagctttgtcatttgaagactttggcaaagtacagatctattttgtagtcatccttgaatgattttccatttgacaagacggagtagagtgttttccttttcttgagaattacattatgtattgtaatggttgaactttttatcctttcaattcttcattttttaactttggatactttgtttagagacttacgcagcatctactctgtctgcagtcactccactgggttctaaaggggaagccaaagatagtttagacaccttctgccttttagtgccagtcatgtgataaaacgtctcccccagctccagagtctgacccctggtgggtgcttaatacttatcattggtattgttagactttttgttgcttttaccaaattctttgctgatggagcaagttttagaacctttggcaccctccctccctctggtggttcacttaccacaccagggaaggtgagtctggggtgaggtgggttgttgactttgccgccaggtcctttgatttcagtgttttgtgtgtttctctgtaggtaccaattcttttctaagtagtcttgtgttatattttcacttccctctgaggggtgtggtacattcagagactgagcacagcacttggacatggagctcttggagccagtgggggagtggctggccaagttgcttgatcctttttaaaaatttcctcatctaattactctggttcaagtattgagatttcttttcgagattttacgattattaactaaggaggttcctaagacattttggatgattatttttaatccacataggctagagagcaaaagactgctttatctaaccattcttttttaaaattacattttatgaaaggtaaatgaatattttcaaaagtcagaatttagaagttattgtttggagtatttgtggaaaatgtggattcagataatttgagacaactattttactttacaaaa

SEQ ID NO: 5035 - DNA, 1011 bp, Homo sapiens
acttgggtcatagtagagtggataaacagggtagagcccaattgaaaaggaccccacaaatggaagacaatggaatcatactgttactttgtaagagtatggtagccattggtagatgtttgagctagggatccactagatataaaggtatttaagcacatttagtcttgaggtggtggtacacaggagtgtggcagggagcgtggctgttgcagttgcttggtcctacactaggaagtcattactgaatttgtatttaagataaattcctgaaggtggaattgcgtcattaaagggcttgccactagggtttttgaaacatattactaaatttccatgttacaagatatcttccttcttgggcgtgttgaaaattaagtgatactagaatatatatatgtgtgtgtgtatatatgtatatatgatggtgatgtgcttagtaaatttgtaaattttttttcttttaaggttgtagaaggaacgcctcttattgatggaagaagactcaagtatagattaaatggtgattttctttttttaagactcaaattgatgatttgatagcttaaacttctaagtgttaaactctttgttaaagctgattagaccagagtagtaagtgataaattatttcttagtagttggaagagcaactgtttatacctgtagccaacttgtataaattatgccattaaagtaacatagcctcttagtcactcttgtccactctccagttttattttcttaatagtgctcatcactgttagaaatcattgcacttgtctaggattttatcacctgaggtgttacacggatgtgggcatccaggccactcctgctgcgtgagctgctcttgtccttgctcatgtcctctgggttgtcccttgaatattcgtcacacacacttcctgggcctttgcctggagaacttacccccaaacgtctgacacctgcatcttcacctccatctgtcttctgctgagagaagccttcaggtccctttctctcccc

SEQ ID NO: 5036 - DNA, 1130 bp, Homo sapiens
gggttatagtcatgttaattgtacatccttgattttcccagtctggtttatagtttgctgtttttaataaaggcaatttgttaaaaatacaattaaatgcatttttaaagccattgtaaattgatacgcaaatttacaaatgagaaaatgtgttctttgtgagattgtgcctcattttttgattagcgagaactgtgatcacggtaggtgggtaacattttacatagtgtgaacttatggcgcctatatacattgttataattaatctttagtgtcacatagataacgcagtggctaaatcatcctctcaaatgattccaaatgagattgaatgtagcctttctggccctaaaatcctgaccagtcaattctggaaagttgtattttagtgatcagcctgtggaaaaagacgaatacataaatgtgtatgtattgactcaaatttttttctttaaaactattcaggttaattatagaaaatgccaagtaggaaatttgccgatggtgaagtggtaagaggtcgatggcctgggagttcactttattatgaagtagaaattctgagccacgacagcacctcccagctttacactgtgaagtataaagatggaacagagcttgaattgaaagagaatgatattaaggtaagagctcctttggtttatcagagtgtgtttacagtaagtgggaaataactctaagtatggtttctaagctcaggatagtcagttcagctcggtttgaaggcagaggattgagctcttgctttgggtcacatactgtttttggctctgggaatgtatgaatgaggcatagtccttgttcccaagaagctcacacttactgggaaagacagccatttgcatctgttggtcccctgggtttactacgttctgtgtctggagtttgctgtgggtggtgttgagtgtatcaagggtagagaagagccctgggcttcaggggaggctttcagaggcagtgacacctagccaagtgctgagaacaaacaggaaaaacagcagttgatggggctgtttctgcagagagggcagtatgccaaagtcaggggtctgggggacacagtcagccaagtgctggaagggggtggtaggggagggctaagcaggagc

SEQ ID NO: 5037 - DNA, 1053 bp, Homo sapiens
ttgttgcccaggctggagtacagtggcgcaacctaggctcactgcaagctccgcctcctgggttcacgccgttctcctgcctcagcctcccgaatagctgggactacaggcgcccgccaccacgcctggctaattttttgtatttttagtagagacggggtttcactgtgttagccaggatggtctcgatctcctgacctcgtgatccgcccgcctctgcctcccaaagtgctgggattacaggcgtgagccaccacgcccagccagaatatttatatttttattattggtttgtgagagttcttcatatatgctagagacaagtctcttaggcgtatgatttacaaaacttttctccattctgtgggttgttttttcactggcttaatagtgtcttttaaaacaccaaagtttttaatttgaacgaagcccaatttatccatgtttttcctttggttgcttgtacttttggtgtcatgttttaaaaaccattgcctaccttgatgtcaaaatttacgtctataatgttgagaaaagagaactcttagatgctattggtggggaaataaattagtttagccattgtggaaaacagtatgggagtttcttaacaactaaaaatagaattaccgtacaatccagcaatcccaccactgggtatttattcaaagaaaaggaaatcaatatattaaaggaatacctgcaccacccttgtctattcacaatagccaagatacggaatcaagctgaaagtccatcaacagatgaatgaattaaaaactgtggtatatatatacacaatggagtattagccataaaaagaataaaattctgttatttgcagcaacatggagggacctagagatcattgtgttagtgaaataaaccagacacagaactacaaatgtcctctcagtcatatgtgggagctaaagaagttgatctcatgtctcgtgcaggtagagagtagaatgatagttaccagaggctgagaaacgggtgggatgaagagaggttgagctgctgggtacaaacatacagttagacagaagg

SEQ ID NO: 5038 - DNA, 1085 bp, Homo sapiens
cagcttagggctattatgggtagtcctgctatgaatattctagcatgtgtctttggtgaacatatggatgtgtttcttctgggtgtgtgactaggaatagcgttggtgggtcacagcgtatgcctgcgttcagcttcagtagatcctgacccacttctaaacgtgcctagcagtgctggagccatttatgggcatgtcagctggcggggctgcgagcctccctccgtcgtagctcccttctgtgaatggccccacgggcagcacagggaacaatccaacgaaagaaccgaacctgccttggacagctaactaactgcggtctcattctgtttccctgaaacgtggaattaagtttcgaatacaactttccttccctcttaacaacgatattattcatgtctacatttattgcaagcatttacctagaagataaggcctatttcctccaataaggtgagtttatactcaatgaaattaattttttcgttcatttagcattgcttcctaacaagttgtcaattgatggaccagacatttctttcctgagctgcagattataaaggggtctcactctcagggcacaagaagcaagagcacatacccaaaggccaaggaagtggctgccttctttgtttttccctaaatgatgtcctctagagaaattcccacagccccattatgagacgggaatttgcttgattaaaggagatgattccactttctgtctagtaatctggggcatgaagtggatggttagatacaaatctccagtgttaagtaccagtaatttttgtcagtatgaaaaaagtggctgggtgcagtggctcatgcctgtaatcccagcactttgggaggccaaggtggacggatcacctgaggtcaggagtttcagactagcctggccaacatggagaaaacccatggacggatcacctgaggtcaggagtttgagactatcctggccaacatggtgaaaccccatctctgctaaaaatacaaaaattatcagggcgtggtggtgggcgcttgtaatcccagctactcaggaggctgaggcaggagaatcgcttgagcccgggaggcgg

SEQ ID NO: 5039 - DNA, 1052 bp, Homo sapiens
caagttgatagaccaaaagtatatagtagaacagcacagtagaaaaaatttaaaagtgaatttcttatggtccaaaaggatggatagtcacagtccataacctttcataatatatgctggaattggaatctcttgtcatcttgctttgctctgaattttagaactagaagtgtgcatgtatgtcaaaagattatgcagagctattttctttgctaacaatgtaaacatttgcaccccatgaatgggactttataatctggaagtgagcctaaggttgcgtatactgaagtcatgttttaaaagttaaggttgacttaaacatatacaaggctgtattttaattgtaactagaaatcatttactatgcatacagaacctcatgtatcttatcatggaatttgtgaattaatgggccttgccgaattcaagggtaagggaaactggtaacaacttgttttaaatcaacatactataagctcctgcttgcttgactcaagttgtttgaaaatctgaattaaacaggatctcattgtcaggaaacatcttctaagcttgacatctacgtttaagaagggaacgtggaagagaaggtgagacatgaaactaaaacagctgggagggtaggatcagactgcacctgatttttggaccaaagtttcatataggaataaataaaaaggaggaccacttgtgagccaacctaggaaggacttgccagaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgc

SEQ ID NO: 5040 - DNA, 1811 bp, Homo sapiens
ggtcattggactgggactgactttaccagttttcaggctgtggggctagtcagtcattctctctgagccttctacctctaaagttgagttctttttttaaattctttttgttttgtttttattttttccttgccactatacaagcaaggatagataaagctttttattattattgttattattattatttcgagacagtctcgctctgtcatccaggctggagtgcagtggtgtgatttcagctcactgcaacctctgcctcccgggttcaagcgattctcctacctcagcctccttagtagctgggactacaggcatgcgccaccacacccggctaatttttgtatttttagtagagacagggtttcaccgtattggccaggctggtctcgaactcctgacctcaggtgatccacccaccttggcctcccaaagtgttgggattacaggcataagcgaccgtgcccatccccgataaagttgagttctgaatttcctctttcactgtattctcggcagctactggttggtttattctttttttttaatcttttttggtttattcttcttttgatctttgaagagaaggagaaaaaagatctgagtttggctctcccatcttaagtgcagcttttagttgttttatagtcatagacgctattgcactggacagcatgcatcctggatgtaaacaatgcggaaaaatcaatggagtgaccatcttggggtcagtggtgttgcataaagcaccagtggtgtgctgttctgtgtcagtttcctctgcgccacgtgctttcacagtttgaattaccagcatctctgtggtggcttcagtacattctccattgtgcttcaacctggaagcacattctgccgttcagaaagactgattccaatcatgtaatgggaccacacgagatccatgctccaattatatgaatagcagaaggtccatttgactcttgtagttcaagagctgtttctaagtaaacagactttccagagctcgatgaagtgaagaagcccttctttcaattcctgggcagaattcagtggttttcatatcatctgaacctgctgtgctgctgtttattctatcactgtcagccttgaaaggaaaaaaggaataatcttaccctcctgcccttcttattttatatcttccatcttatccatctatatccatgtagtcattccttccgagttccctggttttaatccaaaagactctgtttaacagcaatgtcttggcagaccaggtgccgcttccgtgccatttgagggctctgagtctttgcttcgtcttaggaagataaagataatttggcagaaagtcagagatggaaatagcagtttgggatgataaaagatgggtcctgttttgctgacattcttttactttggttcttggtgcgtgtcctttgggattcatttcttgctagcatgaataggacatgcttttcgttaggtgcttttcttttttggagaacatgaagtgtttctaacaaaactgaatgagctagaaagaattctattttgagacatctgtagttgatgcaaagtatttctgtaatcctcaatgacagtacttacatatttgcatagaattttttttttaatttttgaggaaacctctctggagtctgtatttataggagcatcctgaaagtccctattatgtagctggtgggagcgagagagggacagccacactcgtgctgtgagcagagcacaacttcaggcagagtgaatgccttctgagttctcattggaagctttctgttgctcagcctctggcagatttcagaacc

SEQ ID NO: 5041 - DNA, 1939 bp, Homo sapiens
caacttttatgtctcttgtaaatttatatatactttcagtgccattgtgaagaattggccttttaattctaagtagtattaccctatgaagcacagtgtgcaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcagctgaagtcagtaacccctcaagaaagtccgtttatagaagccaagaactgttggaggtctgtgatgcaggtttttctgttcccaacatcaaaagctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaatgactgtcataatgacttaggatgttgtaagaatgtctgccacatttattggttatttctgttgaaatctgaaggaatcgatacatctgaaaattgagaaagggaaataggactgtccccgttacagatactctgtgatgcacacaaccttctaaacggaagtgttagtatcatttaaagcacatagtaggccttgagtatttgcagattaacatgcagaaaaaatcaaagatgaagccccaattaagtgtttgaaccaaagaatcacagtcactgagctgcacccccgttctgtgaagcatgttaaatactcataaagagcagagagcagggcccgtagacgcttctggtgtaggacacaggaattctaggcagagggagaaaattaggggccccagttggtggctgagagtaaaaagaatataccatttgagtagtgctgttctttttcctcagtttttaaagacatataattcctagtagttaggacatctaaatagctcggtaaactggtcagaggcgggaggattgcttgaggccagaagttttgagatcagcctgggtaacagggagactcatttctacaaaaaaatttaaaaatttaggccaggcatggtggtgcacacctgtaatcccagctactcaggagactgaagcgggaggatcacctgagcccagggaggacgcggctgcagtgagccgttatcatgccactgtactccagcctgggtgacagagcgagaacctgtctctaaaaaaaaaaaaaaaaaattctaagagaatatagcttttcatagaaattattagaaaagcttacatatttcattagagagcccagtttgttagactacatttat

SEQ ID NO: 5042 - DNA, 1050 bp, Homo sapiens
aaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccac

SEQ ID NO: 5043 - DNA, 1051 bp, Homo sapiens
aggaaatacccagctgattagttgagggcaatgacttccatagtcctgcccttttaggattagggttttggggaggaggtttctccttcatataatggaaattatttttataaatagggattaaacaatatccctaagtttcaggtgttgtcttttcttagatggaaaaccacatgaacagatctttctctaggttacctctactcacctatcccagtgtcctcttgtttttgagcccacataatcagtgttttcattttgtatacaaaaggagaaaataaatatatagaaattagtatcatctttctaatattaaagatgtgtgcaatgaaagatgcaaagttaatcttcttattactgtgagtttgagcacaatccttaaagtttcttaggaatgaatcactcatttatcttactttatcattatatttattttcaatacttgttcttttccatccagcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctt

SEQ ID NO: 5044 - DNA, 1052 bp, Homo sapiens
gtccaggagtttgagactagcctaggcaatgtggttaaaccctgtctctacaaaacatacaaaaattagctgggcatggttgcatgtgcctgtgggaggctgaggtgggaagaagacttgaggccaggaggtcaaggctgcggtgagctgagatcatgcacactgcagcctgggtgacagaatgagaccctgtgtccaaaaatacatatattttttaaatgtagtaaatctgctcagttatcttgctgctttcacacatagtaccccctgggataatgttattgataaacttttttggtaaaagttaagaaaaaaagtggtgattacatctttccttcagtatgaaaagttcccccctttagttaattatcatggtggtggtggtggtgatggattgcatgttagcatgaattaaatttttaaaaatttgcatgtttccacaattgtttattacataacaataatttttgcattgcctagtaaatatggatatattcataacatacttgcccaattaaatagcaggctgtagttcatgtgaatttcagaggtattcattatataacttgagaaaataactagctaaatgggccacttaaatgggaaatgtaaaagaaaagcagagtatgaattatagtttaattctagagaacaggaataggtagcatgagtgaatatatgaaataacatcctaaactttaagaatatttgccagaagtgactctgcattttatggatctaagtaaatcttaagtgaccttggaatttagtagtcttccctagcaaagtaagaaggtgtagcctcacaagaggaaaggaaatatttcatataaatattattccctacagtgcctagctcagtgcttattgaatgaaattttctggaagttatttttccccctattcatataagcagatacctaataaagtaaaattggacgacttgcttcctaacagtcttttaagcagtaatacgttttgatagtaaagcagattaacaggctgggcgtggtggctcacacctacacccagcaatttgggaggctgaagtg

SEQ ID NO: 5045 - DNA, 1042 bp, Homo sapiens
atcatgcttcattgatctgcatttcacagtgaactaaaagctaagcctacgttgatggcagaagtcatgtcttagaagggacatggacgaggttctccaaatggaatacattctttgatgtatttggtccatttagtaaaggaaaagttgttctttgaaagatttttttatttttcctaattccagggtagggaaaaaaagatttttttttcagacttggaaatttaataagtgctctaaaggtcaccattttgaaaataattttatatagatgagttgaatcttgattcttaatatccagtagtgcaccataatcatgttccaattctgttaggtggttttccttccctttcccaaaatagaaattctggaactcctgattatttcctgaccactcatatatcttttgatagatttgatccaactactgatatataggttttaaaatttcaccaaaagctgttttaaaccataaaggatttttaaaatatgtttaaaagagtaagaactatattgcttttcttcctaagttatctctcctgttccttcggaaagcaagtgtattaagtatgtcttatccttgcattgtagtgaaggtccccatttctctttggaatagctttgtcaaaattacgttagtggtaagatggattaatgtcccataatatgcatgagatattgcatattgctgtatttgttaagtgaatatgtcagagtaaaagcaagactgtttggttaaaaatgctttaaactatgactggattataacgtttgggaagttggtgcattcatctgtggttattaagaccttacagatcttgtattcaagatgggaaaactagtcctttacatgcctcctgagaagagttaattttgtatacttttatatacttactgtgcctacaacctatataaaaagtagccattgtgtaatgatttttaaaattttctgtaactggtatcttcacataactaaaagtaatcttaaaatatcttttattggggaaaaattggttattttaaggttaatagactcaattct

SEQ ID NO: 5046 - DNA, 1597 bp, Homo sapiens
tttaagaatcaaggaagtacaatagaatttcaggattctgatatttattttgagttgttcctatttttttccccaagagggactatttggatttagattaaatgttgaaatacatgaacatattataagttatacttactgtttttatcattggcactaaaaaataatttaaaacagtgtcggtaatactattccattttaattaattgaactatcctaattttaaaattatcctactttattcttactgtcctttctttgttagagaaactccttactatcctaaggttatagaatcataatattttagacttaacaatgtaagttttccttggaaacttactgtactagcttataatttcttctcattttaaggtctggcattgtgcaaattagagtccttacagatttcaattaaagtttagaatttaaatttttatttatattactactatgtaaacaggtataatgagatttagtattttgttatttgttttataataactctggaagcatttatttatttaatagcttttgttttttatttttaaagaaccaacaagaaaaccttgggaaagaacaaatacaatgaatggcagcaagtcacctgttatctccaggtatcaatttttttctctaagttttatattttatttgtataaaaaaaaattaatgcattcttagtgtagaaaaaaattgaatggtaagaaattatacagaggagcccataaaactctcgtgatcctcctagtattggacaaccaccaagcctcattatatattactcatctacattactagtgattgataaattctaccctacatttattaaccagatgatctgagattttaagatagctttctttttcccaatttgtattttgaaaaattcaaaactacagaaaaattaaaaggatagtacagtgaatatgcgtatacccatttcctaggtttaacagttgtcaacattttgccccacttgtcttaaatatctacctatccacacttttttcccctctgattagtttgaaagcaattcacaaataagaactgtttcaccctaaatacttcagtgttttttggaagaaccaggacatctgctatgtaaccacaataccattattactctcaagaaatttaacattaagcaataatattatctactatagtatatagtcacatttccccattagttccaatgacatagattttatgtatatatatttatgtatatatataatttttggagccttttttaaacctgaatatcagctggagagaaaagagagcaaaataaaacatacatctttgaatttgtaaagtagaaacatgtatttccctatctcatttgaaacttgtaagtgtaatcaagttagaaaagatagtatccagaaacaaggctagttaatacttgtttctacaagtacatgtgggcatatttaggcaaatttgttcttcctttagctaggcatactttattttcatgactaaatttatatcacagctcctgaacatagatgaaaccttttcttggtttatgagacagtttaaaggacttgtatttttcccagaaaaaaaaaaagtatgtatttagaaa

SEQ ID NO: 5047 - DNA, 1066 bp, Homo sapiens
tctgttattaaataaattcttgttcactccctttgtgattttataacatttgaacatttctcttcttgccccccattttgtgggataaaaacaactctacttcaaatcctatggtatttaattatttccgagcgttattttgaggttttactttgtactagtaaattcctttacttcagtgattctcagccttggctatccattgaatttaaatgtgaagtattttttaaaatgctgaagctgggacttactcctccttcatgtttttaatacagccactttgactgtaaacaattaaatgtatgtgttcactgttactgaatttactgtctcaacacttaaggttaatgtggattattttgggtctgatatttcaagtagtactaactgccatcctatatactagtttgttttttcagggacgcttacctctcttccaaattttataagtatttattttgcttatttaccaaatccccatgaaaaaaaaaagtcttaattagatgatctgttgcatagttctattactaaagctctaacctaaagtaagtagttatatatacttggaccttacatttcagtatctttcaaaaactgatctagacttttacaactatgataaattggactcattaagtaaatacatgagtcagtttaatttagcatggcattctgcgtaccttcccacataaaataatatcactcagctctattgttgatggtcttacttaacatttctctctctcaggcattgtcttgggaccacttgcacctccacctcctccaccactcccaccagggcctgcacaggcttcagtagccctccctcctcccccagggccccctccacctcctccactcccatccaccgggcctccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacgggtaaatacctttc

SEQ ID NO: 5048 - DNA, 1439 bp, Homo sapiens
ttaaaattaacattcattataggatttaagaatattccttatggcctaattaaaaagtcttaatgtggtttgattaaacagtggttggttggttggtttattaagttaatttatgtatttttagctacctaattattttctggagttatggccaacaaaacaaaacttttccacaagttagcattgaataggagcattgaacccttcatattaaatgttttgccagctttactagttttgctatttgttgtttttaaaaaaacaactaaatttattcttctgtttatggtcctattcatgtgattttaatgtcctttttcttgtagactaaataaaaattaagactaatactagctttttcttgtaaaagaaattagtcaattaaatttattaatccacttattagataaaaggaaacttatttcatccccttctgaatctcaaaatgtatttacaagttaaaatattcttgggtgaaaatagttatttgcgtttgtgcctaattctctgatactaactgtagtctacatttatacattgtgtctgaatgctggttttgtggcttcactagctccctttttctctctccttttttatcctgtcttttgctgctgctttccaccttctgtccagctccatcttcagacagctccctgtataacgctccacttcctgagtattccagttgccagcctccttcagcacctcctccatcatacgctaaagtcatctcagctccagtgtcagatgccactcctgattatgctgtagtgactgctttgccacctacttccacaccccctacaccaccactgcgacactcagcgacacgttttgcaacatctttaggttcagccttccaccctgttcttccccattacgctacagttcctcgtcctctgaacaaaaactctcgaccttcttctcctgtgaacacaccctcttctcagcctccagctacgaagccctgtgcctggtctacttccaatttttcgcccctccctccatctcctccaataatgattagcagccccccaggcaaagctactggtccaaggcctgtcctccctgtttgtgtttcttctcctgtgccccaaatgcctccatcaccgacagcacccaatgggctggttgactctgtaacatatccagtgtctccaccgcctacctcagggccagcagctcctccgccgccgcctccactgccttccctcgcatcactctcacactgtggatctcaagcttctcctcctccaagcacccctattgcctcaactccctcatccaagcctagtgttctcccttctccctctgcagctgcccctgcctctgttgagactcctctaaactctgtgctgggagactcttctgcttctgagccaggcttgcaggcagcctctcagccggccgagactccatcccaacagggtaaggctttc

SEQ ID NO: 5049 - DNA, 1195 bp, Homo sapiens
cactacacctggcccattcagtaaatatttattgagctattgctgtggccagtcattgtattttctgaaatattatttgtacaattaaatttgatattaaggatattacaattacaaatgttttcactaaataattaaaataatgacttggttattaaagtggtatgttatttggaaaattcatttacttgcaacactactcatgaaaagtacagaataaaatgaaatgttagtgcaatgtgctgaagcattcagccaatatgatgctaataggagaaatgattttcatttgtatgaaacagtctctatccaaggtagccttcatgtgggaggagagatgtttgcatgctctacattgcttttatttgactcagaaatagtttacataggtgaaaagaatcgctttttcatgatgagtagccatagatgcatgtttttacttttttttttttttttccagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctggtaagaagtttacaaactcttctgtgttcttgtatctgagcttggatgatgtctcttgtgcagtcatgtgttaaaatatttcacatttgagatgtttgggattaagccatacaatttgaaattatgaataaatatgcagcaattactactttaacattttctttttatttctctctgtattgcttttattgcttggagacttaaagaaagctcttggaaatttttattctgccattctaattcttctaacaccctataaaatggctataaagtgtaagtgtgtttttatgggaaattttttatactggatgaacttcaaatatatttccctcatgagatcacttaaattgtctcaaatactatagta

SEQ ID NO: 5050 - DNA, 1175 bp, Homo sapiens
ttttacagaaaattattgatgtaaagttttggatgtcactaaagtaatagtaaaaaaaaaaatttacttttgtttgtctcatctcaattttgagtgtcactttgatttcatataaacccttccccttttcatagatcatcaccttctcattgagttttttctcctaaagagaatttacttcattgacacttaagctaaaatttaatgtaaatagcctaaataaatggctgtttgatctggccacacatttttaataagacattttgtcaagtatgtatatatatattgagaaaaaaaatagtaacatgtggcttggtaaaaaatgaatagctgacttttagcaaaccaaagatattcttattttgtatcagtgaatataaaactctttattgcagtgtgccgtttataatggctttggtctctttccaactagtaggaatgagttaatcttaagcacttccaagcttaaatttttttcagattcaattctcctaaatgagaatatagatcttgtgaaattaacactaatagccacagatcttggcttcctctaccttatcttcattgactttaaaaatatataaccctaaaatgctggttgcactctttgaccgtataacttaggaaataactaagttataagtgcatcatttgatctatggctgcttacagggtttttccaccaaaaaacgattgcataaatttttttaagagcctatgttaaagaggatgcgtttttattaaattacagagcttccaggatgaggatctagataggacgtatgtataaatacattttgaacatttcaaagcaccttttagtttatgtgaagttcttcagatggccccgttgtccttcgaagcttctaacaccaaggtgtctgttgcagcccagagcaaggttactgctacccaggacagcactaatttgcgatgtattttctgtggtaagcaacattatgtttacattactttttcaagctgtggtacatgctacttgcgcatttccataacttttgttttcttaggccatagtctggtttgtgatatttgggatatatagcaagctattgtttttatgttgtgatatttgttgtggttcatgtaggtgatttggtcagctttgagttggcttgttagcgagcattagaattagttagaattaggatcttaaa

SEQ ID NO: 5051 - DNA, 1049 bp, Homo sapiens
gaaagagttaatggtatcagtattaagcaggaagttctgttaggcttatgcatatgatggcatgaataatttagcatcttcaggaaatgcaaactgcagtagaatttaagcaacctatcagaatttagatcaatattttacatgatagtatgaaattaaagtcagtggaaagaagatgcttaaagataccaagtgaagaatgttaatagtttaaactgtgagaaagactgggaattttttattggaaatgttttgtcttacgcagcaataatggtttacctgcattctgacacttgtcagatgactttttgccaacatgattggtaatgggatgtggcagtatctttgctgtcaaagaagagataatttctcaggtttttcttgtaagttttaaaaattgtccttatgggtttttttttctctttaaatatggaataaaggaactgaagggtaaaacctgaagactagtcatgtttctttaataaaggttttatagaagtagccatttgcaaacgtcggtaagacagatttttaaaaaaacagtttaaacttataattattgaaaatattctaaattgtttatctcctgtggaatgatctcattagcttggtagacattttatgtgtacgcctgtggtctttctatatcttatgtcattactgtaaataaatattgtgcatgcaactttaatagattgggtggttggaagtacttagcaaaggtgacatttatcaatcttattttgtgtttgcaaaaaaaatacagtgtatgtaatattttcaaagcaagacaattggattatgttaaataatttctaaaaatgatgaaaaattctcttttatttaagacattaccatttttagatgtgtgttatttaattataaattggtttggttctgatttttctaaaacttttagttagcatgagttgtatgttttaaataataacagtcttaggggagatctaaaacactgtcttgtttgcctttatgtgggctttcctaagccccagtgcattttaaccactaattgtttcttggttaatacc

SEQ ID NO: 5052 - DNA, 1041 bp, Homo sapiens
agcttatcccctcatacatgtgtgtttatcatttatatatatgtactttgttgttgacaagttgagtacattataagacgttaaaaaacagtaaaatggatgagaaaaattaatgaatggaagtgctactatttttttccctgccccaactgatgtatgttaagcttctgggatacttgttgccccaccctgaacatgactaagcaagggatcatggaacaagaacagtagcaatggagagagtttggagagagaaattaggaggttgcattaacaggacttgaaaattggttaaataggagtaaaagaaaaggtagtggatttctggtttgtgtaactgaacagataagagctctgattaaagagtcaaccaacactctgatagatgctaattgtgttaaagtagcattctgccagaatgtggtggtttctctgagcatatactcaataatgcccttagtaacaaatggtaggagggcatttgatgggcaagtcttgatctgtgttcaggaagaggaagcagagcaatgaacctgaggacacaggttactcttgcctttggaggcattagggtatgacagcattggtaaatgataggcccctcaacttccagttgcctcttcaagtgtctttagctagaggcagggccattcatttcacgactaaaaataaacggcttacaaaacatggtggactgaggaacatattaagactattgccagtgcagacaaataatttttcagcaagttatcaactgatagaagtgattttcatattggcttagaagggaataaaatgcattcgggtcataagttgggagaggattgcaagaaataaaggatgggaaaaaaacccaatcatatatacagttttgccttaaggttgagtgaaaaaaaaaaggcgggggggaagatgtttatgatggtacattttcatgtgtagctatatatgcacgatgctccatttcctgagatatagaaaagtttttttatcacattttaaaacaaaatttgaaataatatttttgaaaatgtttcaaaa

SEQ ID NO: 5053 - DNA, 1049 bp, Homo sapiens
tttttttgtttttgagactgagtctcactctgtcgcccgggctggagtacagtggcgcgatcttggctcactgcaacctccgcctcccgggttcaagcaattctcctgcctcagcctcctgagtagctgggattacaggcacatgccaccaacgcctggctaattttttgtatttttagtagagacggagtttcaccgtgttagccaggatggtcttgatctcctgaccacgtgatccgcacgccttggcctcccaaagtgctgggattacaggcatgagccaccgtgcccggccaattttagaacatttttaaccacaccagaaagaaaccctctacccttaagtcattgtccctttaccccaattcctccatacctcccagcatctggcaactactaacataatttctatcactgaagatttgccagttcttgacgttttatataaatggaatcataaaatatgtggggttttttttgtgactggctttcaattagtgtactgttttcagggctcatacatcttgtagcatttatcatgcatggcattttgaaaagcaaatcttagttaaaaaacatgtatttatgtatctaggcatgctttcttagttttagttactggctcttattttaattgtgtgagtgtggtgtatagtgaaaagtaatggctaaatcttaagaatttttaaagcaaagattaaaatcaaagcaagaagccttcctcagattctttagttttttttttttttttaaataaacgttttaaaacttggtaaattatgtaaaggagaactgtgtagcattttcaatgccagattgaatgtaaacagggatgaattcttgaccaaattgtggaaatgtctgaggtttattctcttggtccaggctcagttttcttgcccagaattgccctatcttcactgccttcattttttccccacccctaagtatgttactgtagttatcagaaacctcatgcctttgtatttctcttaattctttttttctcctataaaagtgggagaaaacagacatggtctttgaaagtc

SEQ ID NO: 5054 - DNA, 1025 bp, Homo sapiens
ttcttgttcactaactgtctgggaaagctgctttagcttatgaagcctcatttttcatgagcgcagcttttagtcttacgttgtgggacttaagacatcttgtcctgccccaaggtgggaatgattaaatggctaaaaagaggcagatactatttttgtgataaatatgggtttcatgtctcatagcaagttattttagcctggagtttgttgtcatacagacactatattctgtctgcctttcattcccttttctctacttccttgtttctctggcagttaggcaccttataatctattgtctgatgcatgtccagctagtgacttcagttcttccaggcttattttacaataggcttgatctttattcagtggtgctacaatgacctgaggatgtcatctgtgattatttgcatgctttcttacatgaggatagtaatttgcatgtaattactttatctttattcatgaatttttatcctttattgctcataaattgaagaagcattttgctggatgttaaatagtcaaaaattgtgatacctctgtgtggaacattttcctcttaaaacaagaataaagagaggctttaatagtctgtcttgttttccactgatgataagagatgaattgcaggaaccacttccactctgatgagaccattcacaacacacagcagcagccaaacctgttccacgatttttacagcttaatctcggctgtgctttcgtgcatttggaagcgtgatggtgccctgtcaggtcgcccatgtgcatattttggggcattgcctctgagttaacattgggcattcctgttttcataatctaggtaaggtagaaaaattctaaggagtcttttgaagatggtgttgaatagcagtatctttgaagttagttggtatttcatatatgaaaaatattgtgacattatttcattaatacataaaaaattcctaaggggtagatgctgttctaatctaagagaagaaatgctgtagttaactggaattatttgtattcctg

SEQ ID NO: 5055 - DNA, 1043 bp, Homo sapiens
ggaaatgcaaactaaaactgcagtgataaagcattcatacccaccagaattgctaaaataaagactgacagtaccagttgtaatgttgcatagtatgtagaagtagcacaagctcttgtatactcttgtggaaatgtaaattactagaaccaatttggaaagctacttggaattttctactagagctgaacatacacatgtcctgtgatatttccactcctgggtatatgcccaacaaaaatgaatgcttgtttgtaccaaaagacatgcagtagaaagttcataacatcgcaatttttaatagcccaaactgcaaataatccaattgttcattaatgggagaatggttaaataaatatgatttatacaaacgactaccatagagcagtgaaaatgaacaaaccacagctgcatgcaacaagtggatggctcttacaattttgaggataagagagcagatacgtttaatacatgttgtataactccatttatataaaatccaaaaacctacaaaactcgattaataataggaaataaatctaatgaaagatacttaagacccctatatagatactcaagaccctcctcagaatgatatgttagtttttggatttcatataaatgtagtaatttatgatgttagaagtgtggctagtaccttttgggaggtgggaggagttaagaagaggggcttctggtgttgctgtttgatttcttaatcagggtactgacttcatgtgaacattcagagagatacactcttaggttgtgtatacttttttgtatttgtaaaacttcagcaaacaagttaaaatatatttaatgaggaaaatttttttttgttttgctgatttactttttttttttttgagacagagtctcgctctatcgcccaggctggagtgcagtggtgtgatcttggctccctgctaactctgcctcctggattcacgccattttcttgcctcagcctcccgagtagctgggactacaggcacccgccactgcgcctggctaattttttgtatttttagtagagatgg

SEQ ID NO: 5056 - DNA, 1030 bp, Homo sapiens
agtttagtgaatgaattagatactcaaatttagaagaaaccatttcttgtgttgcttatctaagtgttcttcgtggatcctgctctccttttggtcttttaattatactttattttttttggtttgtcttcaccattagactgtacacataaagacaggaagcctctgtcttgtccattattgtttccagcacccaataacagcactgatcgttgactgactcctaggtttgtgtggctatgtggaacacttagcatattttaaatattgcaagtttgaatattttattttattttttacagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtaaggctttactacaattgttgttaaaaatgatttagtattacaaaaggacttggcatattccgtaaaataaagtagttttaaaactgtaatcaaaatagtctctctctgggaaaaactgaatataaaattgtctctccaccctttctaccttttatgaagcctgaacttaaacgaagatttagaacaagttgtacaaaaatagaaatacaagttcttttatgatgaattttcattagattttctggccttcaattagtttttgaaatctaaagcaaattaaggacaaacaaacaaaactctacttaagtggcagattgtatgtttatggaattaatttcctgccaatgtttgggatatggggttagaggagggagttgaaagtatagatagtttcagaaaatactgttaaattcacatgtgatagaaaaatagtaggtattgaggttgctggaatagtttggcttttgcagttcatgtctggggcgacagctaagcttttactaattcctcgctctggatttcttagaaagtagctggattatctgattacttgatttct

SEQ ID NO: 5057 - DNA, 1050 bp, Homo sapiens
taagactacaggcatgtgccattgtgcccagctgatttttaagttttttcatttctgtagaggtgggggtcttgctatgttgcccaggctgcacagctgattctcaacctctgggagcagaacagtgcagagtgatgagttgaggagctctgagcatttagagtgctagtggtatggtttgtggatgggaaggggaggagtggagagattgtccatttgggcattggaggtcagaaaaggaagctttcactgtcgtatttcagggctcttactccaagtttacagatgtttactttttatacttagtatctctcaccacttttcaggccacttctctcacaaatctttaattgggagagagacagtgccagtccttcctgggtttaacatctgatattggtagagatgatatgcacaatatattgtgagagcacaggaaataagttcttgttttgggggagtgtaaagctttcaagaagaggtgagtttctgaattctcaaggacagatcagaattagaaggtatctgggaagatgaaaatggggcagataggtcaggaagaggggaaggcgtgttattgctgtagttttagactattttgaacaccagtgtgctcccagcactaggatggtagaataatgtctggcacacattacatgcttaataagtattttaaagaaaaaataaatgttgaggaagacagaggcccaattatagtggaccctgtacgtgatgctgtgaagccagagtttatcctgaaatgagtctttgaggtatcttaaccagaagagtggcatgatcagattttatttataaaaatatccctctggaagcattgagagggaagaataagattgcagtgagagatacaggtaaggagatttttgaaataagccagttgaggaactagggagggcccaaattaaagcttttgagcattgagcattgtgaacaaagggtactgatgcattgtaggagtcttttggaaatagaattgacagggcttggtgactgtgtgtgtggagcagtgagggtcacggaggattctgg

SEQ ID NO: 5058 - DNA, 1035 bp, Homo sapiens
gacacagacttgctctattgccaggctggagtgcagtggcacgacctcggctcactgcaacctccgcctcccatgttcaggcgattctgcctcagcctcctgagtagctgggactacaggcatgcgccaccaagcccagctaatttttgtatttttagtcgagacggcgtttcaccgtgttggccaggctggtctcaatctcctgacttcgtgatccgtccaccttggcctcccaaagtgttgggattacaggcgtgagccactatgcccggccccaacttttctttcaaagtttgttgaaccattttatactctcaccattgctgtgtgggagttagggttaaaccatgttttagccatcctgctggttatgtagtggcatcttattgtgattttaactggcgtttccctgatgattaatgatttaacacaaatttactgagcatttatatatcatgttttgtgacatctgttcaacttatttgcccaatgttttattggttgttggagtttcagaaatgttggattcatgtcagatttatgtttcgtagatttttttcttcatctgtgccttgcctatgtatgcattctctcccttttcccctcctccctctctttcttcctgtaacagctttattgagaaaaaatttatatactctatgcattttcttaaaagtgtctttttatgggagaaaattttaatttgccttttttccctgtaattattgagaagagcttttgccttcctgtgatgatttttctcctaggtttccttctccaagtttatgggtctagcttttaggtttaaatcgatatatcttgaataatttttttgtatggtgtgaggtatgcattgagattttttttctgcatgcatatccagttgttccagcaccacttattgaaaagattatcttttctccactgacgtctttttaaaaaattagttgtctttatatgtgttgatttctggactctgtcctgtttcattgatatatttgtctatttttgaggccactaccataccctcttaat

SEQ ID NO: 5059 - DNA, 1050 bp, Homo sapiens
tttttttttttttttttttttttttgagacggagtctgtctctgtcgcccaggctggagtgcagtgacgcgatctcggctcactgcagcctccgcctcccgggttcaggcagttctcctgcctcagcctcccaagtagctgggactacaggcgcctgccatcatgcctggctaatttttgtatttttagtagagacagggtttcaccatgttggccaggatggtcttgatctcctgacctcgtgatccgcccaccttggactcccaaagttctgggattccgggcatgagccaccacacccgactgttttttttttttttttaaacgtagtttcgctcttgtcgcccaggctggagtgcaatggcgcagtctcggctcactgcaacctccacctccggggttcaagcgattctcctgcctcagcctcctgagtagctgggattacaggcatcaccaccacgcccttctaatttttgtatttttagtaaagacagggtttcaccatgttagccagactggtctcgaactcctgacctcagatgatccccctgccttggcctcccaaagggctgggattacaggcatgagccaccgcgcctggcctgaagctttgttgaggtatagaatgtgtgagaaaaaaatgtatagtccatgtgccaatgattctgataacacaaaatatgcttagcaacaattctataataaaatcatcattgtcatctggtcttaacttaaaaagtgttatagcattaataagctgtctttaatagttcacctgaaaataagaccaatgaagccaatggaaaagtaaatgtattttataaaagattctaattgaactattcctaactagattctcctttgcagaaattgtaggatattatattttctaggtaatatttagatgcttattcttgctcaggaagtagattatggggcttctaggtggagaggctggcggtagaaaggctgttttggaggctgttgtaatctaggaaagaaagaatgcattaatgtagtggcacagtggaacagagtggaggaggtgtt

SEQ ID NO: 5060 - DNA, 1026 bp, Homo sapiens
cctcaggtgatctccccaccgcagcctcccaaagtgcaaggattacaggtgtgagccaccgcacccagccagcaatcacattttaacttgagatttggaggggacaaacatccaaaccatttaagtcacagcactttactccgcagtgtgaataacacaggcattctcctacataatcacagtacagttatcatactctggaaattgaatatcatctaatatactttccatacccagattttcttagatttcccaatgatatttcttactgtcctccctttagccttcctctttctccattcaggattctaccattacatttcattttcatgtctcttcagtctctctttagctttgtttttctttcttgatgttgccacttttaggaggccaggccagttgttttgtgaaagatctgttctctttgatatgtttcattttggatttgtttcattgtttttgcatgaatggattcaggctaaacatttttgggcaggactgtttattgtattacctagtgatgtgttcttttcagtccatcatctggaggcacctgatggcagttttcccaatattgcgaaattaagtttgattattttgttaaggtagtgtccaccagatctctccattttaaagacatccttttctctaattactcagtggactgtagagtgatgctttgaaactgaataactaacactccctaactcagtgatttagcacccgttgattttttttttttgcctgaatcaaatattattatagtagttttaaatggtgattttccatttctattcttttgttagctgccattcttctataattttgtctttatattttactgggtgttaagattgctattccagctttcctttgtcttttacaccttttcccattcttttatttttttccatccctttttgtcctgttttccaatagatggatagaattttctttctctggtttaaaggttatacatttgtgtgtgtgtgtgtattcttagccatttgcccttaaaacatagag

SEQ ID NO: 5061 - DNA, 1047 bp, Homo sapiens
atttctcttcttttggatcttctttgtctttttcttgatgaatcttactagaattttatctaggctattaatatttaccaagaaacagcttttggttttgttatcttcttaattgttcatttggactagattttcattgatttctgtcctttattatttctttcctttttatttatttggcttttctttgttaggcttttcttttttttcaccttcttatttctggtaaatgtttaaagccatatattttcctcaagttcttccttggctctaacatatattttctaaatgtttcctgatttttattgatttcctttttaacgtaagggttattaagttatattttttttagtttccaaatttgaatatttataaaaattattgattcctgagttcattgtattatatcagaacataatctgtatgcccttgtgcctaccacatggtttagtaatataaatgtttagggtatgtgagaaaaaaaatgtatccccgtccattgggatgtatttctttgacctaaggaagtgtaggtcattgcttttaggactttcttttttaatataagtattttgtaattggaaccttctcttttttttttttttggcggggagatggagtctcactctgtcacccaggctggcgtgcagtggcgccatcttggctcactgcaagccccgcctcccaggttcacgccattctcttgcctcagcctcccaagtagctgggactacatgcgtccgccaccacacccggctaattttttgtatttttagtagacacggggtttcactgttagccaggatggtctcaatctcctgacatcgtgatccgcccacctcggcctcccaaactgctgggattacaggcgtgagccaccgtgcctggccgtaattggaaccttctgtttgtactgttgagaacttgaatttttttgcttatattttgtctgcttgatctatcagtagtctgaacagagttgattaagagtaattgttgatttttctctgacagttctgttaattgttgaatatattttaagacctg

SEQ ID NO: 5062 - DNA, 1044 bp, Homo sapiens
accacagacccagtggcttaaacagtactttcctcacaattctgaaggctagaaggtcaaggtgttggcagggttggttccttctgaagcctctttcttggcttgcagatggctctccttctctgtccacagtgatcttccctctgtgtgtgtctgtcctaatcttcttataagggcaccattcatattggattagggcccacctgtatactcagtttacctcagttacctctttaaggccctgtcttcaaatacagtcacattctgaggtaatgggggtaaggattttcacatgtgaatttggtgggtgttggaggggcacagctcagcacataacaaatatttttattatctcatgcatttaaaggagtatcatttctgatacacttcagaaaggaatgtattagtgtgatgaagtggaaataactcggacattgtagtcagataggtaggcctggtttgaactctagccttgcctcttaatagttccctaaatttttgtaacttctctgagacttgcttccaaatctatgaactgggagtaactgtacatcacagaatgatggtaagaaattaaggacgatgtatgttaaaagtgcctgacatcgagttgacttctaaatattatgttcttactggtcttttctctcccccactccccaaagtagtgttttgtatccttcccccttatttaatatcagaaggtgtcaatttcgagtgtagatatgtatcattttaaaattgcttagtctttctattcacaagtggttgaatatcagcagtttcttaagattcaatctacaattgtatttacccagtcgcttgtcagaatttccaatcatcatgtagttcagtttaacattttacatgctttaagtgaaacctacagaagtgtaatctgctgagtcagtggatattcacgtttcaaaggttcttgatgcataaggacaagagcctttgcttttttatcagcaaggtatgaggatgcccttttcccactctaacattactgttttctcctaagtatcaaagtctaaaaggata

SEQ ID NO: 5063 - DNA, 1020 bp, Homo sapiens
aggaaaaggtgagctattgtggtgaggccttcacaggtctgtgtgcctggcactctcagctgcattattcaggaccttgggctgtacgtagttattttattggatttgtgtgagaagggctagttttgtgattggttaagtttattgaaaataatttttttttttttttttttttttttttgagacagagtcttgcactgtcgtccaggatggagtgtagtggtgttatgttggctcactgcaatccctgcctcctgggttcaagggattctcctacctcagcctctcaagtagctgggactacaggtgcactccaccacgtccagctagtttctgcatttttagtagagatgaggttttgccatgttgactaaggctggtctcctggcctcaactgatctgcctgccttggcctcccaaagtgttagaattataggcgtgaaccgctgcatctggccaaaagttgacttattttgaatggactacattatagcttaactagattgtacgagtgcttatcaactaatatgttaaaatatggtaattcctttttttttttttttgagatggagtcttgctctgtgttgcccaggctggagtgcagtggtgcgttctcagctcactgcaacctctgcctcctgggttcaagcaattctgcctcagcctcccgagtagctgggattacaggtgcctgccaccacgcatggctaatttttatatttttagtagaaatggggttttgctgtgttggccaggctggtctcgaactcctgaactcagatgatccacctgcctcggccttccaaagtgctgggattacaggcatgagccactgcacctggccaaaatatggtaattctaataggtcacattcaggtgtattttttttaatggtctaatataacattaaaagtatttgtgaaaaattccattttggtattttaagcataatctatccaaaaggaacattaaaaaataataataaaaggggaatgtgaggtttaggtttttaagatgttc

SEQ ID NO: 5064 - DNA, 1050 bp, Homo sapiens
tttaaactaaccttttttgactgtttcaattttagatttatcttttgacttgccatgatggaagatagtggtttagctgttttacattctcctccccacgatgcatactttccatcttctctatatggttatataaccaattttggttaatcaaagtttatataactattcacattggagccatgctgtgtactattttaatatggttactttttttttttgaaacagctttttgttttagctggatttaatgaatctttgtgtttatttgttttccatgcattcatcacttactcagctcagactatactactaaagtttaactctccttttaatataataaacacatcaggtaatctttcagtttcttttttttttattttggatacctctaactttgtgttccagttgaactgattgccttcttggcttgcttcctggagtgggatttttaccattttcatgggaattctttcagccttattctgttgcttttcattgtagctcccttagaaataaagcatgggaagcaaattctttgagacttagaatatttaagaatatctattagagcctactcttgatagataacttggctgtatttacaagtcaaggttggaaattatttttcttcaaaattttgaaggcattactcaagtgacttgtttctagagttgctctgaaaagtctgatgtcattttgattccaagacccccctccttttttttttttttttttttttttttgagacagagtctcgctctgtcgcccaggatggagtgcaatggtgtgatctctgctcactgcaacctccgcctcccgggttcaagcgattttcctgcctcagcctcctgagtggttgggattacaggtgcctgccatcacacctggccaatttttgtattgttagtagagacggggtttcgccatgttgatgaggctggtctcgagctcctgacctcaggtaatctgcccgcctctgccttccaaagtgctcagattacaggcgtgagccacggtgcctggcctccaagacccttataagaaagc

SEQ ID NO: 5065 - DNA, 1191 bp, Homo sapiens
accagagatcgcgccactgcaccccagcctgggcaacagagcaagactctgtctcaataaataaataaatacgtaaataaataaataaatttttttttttggtagagacaaggttgcccaggctggtctagaactcccaggctcatacagtccttccacctttggctcccaaagtgctgggattacagggactattatcttttttcaacttgaaatttttattgaaatataagatgtacagaaaagggcacatagcaccaactcagtacacatgtgtaaccatcactttatgccctcttctagtcacagtctttcaccaaagagtaaccccacctgacccagaacagcgtcaattagttttgcctgcttttgtactcatgtgaatagaatcacatagaacatattctgtatctgcctttttcggcctaacgttagatctgtgccgttcatctgtatcattcattttattctattgtgtgaaatactagtttattcattctaaggttgatggacatttggattggttgcagtttttggatcttataatgtcgtgaatattctgctatttgttttttcttgagcgtgtatgtgggccaaatacagcttttggagtggttgatcgtactagcgttaaaatgtcgccattggtgtaaataattcctctactttgttggctgtttcttttttttcttttaattttagttctgtttaggcatggagaagttgtaagtggttttcttttgttcatttatttggttagttttaagtttggattgtgaccccttcatccagagttttaaaattggaagtcagctctcttgagtcacataatcttggtatgaagtttaagatgaatgaaatgcaagcatacttgggaaaaaaaagaattttttttactggggacctatcgttcttttcttaccaaatgttaagagtatcccccaatatttttatagtaattataaaatcacaaatttattataaccccacagtaggtcctagagactaactggaacagaaagcaatattgttttaattgtttgatctttgagctctagtaaacttctctatcttttcttattttcttttaaaattacaaaataatgcgtacatattataaaacatttgaaagttacataagaaaatcaaaataatgtcactacttgagagaaaatcacgttagtacataca

SEQ ID NO: 5066 - DNA, 1080 bp, Homo sapiens
gcagcgattgggggtacatcccaggtacaggagatcagaaactcttgctcttaggacccttccagaccttccccatgtgtctcttcgtctggctattcatttgtatcctttaaaatattagtattggctgggcacagtggctcacacctgtaatcccagcactttgggaggccgaggtgggtggatcacctgaggtcaggagttcgagaccatccttgccaacatggggaaaccccgtctctactaaaaatacaaaaattagctgtgcatggtggtgggcgcctgtaatcccagctacttaggaggctgaggcaggagaatcacttgaacccagtaggtggaggttgcagtgagccgagattgtgccattgcactccagcctgggcgacagaatgagactccatctcaaaaaaaaaaaaaaatctttctaataaatgggtaaacataagtaaagtgttttcctgagttctgtgagctgctctagcaaattaaactctggggagagcttatgggaaccctgatttagagctattgggccagaagcacaggtcacaacctggggcatgagattggcattagaagttggggtggtcttctgggactgatcccttaacctatgggatgtgatgttatttccacatagtgtcagaattgagttaaatcataactcacttagtgtctgccagagaatctggtgtcaggagtgtgttgtgtgagagtagaaaaaacactgtttttttccccatctttaataataaaatatgctataaggtgtagtagagcattatcccttattaggaagagtttataattagttatttttgttgttatggctgaaccagacctttgctttgttctcagaaaatatctagcaaagttacacattttctttggttcaataagtgttgtttgttgatctagttgtatatttaaaaatagtgttaaaaataaaatatgtgcttattacacataaaattgacaaactgaaaaagtagaaggaacaagttaatcaacaaatatttattatcttcacaaatatttattattaccaccaggcactgttctctgccctggggaaat

SEQ ID NO: 5067 - DNA, 1003 bp, Homo sapiens
cggggcggccgggcagagacgctcctcacctcccagacggggtggcggtcgggcagagacactcctcagttcccagacggggtcgcggctgggcagaggcgctcctcacatcccagacggggtggcggggcagaggcgctccccacatctcagacgccgggcggccgggcagagacgctcctcacttcccagacgggctggcagccgggaagaggcgctcctcacttcccagactgggcggccgggaagaggggctcctcacatcccagacaatgggcggccaggcagagacgctcctcacttcccagatggggtggcggccaggcagaggctgcaatctcggcactttgggaggccaaggcaggcggctgggaggtggaggttgtagcgagccgagatcacgccactgcactccagcctgggcaccattgagcactgagtgagggagactccgtctgcaatcccggcacctcgggaggccgaggcaggcagatcactcgcggtcaggagctggagaccagtcgggccaacacggcgaaaccccgtctccaccgaaaaaatacaaaaaccagtcaggcgtggcggcgcgcgcctgcaatcccaggcactccgcaggctgaggcaggagaatcaggcagggaggttgcagtgagccgagatggcggcagcacagtccagcctccgctcggcatcagagggagaccgtggagagagagggagagggagagggagagggagaccggggagagggcatcagagggagaccgtggagggagagggagaccggggagagggagagggagaaaagtattactcttaaggatttgtgtatggagaagggtattgaggttgtggaatagaggtaggattggtgttggaggaagggttacttaccttatggaatcggaaatttgagacaggtttctgagtgaaaataggtaaatgtggtattgtaatataataagaaatacatatttggtctctgttcctggttcctggcaca

SEQ ID NO: 5068 - DNA, 1826 bp, Homo sapiens
tgacctcaagtgatctgcccgccttggcctcccaaagtgctgggattacaggcgtgacccaccgtgattggcaagggtggtgttttgctaactgtaggttagtttttctaactgtaggtttttaacaggatttatcacaaatgaaagacaatagaaaatattcaggaaacattgcacatggtaatggcaagtgtttcatgaaacatttagtgtctgtgcatttgtgtgtgtgtgtgtgtgtactgggttgtatatgcagtgtatttatttatcacaggccttaaacatttgagtaatgctgatttgggagatgaattgatgtaggcttggcatcttggggatagaaggtaagccattgtaggggtcctcggacttctttaaccttttgccctcctattgtgggccagaaagtaggccttctctctctccactggtgccatcaaactcctctgaactctggctcatgtctttcctttacctgcatgtaacgcaatgtaatttagtatagagtagaatcctttggaatttttttaaaggtgattcctggtagttgctggtataaaggtggttaaaaacagaaaacctaaagcacagagatagtgttctcatttaagtgttttaagtagaacatgaaactttctaagttgagtttttgtagagtgatcactgagaattcatctatatttcagaggaaaacaagaaagactggtaggtaggcacttgatagatttgtggaatgggtggagacagttctgagcacctgtctaggatcagtgaactacgtattagtgaatatgaagcagaagttgatagtaggaacagagaggtgattatcttcccctttttttctgtgctgtactatcttggagaggtgaggagaaaaaggttccaaattggccactagatgattgaaagaagtccctgtggccaattttgtatctggatgaccattcttttttaagtgagatgcgtgaacctttcatataaagagctgctggcaggatattgttttattaggttttagggatattggcccatggttcactttttctttctccccagtttttggaaaagttgattgctagtaaggctgattgctttcagggaattgtcattttcctccgggggatgtttggatgagaatggagaccagtttggcaagggcaacagctgttgaacaatctgtttgggattaggtgcaagttggtatgtagtggaaatctgcctcctggttcctgaaattatgttcctttgcctcaaggataaatgttttcctgctcattccagttacattcacttagttctggctggtaatgcttctgactgataactttcctcttttaagagagcttccttgaaagaataattgatagctacgatgaacaattaaaaatgttatgccttcccttaagattttgctcaggatttaatcataggttggtggtaacagaacctttcagttcaaaattagctgtatattatctaaccattttggtaaggggagagacttaaggtgctttctgatggtttagatggcagtatcacatgagatttattcatattgtgtgttggaatgtaaattctaatgacctttggaagcattagtagtaaaatttacttagctggctattcctaagcttactagtgagttggagttgcatgcgtgaatcatacctctgaccagttgtgatgatacaaattaagttgagtttaaggaagagactaaattaattgccatcctgtcaccacactgtccacttagcactgtacagctaagatcctttcagttttttaaaaaatacttttttaataccacagatataaga

SEQ ID NO: 5069 - DNA, 1050 bp, Homo sapiens
ggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactgcgtctcaaaaaaaaaaaaaagagagatagatttaaagaagtaattcccatggccatactgagtcagaagggtgataagtataatgagaatggttggtgtgaaaggtcacaccaaggttctggaatttggtaataggatgatagcattgtcactcttaaaaagatgattaggcaagtggacatgggtgaagattttcccaaggagatttgttttaattcgggacacattttatcaaatgatagtatatcaccataaggaaggaggctttcaaagactacaaaggactatctccacacttttttttctttttttttgatggagtctagctctgttacccaggctggagtgcagtggtgagatggcggctgactgcagtctctgcctcccaggttcaaacgattctcttgcctcagcctcctgagtagctgggaatacaggcgcccgccaccatgcccagctaatttttgtatttttagtagatacggggtttcaccatgttggctaggctggtcttgaactcctgaccttgggtgatccgcccaccttggcctcccaaagtgctgggattacaggtgtgagccactgcacccggccctatctccacatttaaggagcttatgatctgattgaagtgaacataccttcagaaaataagatagatctgatagaaagtagcaggctgagattgaggctccagatttggtaattgtgtgaaaacaagaatgaatcaagtatcccaagttgcatggaaaagtagtgggtttgtattagaggcctgggacatt

SEQ ID NO: 5070 - DNA, 1077 bp, Homo sapiens
tgcactccagcctgggcgacagagcaagactccgtctcaaaaaaaaaaaaaaaacccaacaaaaaaacactacttgtcgggtactatgttcacaacttggggggcaggaagcccaaacctcagcatcatgcagtgtacctgtgtaacaaacctgcatacccctgaatctaaaaaaaagaaaaatttgttaatggaagtattatcatatttttgaatatacaagtgaaattatgagtctttgctgataaagacttaatttctttttttcttttctcagtcaccaggttagtactggtgagctcaacaacataaatgagatagcctgtaatctaacagccttagaggaagcatttttaccaatattaagccaaacagaaaaattgggaaatataatttagaaaaacaagggaatgaatttactttgctaattatagacaaaattaaaaccacctttgttttatttttctctaagcctgttttttcagagatctcttaaatccgtagtaagaactctagtgtcttgaaaaattctatctgcctttcttttgcattttagcataatccagaaccttttctgtaataaaaagttcccctacttttaaagccttaacttgcaagtttttctgtttcaagttgagaaggttctgtaaactgggccatggtgggggtgctggagtggaggatttctctttatgtcttatccctgtgcccctcactgcttctagttttttccttttgaaatccatccttcgagttacttcctggtgcaaattactctctgtgatcccctatcccctagctcttataagctgcccttacatgcttaaggcttgtggttatgtcattctgccatagtgctatggtctgaatatgtgtatgctcccaagattcttaggttgaaacctacccccaaggtgatggtattaagagggtaggggctttgagaggtggttaggtcaggggagcttgctccttttgcccttctgccatatgaggacaaatagaaggtgccatccatgaacagcatgccctcaccaaacaccatatctgttggcaatttgatcttggacttcccca

SEQ ID NO: 5071 - DNA, 1060 bp, Homo sapiens
atattttcatacaagtttatacttaggtgtttcagtaacatttttcccaaagtttcagacataaaaataacgcagggggctaaattataaataatatcaatttaagacacattgtattaaaactgtctttctcattttgtaaactgtagagcccataatttttcttttgataggccagaagaaagtttacctatttccttcccaatgactgagaacaaaaattctcactagaggattttatttgtgtgtttttctcatatgatatgtacttgtgtcgtgaaataccattcctctttctcagtttagtgtctcatatgtcagctgacaatgatttgaactgtattgcatggtgatacaacttgtccactcagctcattttcactagtatcagtgcctttgtagtgtatttatttgaacgctattgtggttttgcctttataaaaataactagagaatagaagaaaggaaatgttaatgctaacacagttgagataaagatggaagtcacttggttttccaaaagtggtaattctttggtgttgtagtctgttcttgctgctataacacaacatcttagactgggtaatttataaacacaaatttatttctcacagttttggagcctgggaagcccaatattaagttgccaagagattcagtgtttggttgaatgctgctctctgcttcatagatggcgccttgttgctgcattctcacatggtagaaggcacaaaggcaggagggcctagctcttttttaagggcataaatgccattcacgaggttggaggccttgtgacctattcacctcccaaaggccccaccttgcaatatcatcaccttggtgattagtttcaacatagggattttggagagacacatacattcaaactgtagcatttaacctcagtagaacgatacccagtttgtacttaagctgactgtttatcagacaagatttttttgttggcactgatagaaactcaagttagttctcctggtagaggcaaagtgagagttgctggagctagggcagcttgaggacctcaaagatgagaaca

SEQ ID NO: 5072 - DNA, 2253 bp, Homo sapiens
gcgatctcagctcaccgcaacctccgccttccaagttcaagtgattctcttgcctcagcttcccaagtagctgggactacaggcgtgtgccaccacgtccagccaatttttttttttttttatagtagagacagtttcactatatgttggtcaggctggtctcaaactcctgacctcaggtgatccatgcgcctcccaaagtgctgggattacaggcatgagccaaagtccctggcctttgtacagatttgttttgcatacttctcagccttggtggggttaattgtggcttggcaaatcaagaaaaggagttctgtgctgttttcagactgcagaatcttgttgctatgcaacaaaaattgtcagtcagtatagggtatagtaaattggtattctctgtcccttttcaccacatgctcattttgtaatctgagagaagtggtttggggctagtttgcaaggttttattttaaaacaagcatttaaaaaattttgttgctatttgtaattggttatatttaaggtcggtgaagtctttctgtacttactagaagatacaataaaatgctagtgttcaaagggtttatagatctgtttccaagttgtttcaggttagagcagtgtatttttgttttgttgctgtaacaggggtaatattgccaacttccaaagagtaaattttagcttgagaattcaagttgtataatttgaacatcagaagtttattgtaagcacatcatattatttttaaatttatttatgaaaaacatgaacccaaaaaacccttttattgataaagttttttaaataggaaccctaaacttgtatgaagtctcatgtatgataatttattttctgccaggagaaattaaaatgcctttatagcaaatgggtgatggctaatagccttctaaaaattgtgataaaatatatataacacaaaatttacaattttaaccatttcgagtgtttcacatagttgtgcaaatatcaactgttcatctcctggataacaaccttttgcatcccatttagtaacttagtccagactgtcttctaaatcctttaattcgtttaatcttcgtaagaaccctatatgtacgagaagtacttttgttccaaatgagaagagtgaggcacaaaaaggaacacaaaagtagtaattagtggagccggaattcaaacaccaacagtccaactcttctgtgctctcaactattatgctatgttaccctcttttggaattactttcttttttgtttagtggttaagagcattgatttaaaaaaaaaattactttctgtagcttttccaagtaaagttaatacagtttaacagcattttggactgttaacaaatttagtttggctataaatccctgcaatcttctagacattttttttctaaatatttcaaaaggatgcagtttatgttattttatattgtgttatttgtatatgaaattatacatattatggttaattatatagaaaggacttactttcctttttcagtttgtttctggaccatttttcatgccattccttccaatagagaatgcaaatcattttctggtcatttaatgtaaataggaaggtacacttgctgttagagaattttaatatgatgccatccaaagactaaagccagttggcattggatcatccacttagtattctctaaatttatgatcttctttttcacgaataatctggagttaattgtagtattggcagtttagaataaagagcaatagggaggagtaaaaagggagaaaaacattgcaaggagtcattaacttccaattgatgaatagggatgagtttttgcagactctgctttttttctgccatgtaatatctctactaccattcttaagcatccttaaggagcttactttcctttgattttttttccccaccttctacttttttttttttttctgggacagtgtctcactctgttgcccaggctggagtgcagtggcatgatctcggctcactgcaacctccgcttcccagattcaagcaattctcctacctcagcctcccgagtagctgggattacaggtgcactccactaccacctggctgatttttgcatttttagtagaggtggggtttcaccatgttggccaggctggtcacgaattcctgacctcaaatgatccacctgccttggcctcccaaagtgctgggattataggcgtgagccacagcgcccagcctttccctgccttcttttctttcttcc

SEQ ID NO: 5073 - DNA, 1049 bp, Homo sapiens
atataatgtgcttttaaatcacattttttcagtcaacatatacagtattaaaagtagagcaattattcatgaagttaaaaggtcttttcatctttggaaatgttgagaaccactttttttttttttttttgagacggagtctcgctgtgtcacccaggttggagtgccatggcgtgatcttggctctctgcagcctccgcctcctaggttcaagagattctcctgcctcagtctcctgagtagctgagattacaggcgcctgccactatgcccaactaatttttgtattttcagtagagatgggatttctccacttggccaggctggtcttgaattcctgacctcaggtgatctgcccgctttggcctcccaaagtgctgggattacaggtgtgagcccctgcacccagctgagaaccactgttctacatagatgttttctctatttaatctgtttcttaggcggagattggcagccatttaacattctcaaaataaaggaggaaacctctaaacaatgaaagtatttaaagctaccgcaagaataactgcaatcttgttttttgttctctaggtgaagtagaattttgtgaaaaaacaaaaatgttttgtgaattgttactagttacctacaaaggcaatccataaaaatagtacaaacaaattgtgagtaggagaaaaacttaaactgttaagacattatagtcttttcttataaattataatttttagaaaataaactgaagggatcaaatgatgtctttaaaattaggaaacaaaatctgtgggtatgctattacctaggattaaaaaaacaaaacaaaacaaaacaactaactcttgctagatgatgctttcaaaagaaatgtagtccaaaaatgagcactggcactttttgctggtacatggagaaactttgagagtgaaggcatattaatactttcaagttgtaaataggctggaatttgggcttgtgattttatagttttagaatttatatcattagacttttaatattggatattagtttatgccttttttttttttttt

SEQ ID NO: 5074 - DNA, 1050 bp, Homo sapiens
gactttcccaaaccttaatttctttttttgcaaaatgggattaataattcattgccttgttttgaaatttgctataatgtagttagagtttttatggattgggcatattctgtttattgttttctttgtattgtaccatgagattaaaacaaaaaataaagttcaagcttctgaatgttgttttgccctttttgcttgcttgctttttcttgttttgagacaaggcctgactgttacacaggctgaaatgcagtggcgcgatcatagctcactgcaacctggaactcctgggctcaagccatccttgcacctcggcttcctaagtagctgggactataggcacctgccatcacacccactgttgccttttttaacttaatatgaaagtttctgttttttaggcactctgaaagcaaatagccagttaaattcttagagtacctgtattttaaaatgatgtttataatttaagatgaatatttaaattaaaaaccagcacccagacatagaatggttatttgcattacttagaactaagttctccccctagatctgtcaccctaccttcccttcataatgtgtggttcccgtgtggtcagccatcctgtctaaactttctcctgaaaaaaaggccatgcacggtggctcacgcctgtaatcccagcactttgggaggctgaggcgggtggatcatttgaggccaggagttctagaccagcctggctaactggtgaaaccccgtctctactaaaaatacaaaaattagctgggcgtgatggcgcatgcctataatcccagctactcgggaggctgaggcatgagaatagttagaacccgggagacagaggttgcagtgagcagagattgcaccacttcactccagcctgggcgacagagtgagaccctgtctcacaaccaagcaacaacaacagaaaacaaaaaaaaaatctactgaagaaaccttcccctgcaccctggagcacacagaagagatgtcttaacttggcattcagggccctcgagaaacagttcagcagtgcctttcaatac

SEQ ID NO: 5075 - DNA, 1058 bp, Homo sapiens
atggccgaatcacttcttagtactgttacagttaaatttcaacatgagtttcaagattcaaaccatagcagctctcttaaggtatcatttacatacagctaaatgcataaatcatgtatacatatagcttggtacatttttactatgtatacatacctgtgtagccaccaaccaggtctggatatagaacacacttaggccattaagttccctcatgccccttcccagtcagtatctttccaaatactcatttttttcagttgctttgtaaagagttttcatcattttcagtgacttcataaaggcctacatcttttggaatgtttgcactttcactttgtagatgatatgcattgtgttgctttgtaattgaaataacctgtcaatcattgagagactgacagggcaaaggtgaaatggcctgacatagaggctaatgctgctttgggagggatgtttaatggggactgatattataaatgtttagttcattagcggatatttttgtgttaagaatacttttgcttccctggcaacttctgtgtctgataatgaactttgattttaagacccttgtacctattttgttctgtattacatttttacatatatgtcgttatagattctctaatttattgcattggtctattattcctatgcaatctgttagctgtgagccgttagatctttatgaaatttagatttgatcagctcagccttgagtctgaactacttcagtgccttcccattgctcttggaattaagaccaagctccactaagctcctcctcattatggcctaagtcctgcacaattttactttctcagtgattccaaagtaagtaaaatgacccaataagaaaaatcctcaacaataacttacaaaaaagtaaaaatgtgcataggtatgacccattgccttagacttacagtttagtgggggaggagacattaattttcaagagctggcagagcatagtggctcatgcctataatcccagcagtttgggaggccgaggtgggtggatcagttgagcccaagagttcaagaccagctta

SEQ ID NO: 5076 - DNA, 1047 bp, Homo sapiens
actgttatctcttacctgaactattagtgtttcctcatttccattcatgtcccctgttcttcatgcatcactcagaatactcttaaagtggaaatcagatattgttatttcccatgtaaagccttcagcggcatcttagactaaaacccaaatttgtcataaaaccaaaattattaaggtcttgcgtgacctggctctgcattccaagttcccagcacaggcctctgtgagtatgcataagtatttgagtgaataataaacaaaatgactaaagggagttgtatcagtttttgatacacgttaccagataagcaagagtagatgagatttctagttaccccacattctggccagctcaggccattatcggtcttttaatctttgccaatgtgataggtaaaaggtgttacctcattggtttaatttgtatttctttgattacctgtagggtctctttgtttgtttattggacagctttatttttgtgtggatgtctgttcatgtgctttttctgttttcccaatgagatgtgtagtttttcttctaatgatttataataatgaggatattaactcttcatagtgcatatacatatatcgtatccgatattactgctgtttaacaaagcatctcaaagcctagtaaagctgttacccgggctggagtgcagtggtacaatcatagcttactgcaacctcgaactcctgggctcaagtgatcctcccacctcagcttcctgagtagctgagactgcagatgtgctacggattggctgggcagctcttcttacctggactcattcgtgtgttttccttcacttaggttcatctggtgtgtctatcccatccctctgcctcatcgctcacttaacaatagcagcctcctcatgacaacatgccctagtatgaaagctcttaccagacctcagcttgcatcctgtttgcttatgtttctttggccaaaacaagtcatatggtcaagcccaaagtcagtgggggaggtgattacacaaggacagatcaagaggtgcgattcattggtggtcat

SEQ ID NO: 5077 - DNA, 1050 bp, Homo sapiens
cttagaggtcctcagtcttctgtcctttttggtatctgttacatttgcaacttggcagcgggggagctttatgaagaaccaagaacttaagtaaaataaaatgaatagctcttgaggtcaaatctcaagggagtccaaattgctccttttacagttcagtgaagggatctttttatgcagtcttaataattattatatactggttatttgaatatctgctttgttctgcagtctttctcctcctcccccaaattctcatgttagactgatattgcaagcaaaattgtgaccgttcagtttttaacaatttaagatttatgtatcttaagttttcatttaaaacttttacttacagtctacttaattgtggtctttgcacaatttttttagaattatttttagaaaaataaatcaattactgttgtccatatgtctggtcagtatttttttaaattacttttttccttccattgtaaagtagtacagattttgaacagattttagaaggtatggaaagtataaaacatttatttatgaaatgttaaatccaagccatctagtattttaatattttaatgtgtagatttctaaactttttgtagtgcatttgcagcattgcagatcattgtgcgtgtgcatatgattatatataaaagtaagattatactatttaaaaatggaattatactatatttgtattgtgtattttgtagcttgtccctttccatatatataatatctatactttttacattttattatttttattttttaaatagggtcttaaactgtcacccaggctggagtgcagtggtgcaatcatagcttactgcagcctcgaactcctgggctcaagcgatcctcccatctcagcctcctgagtagctgagactacagatgtgcgccaccacaccctctaattgttaagatttttgtgcagagacaaggtctcgctatgttgcccaggctggtcttgaactcctggcctcaagtcatcctcccacttcagcctcccaaagcactcggattacaggcatgagctgctgtgtc

SEQ ID NO: 5078 - DNA, 1034 bp, Homo sapiens
ttgtaaatattttcaagtaacaagcatatgcatctctattggtttaatttatttttaccccatttagtgcttgctttgttttgattctttttttgtttttgttttttgagatggagtctcactcttgcccaggctggagtgcagtggcatgatctccactcactgcagcttccgcctcctgggttcaagcaattctctagcctcagcctcccgagtagctgagactacaggcgcgtgccaccacgcccagctaattttttgtatttttagtagagatggggtttcaacatgttagccaggatggtcttgatctcctgacctcgtgatgcgcccacctcagcctcccaaagtgctgggattataggcgtgagtcaccgcccccagccctgctttgttttgattcttatcagtgcttcaaataccaatcactgggtagtgtatgatactcttgaagtattagtgtgggctgccataacaaaataccatagactgggtggcttaaacaacagaaaattattttttatttttatttattaatttttttgagacagtctcactgtgtcgcccaggctggattgcagcggctcgatctcaggttactgcaagctctgcctcccgggttcacaccattctcctgcctcagcctcctgagcaggtgggaccacaggcgcctgccaccacgcctggctaatttttttgtattttttagttgagatggggtttcactgtgttagccaggatggtcttgatctcctgacctcgtgggattacaggtgggagccacagcgcccggcctagacatttattttaaggttctggaggctggaagtcagagatcaggttgccagtatggatgggttttggtgagggttctcttcctggcttgcagaagatatccttctctctgtgtcctcacatggtagggtgggtatgggaatcctggggtcggggagatgaggggggatttctctctcctcctcatttcataaggccattaatcctattgaattagggccctgtgcttataacttaat

SEQ ID NO: 5079 - DNA, 1063 bp, Homo sapiens
cagcctcccaagtagctgggattacaggcgggtatcaccacgcccggctaattttttgtatttttagtagagacggggtttcaccatgttagccaggatggtctccaactccggacctcgtgatccaccagcttcggcctcccaaagtgctgggattacaggcgtgagccacggtgcctggccgaaagtgggttatttttaaataaaaacaggaatagttgtctaattcaaagattgtgaactaaaaaaaagttaccgttttgggtattcagtgaagtttaatcactgtcatgtatagatgtcagtctgtcacaggtaaattatgtcttcacttgaaaattccttttctaataaaaagtaacttctgtttttcaagctcttttcttgctctgttccttatgaagtgtagagagagaggaaccacgctgatgttttccagtaacgtaaatatagaacttggtacacaggtctgaaaagtttatttaagcagtctacagtaattcttcgtaggctaattttgaataagagcaggaaagagggtcagcttttcactttggaaggtactggattatttggcaggtggttaggtagtacttagatttgcttagatacctgtaaaagtgagattggtatgggataaaacgttcttgtgctgcttgcaaaagtctttggaatattctttgggatattttggtgcttaggaagtgcttttcaggttatattaatatatgcttagtcttcatgctttcaagtcctgtgggacgttaatgttagtcttttaagttgagtcctttttggttatattaagaggtagttctgatgtttcaaaggccatccagaaataggaatgcctgaacaggaatttccaattaagtcggtcagaatcctgaacagaggatatgatgaatatattacggtataactattagtggtatctgtcagatgactttaattttaggaatagcatgatcactgtgtataatcttatacagaagagaactgaataatagtttatgttcctgaaacggtcataggcatttgagtaaaatgcagtatatagatt

SEQ ID NO: 5080 - DNA, 1372 bp, Homo sapiens
cggcgcggcgagcgcgggcctgtggagcggcggccgggcgcgcggccccggcgggcacccctcagagggcggccgaggaagctccgggaggaggagcaggaccacgaggaggtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgaggtgaggggcgcgcggggcgggggccgggcgggccattgtgccgcgggagccgcgacccccgttctcctcggaccccgccttccctctcccggcccggcgcgtctcccctggtctccggtctgttcctcccccctccgccttttgtcccttccaatttctctttctttcttggaaacctccccaacccgtgtggtttgggggtctcgcttcatcgttctctcatttttcctcaaatgctcttctttcacccaggatttcccttcctaaatttaatttgcgcctggctccctcccccaagcctttgcaagcgaaacccgggagatggggaggggttcgagaatcgaagcgtgcgtgttgctgggaaacaggtattttttcgtatatatgtaaaaatttcatgcacttttgcctccgaactctcgtgtttaattaaaaaaggaagaaaagtttgaaaggtctgaaatctctgcgggtaataaagtgcctctggtaggggtaggtgaaggagctgtgaaaggtgaaatttcacgatggtgggggaagggaaagaattgattaggttcacgtggtgggggcagtaaaagactgggataagtaagttggtaggggtgtgtaagcgggggcggggaagggatctgtttggaaaagccttttctcccctttctctgtagcagcctgtgttgcattgcagcagctgctttttccctttgctctgtactcaataaaacaggagctaaattatttttgcggccccgaagaattgaatgtactgtcgtaaaatatttttttaattgatacgatgaaacatatggtatgatatttttctttattgtttctcaaattgtgtaggagaataaaccgtgatgtggtgtgtcattcattggagattttttttccagcctttcctaaacctgttctgtgtccataaccttctcttttcggattggtgcaagacttcgtgtgaaatgggacttggtagactgaa

SEQ ID NO: 5081 - DNA, 1050 bp, Homo sapiens
ttcctgacagccgtggccaggacagagccgacctcatctgcagggttctttctggtggctgcctcccaggtgtcaggctctcttatcggtgtctgtccttggacaagttccaaacaagggagggcctcagaaggactcattacccagcgacacacctgtggctatgctggccaagcagggaacatgcaggacaggtggatgatgtcaagccctcacagccagggtctcaggaggagtatggcagggctctgtgcctggggtcagtggctggagcctgggattgggaggaaatgagactcaaaatgagactcacacagatatgttgagcatcccaggggtcccagggcagcgttctaagcccccctatataggtagacttgtttcttctacaaagtgagaaatcctcctaggatccagggctaggaagtttagtttcctctgagaactgctctcttgtgcttccttctgtgatcatgagaactgtataactgtgctttctcttttgccctggctgctaggaaattctgcaggtgtcatattttcggtcttaatgtcctaaatggatgtcggtgtttcttcatatgtcctttatggccactgtctgtgtcctgttgggagaagggcaggaggggagggatgcagtgtggaagctcatgcctgtccaggccaagcacaaatccatttgctgacagccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtgagctgctggctgggccaggctcaggggagcctgtggggtgagaagacaggtgaagcggcctgactcccaagttcatgacttcttcccatctgttttaggtctcactgctctgaaaagacacaaccagaatggcctggggctcaggcccttggctgagtgggaatgcgttgggact

SEQ ID NO: 5082 - DNA, 1056 bp, Homo sapiens
ccacccgcctcggcctcccaaagtgctgggattacaggcgtgagactctgtctcaaaaaaaaaaaaaaaaaaaaccagcttgaaaattttgtggccaggcacagtggctcacgcctgtaatcctagcattttgggaggccgaggtgggcagattgcttgagcccaggagttccagcctgggcagtctggcgaaaccccatctctacaaaagagaaaagaaaatgaaacttatcaaggaccttccacttagggaaggcctcatcatggctttatttatctcaaggaaggaagtttctgttaaagcagactgtgacaggtcatgccgtagtaagtggcatcgttgagaacaaaagtcaatctcgagctttggcctgtttttagagcaaaagaaaatgaaagcatgtgtagtgacaatatggaatgctggaaataaactcttagggggttcctttgtttttcagtctagattttttcttccggtggctctttgacaaaacttcctcggaggcctccatcaggttggagtgagtattgccaagttgagttctggagccatggccctgggtgaaagtcccacaggggctggggctgcagtgggatgggtgggggcggtcgtagcctatgcttctgaacaggcatcttcctccccagacagcagggcttggggcctcacctccaccctgccaggtttctggtagacactgtgggagctgacccactttgtgctatgcttgcagaaatgtggttaattttttaggccagaactcaattagcagctgtctcattcattgaaacttactgagcacagagtcacatggggagaaggaattgctgggtctcagtggtgccagggagtggggaaaggagaataataattaaagatggcagccaggatgcctctgggctctggggattatttttgccagaatagaattaaatttattactgatgtatccttgttagtattttaaacttataccatgccacttaatagtaatagctattgtttaagaaggcactatgctaaatgctttatgcatctttttctcactgtat

SEQ ID NO: 5083 - DNA, 1276 bp, Homo sapiens
tcccagcacttcgagaggctgaggcaggcggattgcctgagctcaggatttcaagaccaccctgggtaacatggtgaaaccctgtctctactaaaaatacaaaaaaattagctgggtgtggtggtacacgcctatagtcccagctacatgggaggctgagcaggagaattgcttgaacctgggaggcagaggttgcagtgagccgagatcacaccactgcactctagcctgggtgactgagcaagactctgtctccaaaaaaaaaaaaacagaaaaagaaaaaataaatgccatgctggagccttgtttggcctgcttgggtgctcatgccatctctttgggtaggttctggcccccagactttagctggggagccacatctgagagaataattgttccctctgagctcttggggacctaagatttggtctttctgtagttgaaggtcagtgcagagaacttgcccccaggctagtctcttggtctgcctaaatctgaccttctgacccacctaagccacgagcactgggagacaagcctcgagacctgtatcccctctcccgctgcaggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaatgtgagtaactgttctgcaaggcccctcccaggatagctggtgagaagagggcttggtgggtggggaaggagtggggacaggagtggggtgtgtgcggggaactaaaccagtgggtcatgttgctcagctcacatccttgcttttaagccctgagcaggcatggccacatttattacaaagtccttatagtaatgccatacacacacacacacacacacacacacacacacacacacacacacacacattatatgtatatatacacacacatgcatacatatatattttaatagactatctaaatactgaatggtagggatcatttgagttgaatgtggtatattcaggttggtagactatcaagcatccattcaaaattgtatagattttgtggcacccatgcagggctcctgacagaagcagggatgtaccagtgaggcatgtctatcatggacactacggggaggggccaggaaggaaggaaaaaagcttcgttgattggggtggcaggatcacaaattatttcttttacattttggttgctaatgacctt

SEQ ID NO: 5084 - DNA, 1083 bp, Homo sapiens
caggtctccatctgagggggagacaggaaacaggtgggggcctggggcctgggcatattcccaactttattctttttttttttttcttttttgagatggagtctcactgtgtcacccaggctgaagttgcagtagtgggatctcgactcactgcaacctccacctcccaggttcaagcaattctcctgcctcagcctcctgagttgctgggattataggcatgtgccaccacacttggctaatttttttttttttttagtattttttagtagagacagtttcaccgtgttggccaggctggtctcgaactcctgacctcaggtgatccacctgcctcagcctcccaaagtgctgggattacaggtgtgagccactgcgcccagccctaactttattctgaatgtgatttcttagaagcaggacagggctgtgagatgactgtatttacgtacctttcccacacacgtaacttgggcacaaatgtttctagcaacatcagatggagtgctggtattcctttacctcgagtatggtacaggggctaagacgggctctggaatttatatcatgtgagatcctgaaagttatgcaaatttcctgtgcctttatttcctcatatgtgaacaaaaatgtggggatagcgatcgaaccatctcataagagtgtggtgaggatgatatgagacacttcatgcagagccccgaggcctgttccactgctcattaagattcctctgtgtcttggccagtgatgaccagatcctggaatggtgtggggaggacgccatccactacctgtccttccagaggcacatcatcttcctgttggtggtggtcagctttttgtccctgtgtgtcatcctgcctgtcaacctctcaggggacttgctgggtaatgaccctcctcacccttgtctatgttgtaatggggcagagtggcagtcctagggaaagggctcactgtggtagaccagaaccccaggagtcatgccccacttcagatgtaagatggtctcagggtgactctgaacatttctatctgattaaagatctggagcaaacctaggctaaaactggggcccca

SEQ ID NO: 5085 - DNA, 1094 bp, Homo sapiens
tctttcacagagtgagttatattttgtcccagccatcgagggctggtagctttggttctgagctccaagaggcagcaaaatactggatgtgatctttttgacttgtttggcttttttttttttctaagaattatctgtcattttttttctttttgtgtctctagcgagtccagatttcagagattgtcatcgacttcctcctcaggtcaacaagactttgaaaatgagctggttggtatctaaggcccagttgtggtcatggccagggggtggggactggcagtcatggttttggggagggagcagggcggatcttgagcggcaagtgctggagaaagtgcttttctgcatcgacgaaggcacctgaacttgggaaataccacaggagggatggcagctggatgacccgggaccttgagactggatgaatttgcaggcaggaaggggtacggaatcccttgggcttccccagcacttctctctcttacacctatggctttgtatgacagttaattatggacttgctggctggattatgagccagatgtgggcaggagccctgccctctccagccctgtttcccagcgcctgatgcatagtaggtgtttagtcattgttgaatgaattattgaacaaatatttgtctttcctagctggataacagcccagctttaggggtattaagtttaagagatgtgaaggacaataaaacctgcagacaccctttccccctaacacccactccagcggaccgtccaatccattaggcttgtttcctctcttttgcctcacctcttggtcagtgattgtaaacaatcaaacagcagcccacatcactttgcccagagctgccctgagctttcatcagcttttgatctaagttttgtgatttgaccacgaagttgtcaggagattttagcaagagttccaggcatgtggtgtatattgtgaagtactgggctcatgcttgctgaatatgggataaaagcactgttttttatacaacaggaggttaaatggttatttaatgtcaaagacaatggttacatctgcctctcaaagacacaaatgttggaagctaatccctgttctct

SEQ ID NO: 5086 - DNA, 1115 bp, Homo sapiens
gtgctaggcattcacatacatctaggatgactgaatattgccaggggttctcagccaggcagtgccacttcaaccacagtgcctagctgctggtttggcctcctctatacagctgccagctgggtgctcccctccccctgccttctcctcagcctggcagcactgtcccatggtgtctgtgttcccagctgcctgctcagagcgtgcctgtttgtgaaaatgcagaggagctgtcccatggagagccagagggacggagctgtttcagggggatctggactttatgtgtctaatgggcagggacaggctgggactgagctgaaaggtctgagagagattgtgggtccccagagctctaccctaacctgggtgctcatcggagagggcagacaggactggccacctgaccttacctccgtctcaggctgatagtatttgctagccacctccctgagttcatatcaaactttgtcaaaccaccctgggaagcctatttggcaagagacaagtaacttagaggcatgactggggctggagggagggggaagaggagccgcaggtgtttccctccgcagaggcctctctcctctgcagcactggcgagggtatgccactcccagcaccaccacagcaccctcccctttccagggacaatgctctctctgtgagcattttatggggatgttttttctttccacttcacatttcaagccttccttgttcatgctgctgtgttcccttttcctgattctagctcttggggaaccctggggagcctccccagtagcattggcccttggggcccaggtgaagtcctttgcttggggccctaccgtgagcccacaacctccagggtttctgtgggagagggctgctcccctagacccagcaggtccctgagccattggcaaagaggagagaggctggggccacaggtggtgctggccgaggaaggaggagtagggtcgcacagaggagcactgatggatggagaaccagttctgggagtttggggagagatcaaggcaggagggagcccactgggcagaacctaaaggtccatatgggcagcatgcatacacaggtgtgtgctggagggtttccatccagacccc

SEQ ID NO: 5087 - DNA, 1025 bp, Homo sapiens
ttggcaggggttcagctgctccctgggaggccttggcatagccaggctgctccagcactgtgagctgggagtctcctcttgcagaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaaggtgcccatctcagccctgatgccccttgtgtgaggggagggttgacccacgaatggcagctaatgggtgggtgctggtgggagccgtgccctggccactcattcggctctctccctcaccctagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggacctcatcgatgccgtcacggggctcagtggcagcgggcctgcctatgtgaggccctcatttgctcgctcagccttctaggaacccaggcagcaagatgggctggcaggcaggcttggactgggggtggcgcccacctcttgggcacagctggctggtacaggatgctgacccttggagctagttctagtcatcagaaagcagacctaaggaaaggcccttcagtgcctatggcctggggcttagtgagtgtctccacaggcattcatggctctggacgcattggctgatggtggggtgaagatgggtttgccacggcgcctggcaatccaactcggggcccaggctttgctggtcagtatctttcccccgcatgttcaggaccagggtgtagaatgggggttcttgtgcatcactgaactgaggtgggagttggttgggaagctggggtagcagttgggca

SEQ ID NO: 5088 - DNA, 1050 bp, Homo sapiens
ctatggttatgtgacgtgtattttgtccactcatcacacagccttgttagccccagcctagagaagtatgtcatatccaaacccaggccaaaggatgattgggaaggaaaattgattcttctggtcagtcgttgtgaccaagcattcacacgtgtgtcctgttgagggcctgggttcttagggcctgttacgtagaagtgttcactattaatttgatggtctcatttgtccgtgcatatttgtgaaaacctaccagggacttccagagttacacgtgagcttttactgaactttcaagtaagtaagcttttaccagctataagatattaaacctgttcagttgtcaaaagaatttagtggtttccctgaatctaattttaatgttggcacttgatctagaactctgttctttccgcacctcatccgtgctttcctcggctatttcctctgcttactatttataagcttaacaaatgttaacactgcagtctagaccaaaattttaagagacttggatcgattccgtgaagaagcaatgtgtgtttgcaaataatacggtttttcactttccatgttttccttcctgctctgtaatccagtctaaaaactgtaagcacaactgtttttgaccatgaaaataattgcattctaattcctttgaaaataattcttatttcatgagtacagtgttcttttctccccctcccccacccccgacggagtttgactcccgttgcccgggctggagtgcaatggcgtgatctcggcccactgcaacctccgcctcgctgagttcaagcggttctcctgcctcagcctcccaaatagctgggattgcagtcgcccgccaccatgcctggctaatttttgtatttttagtagagacggggtttcaccacgttggccaggtcttgaactcctgacctcgggtgatccgcccacctcagcctcacaaagtgctgggattacaggcttgagccactcctcccggcctatgagtacagttttcaaacttgctgacaattgatccaaagtgaaaccagaaaaaat

SEQ ID NO: 5089 - DNA, 1061 bp, Homo sapiens
tcactctgtcgccgaggctggagtgcagtggcactgtgtcagctcactgcaacctccgtctcctgggttcaagcaattctcctgcctcagcctcccgagtagctgggtttacaggcgtccaccaccacacctggctagtttttatatttttagtagagacggggtttcaccatgttggccaggctggtcttgaactcctgacctcaggtgatctgcctacctcggcctcccaaggtgctgggattacaggcatgagccaccgcgcctggccttttccattgctattattattattcgagacagagtctcactctgtggtccaggctggaatgcagtggtgtgatcgctgctcactgcaacctccgcctcccaggttcaagcaattctcctgcctcagcctcccaagtagctggaattacaggcatgtgccaccatgcccagctaatttttttgtattttcaatagagacagggttttgccatgttggccaggctggtctcaaactcctgacctcaagtgatctgcccgccttggccaaccaaagtgctgggattattggcatgagccaccacacctgccctccattattattatttcagttatggtgatctgtaatcagtgatctttgatgttactattgtaattgtcttgggcagccacaagctgcacctgtataagatggcaaacttaactccataaatgtcctgtgtgttctgatgtccacggatcagctgttccctcatttctctttctctccttgcgcctccaattccctaagacacaatattgaaatccaggccaattaatagccccacagtgacctctaagtgttcaagttaaaggaagagttgcacgtttctcactttaaatcgaaagctagaaatgattttgcttagtgaggaaggcatgttgaaagccaagataggccaaaagttagggctcttacaccgaacagttaaccaagttgtgaaggcaaagggaaagttcttgaaggaaattaaaagtgctactccagtgagtacctgaatgttaagaaacagaacagccctcttgctgatatg

SEQ ID NO: 5090 - DNA, 1028 bp, Homo sapiens
cccaagttcaagcgattctcctacctcagcctcccgagtagctgggattacaggcacatgccaccatgcccagctaattttgtatttttagtagagacagggtttcacatgttggccaggctggtctccaactcctgacctcaggtgatccacccacctagacctcccaaagtgccaggattacaggcgtgagccaccgagcccggcccagtttaaaatattttctaatttcctttgtgatttcttccttgttacatgggttatttagaagtgtattaggctccatgtatttgaggatttcccaagtctttttctgttgttgatttctaatttaatttcattatttcatttttttttttatttaccaaggcttgttttatgtcccagaatggtgtcttttagtggatgttccatgttcacttgagtagaatgtgtagtctgctgtcattgggtggaatgttctgtaaatgtcagccaagttaagttggttggtagtgatggtaaggtttgcttgttctgtcagttaccaaaagaggagttttgaattattcaactaaattgtagatttgttcctcccccgcaccccccacttttttttggccatttttgctttatttatttcgaagttttctgttggtgtatacacgtttatgattgtatggcttcttgatgaactgacctctttattattatgtaacatatctcttcatgtctagttatattccttgttctgaagtccatttcatctggtattagtgttgccactcgtgctttcttttgattaaagttcacatgatatatcttattccatctttttatttttttattttattttattttattttatttttattttcttgagacagggttttgctctgtcccccgggctgggggacagcttagagcccaggaggtcaaggctgcggtgagttataaccggtggtgcagttataactcaccgcagccttgacctcctaggttctaagctgttcttctgccttagcctctcatgtagttgagactacagg

SEQ ID NO: 5091 - DNA, 1035 bp, Homo sapiens
cattagtacagtatttcaacatttgggtaggagaaaaagaaatgtttcaaacatcttttttgttttaaaaggctctagttgaaaaacaactctttctggccaattatttagttttactattaattaccttagtgagttaaaatagatttaaatttttccacacttttaaatgcaaaggctagcactgatttttcttattgaaaatgactaggttataaagttgtttctctacactaccatgtatgtagtgtgttccattaaatatgtggaccccacacactttaatggatctccagaggcagagccctcgcttgctcagggtggatgattgcagagcacttgtggggaagtgcgcgatcagtgtgatgtggagtcccagaatgaggttgctacatccagatgaccccactgataggcagggtgactggcataatttttttcttttgaaatctggggagacagatgaggtgaccatcttggttatttttgctgtgtgggataccataaagccagactgaagacgcattaaggagagcagttgaggtaagcacatcttggaaagtatgctaccgagtcttgaccatctatcttttggagcaggagaagcaaccggttcaaaataataaataattgctaataattcattagggcttaaagttcaacagtcaggggccgggcgcggtggctcacgcctgtaatcccaacactttgggaggccgaggcgggcagatcacgaggtcaggagattgagaccatcctggctaacacggtgaaaccccatctctactaaaaatacaaaaaattagccaggcgtggtggcgggcacctgtagtcccagctactcgggaggctgaagcaggagaatggtgtgaacctgggaggcggagcttgcagtgagccaagatcacgccactacactccagcctggctgactgagcgagactctgtctcaaaaaaataaaaataaaagttcaacagtcagtagctgtgcatgggggtgcacacctgtagtcccagctactcgggaggctgagg

SEQ ID NO: 5092 - DNA, 1049 bp, Homo sapiens
agaggattgcttgagtccaggaattcgaggctgtagtgagctatatgatcacaccactgcattccagcccgagcgacagagctaggccctccctctaaaaaaaaaaaaaaaaaattaaaaaaaataaaaagcagttagagagcaggactgtagcagattagccagggggcactactgttttctcatgtgaccttcaacaacatcagaacctgttctgtcctttctgttgcatcacagggactcattaaagtcagactgtctgcagatgtctgggaaggaaagttttttgtatgcatacaaattactgtacttacaaagagctttgtgaggccaggcacggtggcccctgcctgtaatctcagcactttgggaggccaaagcggatggattgctagagctcaggagttcaagaccagcctgggcaacatgatgaaaccctgtctctaccaaaaatacaaaaaactagctgggtgtgatggtgtgcacctgtagtcccagctacttgggaggctgaggtgggaaaattgcttgagcccaggaggtagaggttgcagtgagctgagatcaagtcacttcactccagcctgggccacagagccagaccccatctcaaaaaaaaaaaaaaaaaaaaaaaaaaaaagatggctgggcgcagtggctgacacctgtaatcccagcactttgggagcctgaggtgggtgaatcacctgaggtcaggagttcaagaccagcctggccaacatggtgaaaccccatctctactaaaagtacaaaaattagccaggcatggtggcacatgcctgtaatcccagctacttgggagactgaggcaggagaatcgcttgaacccgggaggtggagattgcagtgagctgagatcgtgccattgcactccagcctgggcgacagagccagactccgtctcaaaaaaaaaaaaaaatgaaagagctttgtgaataagaattctctgttcagaagttggttgaggtaatgtatttctcctggcttgcctattagagagcttctaaaaggtggttactgcctagtct

SEQ ID NO: 5093 - DNA, 1106 bp, Homo sapiens
aatacctccttaaacttaacgtagcttagtttaacttacttaattttcacttataaagcagttaccacctgtcaaaaaatctgagtgaagaaaagtgttacattatagttgctcagcatttcttactgcatgaaataatctttgttgtttttgccaaactctttaaattccttgaaaatgtgtattcttactaaacaaccttttctcctgagtctttggcatcagttagaagttaaaaagcactgcaagttttttgtaatcctgaagaggaggaaaagatgccaaaccagagtttattcaagataataagtggtatttttgagagatttattctctctcctctgaagcctgtttctactttagtttcacttccattttcctgcttctttgataggcagtgagatgatttttaatagcacatacactctgtcctgtttataggttgctatcatttaatgagaagaaagtcaaataggacaaaaccgcaaatctttgaaacaaaactagaaagccataatggaggctgggcatagtggctcatgcctttaatcccagcacctggggaagccaaggccataatggttgcttgaggccaggaatttgagaccagcctgggcaacatagggagaccccatctcttaaaaaagaaaaaaaaaattagctgggcatggtggtgcacgcctgtagtcccagttacttgggaggctgaggcgagaggatcactcgagctcaggagtttgaggctatagtgagctgtgatggcgccactacattccagcctgggtgacagagtgagaccctgtctcgaggaaaaaaaaagccataggccaggtgtggtggcacatgcctgtaatcccagcactttgggaggctgaggtgggtggatcacttgaggttgggagttcgagaacagcctgaccaatatggagaaaccccatctctattaaaaatacaaaattagcctggcatgttggtacacatctgtaatctcagctactcgtgaggctgaagcaggagaatcacttgaacccaggagggggaggtttcggtgagccaagattgtgccattgcactccagcctgggcaacaaaagagaaactccgtct

SEQ ID NO: 5094 - DNA, 1041 bp, Homo sapiens
atcccagcactttgggaggccgaggcgggcggatcacttgattgaggtcaggggtttgaaacgagcctggccaacatggtgaaaccgtctttactaaaaatataaagattagccaggcgtggtagcaggtgcctgtaatcccagctacttgggaggctgaggcaggagaatcgcttgaacctaggaagtggaggttgcagtgagctgagatcacgccactgcactccagcatgggtgacagagtgaaactccgtctcaaaaaaaaaaaaaagaagaagcatgtggtttatctataaaagaatatgagtatctctaaactaagcatgccaagatattttcagtatttcctctattaagacaggctttaaattaaatgctgtggacccttaatttttcactggctttatttatacttaccagggccacctgtaacatcttccagctattcttctgcctcttactgttttttatgtatttaggtacagaagccatagccaacagttaaatacctcatctatgtcagagatgacaatccatcatcttaaagcatcgtggtaaattagtgtagctctagagccaaactgcctggatttgcatcaggctgtagcatctgctagcagtatagtcttgggcaagttactgaaccctctgtcagagggttgttgtgaggactaaatgggttagtatgtgtgagtactttcaacactgcatggcacatagtaagggcacaataaatgttaataattatgatggtggtcatgatgatgatgatcatatgcttatcttccatcccgaattttcctggaaaatcctaagtaaaaaattagaggccaggcttattttcttaaatctttcttctggacccagaacacatactaattggtgtacattactagcttagttgtttttaagagttacagactgtaaaagtaagtaataaggacattttattttgtcatgaacaatctcctgtagccagactagtatatatatttttaatgtttttaggcagcagataatggcagctttaaactcccagac

SEQ ID NO: 5095 - DNA, 1091 bp, Homo sapiens
ttctctgttgtagttgtgaattagaattatagttacaccttatttttctagtggctatattttcatcaattttgactatctaaaattttaggtgatgaaaatgatgctacaaaaccaatttttcttcaggttatgttatactttttttttttttttttttttttttttaagatggagtcttgctctgttgctattgctcaggccggagtgcagtgacacaatcctctgcctcctgggttcaagcagttctcctgcctcagcctcccgagtagctgggagagggattacaggtgcctgccaccaacccagctaatttttgtgtttttagtagagatgaggttttactatgttggccaggctggtctcaaactcctgacctcaggtgatccacccgcctggtcctcccaaagtgctgggattacaggcatgagccaccttgcccagccgatgttattctttaaaaacaattgattctctggtttcctaccttaacctggattagaaataacagattagaagagaaaatagcttgataattagggacataatagaaagcatgaaaaatagacacgagaattataaaagcatggcagtcaggggtcatttaatatgaaggtaaacttctccattacaatagtatgatgtacaatttttatgtttacagctgtaacccctgagttatcaagagatggaacattagatatgatttattcctatttaagataataggaaattgcttgattacattttcagaagatatttatccaaagaaatttttttttttaatctaaaggaaaggttttgattcttatgagaaaagaatgagatttctttaactggaaaattgatttatgtcctacagtccattgtgtagtgatgttggatcaatcaggtatcgctagggtgtctgtagaagtatctatatattgctttttaagttcttattttaatgatatatatgcatatttctcttaagcattgtcaaaagttactactcaacatatagagctgcgttttcgttttaaaaatatacttttgtcatgggataaagtccacatagaattattttaaagtgtttaagagtagacttc

SEQ ID NO: 5096 - DNA, 1049 bp, Homo sapiens
cactctgggaggctgaggcaggcggatctacgagttcaggagatggagaccatcctggctaatgcggtgaaacccgtctctacttaaaaaaaaaaaaaaagccaagagtggtggtggccacctgtagtcccagctacttgggaggctgaggcaggagaatggcgtaaacctgggaggtggagcttgcagtgagctgagatcacaccactgcactccagcatcaactgggaccacttgaacccgtcccggttcaagcgacaaaagcaagactccgtctaaaaaaaaaaaaaaaaaaaacagctacatgggaatttgttcctctgccgcattgtgcagtgactggtttcacccagtactttgatgtgagaataagcactttcctcatatcaggaatattgtgggtgtttcctgttactcacggctgaatgtaatcttcggtacattaccaattatgtttgattgtatgtgattaaaaataatgtgcacattttttcctcaaagttgctggacatgtttcttcgaaagcagttaataaacaatttctaacaatttatctactaacaaatactgtttttttaaatttactgagaagaaatattaaaatatctcattgacagtcatggatcagataaactttataattagccttataattttgctgattatttgacattgtgagtcagtattcacaaaagttgaggcatttttttcttcatgtatattttacttttcatattcatatagtcacagtttttatgataataatttctcattcactcataataccaaaagttaaatcgtgcttttctgagtgccctcttgccaaagaccaccaggatcacaactattgttaaagaaggtgtaaaaaattgtagtaataaatatgaccacaagcaaagcaaacaaaaaccacacacacactgttaccgttctgtaggttagagataggtcctgttggggtaaaatcaaggtgtcagcagggctttgtttcttctggagagcacctgaaagcttttttttttttttttttttgagacggagtctcgctc
